United States Patent 10,760,091 (GENES AND USES FOR PLANT ENHANCEMENT) - sequence listing, part 12

SEQ ID NO: 49022 - protein, 520 aa, Arabidopsis thaliana
MDFVSRDRISSLPNPVVSHILSFLPTKEAASTSVLSKKWRYLFAYVTNLDFDDSDYQDGKPKSDVELSRSFMEFVDRVLALQGNGSVNKFSLECSNYDVDLARVTGWILNVLGRGVSELDLSILEYPLPSEIFVSKTLVRLKLGPANDLTLTLDRKDVFLPKLKTLYIDCVDVQERGFGFVKLLSGCPVLEELVLMNIGWENWKFCSVSVKTLKRLTFFCEETYENPKSVSFDTPNLVYLEYSDAIASKYPKVNFNSLVEAHIGLRLTEDQSGDADFSEEDYFSEGDEKKQMVGNATDFLKGISTVQILYLSAQAIEVLTFCCEPIPVFNNLIQLTIENNSEIRWDSLPGLLKNCPNLETLVLKRLLHKYNKACGNVCCCKRPKQPSCLSSSPVKVLKIFLFDDNDEEDGSEMRQIKYFLEKMPRLEELVVYYNTAYDPAVLELSKKLQKIPKIASPKCKIQVISENLSLSSTVPSFLTTRWSSLPPEEAYPWVDSPPPQIIDPMLEYGSPPEDDDSWLY

SEQ ID NO: 49023 - protein, 189 aa, Triticum aestivum
WASSATSVVLFQGLKSTAGLPVSRRSTGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKASTAHSRQAIYKVPLQFCQL

SEQ ID NO: 49024 - protein, 137 aa, Triticum aestivum
MARTKQTARKSTGGKAPRKQLATSIAARKSAPTTGGVKKPHRYRPGTVALREIRKYQKSTDLLIRKLPFQRLVREIAQDFKTDLRFQSHAVLALQEAAEAYLVGLFEDTNLCAIHAKRVTIMPKDIQLARRIRGERA

SEQ ID NO: 49025 - protein, 271 aa, Pseudomonas putida
MSDVIYQNYIANAFVDSDAQIEVHNPANGQLLGRVPQASDAQVEQAIAAARKAQKGWATRPAIERAGYLRKIASKVRDNAERLARIITAEQGKVLGLALVEVNFTADYLDYMAEWARRLEGEVLTSDRAGESIFLLRKPLGVVAGILPWNFPFFLIARKMAPALLTGNTIVIKPSEETPINCFEFARLVAETDLPSGVFNVVCGTGATVGQRLTSHAGIDLISFTGSVGTGSRIMAAAAPNITKLNLELGGKAPAIVLADADLELAVKSIP

SEQ ID NO: 49026 - protein, 1551 aa, Candida albicans SC5314
MSIEKVPILGKETIHVGYGIADHIVREVIANLASSTYVIVTDTNMARTPQYSKLTDDFKTNLSEKRPESRLLTYCVSPGENNKNRATKAAVEDFLLQQGCTRDTVILAVGGGVIGDMIGFVAATFMRGVRVVQVPTTLLAMVDSSVGGKTAIDTPLGKNFIGAFHQPEYVFCDVSFLETLPARQFINGMAEVVKTAAIWNEEEFTRLENFSKKFLSVVTSKKPDLQSIKAELVKTVLESVRVKAGVVSSDEKEAGLRNLLNFGHTIGHAIEAVLTPEALHGECVSIGMIKEAELSRYLGILPPVAVARLSKCLVAYGLPVSIDDKEFLKKVGPKRHYVEIDILLKKMAIDKKNDGSKIRCVLLEKIGKCYQLKAHQVSKQDLSFVLTDEVLVHPFTNPPKENIIVPPGSKSISNRALILAALGNGTVRVKNLLHSDDTKHMLDAVASLKGAEISTEDNGETIVVKGNGGNLVTSGEELYLGNAGTASRFLTTVASLVGKSQASDDVILTGNARMQERPIGPLVDALGSNGSEIEYLNKQGSLPLKISAGNGLKGGRIELAATISSQYVSSILMCAPYAKEPVTLALVGGKPISQLYIDMTCAMMKSFGIEVTKSTTEEYTYHIPKGTYKNPSEYVIESDASSATYPLAFAAMTGTSCTIPNIGSSSLQGDAKFAVDVLKPMGCKVEQTTTSTTVTGPPRGHLKPLPHVDMEPMTDAFLTASVVAAVAKGGSSTSITGIANQRVKECNRIEAMVTELAKFGVPANELPDGIEIHGIDIEDLKTPEISKRGVSSYDDHRVGMSFSLLAGLCKEPVLILERSTTGKTWPGWWDILHSKFKIELDGYEPPFNTDKHVDKSSDKSIIVIGMRGTGKSTLSEWLASFLGFKMLDMDKYLEEKLGTGIKSLIKAKGWEYFRQEEAIVAKECFTKFSKGYVLSTGGGIVEGEDARQQLKSYADNGGIVLHLHRDLDETVTFLAADTTRPAYSSEVQEVWLRREKWYHECSNYHFYSSHCSTEDEFNHLRRSFVNYIKLITGAERPVVPVGRSAAVVLTSPDLNEVVRDLESITIGADAVELRVDLFKDTSAEFVAAQIAVIRKHADLPIIYTVRTMSQGGKFPDENVDELKSLLLLGIRLGVAYVDLQLTAPNELIEEISSKKGFTRVIGTYQDINGELKWNNVEWKNKYNQGVSMNADIVRLVGKANSIQDNLDLENFKKQNTLKPLIAFNLGSQGKLSQVLNGTFTPISHKLLPNDEEFLTIGELNQTYFDIGGFTAKKFWVIGSPIEHSRSPNLHNAGYKALNLPYQFGRFEATDVDVVYDNLINKPDFGGLAITMPLKLDIMKFATKLSDAAETIGAVNTLIPIEGGYFGDNTDWVGISNSFIRAGVPPKSSSNGLVVGAGGTSRAAIYALHQMGCAKIYLVNRTAAKLEELVKSFPKDYNLEIVETEQQADKASKVSLAVSCIPADKPLDGEVLKKIERILSNGSEQSAGFKPTLLEASYKPRVTPIMKLTEEQYKWKVIPGVEMLVNQGDRQFKLHTGFTAPYEIIHRAVVEE

SEQ ID NO: 49027 - protein, 544 aa, Oryza sativa (japonica cultivar-group)
MGSASASSLPASAGFGENLVLILDFGSQYTHLITRRVRQLGVLSLCVSGTAPLASLAGLRPRAVVLSGGPHSVHASGAPTFPEGFLEFAAGAGAHVLGVCYGMQLLVQSLGGAVEAGEKQEYGKMEVEVTARSSALYGEGEVGKRQTVWMSHGDEVVRLPEGFEVVARSVQGAVAAVENREKRFYGLQYHPEVTHSPQGMETLRRFLFDVCGIKADWKMQDVLDEEIRTIQSMVGPDEHVICALSGGVDSTVAATLVHKAIGDRLHCVFVDNGLLRYNERERVMLTFESDLHLPVTCVDASEQFLSKLKGVKDPEMKRKIIGREFIAVFDDFAHKLEQKIGKRPGYLVQGTLYPDVIESCPPPGSGRTHSHTIKSHHNVGGLPKDMKLKLIEPLKLLFKDEVRKLGSILNVPESFLKRHPFPGPGLAVRVLGDVTEGNALEVLRQVDEIFVQAIKDAGLYDIIWQAFAVFLPVQTVGVQGDQRTHSNAVALRAITSEDGMTADWYYFEREFLVDVVNKICNNVRGVNRVVQDITQKPPATVEWE

SEQ ID NO: 49028 - protein, 263 aa, Oryza sativa (indica cultivar-group)
MGNATAAAAVACSSQSCTTRSSPYRCALLKRKRSCIRACSSEDGSDASSSLGGDKRQQEVLAKIAMLQAQKVRITSFLDERSAYLTKFAKDADTEFDLIGQNAMKELDEVGDQIMERLDSKMQAFEETAEVQRQEIEMNERVLEDFEDWIEKEKNEGMFFKSLGKVKPRNKKELTVKPIPKLEAQKVKDIAKESAGSKTRMNIYLGLMAILGLTIANAVFATPEVEWRKVAALGLIFIGLVAQVIYEQDISSPEAEKKGGKEE

SEQ ID NO: 49029 - protein, 355 aa, Cochliobolus heterostrophus
MAEFVRAQIFGTTFEITSRYTDLQPVGMGAFGLVCSAKDQLTNQAVAVKKIMKPFSTPVLSKRTYRELKLLKHLRHENIISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVIQTICSENTLRFVQSLPKRERQPLANKFKNAEPDAVDLLENMLVFDPRKRVRAEQALAHPYLAPYHDPTDEPVADEKFDWSFNDADLPVDTWKIMMYSEILDYHNVDAAVPEQENNGS

SEQ ID NO: 49030 - protein, 659 aa, Aspergillus oryzae
MASNNFPSSLHDEYPQRADLRQMMGQRPLPTIPAGTIDPASMAGDEPVKQARAVLDRLSAALAVDDAIALESCFFASQAYWKDQLALTYHLRTFSGPSVIAAGLLETKNLREIAGGFAVDGGAVFLPATPTLQFIDCGIIFRTGSPGATCKGKVVLLPVKNRDETIEWKIWVLSTFLESLDLQQEDEALLHSPGRELDGLATFDTDVFIIGGGNAAVTVAARLKALGVESVMAERNPRPGDNWASRYDCMRFHIPTSFCDLPYMSYDEELRAPHLLTRDELASQVRRYVETFKLNMITSAQILSTKYDPSTRLWEVKIKTPAGQQTAHSKHLVLATGISSQEPYLPGVADSDFYQGTSLHSAQYRNAKQLAETGAKSVLVVGSANTAFDVLEDCHAAGLKTTMVVRSPTYIVPVEYLCDNHSLGAYDMGVEIADRLFLTLPSYVDAQLARGLMTQFAAQEPHRYDALAAAGFPVIDSRDPDMALMHNLLERAGGHYVDVGGTKLLADGKAGVKAGVEPIAYTATGLRFSDGTSVDADAVVWCTGFADKDVRDNAFRILGGQSCSREADNGTTHKLGAREIAGRLDATWGLDAEGEVRGLWKRQSRLDNIWVAGGYTQQHRWHSRTIALQIKASLEGVLPPAYMNTPRPVRGSPQKCTLL

SEQ ID NO: 49031 - protein, 472 aa, Oryza sativa (indica cultivar-group)
MARKLPLQQRLVLDIEYDKFIRTTDRKHEAVVNDFYSRVLDSGDIYRADYEGLYCVSCEEYKDEKELGENKCCPVHLKPCVPRKEDNYFFALSKYQHQLEDLLTKNPNFVRPSHRLNEVQGWVKSGLRDFSISRASVEWGIPVPNDTKQTIYVWFDALLGYISALLDDGEKASLQQAVERGWPASLHLIGKDILRFHAVYWPAMLMSAGISVPDAVFGHGFLTKDGMKMGKSLGNTLEPKDLVNRFGVDAVRYFFLREVEFGNDGDYSEERFINIVNAHLANTIGNLLNRTLGLLKKNCKSTLAFDSIAAADGISLKDNVENLVDKAKDQFENLLLSSACETLMEIGNLGNLYIDEQAPWSCFKQGGESAEKAAKDLVIILETMRIIAIALSPITPSLSLRIYTQLGFTEDQFRTLRWEDTKWGGLKAGQVMMEPKPVFARIETETDEKDQSSSKATKGGKKKARSQGLVEA

SEQ ID NO: 49032 - protein, 545 aa, Prochlorococcus marinus subsp. pastoris str. CCMP1986
MTEVNVINIKNPFLDQKPGTSGLRKSTLKFKEEHYLEIFIEAIFKSLNNLSGSTLVVGGDGRYGNIEAIEKIIQICVAHKVGKVIIPKNGLLSTPATSHLIRKEEAIGGIILSASHNPGGIDGDFGVKLNTANGGPAPESITDQIFQCSQSLKSYKISNIKIPDLDKFGVFSLGETSLEIIDGLKDYSDLMENIFDFDQISDFLKNDFSLIFDAMNAVTGPYAKNIFVEKMGLVDACVMNGTPLEDFGGLHPDPNLTYASKLADLLLVQKAYSFGAACDGDGDRNMILGQGCFVNPSDSLAVITANTNCVPGYKDGIAGVARSMPTSSAVDFVARALNIPCFETPTGWKFFGNLLDSNLITICGEESFGTGSNHVREKDGLWAVLYWLQILAVKNCSVSELIQNHWKQYGRNYYSRHDYEAIPSTIANQIFNNLSSMLPSLKDNKFAGNLVKQADNFSYLDPVDNSVSKNQGLRIILEDNSRVIIRLSGTGTKGSTLRLYFEKFANSQHNLDLNPQIALKDLINDLDHLLNISKLTKMEKPTVIT

SEQ ID NO: 49033 - protein, 396 aa, Arabidopsis thaliana
MASVTFSVPKGFTEFSGLRSSSASLPFGKKLSSDEFVSIVSFQTSAMGSSGGYRKGVTEAKLKVAINGFGRIGRNFLRCWHGRKDSPLDIIAINDTGGVKQASHLLKYDSTLGIFDADVKPSGETAISVDGKIIQVVSNRNPSLLPWKELGIDIVIEGTGVFVDREGAGKHIEAGAKKVIITAPGKGDIPTYVVGVNADAYSHDEPIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDSAEKELKGILDVCDEPLVSVDFRCSDFSTTIDSSLTMVMGDDMVKVIAWYDNEWGYSQRVVDLADIVANNWK

SEQ ID NO: 49034 - protein, 90 aa, Chlamydomonas reinhardtii
ADLALGAQVFNGNCAACHMGGRNSVMPEKTLDKAALEQYLDGGFKVESIIYQVENGKGAMPAWADRLSEEEIQAVAEYVFKQATDAAWKY

SEQ ID NO: 49035 - protein, 473 aa, Prochlorococcus marinus str. MIT 9303
MGKSPQDVLRQIKDEGIELIDLKFTDLHGKWQHLTVCSDLIDEEAFTNGLAFDGSSIRGWKAINESDMDMVPDASTAWIDPFYRHKTLSLICSIREPRSGEPYARCPRALAQKALGYLAGTGLADTAYFGPEPEFFIFDDVRYNSGEGGCFYSVDTIEAPWNSGRIEEGGNLAYKIQLKEGYFPVPPNDTAQDIRSEMLLLMGQLGIPMEKHHHEVAGAGQHELGMKYAELIEAADNVMIYKYIVRNVARKYGKTATFMPKPVFNDNGTGMHVHQSLFKGGQPLFFGEGTYANLSQTARWYIGGILKHAPSFLAFTNPTTNSYKRLVPGFEAPVNLVYSQGNRSAAVRIPLTGPNPKAKRLEFRPGDALANPYLAFSAMMMAGVDGIKNQIDPGDGFDEDLFELPAERLASIPTVPASLNGSLEALNADKNYLMEGGVFTEDFINNWIDIKYEEVQQLRQRPHPHEFTMYYDA

SEQ ID NO: 49036 - protein, 411 aa, Pseudomonas aeruginosa PAO1
MAESRPARRFARIDRLPPYVFNITAELKMAARRRGEDIIDLSMGNPDGPTPPHIVEKLCTVAQREDTHGYSTSRGIPRLRRAISHWYRDRYDVQIDPESEAIVTIGSKEGLAHLMLATLDHGDTILVPNPSYPIHIYGAVIAGAQVRSVPLVPGIDFFNELERAIRESIPKPRMMILGFPSNPTAQCVELDFFERVVALAKQYDVMVVHDLAYADIVYDGWKAPSIMQVPGAKDIAVEFFTLSKSYNMAGWRIGFMVGNPELVSALARIKSYHDYGTFTPLQVAAIAALEGDQQCVRDIARQYQQRRDVLVKGLREAGWMVENPKASMYVWAKIPEPYAHLGSLEFAKKLLQDAKVSVSPGIGFGDYGDDHVRFALIENRDRLRQAVRGIKAMFRADGLLSPQRKVDSLAE

SEQ ID NO: 49037 - protein, 570 aa, Escherichia coli O157:H7 EDL933
MSEKHPGPLVVEGKLTDAERMKLESNYLRGTIAEDLNDGLTGGFKGDNFLLIRFHGMYQQDDRDIRAERAEQKLEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPGRPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRIGTRIPRMYKENITEPEILASLDELIGRWAKEREAGEGFGDFTVRAGIIRPVLDPARDLWD

SEQ ID NO: 49038 - protein, 480 aa, Arabidopsis thaliana
MQISSSSFITKFTNLHMVRSTSDHHQWRHNYNLKQLFIPNLSVSNSQHLPLNQSVAAIVFGGGSDSELYPLTKTRSKGAIPIAANYRLIDAVISNCINSGITKIYAITQFNSTSLNSHLSKAYSGFGLGKDRFVEVIAAYQSLEDQGWFQGTADAIRRCLWVFEEFPVTEFLVLPGHHLYKMDYKMLIEDHRRSRADITIVGLSSVTDHDFGFGFMEVDSTNAVTRFTIKGQQDLISVANRTATRSDGTSSCSVPSAGIYVIGREQMVKLLRECLIKSKDLASEIIPGAISEGMKVKAHMFDGYWEDVRSIGAYYRANMESIKRCRLDLKFYDRQCPLYTMPRCLPPSSMSVAVITNSIIGDGCILDKCVIRGSVVGMRTRIADEVIVEDSIIVGSDIYEMEEDVRRKGKEKKIEIRIGIGEKSRIRRAIVDKNARIGKNVMIINRDNVEEGNREAQGYVIREGIIIILRNAVIPNDSIL

SEQ ID NO: 49039 - protein, 430 aa, Xanthomonas axonopodis pv. citri str. 306
MTSLPSQAPLHLVVVGGGFAGLWATRALDDPGIRITLVDRQNHHLFQPLLYQVATAGLSAPDIAAPLRHILREQRNVEVLLGDVTDIAPSRREVVLADGGTLGYDMLLLATGATHAYFGNDQWAEHAPGLKTLYDALVLRRKLLLAFERAEAESDPAARAAWLSFAVVGGGPTGVELAGTLAEIARHTLKNEFRHIDPRQARVRLVEAGPRVLPSFPEDLTAKARKQLERLGVEVHTGTPVTQIDALGYQLGDTFVPARTVVWAAGVAASPLARTLGVPLDRAGRVLVEADLSVPGHPEIFVGGDLASVQQDGRPVPGVAPAAKQMGKHIAKAIRARQRGQTAPAFRYQDYGNLATIGRMAAIVHVGKLKLSGVVAWWFWLAAHVYFLIGFRNRFVVLVNWAMAYWSYQRAARIIFGGATDDPPPSSKDG

SEQ ID NO: 49040 - protein, 510 aa, Antithamnion sp.
MNNKSISPIILMILDGWGHSTNAKGNAIHEANTPIIDKLWDNYPKTLLSASGEHVGLPHKQMGNSEVGHTTIGAGRIINQDLVKISKSIKNKEFFNNYQLHNIYKYSCEKNSKVHIVGLCSNGGVHSHINHLKALIQISKQYKVMTCLHLITDGRDTLPKQAKLFVKEIIDIIDENYNTEICTISGRYYSMDRDCRWSRTEKAYKAMVENSCNQNSSSDILSIIDKYYEQNISDEFLPPTKISMHNIVHNDSLIFFNFRPDRIRQLLHSFAKPNFKGFQRKTIKNLMLTTFTEYDSTLSIPTVFPNEPKKNFLGQIISNSGLKQLRLAETEKYAHVTYFFNGGIEEPFPGENRELIASPKVETYDLPPEMSAYQLTNSLIEAINKQLYQFIVINYANPDMIGHTGNMNATIEAIEIVDQCIEKVLHTIEDTNNILIITSDHGNADYMLTDENKPCTSHSINPVPFILINNRQKKQTNLHSHGSLADIAPTILDILNINIPNEMNGKSLIT

SEQ ID NO: 49041 - protein, 547 aa, Oryza sativa (japonica cultivar-group)
MDPNRRAGGARAPWASRGPDRAGQPRRHHAAALLACHGDAAGVEALLRGGVDVNSINLDGRTALHIASCEGHPDVVRVLLTWKANIDARDRWGSTAVADAKCYGHTEVYNLLKARGAKIPRNRRTPMMVSNPGDVPEYELNPSELQFKKGDEVVKGVYQVAKWNGTKVHVKILDRECYCDQEVINSFRHELTVLEKVRHPNVVQFVGAVTQNIPMMIISEYLPNGDLSSCIPRKGKLHGQKVLKYGLEIARGMTYLHQCKPDPIIHCDLKPKNIFLDSGGQLKIAGFGLTRLSKISPGRVKLADHESMVDSFSHYTAPELYRNEIFDASVDAFSFGFILYEMVEGTHTVHGKSSEESGHTIRYDGMRPSLKNKLRGYPPDFKALIEECWDTQGNDTCGLSCMNAFLCTYHCEANASLSVKKKPELALTRLEEDDTTYRQICAGAAAVRAMEEGRGGDPPSSSSSAAAAAGVAIGYPFLEPQQGARLRRRRTISPFKKYFSRGFAIGMEIAFIVFGTIVHFPVWARIFLIISLSILPFSAFSITFQEY

SEQ ID NO: 49042 - protein, 179 aa, Pseudomonas putida KT2440
MNSPLSAIVVMGVAGCGKSCIGAAIAARSGGRLIEGDAFHPAENIRKMSAGIPLDDSDRAGWLVRLGEELQATTQAGERPILTCSALKRRYRDTLRDAMPGLVFVFLELSPAEAEKRVLARPGHFMPASLIDSQFAALESPRGEPLTLALDATQPIEALAEAVDHWLKHCGEPGLAQTA

SEQ ID NO: 49043 - protein, 504 aa, Arabidopsis thaliana
MDDICCKDIISDLPEALICHLLSFVPTKEAALTSLLSEKWRYLFAFAPILDFDDSVWMQSPLVYMNEVHRKFMDFVDRVLGLQGNSTLVRFSLNCRNGIDRECIFRWISNVIERGVSDLDLGGNFVSNRSMPSSVFVSKSLVKLRIRTENCTIIDLEDVFLPKLKTLDLSSIWFRDGDTCLLKLISGCQVLEDLTMSDLWWDGYWNRSMSSKTLKRLTVHCSDWDRSPGSISFDTPNLVYFEYFDLVADKYEVVNFDSLVEASIGLRMRHHQRAHASYGDLVVNATNLFMGISNVRILQLFSNALEVLTFCCAPIPVFKKLIHLTVETDKDVGWESLPALLKNCPNLETLVFKGLHHRSTSKCQDTDGCLCKSSKDIRSCLSSSPVKVLKILKFGEVASYFGDEEKQLELVKYFLETMPNLEQMILHYNTRISEGVKSQLDWLVPRVSSSKCSVQLICDNAPTYPFYGGIICDNFITPAPTYPFFGDPLHGMVIPYMGDQPHFI

SEQ ID NO: 49044 - protein, 399 aa, Oceanobacter sp. RED65
MTLLDFFANGLSQASGWQILGYTLLTTHISIVAVTVYLHRAMAHRAMDMHPALAHFFRFWAWLTTATITKEWVSVHRKHHAKCETEDDPHSPVVKGLKTVLLTGAELYKKEASNEETTNRYGKGCPDDWLENNLYQKYKFLGIFTLLAINIALFGAIGITVWAIQMLWMPFHAAGVINGLGHWFGYRNFECSDAATNISPIGIWIGGEELHNNHHTYPNSAKLSVKPWEFDIGWGYIRVFEKLGLVKNVRRGPVVHVDKSKLMLDKDSVLAAANNRFQIMAKYRKRVIKPVVAEQRQAACETTQPLMKRAKKLLTREQSLLSAKHQQQLQTLLEHNEMMEKLYEMKEQLQQVWKKRTSNSEELIKAMEDWCKRAEESGIQALQDFADSLKYYSTGKAAR

SEQ ID NO: 49045 - protein, 425 aa, Arabidopsis thaliana
MDIGPKDKISNLPEALICHILSFLPIEDSALTSVLSKRWRYLFAFRPNLVFDDSVCLRPPCGHGVIPDYVTSWILNVLERGVLDLDLQVNVNGVRLPSKVFVSKSLVRLRIESGNVRGIDVDDVFLPKLKSLYLHTIMLGKGEDCFEKLTSGCHVLEELVLNNVYSNVWNRSVSSKTLKRLTLWCTESYDKNPHSVLFDTPNLVYLKYSDYVAAKYPKVNFSSLVDATIGLAMTSDQDANASYDALVGNATDFLMGICNVQILCLSANSLAVLTFCCESIPVFNNLIQLTIKTNQSVGWESLPALLKNCPILETLVFEGLLHMYTIKCGDVDGCLCKYSGEVPSCLSSSPVKVLKILRFGEYGIVNQIEMIKIFLETMPHLEQLTVYYNTPIGGDLIEEVSSQLKNFAREASPNCEIQVIPDVLS

SEQ ID NO: 49046 - protein, 473 aa, Oryza sativa (japonica cultivar-group)
MGNWHNKQHMGISKIIRRQFIGVRMGKNNVYFFRGCGSPCARSPTLESPGDIYAMWALRPERSWGPRGLTQRVLGGGFAAAWVAVGGPRGGECWGPLVLVVLLKHVIVFSKKYSLRTKIYGGVLNSEIDLRSTIFAYRKRQGGCCWWGCNGGEERAGGELRGDADRLRADGGGGVAGGGAGVRQGARGGAGERGHRGGAARRRGRVRRQAGGRRVRAGCSRPSSATTASTTAGSCSTPGARTALAFVTLRADGEREFMFYRNPSADMLLTHAELNVELIKRAAVFHYGSISLIAEPCRSAHLRAMEIAKEAGALLSYDPNLREALWPSREEARTKILSIWDQADIVKVSEVELEFLTGIDSVEDDVVMKLWRPTMKLLLVTLGDQGCKYYARDFRGAVPSYKVQQVDTTGAGDAFVGALLRRIVQDPSSLQDQKKLEEAIKFANACGAITATKKGAIPSLPTEVEVLKLMESA

SEQ ID NO: 49047 - protein, 301 aa, Salmonella typhimurium LT2
MTQITKFHGVFPPVPTIVNAQGELDKVGMATLLDHLIASKVNGVLLLGSGGEFCHMTNALRLETAEFCVRHINRRIPVLLGISSTSTQEVIEYGQHADRLEVDAVLVLNPYYARLTDEYIYHHFKTVANNIKSPVILYNFPALTGQDLSVDLITRLAQDHPNIIGIKDTVDNISHIREIINNVRPVRPDFVIFSGYDEYMMDTLILGGNGGIPATANFAPQLTCGIYRAWCEKEYETMFGLQRRLSALSTIYSLDSPFFGIIKKAIQLSGVDISTHVMPPVLPANEEHISNLKQILQRAGL

SEQ ID NO: 49048 - protein, 292 aa, Vibrio vulnificus CMCP6
MLSGSIVALLTPFKADGEVDFDGLQKLVEYHIAAGTNGIVAVGTTGESSTLTVEEHVKVVNKTVEFVNGRIPVIAGTGANATHESVTFSRLLNDSGIDACLSVTPYYNKPTQEGLFQHYKAIAEVSNVPQILYNVPGRTAVDLLPEPVARLAELENIVALKDATGDLNRVAIHRELCGEDFILLSGDDATGLDFVKLGGQGVISVTNNIAAKDMADMFRLALEGRFEEAEVINQRLMPLHKNLFIESSPIPVKWAATQLGLIECGHLRLPLTELSEKCHPIVAQAMTDAGIY

SEQ ID NO: 49049 - protein, 390 aa, Pseudomonas aeruginosa PAO1
MATSYSARSRAIEPFHVMALLARANELQAAGHDVIHLEIGEPDFTTAEPIVEAGRAALAAGHTRYTAARGLPALREAIAKFYGERYGVDLDPQRVLVTPGGSGALLLASSLLVDPGRHWLLADPGYPCNRHFLRLVEGAAQLVPVGPDSRYQLTPDLIERHWDSDSVGALVATPANPTGTLLDRDELAGLSGALKARGGHLVVDEIYHGLTYGVDAASVLEVDDDAFVLNSFSKYFGMTGWRLGWLVAPTAAVPELEKLAQNLYISAPSMAQQAALACFEPTTIAILEERREEFARRRDFLLPALRELGFGIAVEPEGAFYLYADISAFGGDAYAFCKHFIETEHVAFTPGLDFGRHQAGHHVRFAYTQNLPRLQEAVERIARGLKNWRP

SEQ ID NO: 49050 - protein, 553 aa, Clostridium perfringens str. 13
MAVGAPFLYRYSLYNCAYVILNGKVLGIVPKSYIPNYSEFYEKRWFTEGFNIKGLNVDLDFQKEVPFGTDLIFSFKNLKVGFEICEDLWVTIPPSSNLALMGANLICNLSASNELVSKSSYRKSLVQNQSARTMCSYIYSSAGVHESTTDLLFSGHMIIAENGTIIKENNRFKRENDLLTGIVDLFKLDAERIKNISFRNSTFNENNEPRFIPFNLENTEIKNFDREIDKHPFLPKSQYAMEARCEEILNIQAAALAKRLEHTNLKKAVIGISGGLDSTLALLVVVKTFDMLNIPRENIITITMPGFGTTDRTYNNAVTLCKELHCDFREINIVNAALQHFEDIGHDKDIHDVTYENVQARERTQILMDLANKEGGLLIGTGDLSELALGWCTYNGDHMSMYSVNCSIPKTLVRFLVNYFANHEISNDAKEALLDILDTPVSPELLPKDKEGKIAQKTEDIVGPYELHDFFLYHFIKHGSSPERILFLAKEAFKNDYDEETLKKWLDKFIRRFFTQQFKRSALPDGPKVGSISLSPRGDWRMPSDAVYNDFLI

SEQ ID NO: 49051 - protein, 688 aa, Oryza sativa (japonica cultivar-group)
MSARKEAKGSAGGDRIGALPDEVLHRVLSFLPAQDAVRTCVLAPRWRHLWKSATGLRVGEDESNLGSVKEQQEFLDHLLVLRDSAPLETCVLRFNWYDDDDFEDIFRLNVWFRYAIHRKVRFLRLDVWQEEEFGNPVPIDEQPIVSQHLTRLQLYGIVLNDGLLDFSSCPSLEHLVFESCVFECAKISSNSVKHLSITFSNFPAGTSRVRIDIPSLVSLRLDRIYDRKPVLERMPSLVDAFVSVPSSSEDFCGESDSGDCGRDGCESCYGFTNKNCVLLEGLSEAKMLVLINEDESFIFKRDLKWCPTFSKLKTLILNGYWCVPDDSHMLARILEHSPALEKLVFQLGYQAYKRTNKIKGILNPMERSAGISEHLQIVEVQCNAIDGQVLKVLKYLSTFKIYSLFEHKNRVAHLSGSISSLPLPIVFLRSGDSSVHPHTYSCRRAVASREAADGDPERPLLLVSPRYLRSLCRLSGFLASCIAVGRAHAHAHNLFDGMRQRKKAKRAPCSTGVDRIGALPDEVLHRVLSFLLAPPLEVRHEAAHRRRSTLGSIKERRRFIENLLLLRDSAPLGTFVLRFRECEGIDDIARLNLWYQACSAPQGYNFTVQKLNDIFLNFSSCPALEHLVFDYCILECAKISSSSVKLLSITDSNFSETLRVCISISRALFLCGWMTYVTGHQCLRGCQH

SEQ ID NO: 49052 - protein, 194 aa, Magnetospirillum magnetotacticum MS-1
  misc_feature (2)..(2): Xaa can be any naturally occurring amino acid
MXRGAGRRFRFASSLPALLAAGEVDTSIDKAALHHYMSWHAGVPAPLTILAGVRKLHPATTVTFEPDGSRKEETYWSLVVGPRAEDRFMTEGDWRAAVLDSLATAVARRQIADVPTGVLLSGGLDSSVIVALLAQNGQAGLKTFSVGFDAVNGVEGDEFKYSDIIAERFATDHTKLVVDGSRTLDALPGAIHAM

SEQ ID NO: 49053 - protein, 138 aa, Magnetospirillum magnetotacticum MS-1
MTKWVYSFGDGKAEGEASMRNLLGGKGANLAEMSNLGLPVPPGFTITTEVCTYYYEHGETYPAELKDAVNAALDTVGKLTGRRFGDAEKPLLVSVRSGARASMPGMMDTVLNLGLNDTTVEALAKDADDERFAYDSYR

SEQ ID NO: 49054 - protein, 573 aa, Glycine max
MTVGSFFIRTSRVLNSSNFLLLCTLSGGGVVAYSESQSGAERPSIEANEPAKKKVVVLGTGWAATSFLKDLDASLYDVQVVSPRNYFAFTPLLPSVTCGTVEARSIVEPVRNIIKKRKGEVNFWEAECVKIDYSNKKVFCRSNIDNLVGSNEFSLDYDFLVVAVGAQVNTFNTPGVKENCHFLKDVEDAQKIRLSVIDCFEKAVLPSLSDDERRSNLHFVVVGGGPTGVEFAAELHDYVQEDLIKLYPTVKDKVKITLIQSGDHILNMFDERISSFAEQKFTRDGVEVQTGCRVVAVNDKDITVKVKSTGDVCSVPHGLIVWSTGISTLPVIRDFMEEIGQTKRHVLATNEWLRVNGCEDVYAIGDCSSITQRKIMDDITAIFEAADKNNSGTLTIEEFQEVMDDIILRYPQVEQYLKQKHLRDFTTLWKDLQGNESKEIDIQAFKLALSHADSQVKSLPATAQVAAQQGAYLARCFNRRDHTEENPEGPRRFSGSGRHRFLPFRYRHLGQFAPLGGEQAAAELPGDWVSMGHSTQWLWYSVYASKQVSWRTRVLVMSDWTRRFIFGRDSSRV

SEQ ID NO: 49055 - protein, 179 aa, Arabidopsis thaliana
MEFSRDAGMMMENKRNVCSLGESSIKRHKSDLSFSSKVLLILASFHGFLGRNSLRYNKLHGNDPSIFVLLMANRRGRTRLENTDTASVLLDAMHYIEFLHEQVKVCNLHLELEYLARTDFPVFCNQEELEQYSLRNRGLCLVPMENTVGVAQSNGADIWAPVKTPLSPAFSVTSQSPFR

SEQ ID NO: 49056 - protein, 127 aa, Brassica napus
  misc_feature (123)..(124): Xaa can be any naturally occurring amino acid
LSRLSLITVVDEKTTMAVRLMLVAALLCAAAAAAAAQQANNVRATYHYYRPAQNNWDLGAPAVSAYCATWDASKPLSWRSKYGWTAFCGPAGAHGQAACGKCLRVTNPATGAQVTARIVDQCXXGGL

SEQ ID NO: 49057 - protein, 335 aa, Arabidopsis thaliana
MNLDFDDSKRMHYGVTKQERVKMLQRFIKRVDGKLALCKNVPLNRFSIKCKDDVGPAPVIGWITNVLKRRVSELALDISSCWDWPMSTAIDGCNTMVQEFWESCSVSSTSLKRLTYLKANFDSLVEARLDLQMTHDQIHKAKFSADDPIQHEGLVGNATVFFIGICNVRSLYLSYNTLEPLPVFNNLIQLTVKTDRLVGWESLTALLKNSPNLETLVFEGLLHRYDMKCQSSDECLCKPWEEENIPTCLSLSPVKVLKIMKFGDIDEDEDMDKMMDQVEYFLETMPNLEQLIIHYETSIDEDVEEVLSQFQMVPREGLTECRIQVISDNLVLSSI

SEQ ID NO: 49058 - protein, 1213 aa, Oryza sativa (indica cultivar-group)
MELRFKAPDYATWKKEAAACDKNNGNDKDGSIPVRNKYPRHPPPRFELAEGLDYKKIDKFMDERAISIAKTIANDIIIPDPAPEWMCHTFLDKHDELEPIFVKDSPRCFLRYFKNCGGYGMSWNLTITAQTLTCMVSFNALRCAKVVLEGRAPELFGMHANPNCVTKYGYFPLHEAAERFSVEMIKLLLRFGASANVRTVGDDVIEDLLPLHIAIENTCLHKYLEDNLSPSQNHLDYIYKLIHLLCLPEMKIFLDTIRLLAGKTNNLLEELWYYIEDGKLIQSAILLLAAQEQIRGGCSSKINGSSKKDGFGIISKRILRLSFALRWEKGSNGMAQKLREEKRALIDCIGLLVDVISQAGEPLSAYVQAHSEAPHVEVLEHVSTILKEYGFYPTAEVIDTMNLIWLIDANMAFTETANRHASEEKAGRKEVGGGWDPTGKNPTICKQSSIQKELQHLCYWCIQALEAAEVLAWGLRYPCPLDLEAQQLGKYIVKYSLLFCQFQNVMVTIYWCSRQKVAWSATGCTLLISLLFFFSDSPHRILLNKKPLNFKTAPSRLLHEISISSSRVQRVNNSSAEFVANLNDRNVEIVQHMEDNDHNIINATANVTSDWSIVKEEFTFPAGSAPFNSCHASTIVETEKDSFLVAYFGGSKEGAPDVKIWLQRYSPFLVEDGRLLCGSSVESWNSWGAWLEVTKDAGRTWRKYGPIYIEGETLGVIQPVPYMTANGTIRVLLRSFETIGRVCMADSADGGVTWSYVHETDLPNPNSGIDGVKMKDGRVLLAYNTFSRGTLKVAVSMDDGDSWNDVMALEDTEGMEFSYPAVIQTMDDLIHITYTYNRTQIKFDLPTLSSQGSKDHGLILHIQEKCDKMTNKWSVLREEFTFSEGNVPFKTCHASTIVEVQKNMFLVAYFGGTQEGADDVKIWLQRYYNGSWHSPEVVDEVPNVPLWNPVLFQLPSGEILLFYKVGKTVESWSGCMKCSSDGGVIWSKREQLPPGILGPIKNKVTKDHGKTWKKYGPIYVRGKTMGVIQPVLYQTSSGTIRMLLRPSDEVGRICVAESKDSGVNWSYAQPTELPNPNSGIDGVKLKDGRVVLVYNSTSRGVLKVAVSQDDGDKWEDVLTLEETHGVEFSYPAVIQTSDGLVHVTYTYKRTQIKVVLPMLFGLLMVITSFIIFHVKNEFLLVTALCSMSFYNQARFDAVSNQTCGFVSGVKFEL

SEQ ID NO: 49059 - protein, 265 aa, Arundo donax
AESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNANRFEEAKKFGCTEFLNPKDHSKPVQEVLAEMTNGGVDRSVECTGNINAMIQAFECVHDGWGVAVLVGVPHKDAEFKTHPMNFLNERTLKGTFFGNFKPRTDLPNVVELYMKKELEVEKFITHTVPFSEINKAFDLMAKGEGIR

SEQ ID NO: 49060 - protein, 331 aa, Aspergillus nidulans FGSC A4
MGSVSKANVPKIDVSPLFGDDQAAKMRVAQQIDAASRDTGFFYAVNHGINVQRLSQKTKEFHMSITPEEKWDLAIRAYNKEHQDQVRAGYYLSIPGKKAVESFCYLNPNFTPDHPRIQAKTPTHEVNVWPDETKHPGFQDFAEQYYWDVFGLSSALLKGYALALGKEENFFARHFKPDDTLASVVLIRYPYLDPYPEAAIKTAADGTKLSFEWHEDVSLITVLYQSNVQNLQVETAAGYQDIEADDTGYLINCGSYMAHLTNNYYKAPIHRVKWVNAERQSLPFFVNLGYDSVIDPFDPREPNGKSDREPLSYGDYLQNGLVSLINKNGQT

SEQ ID NO: 49061 - protein, 431 aa, Salmonella typhimurium LT2
MVSLEKNDRVMLARQLPLKSVALILAGGRGTRLKDLTNKRAKPAVHFGGKFRIIDFALSNCLNSGIRRIGVITQYQSHTLVQHIQRGWSLFSEEMNEFVDLLPAQQRMKGENWYRGTADAVTQNLDIIRRYKAEYVVILAGDHIYKQDYSRMLIDHVEKGARCTVACMPVPIKEATAFGVMAVDESDKIIDFVEKPANPPAMPGDASKSLASMGIYVFDADYLYELLAADDKDDASSHDFGKDIIPKITREGMAYAHPFPLSCVQSDPQAEPYWRDVGTLEAYWKANLDLASVTPELDMYDQNWPIRTHMESLPPAKFVQDRSGSHGMTLNSLVSGGCIISGSVVVQSVLFPRVRINSFCNIDSAVLLPEVWVGRSCRLRRCVIDRACIIPEGMVIGENAEEDARRFYRSEEGIVLVTREMLRKLQVKQER

SEQ ID NO: 49062 - protein, 658 aa, Salmonella typhimurium LT2
MTQLAIGEATPHGATYDGHGVNFTLFSAHAERVELCVFDSRGNERRYDLPGRRGDVWHGYLAGARPGLRYGYRVHGPWQPAQGHRFNPAKLLLDPYARRVEGELKDHPLLHGGHDEPDYRDNAAVAPKSVVISDHYDWEDDAAPRTPWGKTVIYEAHVKGLTYLHPELPQEIRGTYKALGHPVMVAYFKQLGITALELLPVAQFASEPRLQRMGLTNYWGYNPMAMFALHPAWASSPETALDEFRDAVKALHRAGIEVILDIVLNHSAELDLDGPTFSLRGIDNRSYYWIRDDGDYHNWTGCGNTLNLSHPGVVEYACECLRYWVETCHVDGFRFDLASVMGRTPTFRQDAPLFAAIKACPVLSTVKLIAEPWDIGEGGYQVGNFPPPFAEWNDHFRDAARRFWLPRNLTTGEFACRFAASSDVFKRNGRAPGASVNLLTAHDGFTLRDCVCFNQKHNEANGEENRDGTNSNYSDNHGKEGLGGPLDLMERRRDSIHALLATLLLSQGTPMLLAGDEHGHSQHGNNNAYCQDNALTWLDWQQANRGLTTFTAALIRLRQQIPALTGNSWWEEGDGNVRWLNKNAQPLSADEWQNGPKLMQILLSDRFLIAINATLEVTDIVLPEGEWRAVPPFAGEDNPVITAVWQGPAHGLCVFQRG

SEQ ID NO: 49063 - protein, 330 aa, Haemophilus somnus 2336
MIEKMNPMNIHAIQSLIKTDMDKVNATILAQLNSDVALINQLGYYIVQSGGKRIRPMIALLAARALNYQGDEPITCAAFVEFIHTATLLHDDVVDESDMRRGNPTANAEFGNAASVLVGDFIYTRAFQLMTKLNSLRILQIMSDATNIIAEGEVQQLMNVNDPETSEDNYMKVIYSKTARLFEVATQCAAITAQSNAEQEIALQHYGRYLGTAFQLVDDVLDYSANAATLGKNIGDDLAEGKPTLPLLHAMRNGTPQQSALIREAIEQGGKRDFLDDVLAIMTEQKSLDYAMSKAKEEAQKAVDSISCLPENQYKQALISLAYLSVERHY

SEQ ID NO: 49064 - protein, 452 aa, Primula farinosa
MADPPPNPKTGYITSSDLKAHNKAGDLWISIHGQVYDVSSWAALHPGGTAPLMALAGHDVTDAFLAYHPPSTARLLPPLSANLLLEHYSVSPTSSDYRKLLHNFHKLDLFQTKSHTTCFTFVAMVVLFFLSLLGVFCSDSTWVHLASGGVMGVAWIQSGWLGHDSGHYQIMSSRKTNRFAQVLSGNCLAGISIAWWKWNHNAHHLACNSLDYDPDLQHMPFFVVSSKFFNSLTSRFYDRKLNFDGVSRFLVSYQHWSFYPVMCLARINLFAQSFMLLFSSRKVPDRVQEIFGIGVFWVWYPLLVSCLPNWGERIMFVVASFSVTGIQHVQFCLNHFSAEVYLGPPEGNDWFEKQTAGTLNISCHSWMDWFHGGLQFQIEHHLFPRLPRSQLRKVSPFVRDLCKKHNLPYNVTSFTMANVLTLKTLRNAAIQARDLSNPTPKNLVWEAVNTHG

SEQ ID NO: 49065 - protein, 197 aa, Zea mays
  misc_feature (163)..(163): Xaa can be any naturally occurring amino acid
  misc_feature (171)..(171): Xaa can be any naturally occurring amino acid
  misc_feature (188)..(188): Xaa can be any naturally occurring amino acid
MGSISLSNSLPIPRLPLHTSSLNPCLPSSFPLPPRRSTFSPRISASAVFAAPSGVNNSVPGKNGGYTVGDFMTGKQHLHVVKPSTSVDDALELLVEKKVTGLPVIDDDWSLVGVVSDYDLLALDSISGRSSQNDTNMFPNVDSSWKTFNELQKLISKTHGKVXVGDLMTPXSSLGVRGSTNLEDAARXLLETKSKNY

SEQ ID NO: 49066 - protein, 453 aa, Primula farinosa
MANKSPPNPKTGYITSSDLKSHNKAGDLWISIHGQVYDVSSWAALHPGGTAPLMALAGHDVTDAFLAYHPPSTARLLPPLSTNLLLQNHSVSPTSSDYRKLLDNFHKHGLFRARGHTAYATFVFMIAMFLMSVTGVLCSDSAWVHLASGGAMGFAWIQCGWIGHDSGHYRIMSDRKWNWFAQILSTNCLQGISIGWWKWNHNAHHIACNSLDYDPDLQYIPLLVVSPKFFNSLTSRFYDKKLNFDGVSRFLVCYQHWTFYPVMCVARLNMLAQSFITLFSSREVCHRAQEVFGLAVFWVWFPLLLSCLPNWGERIMFLLASYSVTGIQHVQFSLNHFSSDVYVGPPVGNDWFKKQTAGTLNISCPAWMDWFHGGLQFQVEHHLFPRMPRGQFRKISPFVRDLCKKHNLPYNIASFTKANVFTLKTLRNTAIEARDLSNPLPKNMVWEALKTLG

SEQ ID NO: 49067 - protein, 554 aa, Pseudomonas aeruginosa PAO1
MKHHLTPLDATQLDSWRALAAHRQELQDFRMRQAFIDDPERFKRFSFSACGLFLDFSKNLIRQDTIDLLVKLAEEARLSDAIRAMFDGEAINASERRPVLHTALRRPIGDKVLVDGVDVMPEVHRVLHQMTELVGYVHNGLWRGYTEKPITDVVNIGIGGSFLGPQLVSEALLPFAQKGVRCHYLANIDGSEFHELASRLNAETTLFIVSSKSFGTLETLKNAQAARAWYLAQGGTEEELYRHFIAVSSNKEAAIAFGIREENIFPMWDWVGGRYSLWSAIGLPIAMSIGISNFKELLSGAYNMDQHFQTAPFERNIPVLLGLLGVWYGDFWGANSHAILPYDYYLRNITDHLQQLDMESNGKSVRQDGTPVTSGTGPVIWGGVGCNGQHAYHQLLHQGTQLIPADFIVPVSSYNPVADHHQWLYANCLSQSQALMLGKSREEAEAELRAKGLPEAEVQRLAPHKVIPGNRPSNTLVVERISARRLGALIAMYEHKVYVQSILWGINAFDQWGVELGKELGKGVYSRLVGSEETPAEDASTQGLIDFFRGRHRG

SEQ ID NO: 49068 - protein, 452 aa, Primula vialii
MADPPPNPKTSYITSSDLKGHNKAGNLWISIHGEVYDVSSWAGLHPGGSAPLMALAGHDVTDAFLAYHPPSTARLLPPLSTNLLLQNHSVSPTSSDYRKLLHNFHKIGLFQTKSHTTCVTFVAMVALFFLSLYGVFCSDSAWVHLASGGVMGVAWIQSGWLGHDSGHYQIMSSRKTNRFAQVLSGNCLAGISIAWWKWNHNAHHLACNSLDYDPDLQHMPFFVVSSKFFGSLTSRFYDRKLRFDSVSRFLVSYQHWSFYPVMCLARINLFAQSFMLLFSSRKVPDRFQEIFGIGVFWVWYPLLVSCLPNWGERIMFVVASFRVTGIQHVQFCLNHFSAEVYLGPPEGNDWFEKQTAGTLNISCPSWMDWFHGGLQFQIEHHLFPRLPRSQLRKVSPFVRDLCKKHNLAYNIASFTMANVLTLKTLRNAAIQARDLSNPTPKNLVWEAVNTHG

SEQ ID NO: 49069 - protein, 129 aa, Oryza sativa
MGKTWALISHLHAFAGPTLTLIYPLYASICAMESTSKVDDEQWLVYWILYSLITLMEMALHKVLYWIPLWYEAKVLFVAWLVLPQFRGASFIYDKFVREQLKKNRVKLHEHHGHGHGHADEHQSHVVRG

SEQ ID NO: 49070 - protein, 137 aa, Brassica napus
RNLVWLFLIGAVLPVPVWAMSKIFPDKKWIPLINIPVISYGFAGMPPATPTNIASWLVTGTIFNYFVFNYHKRWWQKYNYVLSAALDAGTAFMGVLLFFALQNAGHDLKWWGTEVDHCPLASCPTAPGIIAKGCPVF

SEQ ID NO: 49071 - protein, 397 aa, Synechococcus sp. RS9917
MHTSRRLERLGSGVFDRNDQRKHHYRLSEAAQGLPLVDLSLGSTDLEPPPQALAAMAAALEAPGSATYCLHAGTRPLREAVASWCQSRFAVDVDPEREVLLLVGSQEGTAHLPLAVLNPGEAGLILDPSYPSHRGGLLLADARIASLPLEEATGWRPCWDRLSSAEWDQLRLMVLGFPHNPTAQVGEQIWLDEAMQRAQRHDCVLAHDNPYLDLALEGEAPALLRSQGWRERGIEFFSLSKGWCLGGFRLAFAVGAAPLISALRQLKGVVDFNQSLALQQGAIAALTEVPDWPRRIVPIYRERRDRTLKALQRLGWQAPVPSMALYLWLPVPAWARQRGWNDEDLAAALLDQAGVALTPGSGFGAAGAHWLRLALVQPSDSLEQAIRRLEPWWRQQG

SEQ ID NO: 49072 - protein, 272 aa, Arabidopsis thaliana
MSMSQSRAVQRSSSPNEDRGENQLVVYDLKGNDDTEEEVLPVQSQPLSSRTQCPSIGAFTVQCASCFKWRLMPSMQKYEEIREQLLENPFFCDTAREWKPDISCDVPADIYQDGTRLWAIDKPNISRPPAGWQRLLRIRGEGGTRFADVYYVAPSGKKLRSTVEVQKYLNDNSEYIGEGVKLSQFSFQIPKPLQDDYVRKRPARLLDSIDNTNTPVAKEANPLAWISPDDHISLQLGTPTESGLNNSHYQPSKKKKTSTLSIFGSNDELADR

SEQ ID NO: 49073 - protein, 123 aa, Arabidopsis thaliana
  misc_feature (13)..(13): Xaa can be any naturally occurring amino acid
GNKGFSSSTQAPXTVDPVLDHIKNNQNLRFLAKTKKDWGEFKENPQGVGDDLDRVKKSSGQYLDKVGFLERGDYLRFEKKKNARLAVQAKRRHDDVLNEMWPSPFNMYEIIFSSHFGPILSKV

SEQ ID NO: 49074 - protein, 309 aa, Aspergillus oryzae
MAERLVPVISLKDFEQRKDQITAELMEAAEYAGFFTLVDHGILKEEIEAQFSISKTFFDLPAETKGKTPHDPKTNNGWEYMAQLRPSTGTYDQKESLWLRHNSDWPSDDDVPGFQNTTREFMNKCAGISDQVLTCFARGLGFKEDYFKIANDPSQPDCLTQLRLIHYPASENSIGTWRAGSHTDVGCLTLLFQRDGEDGLEICPGRESHSSFASGDVFTPLPAETGPIVVNIGDMLMAWSDDRLKSNFHRVRAKEYGMSPSRYSIAYFNQARRDFVLQGPLKKYPAITVGEYVAQAVAKNFSPSMRAAA

SEQ ID NO: 49075 - protein, 421 aa, Zea mays
LEAGRVLPPFIHTPHLPNSELQVSLLVATTGRDRRRRRRLSSLEMADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYIALDYEQELETAKNSSSVEKSYELPDGQVITIGAERFRCPEVLFQPSMIGMEAAGIHETTYNSIMKCDVDIRKDLYGNIVLSGGSTMFPGIADRMSKEITSLAPSSMKIKVVAPPERKYSVWIGGSILASLSTFQQMWISKEEYDESGPAIVHRKCF

SEQ ID NO: 49076 - protein, 133 aa, Oryza sativa (japonica cultivar-group)
MASKAFALFLAVNLVVLGVASACGGSPSCPTPTPSTPTPSTPTPTPSAFGRCPRDALKLGVCANVLGLIKAKVGVPPAEPCCPLLEGLVDLEAAVCLCTAIRGNILGINLNLPIDLSLILNYCGKTVPTGFKC

SEQ ID NO: 49077 - protein, 453 aa, Primula vialii
MANKSPPNPKTGYITSSDLKGHNKAGDLWISIHGEVYDVSSWAGLHPGGSAPLMALAGHDVTDAFLAYHPPSTARLLPPLSTNLLLQNHSVSPTSSDYRKLLHNFHKIGMFRARGHTAYATFVIMIVMFLTSVTGVLCSDSAWVHLASGAAMGFAWIQCGWIGHDSGHYRIMSDRKWNWFAQVLSTNCLQGISIGWWKWNHNAHHIACNSLDYDPDLQYIPLLVVSPKFFNSLTSRFYDKKLNFDGVSRFLVCYQHWTFYPVMCVARLNMIAQSFITLFSSREVGHRAQEIFGLAVFWVWFPLLLSCLPNWSERIMFLLASYSVTGIQHVQFSLNHFSSDVYVGPPVANDWFKKQTAGTLNISCPAWMDWFHGGLQFQVEHHLFPRMPRGQFRKISPFVRDLCKKHNLPYNIASFTKANVLTLKTLRNTAIEARDLSNPTPKNMVWEAVHTHG

SEQ ID NO: 49078 - protein, 394 aa, Arabidopsis thaliana
MGLRMSESAKPYFAMVCLQFGYAGMNLVTKTVLDRGMSHYVLVAYRNAFATAAIAPFALLSERKVRSKMTFPIFMRIFLLALLGPVIDQNLYYIGLKLTSPTFSSAVSNIVPAITIILATLFRMEKVEMRKVRCLVKVMGTLVTVVGSILMIFYKGPFINFFRSHLTAASSPPTADYLKAAVFLLLASLSWASFFVLQAATLKKYSAHLSMSTMVCFMGTLQSLALAFVMEHNPSALNIGFDMNLLASAYAGIMSSSIAYYVQGLMMQRKGPVFVTAFNPLIVVIVSIMSFFVLGQGIYLGGVIGVVVLMVGVYAVLWGKHVDDDGEETRHEDNVVAVKCCSGNNGLTIMPKIDEADEEDVETGKATSEKESSVPEVVVVVFCSENVHSVSRPN

SEQ ID NO: 49079 - protein, 198 aa, Triticum aestivum
IAPAWPPTVMALWATSVAPFRGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKASTAHSPRATYKVPLRFCQL

SEQ ID NO: 49080 - protein, 598 aa, Prochlorococcus marinus str. MIT 9303
MTEGQTTSGQAADLKFAACLASGADLSKFEQFKADSCYLLDPLAAELENSSDHFSNDAVQLLKFHGSYQQDNRDNRQKGEGKDWQMMLRLRSPGGRIPPSLFLALDDLSNRLGNGSLRATTRQAFQIHGVRKEDLREVISTIIRSMGSTLAACGDITRNVMAPAAPYEKGGYPAARQLANEIADVLSPTAAEGSYLDLWVNGSATYRIRPSRRVKKVRTRQHQGNVFSGDTKEPLYGKTYLPRKFKCAVTVPGDNSVDLLTNDIGLVVFTAANGEIKGCNVYVGGGMGRTHNNEQTFARTADPLGYVAAEHVLDLVQSILALQRDYGDRKTRRHARMKYLLNDQGISWFKQELKSKYFLHPIKALRPEPKSKLEDYLGWHQQSVGQWFVGLPLLSGRLEGDLKKGLRQLVETFQLEIRLTPNQDLLLCNIGTSQRSSVRKGLAALGIRAPEAPAMLARHAIACPALPLCGLAVTEAERTLPVLLERIDAQLRRLEITKSILIRMTGCPNGCARPYMAELALVGSGVDQYQLWLGGTPNLQRLAKPYLQRMPLDQLESTLEPLLLSWKQAGGRRSLGDHVNKLGDQAVLGLLSGTGKAP

SEQ ID NO: 49081 - protein, 447 aa, Yarrowia lipolytica CLIB122
MAAKQVLLLGSGFVAKPTVDILAATDGIEVTVACRTLDKAKALAGDVAKAKSVDVENPESLDAAIAECDLVISLIPYIHHATVIKSAIKHKKNVVTTSYVSPAIQALEQEAKDAGIVVMNEIGLDPGIDHLYAVKTIDEVHRAGGKIKSFLSYCGGLPSPEDSDNPLGYKFSWSSRGVLLALRNAAKFYKDGKIEEVSGEDLMTLAKPYFIYPGYAFVCYPNRDSSPYKERYEIPEADTIIRGTLRFQGFPEFIKVLVDLGFLSDDNVETFAVGSKPAWKDALAAQVGAKGNSEEEIIAAISSKTKFKDEDDKERIINGFRWLGLFSDTPITARGNPLDTLCATLEEKMQFGPRERDMVMLQHKFGIEWADGKTETRTSTLVAYGNPDKYSAMAELVGVPCAVAVKQVLNGTISTPGILAPVNPAINGPLIKELKEDYGIELIEKTL

SEQ ID NO: 49082 - protein, 481 aa, Oryza sativa (indica cultivar-group)
MDLSPSAAASPSLAKAVETYRKAVATAATVTAYAVLAHGMARELVPHDLRAALSWAASLVRARVEPRPAERRTAIIRSIEGNGHGHAQCIESRFFVDAHAYLATKIDPRSMSRFFLGGGRRGRNVLSMVPGDSMTDVFEGVEFKWTSVPAEGRFADTEVSLELSFDAAHTDMALGRYVPFIKEEVEQARRRDRELMIFMNEGSSWRGIAHHHPATFDTLAMDPELKRSIVADLDRFLKRKEYYRRIGKAWKRGYLLHGPPGTGKSSLVAAMANYLRFNLYDLDLSEVHSNSALQRLLIGMTNRCILIIEDIDCCFRARSRENGKERKTPTPTNNDGDDDDDDEEGDDFSEKRMTLSGLLNFIDGLWSTSGEERVIVFTTNYKDRLDAALLRPGRMDMHVYMGYCGWDAFKTLAHNYFLVDDHPLFPEIRALLAGVEATPAEVSEMLLRSEDADAALSGLVEFLEEKKEKKKKKQAMCEAGK

SEQ ID NO: 49083 - protein, 280 aa, Bambusa multiplex
  misc_feature (97)..(97): Xaa can be any naturally occurring amino acid
IVESVGEGVTDLAPGDHVLPVFTGECKECPHCKSAESNMCDLLRINTDRGVMIGDGKSRFSINGKPIYHFVGTSTFSEYTVMHVGCVAKINPEAPLXKVCVLSCRISTGLGASINVAKPPKGSTVAIFGLGAVGLASAEGARIAGASRIIGIDLNPSRFEEAKKFGCTEFVNPKDHSKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSV

SEQ ID NO: 49084 - protein, 210 aa, Synechococcus sp. RS9917
MSRRQALRMMETAYLAAAAALIWLALYYLPVGGALFRLALPLPLALLVLRRGWKAGLEGVAVALLLLTALMGPVRGPLMLFPYGLLSLWLGWAWSRSFSWWLSWGVGLLLGAIGFLVRVLALSLLVGENLWVVITRAGAGLLDRLVDLLRLPLAPDLLEVQLMALGLVLFQQLVYVLALHALAYWIFPRLRSPLPEPPPQLKGLVALDPL

SEQ ID NO: 49085 - protein, 471 aa, Oryza sativa (indica cultivar-group)
MSRELLPDELRAVARWGAAFVRARVGAAEKERHTVVIRRQLDGGYGENQMFEAARAYLATKIDPRALRRLSLARSRCIDADGRSSWTTLLCLEPGDSSTPPPTCSMASSSGGRPWRPAAATTARGAARAVTAVTAPRASSSPSPSSSASTPSTPTQRSSATSPSSWPRRERALRIFMNEERSWHGFNHHHPATFDTIAMEPDLKKSIVDDLDRFLKRRDYYRRIGKAWKRGYLLHGPPGTGKSSLVAAMANYLRFNLYDLDLSQVRVNAALQRLLISMPNKSILVIEDIDCCFDAKPREDHKITTAALDQPEDFDFSDDGGGAPRGAGDLQQKNVTLSGLLNFIDGLWSTSGEERVIVFTTNYKERLDPALLRPGRMDVHVYMGYCGWDAFKTLAHNYFLVGDHPLFPEVRELLAGVEATPAEVSEMLLRSEDVDVALRGLTELLRERTRRRARQEAAIENEVVAEKGNAA

SEQ ID NO: 49086 - protein, 559 aa, Zea mays
ANAVLQCLMCTKPLMIYLLLRLHSKDCNTIISNSCPHPLLEILMCTLYFFLFDLSYYFIGCSKNWCLMCELEQYASTLRESGGPLSPSRILSNLRNIGCRLGGGTQEDAHEFLRHLVMSMQAACLDGLGGEKHVEPSLQETTLIQQMFGGRLKSKVKCLRCYHESERYENIMDLTLEIHGWVESLQDALTQFTAPEDLDGDNMYKCGRCSAYVKARKQLSVHEVPNILTVVLKRFQSGKYGKINKCVTFPDMLDMVPFVTGSGDNPPLYFLYAVVVHVDTENASFSGHYISYVKDMQGTWLRIDDSEVQVVSVNQVMSEGAYMLFYLRSFPRPPRIYIEKGLPVTSAKRHTSKSSKGSKHDRKQTELLFPANDQAYGVYDFRPDGEGYAQDQHAELRSRAFHHADDAFADSVSADFSEATSSEWSLFTSSDESSFTTESTRDSFSVVDYGDNAGLDPISSIFGPSYAPEHGAPGSFVSRTRFSPSSPQTRYFSESTGFVSDSSMPAHPHGIVHRGRYPDSRACASSAEPLASAAHQRSGYGRYPLSRDGFVQTSGFCQM

SEQ ID NO: 49087 - protein, 358 aa, Solanum lycopersicum
MMTRGATRMTRVVMGHMGPRYFSTTVLRNNPGTGVVGGVAAGLLHGLPANPSEKVAVTWVRHFSAMGSRSASTAALNDKQQEKESSDKKVENTATATAAVNGGVGKSVVSYWGVPPSKATKPDGTEWKWNCFRPWETYEADMSIDLTKHHAPVTFLDKFAYWTVKILRFPTDVFFQRRYGCRAMMLETVAAVPGMVGGMLLHCKSLRRFEQSGGWIKALLEEAENERMHLMTFMEVAKPNVYERALVFAVQGVFFNAYFAAYLISPKLAHRIVGYLEEEAVHSYTEFLKELDNGNIENVPAPAIAIDYWRLPKDATLRDVVLVVRADEAHHRDVNHYASDIHYQGQQLKDSPAPLGYH

SEQ ID NO: 49088 - protein, 430 aa, Arabidopsis thaliana
MENGSISFPSNGDVNSGGTSWAFKQPSLEIGNEKEEKEVQTGKPKGVLPLSFFEDEKSETSDTLVHEDSFVLASDFPVREKTKAPSPTVSISDLISRLYSQVEEKNAVNILENSATASNEVNGEDDSWEFQGPKMPITDSGIAEGADDFDSTWEFQGPSPALKMSDVTEVVDEFDDDSWEFQGPTQPVKDSMSRIGDNGLWEYKHSSVENEVGNQSSVPNGFGELHDKTVIRIEPNDYQDLFHKLKIELYHIALYHLEKLKEARDKAADSDEVQKCDSEIEDLQNLLNNDVLISGVNLESLQPGSSGMTELYKALQEPKFRELDSEDLLTERLLSAEKDWKSTIELLKHATLTLKIINLGSLEQQSKYASTWFEISSTCAQELRHAASIWKQVIKNDVQEEILSKPQELCSLSGRNLQSSKNSESINQII

SEQ ID NO: 49089 - protein, 245 aa, Clostridium acetobutylicum ATCC 824
MLLLDKINELKKIVAESSSIVFFGGAGVSTESNIPDFRSENGLYKTKNNFSYPPEVMLSHTFFKNHTEDFFEFYREKMIFKDAKPNAAHYSLAKIEEQGKLKAIVTQNIDGLHQLAGSKNVYELHGSIHRNYCMDCGKSFDLEYVIKSETTIPKCDKCGGIVKPDVVLYEEGLDDSIIQNSVKAISEADTLIVGGTSLVVYPAAGLIRYFKGNKLILINKSATAYDNEADLVISDSIGKVLETVI

SEQ ID NO: 49090 - protein, 499 aa, Burkholderia xenovorans LB400
MDASTILADLGIAHAAQAGDIAVHSPITGELIGRVASNTVAEVDTALAQAKQAYTAWRNVPAPRRGELVRLLGNRLREKKQALGSIITLETGKILQEGMGEVQEMIDICDFAVGLSRQLYGLTIASERPGHRMAETWHPVGTCVVISAFNFPAAVWSWNAALALVCGNAVIWKPSEKTPLTALAVNQILSEALQEFGDAPAGLTALINGGRDVGAKLVADPRASIVSATGSTEMGRTVGVEVAKRFGRSLLELGGNNAGIVTQTADHELAMRGILFSAVGTAGQRCTSLRRLFVHESVYDKTIERLKQLYSKVPIGNPLEKGTLMGPLIDKQSYGRMQEALQQATAEGGKVFGGERVEVKGYEGGYYVRPAIVEMPSQTSVVLKETFAPILYVLRYTDFADAVEANNAAVHGLSSCVFTTDLREAERFLSDSGSDCGIANVNIGPSGAEIGGAFGGEKETGGGRESGSDAWKAYMRRATNTVNYSSALPLAQGIDFNIG

SEQ ID NO: 49091 - protein, 633 aa, Synechococcus elongatus PCC 6301
MLFFSGQRTMSPTAAPQKLSKVEDLKARSQYLLEPILSQLQEESTHFNEDGIQILKFHGSYQQDNRDNRVKGQEKDFQFMLRLRSPGGYIPPQLYLTLDQLADDYGNGTLRATTRQAFQLHGILKRDLKTVIRRIVENLGSTISACGDVNRNVMAPPAPFRDRPEYEWARTYANNIADLLTPESGAYYELWLDGEKVLSGEPDPAVLAARRNPKGRVADSVEPLYSDRYLPRKFKIAVTVPGDNSIDLFTQDIGLVVIGNDRGELEGFNVYVGGGMGRTHNKEETFARLADPLGFVPAADIYAAVQAIVATQRDYGDRSNRRHARMKYLIHDWGIAKFKEAVESVFGKAIAPVRELPPFRYRDYLGWHEQGDGKWFLGLPITSGRIKDDGNWQLRSALREIVSRWQLPLLLTGSQDVLIYDVQPGDRAAIDKLLRDRGVHTVEAIDSLQRYAMACPALPTCGLAITESERALPGLLVRIRRLLEEQGLPDEHFVVRMTGCPNGCARPYMAELAFVGSAPNTYQLWLGGSPDQTRLARPFIDRLADGDVETQLRPLFVFFKQSRQAGESFGDFCDRVGFDALRQFSESYQHEAAKPRYRVGLRADVHGRLKAEADKRGVSLTDLACEAIAAYLR

SEQ ID NO: 49092 - protein, 251 aa, Pseudomonas aeruginosa PAO1
MRRPLVAGNWKMHGTHSSVAELIKGLRQLALPSGVDVAVMPPCLFISQVIQGLAGKAIDVGAQNSAVEPMQGALTGETAPSQLADVGCSMVLVGHSERRLILGESDEVVSRKFAAAQSCGLVPVLCVGETRAEREAGKTLEVVARQLGSVIDELGVGAFARAVVAYEPVWAIGTGLTASPAQAQEVHAAIRAQLAAENAEVAKGVRLLYGGSVKAASAAELFGMPDIDGGLVGGASLNADEFGAICRAAGS

SEQ ID NO: 49093 - protein, 100 aa, Glycine max
  misc_feature (37)..(37): Xaa can be any naturally occurring amino acid
  misc_feature (42)..(42): Xaa can be any naturally occurring amino acid
GALVGSPSKTQKRVVPVRGINSFGGLKATHGVVFLGXPLSPXKCFVKVVGSVKAAPSNGKGKGGGFFSPGNPAGEIFPIAAIPKGLVFVGGAVGFGVFRV

SEQ ID NO: 49094 - protein, 512 aa, marine gamma proteobacterium HTCC2207
MFHKQVVNIGMGQTILKSAELFSQDPALRFEGKVQTYADLSDRIRKLAAVLSQLGVSRGDRVGYMGLNHPCFLEAVYACSCLGAIFVPLNFRLTPSEAGFIIDDSGIQIVLADDACTAILDKQKQELSVQHYLAIESDRPGWQSLENLLATAAPIETVTAIEADDVALIMYTSGTTGLPKGAMLTHGNIFWNTVNVSLLEESMVGASLTCAPLFHIGGLNVTTHISLVRGVAVVLHRSFDAGAVLHDIEKYQVSTMFGAPTMFTMMSQHEAFASTDFSSVISFNVGSAPVPLPLLNIYASRGVTFCQGYGLTETSPYVTVLGSKFATSKIGSAGQSLMFTSVRIVDGRGQTVANGERGEIWIKGPNVMKGYWNRPEATAEAVDEDGWFHSGDVGYFDDDNFLFICDRIKDMVISGGENIYPAEVESVLFEHSAIAEVAVIGVPDDKWGELLVAVVVLHEGTTLDLEELQGFVGGKLARYKLPRKLHLVDALPRNPAGKVKKFILKQQMTEAV

SEQ ID NO: 49095 - protein, 706 aa, Yarrowia lipolytica CLIB122
MHGQPHQHLHTSPTAPFNMTIPYQPSTYYGCSNVTESYKPLGKIGEGTFGEVFRAEQITTKRHVALKKILLHSEKEGFPVTALREIRILKLLRHENVIPLVDLAVERGDQSKKERGCVYMVTPYMDHDLAGLLGNQSVQLSPAHIKCYMLQLLEGIGYLHAKKFLHRDIKAANILVNDQGILKLADFGLARGYDGPAPNSQTAGVNTENLTAMVVTRWYRPPELILGDRKYTTAIDMWGIGCVFGEFFTRKPIFPGASDVDQGSKIFQAVGVPTEDTMPGWSVLPGAQNSNIWGTDATNKLDKLFGRLSKDGLDFLKGLLLLDPTKRLTAIGGKNHAYFKTEPLPCQPHELPKWQSSHELDNHKRREQEKNESKVQPPPREKQPPVREPRDRDRSRDSRPPRERDSRDRRPPRGRYDSFERPERRPEGPRDGPRDRDRDEYPRELPPRDLPPRDLPPRDRDYPPRERDWDRRPPPRDRDYPPRERDYPPRDSRDRDYHPRDRDYPPRDSRDYPRDSRDSRDSRPISPSRERFHKRPQFDMYSDTDYDRERDEDDRRRRPLPRDSSRDMTRDVYVPSRGREPRELPKGPPPAPGDKVEDKGESHNKDDKPCDTENPRDSDKSRDLGPPPGPPLPADGPPPPPSSNPPRPSETYGGSRPPWRRDSRDRRESRDRDGRDRDGRDRRLSSSRYARDEFDEYGRKRPRIER

SEQ ID NO: 49096 - protein, 128 aa, Prochlorococcus marinus str. MIT 9303
MSTPAVLSQEGSPSAPVEDGGLITIESDIQNADSVTGVFTAIGNVRIVYPARGIVATSRQAQYFSKEDRVVLTGDVDVIRDGENSMQAERVVYLLEEEQAVADPSTGAQVFTSVQLDSNKQAEAPLAQ

SEQ ID NO: 49097 - protein, 142 aa, Prochlorococcus marinus subsp. pastoris str. CCMP1986
MTDDINPIESDFNAALSRYQDGQELIPIAQDFQKIIQQIPNHFAAWTCLSWLQLLLKNNEEALAAAREAVRLNQQDPQARMNLSLALLATNNKGVRDHVELIKKMAMMMPDVKTELKESVEDGFNRYPNWPELTKINKWLEF

SEQ ID NO: 49098 - protein, 431 aa, Prochlorococcus marinus str. MIT 9303
MKRVLAIILGGGAGTRLYPLTKMRAKPAVPLAGKYRLIDIPISNCINSNINKMYVLTQFNSASLNRHLGQSYNLSAAFGQGFVEVLAAQQTPESPSWFEGTADAVRKYQWLFQEWDVDEYLILSGDQLYRMDYSLFVEHHRRSGADLTVAALPVDAEQAEGFGLMRTDSDGNIQEFREKPKGESLKAMAVDTSRFGLSAESAKNKPYLASMGIYVFSRATLFDLLHKNPSHKDFGKEVIPEALARGDRLQSYVFDEYWEDIGTIGAFYEANLALTQQPNPPFSFYDEKFPIYTRPRYLPPTKLVDAQITESIIGEGSILKSCSIHHCVLGVRSRVESDVVLQDSLVMGSDFYESSEERTLLRQGGGIPLGVGEGTTVKGAILDKNTRIGNNVTIVNKDHVEEADRADEGFYIRNGIVVVVKNATISDGTVI

SEQ ID NO: 49099 - protein, 794 aa, Arabidopsis thaliana
MTDEVDGDAWLSDLVDVSFLATKTAEQSEMIETGGDKQSSVEEGCGGRTILVGVKLDAPSRELLTWALVKVAEPGDTVIALHILGNEIVDRAGNSSLLSLVRTFDSVLDVYEGFCNLKQVDLKLKLCRGSSARKILVREAKSFSATKVLVGISKSHHAIRSSASVAKYIAKKLSKDCWVIAVNNGKILFQKEGSPSSTINQSQVVEETVIGFGYIGKEDVRRITLLNVLQRSVTLNKTTKVVSHSEEDSNSKEEEEDQACGQNLRQVLAAARLENCSVCGFDSLSPNDTTTPGKLSGASDFDRSEDDDECNKAMEIVPVNGSEDSGGSVTMLVRKLPEPRPGWPLLRRAVSTLGQSVTPHKIPVVQWALKLPPRDTKQLGYDSSEDNLSTLNALVPFGINSITNKSIPDNSPRKLPEELEGLYERFSSTCRFFKYKELVSVTSNFSADNFIGKGGSSRVFRGCLSNGRVVAVKILKQTEDVLNDFVAEIEIITTLHHKNIISLLGFCFEDHNLLLVYNYLSRGSLEENLHGNKKDPLAFCWSERYKVAVGVAEALDYLHNTASQPVIHRDVKSSNILLSDDFEPQLSDFGLARWASISTTHIICSDVAGTFGYLAPEYFMYGKVNDKIDVYAFGVVLLELLSGRKPISSGCPKGQESLVMWAKPILDDGKYSQLLDPSLRDNNNNNDDQMQRMALAATLCIRRSPQARPKMSIVLKLLKGDEDTLEWAMQQVNSSSEESEMLKDEQCQRSNLQSHLNLALLDVEDDSISMGSIEQGVSVEDYLKGRTSRSSSFD

SEQ ID NO: 49100 - protein, 334 aa, Oryza sativa (japonica cultivar-group)
MAAAAVSKAYDIHRSSVSSRQRALNVLLVSGDCVLAGLQPILVYMCKVDGKFKFSPVSVNFLTEITKIIFAIIMLCIQARRLKVGEKPFLTVSTFMQAARNNVLLAVPALFYAINNYMKFVMQLYFNPATVKMLGNLKVLVIAVLLKVIMRRRFSTIQVTVPALASVYNEKALKSQFDTSIYLQNLFLYGYGAIFNFLGLVITAIIQGPSSFNILEGHSKATMFLICNNAAQGILSSFFFKYADTILKKYSSTIATIFTGVASAVLFGHTLTINFVLAISIVIISMHQYLSNQIKDEVPSSKIEMGDAHEHRSKESVVVNVSDSIATEICYRND

SEQ ID NO: 49101 - protein, 326 aa, Arabidopsis thaliana
MAASNGEKSLIVSFGEMLIDFVPTVSGVSLADAPGFIKAPGGAPANVAIAISRLGGRAAFVGKLGDDEFGHMLAGILKQNGVSAEGINFDTGARTALAFVTLRSDGEREFMFYRNPSADMLLRPDELNLDVIRSAKVFHYGSISLIVEPCRSAHLKAMEVAKEAGALLSYDPNLRLPLWPSKEEAQKQILSIWDKAEVIKVSDEELMFLTGSDKVDDETALSLWHSNLKLLLVTLGEKGCRYYTKSFRGSVDPFHVDAVDTTGAGDSFVGALLCKIVDDRAVLEDEARLREVLRLANACGAITTTKKGAIPALPTESEVQSLLKGN

SEQ ID NO: 49102 - protein, 130 aa, Citrullus lanatus
MVRVSVLNDALKSMYNAEKRGKRQVMIRPSSKVIIKFLLVMQKHGYIGEFEFVDDHRSGKIVVELNGRLNKCGVISPRFDVGVKEIEGWTARLLPSRQFGFIVLTTSAGIMDHEEARRKNVGGKVLGFFY

SEQ ID NO: 49103 - protein, 345 aa, Streptococcus agalactiae 2603V/R
MKVATFIEPGKMVITDTPKPVIEQETDAVIKIVRACVCGSDLWWYRGISKRESGSFAGHEAIGIVEEVGTKVTDVSKGDFVIVPFTHGCGQCPSCKAGFDGNCTNHQAAKNVGYQGQYLRYTNANWALVKIPGQPSDYDNETLNSLLTLSDVMATGYHAAATAEVKEGDTVVVMGDGAVGLCGVIAAKMLGANRIIAMSRHKDRQELALTFGATDIVEERGDEAVKRVLDLTNQAGADAVLECVGTEQSVDTATQIARPGAVIGRVGIPQNPDMNTNNLFWKNIGLRGGIASVTTFDKSVLLDAVLTHKINPGLVFTKSFVLDDIQKAYEAMDKRDAIKSLVIVD

SEQ ID NO: 49104 - protein, 402 aa, marine gamma proteobacterium HTCC2207
MKSGVVIIGAGQAAAVAAATLRKEKYTGTIKILGDESHPPYDRPPLSKHYLAGELSLAETLIRPLAFYSDNDIELLTNTRVASIDIESKQVVTESETVFDYDKLVITTGSRARRLDLPGCQLGGIFYLRSLNDVDLIRASMGSAKKLCVIGGGYVGLEVAAVATKAGLDVTVIETQERILQRVTTPEMSDYYHSLHTERGVNIMLNQAVTGFDGEGSVSKVLCGDLSVDADIVVIGVGILPNVEIAENAGLECDNGIVVDDHGQTSNPDIYAAGDCANHPNRLLNRRLRLESVPNAIEQARVACINLLGGDLEYASIPWFWSDQYELKLQMVGFSADGEESVVRGDKSTNKFAVFHLKEGRVVAVDAVNNSKAFMLGKRLYGKSVDAKLLADESVELKAFLK

SEQ ID NO: 49105 - protein, 529 aa, Myxococcus xanthus DK 1622
MTERELWERYQRYLCVVPALDFTLDVSRMRFPADYLERMRPRLEEAFGAMEALEKGAVANPDEKRKVGHYWLRAPELAPEPALQKEITDTVAAIHAFAKNVHEGRVKPQKAQRFTHMLIVGIGGSALGPQLVADALGTAKDPMQVSFFDNTDPDGFDRVLAQLGERLSETLTLVISKSGGTKETRNGMLEAERGYSARGLDFSKHAVAVTGAGSELDNHAKKQGWLRAFPMWDWVGGRTSVTSAVGLLPARLQGLDIDALLKGARDMDAATRERDALKNPAALLALMWHYAGDGRGHKDMVILPYKDRLLLMSRYLQQLVMESLGKETDLDGQVVNQGIAVYGNKGSTDQHAYVQQLREGVLNFFATFIEVLKDRDGGSQEVEPGVTSGDYLLGFLLGTRRALYEKDRESLTLTVPDVSARTLGALIALYERAVGFYATLVHINAYHQPGVEAGKKAAGVVLELQRKLTTRLREARAEARTAEQLAADIGMPDEVETVFKVLQHLAANPDRGVTRTPGATPTQARFQAK

SEQ ID NO: 49106 - protein, 113 aa, Medicago truncatula
MASTMIPIQACAGSGHRIPDPDRRRNSSSTNWWTPLFGMSSEPDYIDSDNKAPKSESDPSSKPSQLRFSGGLTEEKAKQLRKMTVGTESFHDTMYHSAIASRLASDFKARSDL

SEQ ID NO: 49107 - protein, 186 aa, Oryza sativa (indica cultivar-group)
MAVVRQLLVHRLSCSGLPASRCKNSCWSSGERLPGLKSRVRLLAVAIKPPRAAAGKDEIVRADDDDDGVSLGTVKLPANIDIARFETLLFQWGNSLCQGATLPLPVPLRVDKVEGGVRLGFMAVDDGVTQVLVYIDCLVSPATAASGPVFRAIRNGPMKDQEPPGEPRIMRSLLEALQKCIQYAQV

SEQ ID NO: 49108 - protein, 1073 aa, Pseudomonas aeruginosa PAO1
MPKRTDIKSILILGAGPIVIGQACEFDYSGAQACKALREEGYRVILVNSNPATIMTDPAMADATYIEPIKWATVAKIIEKERPDALLPTMGGQTALNCALDLERHGVLEKFGVEMIGANADTIDKAEDRSRFDKAMKDIGLACPRSGIAHSMEEAYGVLEQVGFPCIIRPSFTMGGTGGGIAYNREEFEEICARGLDLSPTNELLIDESLIGWKEYEMEVVRDKKDNCIIVCSIENFDPMGVHTGDSITVAPAQTLTDKEYQIMRNASLAVLREIGVETGGSNVQFGICPNTGRMVVIEMNPRVSRSSALASKATGFPIAKIAAKLAVGYTLDELQNDITGGRTPASFEPAIDYVVTKIPRFAFEKFPKADARLTTQMKSVGEVMAIGRTFQESVQKALRGLEVGATGFDPKLDLNDPEADSILKRELTVPSAERVWYVADAFRAGKSVEEVFELTRIDEWFLVQIEDLVKDEEKVKTLGLSSIDRELMYKLKRKGFSDARLAKLLGVTEKNLRSHRHKLKVLPVYKRVDTCAAEFATDTAYMYSTYEEECEANPSSREKIMILGGGPNRIGQGIEFDYCCVHAALAMREDGYETIMVNCNPETVSTDYDTSDRLYFEPVTLEDVLEIVRVEQPKGVIVQYGGQTPLKLCRALEEAGVPIIGTSPDAIDRAEDRERFQQMVQRLNLRQPANATARSEDEALAASKAIGYPLVVRPSYVLGGRAMEIVYQEEELKRYMREAVQVSNDSPVLLDHFLNCAIEVDIDAVCDGEIVVIGAIMQHIEQAGVHSGDSACSLPPYSLPQHIQDEIREQVKKMALELGVVGLMNVQMAVQGEDIFVIEVNPRASRTVPFVSKCVGESLAKVAARVMAGKTLAEVGFTQEIIPPFFSVKEAVFPFAKFPGVDPILGPEMKSTGEVMGVGDSFAEAFAKAQLGASEILPTAGCAFISVREDDKPFAAQVAGDLVALGFEVVATAGTARVIEAAGLPVRRVNKVTEGRPHVVDMIKNDEVTLIINTTEGRQSIADSYSIRRNALQHKICCTTTIAGGQAICEALKFGPEKTVRRLQDLHAGIKA

SEQ ID NO: 49109 - protein, 125 aa, Pseudomonas putida KT2440
MSNDIQRFPSSLPFPFSRAVKAGGFLFLSGQVPMSAGGEVVRGDIQTQTRAACERIAESLAACGARFDQVVKVTVWLSDMRHFAGFNEVYKAFFGAALPVRSTVASALALGVDVEIEVQAFVGDA

SEQ ID NO: 49110 - protein, 377 aa, Pseudomonas aeruginosa PAO1
MAKRDFYEVLGVERGASEADLKKAYRRLAMKYHPDRNPGDKEAEDKFKEANEAYEVLSDASKRAAYDQYGHAGVDPNMGGGAGAGFGGASFSDIFGDVFSDFFGGGGARGGSRGGAQRGADLRYTLDLDLEEAVRGTTVTIRVPTLVGCKTCNGSGAKPGTTPVTCTTCGGIGQVRMQQGFFSVQQTCPRCHGTGKMISDPCGSCHGQGRVEEQKTLSVKVPAGVDTGDRIRLTGEGEAGSMGGPAGDLYVVVNVREHPIFQRDGKHLYCEVPISFADAALGGELEVPTLDGRVKLKIPESTQTGKLFRLRGKGVAPVRGGGAGDLMCKVVVETPVNLDKRQRELLEEFRKSLQSDTSHSPKASGWFEGMKRFFDDL

SEQ ID NO: 49111 - protein, 385 aa, Triticum aestivum
MLRLRGCILVRLLSSPATSQGAPLHRPLSAGAAAAVYPNPSFAADDYLVSTCGLTRAQALKASAKLSHLKSPAKPDAVLAFLAGLGVSAADVASLVAKDPLFLCASAEKTLAPVVIELAGLGLSHSEIARLVPLCFLHFRSRSIVSKLQYYLPLFGSSENLFRVLKLGYLAGADIEGTVKPNVALLRQCGLDDCDITKLSLTKRGVLSSKPERVGAMVACAEGLGVPRGSGMFRHALDAVGFIGQEKIAAKVAYLKKTFRWSDAEVSIALRKAPCVLRKSKELLQRRSDFLISEVGLEPSYIAQRSVIINYKLEGRMKPRYYVVKFLMENGLLKCKPGYYYTAFKVREKVFMEKFICPHKEVAPHLSEDYARACEGVVPARFRFT

SEQ ID NO: 49112 - protein, 491 aa, Methylococcus capsulatus str. Bath
MSHELRLDQPGLLRTRCLIDGQWVDADHSKTFSVTDPATGRALADVPAMGAAETMRAIAAAEHAWTGWRGKTAKERAAVLRRWYELILSHTEDLARILTAEQGKPLTEARNEIGYAAGFVEWFAEEAGRAYGETIPSPVPDKRLLVIRQPIGVCAAITPWNFPAAMITRKIAPALAAGCTVVVKPAEQTPLTALALADLAVQAGFPPGVINVVTGDPEAIGGELTSNPLIRKLSFTGSTEVGRLLMAQCAATVKKISLELGGNAPFIVFEDADLDAAVEGALLSKYRNTGQTCVCTNRFLIQDSIYDAFAERLAAKVRRLEVGNGLDEGVVQGPLIDEQALAKVERHIADALDRGARVLAGGGRHPLGGRFFQPTVLVDVTPEMLCTREETFGPVAPLLRFGSEEEALAIANATEYGLAAYFYTRDLARAFRVGEALEYGMVGINTGMLSYDVAPFGGVKQSGIGREGSHHGMDEYLELKYLCLGGMAPSA

SEQ ID NO: 49113 - protein, 1331 aa, Saccharomyces cerevisiae
MMMDILNTQQQKAAEGGRVLAPHTISSKLVKRLSSHSSHKLSRSDLKALGGSETISDGPSQLTFKDRYVFNESLYLKKLKKTALDDYYTRGIKLTNRYEEDDGDDEIIRLSNGDRIDEDLHSGVKFFSTTPYCRKMRSDSDELAWNEIATERFKWQSMLARVLKGDIVKGEKTRIANQVKKPGLNKELSDEIWLELKAWLNGRTMQEMEQSLTYLRDSSDSVFEEIMKFQIPQGKILSLDALEAILQDLMNRYHSVVSYWPNLKKMYKDKPITNTAEFTARIDVMNSWLNFKTNLTLRRQELDDWINRFSPISSSDNCQEDFDGVPQWNCKMKILAEQLMKEKNIESIFQKKIFYPLSPWMFKLKLHFIVYRETLTKMNIKYPYERLRSLLAFPVYLIKEVILTRLSYARKLKNPTMMMIDQMIDDFNAFIRLSVQLKYTLTKYCSNLPFDVDFDPTFENTVIEAIRYLFFLLNLKLIDSSKQNFKAPDLLLKYWDHLKNTGHYINGAETVIPNEFLKLTLRLVHKLQFYLLKQQNFPPTFANASEAEKWLSSIFENLGAMKRKLNRFSNILVKAFQNSAVYQINHNAQLVKKLKDAHYFLVYSGNTFESSGVYMFAAPELLGCDNDTILRILRNKSIGCDLVPKLDIGNNLNVYDITTKETDLNILVSKGEDSKGIPYYRVVANSSSDLDRHAHQSKKKNFSTDPFDQHLDEKNNEVFELEVALSSLGALVVLYPGEPVVWDGPVYKLPGNNLFASNEMDLGKIGNPNTLILLNQGSNYALTYQIDKFNQTVGDSVSFIEKRCSLNSIESSLQKINKAYYKLTYTVLNNYKGILGSFMKQCPGNELLNSIFMFGRDFGRSFLKYNAFSSKRKYVIIFLMVKLGMNWLKFLVEECDPTDQRTFRWCVLAMDFAMQMTSGYNILALNVKQFQELKERVSVCMSLLISHFDVMGARATEAENGMQQARLNIDTEENIDEEATLEINSRLRLEAIKTLEKTMKRNPRQMGKVLDATDQGNKYLLSLASSLSNVSMRWQKRSFIGGGTFGQVYSAINLENGEILAVKEIKIHDTTTMKKIFPLIKEEMTVLEMLNHPNIVQYYGVEVHRDKVNIFMEYCEGGSLASLLDHGRIEDEMVTQVYTFELLEGLAYLHQSGVVHRDIKPENILLDFNGIIKYVDFGTARTVVGSRTRTVRNAAVQDFGVETKSLNEMMGTPMYMAPETISGSAVKGKLGADDVWALGCVVLEMATGRRPWSNLDNEWAIMYHVAAGRIPQLPNRDEMTAAGRAFLERCLVQDPTMRATAVELLIDPWMIQIREIAFGNSEKDQVPILSS

SEQ ID NO: 49114 - protein, 251 aa, Triticum aestivum
NKFVQKSRLVPVRNSRDIVDPRVRIEQQLAGPAMVHPSEAVAKGTKWAELFEPGVKHALFVGIGLQILQQFAGINGVLYYTPQILEQAGVGVLLSNIGLSSSSASILISALTTLLMLPSIGIAMRLMDMSGRRFLLLSTIPVLIVALAVLVLVNVLDVGTMVHAGALNDQRHRLFLLLSSWGLGLIPNILCAEDFPHLCPWHLHSHLRANLLDRRHHRDIHSPRDAQRHRSRWSLRHICHRLHTSLCIRLH

SEQ ID NO: 49115 - protein, 497 aa, Pseudomonas putida KT2440
MLSELPILPATRAFLERKLKMRIGADWQDAASGRTLSFRNPATGEVLGEVPAAEAEDVDRAVRAARQAFDDSPWSRMRPRERQNLLWRLADLMERDARQLAELECLNNGKSAAVAQMMDVQLAIDFLRYMAGWATKIEGSTVEASMPLMPNDQFHGFVRREAVGVVGAIVAWNFPLLLACWKLGPALATGCTVVLKPADETPLSVLKLAELVDEAGYPAGVFNVVTGTGLNAGAALSRHPGVDKLTFTGSTEVGKLIGKAAMDNMTRVTLELGGKSPTIVMPDANLQEAAAGAATAIFFNQGQVCCAGSRLYVHRKHFDNVVADIAGIANAMKLGNGLDPAVQMGPLISAKQQDRVTGYIELGRELGATIACGGEGFGPGYFVKPTVIVDVDQRHRLVQEEIFGPVLVAMPFDDIDEVIGMANDNPYGLGASIWSNDLAAVHRMIPRIKSGSVWVNCHSALDPALPFGGYKMSGVGREMGSAAIEHYTELKSVLIKL

SEQ ID NO: 49116 - protein, 476 aa, Triticum aestivum
  misc_feature (123)..(123): Xaa can be any naturally occurring amino acid
MNLAAPISTSTSTSTSTAVRPHAHGLMPLNLPSAASSSLRRSLFASLRKKISPMASAPASASAALSTAAPADNGAAKPAEQRPVQVAKRLEKFKTTIFTQMSMLAVKHGAINLGQGFPNFDGXPDFVKEAAIEAIKDGKNQYARGYGVPELNSAVAERFLKDSGLQIDPDKEVTVTSGCTETIAATILGLINPGDEVILFAPFYDSYEATLSMAGANVKAITLRPPDFAVPLEELKAAVSKNTRAIMINTPHNPTGKMFTREELEFIADLCKENDVLLFADEVYDKLAFEADHISMASIPGMYERTVTMNSLGKTFSLTGWKIGWAIAPPHLTWGVRQAHSFLTFATSTPMQSAAAAALRAPDSYFEELKRDYGAKKALLVDGLKAAGFIVYPSSGTYFVMVDHTPFGFDNDIEFCEYLIREVGVVAIPPSVFYLNPEDGKNLVRFTFCKDDDTLRAAVDRMKAKLRKKYWGGGFV

SEQ ID NO: 49117 - protein, 386 aa, Oryza sativa (japonica cultivar-group)
MGDAAAGGRKAAASGGGARLHVAMLALQLGYAGFHVVSRLALDMGVSKLVFPVYRNLIALFLLAPFAYFLEKKERPAMTASLAVQFFFLALCGITANQGFYLLGLENTSPTFASAIQNSVPAITFAMAAALRIERVRLSSRDGLAKVAGTLLCVAGASVITLFKGPAIFNTHHNHQPQPQQLAVAVAAGNKSWTLGCVFLLGHCVSWSGWLVLQAPVLKRYPARLSVTSYTCFFGLIQFLAIAAFLERDAAAWAVRSGSELFTILYAGFVASGVAFAVQTWCIHRGGPVFVAVYQPVQTLLVAVMASLLLGEQFHLGGIIGAVLIVAGLYLVLWGKSQERAIAAAKEASAAAAIADHQQQPASAAAADSCLKQPLLPASTVASENV

SEQ ID NO: 49118 - protein, 188 aa, Arabidopsis thaliana
MDHTVCKQVQPVVRKAKKKHGKDEFDRIKQAEKKKRRLEKALATSAAIRAELEKKKQKRLEEQQRLDEEGAAIAEAVALHVLLGEDSDDSSRVKFGEEKGFTMDLFRNERTNYVPRQSCASYAVQGIGFVSNGYGLGDSNWSPFTRRGAWDNNMGISADLIAAQAVSALQISENADGNAFVFNGMFRG

SEQ ID NO: 49119 - protein, 588 aa, Arabidopsis thaliana
MADLLPIYLIILAFLCTVGAIALALFHIYKHLLNYTEPIYQRYIVRIVFMVPVYALMSFLALVLPKSSIYFNSIREVYEAWVIYNFLSLCLAWVGGPGSVVISLTGRSLKPSWHLMTCCIPPLPLDGRFIRRCKQGCLQFVILKPILVAVTLVLYAKGKYKDGNFSPDQSYLYLTIIYTISYTVALYALVLFYVACKDLLQPFNPVPKFVIIKSVVFLTYWQGVLVFLFAKSGFIRDEEEAALFQNFIICVEMLIAAAAHFYAFPYKEYAEANVGGARSFSGSLAHALMLNDFYHDTVHQFAPTYHDYVLYNHNDGGEEGTRKYRARTFVPTGQEMDAVRKNKHMFGNKIDGVSVSSQSSETSTPKTSGVTYDPARPESMKSSLLVDASDSVSTMYDMSLIDIDISSYPSKQQREALENTIEIYPTKPKTLFVVATADLAAAAAKCFSVLQVNQISHHRNPVQEISIHPFEHNSLLSQILIPMSRNSSSNGVWQSNSNGYYSYGYGGGYVEKRQLFLKSYQFSRKQSFTEKIKISMKRVVKKVVCMRLKSARRLKRVVWSRLKTAFFYRRRRFLRLLHPNKSSSYCFY

SEQ ID NO: 49120 - protein, 272 aa, Oryza sativa (japonica cultivar-group)
MGEGDAAYAKRVLLTAAGDDVSRGIASTLATHGCRLVLVGDEGALAGTAEEARRGGGGGDAVAVVGLDLHGCDEAAVDAAVGTAWRCFDGLDAMVNCYSYEGEVQDCLNISEDEFKKTMKANVMTPWFLVKAIAKRLRDSESSCGGSVVFLTQIIGAERGLYPGAAAYGTSLGAIHQLVRLSAMELGKHKMRVNAVCRGLHLGDRFPVWVGKEKAEKATGEVMPLRRWLDPEKDVASTVLYLVGDESRYMTGSTIFVDGAQSIVRPRMRSFM

SEQ ID NO: 49121 - protein, 720 aa, Saccharomyces cerevisiae
MTQQEYRSPSQRLSKGRSMSLPKIFARNLRSLQNNAPPGKNINVNCLNVNSCSLSASPSSQINMACNGNKQDLPIPFPLHVECNDSWSSSKLNKFKSMFNHNRSKSSGTTDASTSEKGTHKREPRSTIHTELLQSSIIGEPNVHSTTSSTLIPNEAICSTPNEISGSSSPDAELFTFDMPTDPSSFHTPSSPSYIAKDSRNLSNGSLNDINENEELQNFHRKISENGSASPLANLSLSNSPIDSPRKNSETRKDQIPMNITPRLRRAASEPFNTAKDGLMREDYIALKQPPSLGDIVEPRRSRRLRTKSFGNKFQDITVEPQSFEKIRLLGQGDVGKVYLMRERDTNQIFALKVLNKHEMIKRKKIKRVLTEQEILATSDHPFIVTLYHSFQTKDYLYLCMEYCMGGEFFRALQTRKSKCIAEEDAKFYASEVVAALEYLHLLGFIYRDLKPENILLHQSGHVMLSDFDLSIQATGSKKPTMKDSTYLDTKICSDGFRTNSFVGTEEYLAPEVIRGNGHTAAVDWWTLGILIYEMLFGCTPFKGDNSNETFSNILTKDVKFPHDKEVSKNCKDLIKKLLNKNEAKRLGSKSGAADIKRHPFFKKVQWSFLRNQDPPLIPALNDNGCELPFILSCNKHPKRNSVSEQETKMFCEKVANDDEIDEADPFHDFNSMSLTKKDHNILTYSENYTYGKILYKATCTRPRHNSSHRSFFKDIIPEL

SEQ ID NO: 49122 - protein, 335 aa, Glycine max
MENSTQESHLRSENSVSYESPYPIYGMSFSPSHPHRLALGSFIEEYTNRVDILSFHPDTLSLTPNPSLSFDHPYPPTKLMFHPRKPPSSSSDLLATSGDYLRLWEVRDNSVEAVSLFNNSKTSEFCAPLTSFDWNDIDPNRIATSSIDTTCTIWDIERTLVETQLIAHDKEVYDIAWGEARVFASVSADGSVRIFDLRDKEHSTIIYESPHPDTPLLRLAWNKQDLRYMATILMDSNKVVILDIRSPTTPVAELERHRGSVNAIAWAPHSSTHICSAGDDTQALIWDLPTLASPTGIDPVCMYSAGCEINQLQWSAVQPEWIAIAFANKMQLLKV

SEQ ID NO: 49123 - protein, 489 aa, Citrus unshiu
MWGRQREASMMYKRTSSRDRSSTFDVEETTALVQNGTEVENTNPSWKLSFPHVLVATLSSFLFGYHLGVVNEPLESISLDLGFNGNTLAEGLVVSMCLGGAFIGSTLSGWIADGVGRRRAFQLCALPMIIGASISATTRNLIGMLLGRFVVGTGMGLGPTVAALYVTEVSPPFVRGTYGAFIQIATCLGLMGSLLIGIPVKEIAGWWRICFWVSIVPAAILCLAMVFCAESPHWLYKKGRTAEAEAEFEKLLGGSHVKSSLAELSKLDRGDDGDIVKFEELLYGRHFRVVFIGSTLFALQQLSGINAIFYFSSSVFKSAGLSSGLANVFVGIANLLGSVVAMVLMDKLGRKALLQWSFFSMAVSMAIQVAASSSYIPGSASLYLSVGGMLMFVLTFALGAGPVPSLLLPEIFPSRIRAKAMAVCMSVHWVINFFVGLLFLRLLEQLGPQLLYSIFGTFCLMAVAFVKRNVVETKGKSLQEIEIALLPQE

SEQ ID NO: 49124 - protein, 432 aa, Oryza sativa
  misc_feature (53)..(53): Xaa can be any naturally occurring amino acid
  misc_feature (180)..(180): Xaa can be any naturally occurring amino acid
  misc_feature (229)..(229): Xaa can be any naturally occurring amino acid
  misc_feature (421)..(421): Xaa can be any naturally occurring amino acid
MAAAAAAASSAKRALLPWARDAHHALARALQGCGGGGGLGLRGALPTGPCGCXAGGRWSLLQCRWRSSLPQLDSADRSDEESGGEIDWDNLGFGLTPTDYMYVMRCSLEDGVFSRGELSRYGNIELSPSSGVINYGQGLFEGLKAYRAANQQGSYMLFRPEENARRMQHGAERMCMPSPXSVEQYVHAVKQTVLANRRWVPPQGKGALYIRPLLIGSGPILGLASPPPXKYTVPSILRPAPVGTYFKMDRFQEGLAPINLVVEDSIHRAMPGGTGGVKTITNYAPVLKAQIDAKSRGFTDVLYLDAVHKTYLEEASSCNLFIVKDGVVATPATVGTILPGITRKSVIELARDRGYQVEERLVSIDDLVGADEVFCTGTAVVVAPVSSVTYHGQRYEFRTGHDTLSQTLHTTLTSIQMGSVXMYKKGWTVAID

SEQ ID NO: 49125 - protein, 870 aa, Oryza sativa
  misc_feature (644)..(644): Xaa can be any naturally occurring amino acid
MLGGIIGGLTGNKNARLKGSLVLMRKNALDINDFGATVIDGISEFLGRGVTCQLVSSSLVDPNNGNRGRVGTEASLEQWLTSLPSLTTGESKFGVTFEWEVEKMGIPGAIIVKNNHAAEFFLKTITLDNVPGHGAVVFVANSWIYPASKYRYNRVFFSNDTSLPSKMPAALKPYRDDELRNLRGDDQQGPYQEHDRVYRYDVYNDLGEPDSGNPRPVLGGSPDRPYPRRGRTGRKPTKTDPTAESRLSLLENIYVPRDERFGHLKMADFLGYSIKALVDGIVPAIRTYVDLTPGEFDSFKDILKLYEGGLKLPSIPALEELRKRFPLQLVKDLIPAGGDYLLKLPMPHVIREDKKAWMTDDEFAREILAGVNPMVIARLTEFPPRSRLDPARYGDQTSTITAAHVERGLEGLTVQQAIDGNLLYVVDHHDHFMPYLLDINSLDDNFIYATRTLLFLRGDGTLAPLAIELSLPHLQDDGLITARSTVYTPAARGGTGAGAVEWWVWQLAKAYVNVNDYCWHQLISHWLNTHAVMEPFVIATNRQLSVAHPVHKLLLPHYRDTMTINGLARQTLINGGGIFEMTVFPRNDALAMSSAFYKDWSFADQALPDDLVKRGVAVPDPASPYKVRLLIEDYPYANDGLAVXTPIEQWATEYLAIYYPNDGVLQGDAELQAWWKEVREVGHGDIKDATWWPEMKTVADVVKACATIIWIGSALHAAVNFGQYPYAGYLPNRPSVSRRPMPEPGTKEYDELARDPEKVFVRTITKQMQAIVGISLLEILSKHSSDEVYLGQRDTPEWTSDAKALEAFKRFGARLTEIESRVVAMNKDPHRKNRVGPTNFPYTLLYPNTSDLKGDAAGLSARGIPNSISI

SEQ ID NO: 49126 - protein, 176 aa, Triticum aestivum
  misc_feature (79)..(79): Xaa can be any naturally occurring amino acid
  misc_feature (139)..(139): Xaa can be any naturally occurring amino acid
MAPTVMFSSATAGAPFQGLKSTAGLPVSRRSNGASLGSVSNGGRIRCMQVWPIEGIKKFETLSYLPPLSTEALLKQVDXLGRFKWVPCLEFSKVGCIFREHKASPAHYDGRYWTMRKLPMFGCTDPTQVINEVEEVKKXEYPDAYVRIIGFDNMRQVQCVRCIAFKPPACEESGKA

SEQ ID NO: 49127 - protein, 214 aa, Burkholderia xenovorans LB400
MPPSIIMISTPKKSRGHSMPHMSRRQFLKVSATTLAGSSLALMGFSPTPALAEVRQYKLSRTTETRNTCPYCSVGCGILMYGLGDNAKNAKSSIIHIEGDPDHPVNRGTLCPKGASLIDFIHSPSRLKYPEYRAAGSNEWKRISWEDALDRIAKLMKEDRDANFVETTEDGKKVNRWLTTGMLAASAGSNEVGYLTHKAVRSLGMLAFDNQARV

SEQ ID NO: 49128 - protein, 288 aa, Coprinopsis cinerea okayama7#130
MAETLLAFKAGRAFRREGTKFVDADATKGAIILSNGEDGLLHFIWKNRITNEVADDLILFPGDATFSKVTESNGRVWVLKFESSGSRHFFWMQDADSSRDQEFADNVNRLLEDPESELSWNVNIQSTSGSQSTAAPAAGSSSGAGSQYPPDQLATLAAILRGGGSGGNDAAAAAEDEAFALTDVLTPTNLAPLFNNHPELIPTLFPHLPSDLPVPPSAEALQRVVNSTQFKAAAASLDRALRTGLLGGFVRQLGLPEEAGLGLGPFLRAIQEQADHENRDSGNRMDTD

SEQ ID NO: 49129 - protein, 821 aa, Burkholderia xenovorans LB400
MAGLAPTFGRGAMTNHWVDIKNADVILVMGGNAAEAHPCGFKWVTEAKAHRKARLIVVDPRFTRTASVADYYAQIRTGSDIVFLGGVINYLLTNDKIQHEYVKNYTDMPFIVREDFSFTDGLYSGYNADKRKYDQSSWDYERGDDGFAKVDPTLQHPRCVYQLMKQHYSRYTPEQVEKACGTPKEKFLKVCEMLASTAVPGRAGTVLYALGWTHHSIGAQIIRTGAMVQLLLGNIGIAGGGMNALRGHSNIQGLTDLGLMSNLLPGYMTLPLEAEQDFDAFIKKRASQPLRPNQLSYWRNYRAFHVSFMKSWWGDNATAENNFGFDYLPKLDKSYDMLQVFELMNQGKMTGYIAQGFNPLAAAPNKAKIGAGLAKLKWLVVMDPLATETSEFWKNFGEFNDVDPASIQTEVFRLPTTCFAEERGSLVSSSRVLQWHWQGADGPGESRSDLEIMSGLWLRIREAYRKNGGKYPDPILNMSWPYANPESPTPEEIAMEFNGKALADVTDATDKTKVLAKKGEQLASFAQLRDDGSTASGCWIFCGSWTQAGNQMGRRDNSDPTGIGNTLNWAWAWPANRRILYNRASCDVSGKPFDPTRKLIAWNGKAWAGADIPDFKVDEPPENGMNPFIMNPEGVARFFSRDGLVEGPFPEHYEPFETPIGYNPLHPDNKLVVSSPAARVFPDDRAAFGTHENFPHTATTYRLTEHFHYWTKHARLNAIVQPQQFVEIGEDLAKEVGVVAGDRVKVSSNRGHIIAVALVTKRIKPLMIEGKKVQTVGLPLHWGFKGLTKPGYLVNTLTPSVGDGNSQTPEFKSFLVKVEKA

SEQ ID NO: 49130 - protein, 490 aa, Oryza sativa (japonica cultivar-group)
MAAANLLSRALLPALNPNPSSHSNRVSPSAVSLRCRHGLTASVRASLSTAAPSPPPRPAAAAADGRAPKRCFRRGADGHLYCEGVRVEDAMGAAERTPFYLYSKPQVVRNFTAYRDALEGLRSIVGYAVKANNNLRVLQLLRELGCGAVLVSGNELRLALRAGFDPTRCIFNGNGKTLEDLVLAAESGVFVNIDSEFDLENIVTAARVAGKKVPVLLRINPDVDPQVHPYVATGNKTSKFGIRNEKLQWFLDSIKSYSNDITLVGVHCHLGSTITKVDIFRDAAGLMVNYVDEIRAQGFELEYLNIGGGLGIDYHHTDAVLPTPMDLINTVRELVLSRDLTLIIEPGRSLIANTCCFVNRVTGVKSNGTKNFIVVDGSMAELIRPSLYGAYQHIELVSPSPDAEVATFDIVGPVCESADFLGKDRELPTPDKGAGLVVHDAGAYCMSMASTYNLKLRPPEYWVEDDGSIAKIRRGESFDDYMKFFDNLSA

SEQ ID NO: 49131 - protein, 376 aa, Coprinopsis cinerea okayama7#130
MLKSTLLRTTAVQLRTPTTLSTARLLARPLVCRGLHSTGYLRSALSASAKTRETHTETRSTKSETKEAPKADPLTTESAVSTVPTMVRGDWVLFHPVYSSEELKAVEVIHREPKTLSDKAARGFVTLARKMFDLVSGYKHKPLPPNYKDLTVQHLRDQGYILDDKGWLRRILFLESIAGVPGMVAATLRHLQSLRLMRRDSGWIHTCLEEAENERMHLMTFMTLRKPSIAFRAMVLGAQGVFYNLFFLSYIFSPKTCHRFVGYLEEEAVVTYTKCIKELEDGLIPEWEGKPAPEIAIDYWRMSPDAKMIDLLYAVRSDESTHRFVNHSLANLNHDTDVNPFALREPDMHTKGKKIEFERHEAEAYIKESHELLGKK

SEQ ID NO: 49132 - protein, 248 aa, Synechococcus sp. WH 5701
PIEKHHHEVAASGQQELGMFAELISAADNVMIYKYVVRNVARKYGRSATFMPKPVFADNGSGMHVHQSLWRDGQPLFFGLGTYADLSQTARWYIGGLLRHAPSFLAFTNPTTNSYKRLVPGFEAPVNLVYSQGNRSAAVRIPLSGENPRAKRLEFRSGDAMANPYLAFSAMLLAGLDGIRQQIDPGDGMDLDLFELPPEDLEQIATLPSSSEGVLAALEADHEYLLAGEVFSEDFISNWIALKSEALQ

SEQ ID NO: 49133 - protein, 387 aa, Ustilago maydis 521
MPGKVAPNNSLATEPAERNVSFVLQEIEKVSFEERPIVAPKPGQVQVNIRQTGLCASDCHYLHHGRIGDFVVRKPMVLGHESSGIVTAVGEGVTTHKVGDRVALEPGVPCRSCQVCLNGMYNQCAHLEFAATPPYDGTLCTYYNIQSSFAHHVPDHMSLEEASLMEPLSVAVYSAGMRGQVKAMENVLVFGAGPIGLLNAAVCKAYSAKRVVVVDVVESKLEFAKEWCATSTFKPSLPQEGETKAETAARNAQHLISSLGDDVAAREGFDLVLECTGAEPCINMGIQALRPQGRFVQVGMGRSEVEFPITRVCVKEINVTGSFRYGAGTYKTSINLVSTGAIDVTKMVTHRFLFKDAVKAFETTTKGVGEDGKTAIKVQISQGEGKQ

SEQ ID NO: 49134 - protein, 227 aa, Medicago truncatula
MGVDSAASSSSNSWSHNDEDDNSSKNNSSIVVLNVYDLTPINNYMYWFGFGIFHSGIEVYGKEYGFGAHDFPASGVFEVEPKNCPGFIYRCSINLGQIQTSPSEFRTFIENMASEYHGDTYHLISKNCNHFTDDVSYRLIGKQIPGWVNRLAKLGALCSCLLPESLQVTSVKQLPEYHECSEDEFVDSLSTATPHGSPEIDAEQEKHLLSPSARAEDVTFVKEAHVK

SEQ ID NO: 49135 - protein, 349 aa, Medicago truncatula
MPKERKDRSLSHECSRTSPYPSSSSRVRRSTSKSPLESDENIKEWEEARCPVCMEHPHNAVLLICSSHEKGCRPYMCNTSYRHSNCLDQFCKSFAEPSPPTVPQVESEISNSDSPQDQSTEANIVNVQEETIVDVQEETIVDVQEETSEGFVTMQSLSCEDETKSKLVCPLCRGHIKEWKVVEGARHFMNDKSRSCSCESCNFTGTYTDLRKHARVEHPLERPSAVDPERQRNWRRLERQRDLGDLLSTLQNSFGENRVDDGLGLAPIDDGGLLAVFFLILQPSSVSRGTTGTRLQMRIRRPSRLWGETYEAESGSAARDDTTNESSDGGSDNRRRRVRRRVQTPDRQP

SEQ ID NO: 49136 - protein, 304 aa, Zea mays
MADESWRVPTPVQELAATATLEEPPSQYVLQEKDRPGSPLVADDMPEPLPIINLSRLSEDATEAAKLESALQSWGLVLVTNHGIETSLMDGVMDASREFFRQPLEEKQKYSNLIDGKRFQVEGYGNDRVATERQILNWNDRLHLKVAPEDERNYTHWPKHPESFRDVLHEYALETKRVRDGIFRATAKILELDEDHFVSLISDRAAAFARFNYYPPCPRPDLVNGVQPHSDAGVLTILLVDKDVRGLQVQRDGVWYNVPPMPYTLLINLGDVMEIMSNGIFKSPVHRVVTNAEKERISLAVFYG

SEQ ID NO: 49137 - protein, 511 aa, Burkholderia xenovorans LB400
MRNTQFTQISRSFVVNIPDASVWRARAQEIRPEGRAFIDGNYVGALSGRTFATVNPATGQVIAQVAECGEEDVNLAVASARKAFESGVWSRRAPAERKAVMLRFAQLMMEHREELALLESLDVGKPVANAYNGDIVSSATCIQWYGEAIDKLYGETAPAAPDMTTMIVREPLGVVAAVVPWNYPLSMASWKLGPALAAGNSVVLKPAEQSPLSAIRIAALAMEAGLPAGVLNVLPGYGETAGRALGLHMDVDAVGFTGSTAVGKLFMQYSGQSNIKRVGLECGGKSPHIVLDDCADLDAAARAVAAGIFGNSGQVCNAGSRLIVQAAVRDELLEKVAAIARELVPGDPLDPATKMGAIVSDVQHASIMSYIDAGRADGARVVAGGRAARPESGGYFIEPTVFDGVNNDMRIAREEIFGPVLSAITVDSPEEAVRVANDTIYGLAAAVWTSNVTRAQQVSRQLKAGVVWVNCFDRGTMSSPFGGFKQSGFGRDKSMHAFDKYMDWKAIWIAG

SEQ ID NO: 49138 - protein, 611 aa, Geobacter sulfurreducens PCA
MCGIVGKYYFNKNAGDSSDIDAMMQAIYHRGPDSSGKYINGRAALGFQRLSIIDTVSGHQPLYNETKTIVLLANGEIYNYKEFVPFLESKGHVFSTRSDCEVIIHLYEEYGIEFISKLNGMFAFCLYDTRNDVMFIARDRVGIKPLYYHLNKEAIIFGSEIKGILASGEVVTEEANDCLAEYLCFRYVANFRTFFSSVNALEPGTYIKISPNGCTFEKFWDLSKYVLNYAQDGDLVETVDAALTASVQRQMMTDVPLGTQLSGGVDSSLVSKLAAGYSPGLKTFTVSFFESAYDESAYARLLADSAGLEYHQIRVDGKTFADTLPKVIWYHDEPLCHANSVHMYLLCTYARQFVTVLLTGEGADELFAGYPRYQICRFGDAYNKLNPSVASLVKSVLKGVPARKIVKIVDNLGLGARELALWNSSFTTKEKVSWLLDSGDVTLDARSALVDSVWNDELSLFDNLLLYEQKSYLQPILMRQDKMSMAASVESRVPVLDNEMLDVANTIPYQYKVRHFTPKHVFKKVAERHISRKIVYKKKVGFGVPVDEWLRDHSGLGRYLDLLLDTARGINGVSRPRIEQLIAEHASRRYNHGDVLWPLVNYAIWREQFFK

SEQ ID NO: 49139 - protein, 368 aa, Streptococcus agalactiae 2603V/R
MPKKTDTPAYKPSIYSLTRDELIAWAIEHGEKKFRASQIWDWLYKKRVQSFDEMTNISKDFIALLNENFVVNPLKQRIVQESADGTVKYLFELPDGMLIETVLMRQHYGLSVCVTTQVGCNIGCTFCASGLIKKQRDLNNGEITAQIMLVQKYFDERGQGERVSHIVVMGIGEPFDNYTNVLKFLRTVNDDNGLAIGARHITVSTSGLAHKIREFANEGVQVNLAVSLHAPNNDLRSSIMRINRSFPLEKLFAAIEYYIETTNRRVTFEYIMLNGVNDTPENAQELADLTKKIRKLSYVNLIPYNPVSEHDQYSRSPKERVEAFYDVLKKNGVNCVVRQEHGTDIDAACGQLRSNTMKRDRQKAKVGQ

SEQ ID NO: 49140 - protein, 282 aa, Moorella thermoacetica ATCC 39073
MSVTIPEDIHFNAEGLIPAIIQDAASGQVLMLAYMNRESLARSLATGETWFYSRSRRELWHKGATSGHRQYIESASYDCDADALLFKVRQVGVACHEGEFSCFHNPLPLQVSRPRETGAGGDAQAAGAPRGAAFPLPEGVGKAANKGEAGRVVTTTAGEQQEAGSYCDHTSGQEKQGRREGNTSSQVNADLGTILSQVFQVIKERQATRPEGSYTAYLFNNGQDKILKKIGEEAGETIIASKNDSRHEILYEMADLYYHTLVLLAYHGLEPEQLAAELAARR

SEQ ID NO: 49141 - protein, 395 aa, Candida glabrata CBS 138
MMLNSRLAFASISRNFGLARRSIASLDASKLKVTKKTPPSQPRPNDELVFGQTFTDHMLTIEWTKEKGWDIPEIKPYGNLTLDPSSCVFHYAFELFEGLKAYRTPDNKITMFRPDMNMIRMNKSAARICLPTFDSEELIKLMGKLIEQDKHLVPTGTGYSLYIRPTLIGTTNGLGVGTPDRALLFVITSPVGPYYKTGFKAVRLEATDYATRAWPGGVGDKKLGANYAPCILPQLQAAERGYQQNLWLFGPEKHVTEVGTMNVFFAFKNSVTGKKELVTAPLDGTILEGVTRDSILTLTRQNLDPNEWEINERYYSINEVAERAAKGELLEAFGAGTAAVVSPIKAIGWQGKDIDVPLIPGEQSGPITKQVAQWIADIQYGRVKHGNWSRVVAQL

SEQ ID NO: 49142 - protein, 196 aa, Moorella thermoacetica ATCC 39073
MSREALIERQTTETNIRLKVALDGSGTWQGSSGIPFFDHLLAQMARHGLLDLKVWAEGDLEVDNHHTVEDIGICLGQAVKKALGDKKGISRYGSALVPMDEALVLVALDFSGRPYLAWGLELPPGRIGSLETELVEEFLRAMVNNSGLTLHVRQLAGHNAHHLAEALFKALGRAIRQAVTLDPREQGIPSTKGILS

SEQ ID NO: 49143 - protein, 184 aa, Oryza sativa
  misc_feature (114)..(114): Xaa can be any naturally occurring amino acid
  misc_feature (121)..(121): Xaa can be any naturally occurring amino acid
  misc_feature (147)..(147): Xaa can be any naturally occurring amino acid
MALAGHAHPHSPAASSPRRPPQPRSSPGSGSRHPLFACLVFSGATALHPPRPHPCGCAARPVEAPAAAAPTAQGRAAAPRLQAISAAIRVVPHFPKPGIMFNDITALLLRPAVXKDAVDLXVARYRGLRIADSAGIEARGITLAPRXALAIGATFIPSSHTQQLPSAVHSAHYTLSMAGMAAQL

SEQ ID NO: 49144 - protein, 437 aa, Candida glycerinogenes
MSTVTKVFARSVYDSRGNPTVEVELTTAEGVFRTIVPSGASTGVHEALELRDGDKSKWLGKGVTKAVDNVNKIIAPALVEAKVPVTEQLKIDQFLINLDGTPNKGKLGANAILGVSLAVAKAAAAYEKVPLYQYIHKISGSKDAYVLPVPFMDVVNGGSHAGGSLAFQEFMIAPTGAESFSEALRMGSEVYHHLKSLTKKTYGQSAGNVGDEGGVAPDIHTPQEALDLIMSAIKAAGYEGKIDIAMDSASSEFYKNGKYDLAYKDPNSDGSKAITGSQLGDLYAELCKNYPIVSLEDPFAEDDWETWTNNFEKLPVQIVADDLTVTNPQRIKTAIEKKAASALLLKVNQIGTLSESIQAANDSFAAGWGVMVSHRSGETEDTFIADLTVGLRTGELKSGAPARSERMAKYNQLLRIEEELGDKAVYAGKKFRTAHEL

SEQ ID NO: 49145 - protein, 156 aa, Crocus sativus
NCNTTHYRANWVPGPPLEEAENERMHLMTFMEVSQPRWYERALVMTVQGSLLQCLLPRKPHLPKVCFIGVVGYLEEEAIHSYTEFLKELDKGSIENVPAPAIAIDYWRLSKSATLRDVVMVVRADEAHHRDVNHFASDIHCQGHELRVHPAPVGYH

SEQ ID NO: 49146 - protein, 769 aa, Bacillus anthracis str. A2012
  misc_feature (226)..(226): Xaa can be any naturally occurring amino acid
  misc_feature (714)..(714): Xaa can be any naturally occurring amino acid
MFGEKEGDYTMNTPTQTPSLSETMKEWHYALAYEIKHWKTIGGSKISIMNGRFLYTDYESTVYVFQLISEVSLPEGSPIRIEFDGEEATGEVLSVHGLEIELKLNDYIQGEIREAVLYSEPWQLLEQLQERLKEARKDKLKRNRIKRLVDGTSSPKHIEKMKNPKNELAYRAFYNPTTYVWGPPGTGKSYNLSRIISAHYQKGKSVLVLAHSNAAVDVLMSEVTKXIEKKKKWTPGEIVRYGYSQHEHIRNHETLLASKLVETTNGSWGEERLYLEETRQELREKILSYKATSADKKRMQEIESDLRKQRAKIKEVEKEYIENAKVIGATLSKCAIDSLIYERTFDLVVVDEVSMAFVPQIALAASLGKRIVVCGDFLQLPPIAMANHELVRKWLGEDMFYHAGIVESVNKSEAHPNLFMLQEQRRMHADISKFTNSFIYKNRVYDHPSVSERKELAQLQPFANEASVLFDTSQMGAFSLKDAASGSRFNIMSGLVAMQMMLIGLLDGVQSIGIVTPYRAQSRFLSTCIREMLQRTKYQNIPVLAATVHKFQGSERDMMIFDTVDSYPQERPGVLFFDHKNHRLVNVAVTRARGKFIQLSDCHYMCKNLSRKQALSQLTAHIERHGDVYDRTTSRQLWERKISKRLRWFMEMNLEEPKGLLKDILAAKRKIVISLPSTKQVDKRVWQALMRTNAQITVYSDGPVPLKNVKLQRXNKAFPFIVIDDEIFWAGAPLTSQMMFEGSTEFPYVCARLQAPETIGVLKGFLDIR

SEQ ID NO: 49147 - protein, 494 aa, Gibberella zeae PH-1
MSPQEYENPPQIKFESSPSNSHYRNPSNTSVPNVLQPAGSQRNISNTPLGLADIRPRADSSMSDGTGAAMAYDANNAQPGTSNYLAPWAIYAFDWCKWPAQGNSAGKLAVGSYLEDGHNFIQILDSHITPTPQDIYTPGSSKFSLEFTKAAEATHSYPVTRLLWEPPSSQKQSTDLLATSGDHLRLWSLPSENPSTPSGTIGRRDNVTTKLTPLALLSNSKTPDHTAPLTSLDWNTVSPSLIITSSIDTTCTIWDIPSLTAKTQLIAHDKEVYDVRFCAKSVDVFVSCGQDGSVRMFDLRSLEHSTIIYEPTGKEERDPNGGRVSPTLAQQTMSNPPPLLRLATSPHDTHLLATFAQDSNAIRILDVRQPGQALLELRGHAGNINSIEWSPHRRGMLASGGDDCQVLLWDIYNSGQPINGAPQQDNPRSPVASWQCDYEIGNLGWVPQLPNSEYGEWLGIGAGRGIWGTRVSKAWAGREGGSIERIFHWRLALE

SEQ ID NO: 49148 - protein, 370 aa, Oryza sativa (indica cultivar-group)
MALFKPLHLPPLFAAAAAAAGPRPLSLSARPLYRQQDPLFLASRVASPAPPPPSATADGARPVEAAPAGAAPEEAARRAKIGVYFATWWALNVIFNIYNKKVLNAFPYPWLTSTLSLAAGSAIMLASWATRIAEAPATDLDFWKALSPVAIAHTIGHVAATVSMAKVAVSFTHIIKSGEPAFSVLVSRFFLGEHFPAPVYFSLLPIIGGCALAAITELNFNMIGFMGAMISNLAFVFRNIFSKKGMKGKSVSGMNYYACLSMLSLAILLPFAFAMEGPKVWAAGWQKAVAEIGPNFVWWVAAQSVFYHLYNQVSYMSLDEISPLTFSIGNTMKRISVIVASIIIFHTPVQPINALGAAIAILGTFIYSQV

SEQ ID NO: 49149 - protein, 238 aa, Methylococcus capsulatus str. Bath
MQESDSKGKDECEVEGICCDLERFISGVKGFKERFYRRYPEHMQQLVERGQRPVALMIACSDSRVDPALLMNVAPGDLFVVRNVANLVPPYHGSSAPDGVGAALEYAVRHLHVPHVIVLGHAQCGGIKALLDMATGAEFESDFIGEWVSMAMEACWQYVPDASGEGLRRVSLERLKDYSYLVERAAIQGSLGNLLTYPWVREAVEKERLFLQGWWFDLESGDLWVTSGDNSQFLPVTD

SEQ ID NO: 49150 - protein, 370 aa, Oryza sativa (indica cultivar-group)
MALFKPLHLPPLFAAAAAAAGPRPLSLSARPLYRQQDPLFLASRVASPAPPPPSATADGARPVEAAPAGAAPEEAARRAKIGVYFATWWALNVIFNIYNKKVLNAFPYPWLTSTLSLAAGSAIMLASWATRIAEAPATDLDFWKALSPVAIAHTIGHVAATVSMAKVAVSFTHIIKSGEPAFSVLVSRFFLGEHFPAPVYFSLLPIIGGCALAAITELNFNMIGFMGAMISNLAFVFRNIFSKKGMKGKSVSGMNYYACLSMLSLVILLPFAFAMEGPKVWAAGWQKAVAEIGPNFVWWVAAQSVFYHLYNQVSYMSLDEISPLTFSIGNTMKRISVIVASIIIFHTPVQPINALGAAIAILGTFIYSQV

SEQ ID NO: 49151 - protein, 243 aa, Castanea mollissima
MGRGRVEVKRIENKINRQVTFAKRRNGLLKKAYELSVLCDAEVALIIFSNRGKLYEFCSTSSMLKTLERYQKCSYGAVEVNKPGKELEISYREYLKLKARFESLQRTQRNLLGEDLGPLNTNDLERLERQLDSSLKKSGPLRQYMLDQLSDLQNKEHLLVEANRALAIKLDEISPRNNLRQSWEGGEQSMSYGPQNAHSQSFFQPLDCNPTLQIGYNASGSDQQLSGTTHAQQVNGFIPGWML

SEQ ID NO: 49152 - protein, 361 aa, Synechococcus sp. RS9917
MPTVLALETSCDESAAAVVRQNGSRLEVLAHRIASQVEEHAQWGGVVPEIASRRHVEALPTLVDEVLEHSGLGIDALDAVAATVAPGLVGALMVGSVSARTLAALHGKPFLGVHHLEGHLASVLLGATPPTPPYLVLLVSGGHTELIQVAADGAMTRLGRSHDDAAGEAFDKVARLLGLPYPGGPAIQALAAQGDASRFSLPKGRVSRREGGFHPYDFSFSGLKTAMLRQVDACKAELVDGDAAAAVWADLAASFEQVVADVLVERSLRCCRDAGLHHLVLVGGVAANLRLRREMSQRAAACGVQVQIAPLEFCTDNAAMVGAAALQRLRGAQGFSSLRLGVSARWPLEQAEALVSTVAPF

SEQ ID NO: 49153 - protein, 227 aa, Oryza sativa
  misc_feature (20)..(20): Xaa can be any naturally occurring amino acid
MDCQRLDVAKDCIGVLSKQXFPGSMRVGRLEALLFEAKGEWTDAERAYALILENNPFDQIVHKRKIAIAKAQGDMALAVEYLNKYLELFMADHDAWRELAETYVALQMYKQAAFCYEELILAQPTVPLYHLAYAEVLYTMGGLENLQTARKYYASTIQLTGGKNTRALFGVCLCSSAINQLTKGRNKEEESSELQSLASEALLKDYKQRAPSKEALITSLLKNMKLS

SEQ ID NO: 49154 - protein, 512 aa, Clostridium perfringens ATCC 13124
MSKKPVMLMILDGFGISPNKEGNAVAAANKPNYDRLFAKYPHTELQASGLEVGLPEGQMGNSEVGHLNIGAGRIIYQELTRITKEIKEGTFFTNKALVKAMDEAKENNTSLHLMGLLSNGGVHSHIDHLKGLLELAKKKGLQKVYVHAFMDGRDVAPSSGKEFIVELENAMKEIGVGEIATISGRYYAMDRDNRWERVELAYNAMVLGEGEKASSAVEAIEKSYHDNKTDEFVLPTVIEEDGHPVARIKDGDSVIFFNFRPDRAREITRAIVDPEFKGFERKQLHVNFVCMTQYDKTLECVDVAYRPESYTNTLGEYVASKGLNQLRIAETEKYAHVTFFFNGGVEQPNTNEDRALIASPKVATYDLKPEMSAYEVTDELINRLDQDKYDMIILNFANPDMVGHTGVQEAAVKAIEAVDECLGKVADKVLEKEGTLFITADHGNAEVMIDYSTGKPMTAHTSDPVPFLWVSKDAEGKSLKDGGKLADIAPTMLTVMGLEVPSEMTGTCLLNK

SEQ ID NO: 49155 - protein, 450 aa, Salmonella typhimurium LT2
MTKHYDYIAIGGGSGGIASINRAAMYGQKCALIEAKELGGTCVNVGCVPKKVMWHAAQIREAIHLYGPDYGFDTTINQFDWSKLIASRTAYIDRIHTSYDNVLGKNNVDVIKGFARFVDAKTIEVNGETITADHILIATGGRPSHPEIPGVEYGIDSDGFFALSALPERVAVVGAGYIAVELAGVINALGAKTHLFVRKHAPLRSFDPMISETLVEVMNAEGPQLHTHAVPKAVVKNADGSLTLELEDGRSETVDCLIWAIGREPSTDNINLAAAGVKTNEKGYIIVDKFQNTNVEGIYAVGDNTGAVELTPVAVAAGRRLSERLFNNKPEEHLDYSNIPTVVFSHPPIGTVGLSEPQAREQYGDEQVKVYKSSFTAMYTAVTTHRQPCRMKLVCVGPEEKIVGIHGIGFGMDEMLQGFAVALKMGATKKDFDNTVAIHPTASEEFVTMR

SEQ ID NO: 49156 - protein, 276 aa, Oryza sativa (japonica cultivar-group)
MAATAAASVAAISPLPGASLPRPVSARVPLLPRASPPTWRLSVGSARARSTRCLAAAGGGGLAPEMRATLDKVVGSHKVVLFMKGTKDFPQCGFSHTVVQILRSLDVPFETLDVLANEALRQGLKEYSSWPTFPQLYIDGEFFGGCDITVAGFERFGACCLLRIFSVNKTTTRAWPPTRASDLVKTILVDSAAVNAHLRELLHLHGVGAVVLLREVVHDAARHHVVHRRNLSIHGADGHFVFMRDGGVLQLDIHDAGARRAALSRGEATQWPEASN

SEQ ID NO: 49157 - protein, 544 aa, Haemophilus somnus 2336
MKFNDIKRLYKIVRVFLSYGIDEILPHNKYTRSIRCWRMLFFWLKNKHNNKAFGLRLRLALQELGPVWIKLGQMLSTRRDLFPAEIADELALLQDNVEAFSGKIARQQIEQALGSSLENWFTDFDENALASASIAQVHTAKLKLGEEQEKEVVIKVLRPNIQPQIEADLSWMYKLAGLLPKLFREGYRLRAVEVIQEYEKTLRDELDLRVEMANAIKLRENFLDSPMLYIPKMYEAFCHKNVIVMERIYGIPVSDVETLQRNGTDMKLLAERGVQVFFTQVFRDSFFHADMHPGNIFVNPLRPENPQYIGIDCGIVGKLNESDKRYLAESFVAFFNRDYRRVAQMHVDAGWTPQDTNIDDFEQAFREVCEPIFAKPLSEISFAQVLLNLFNVAREFNMQVQPQLVLLQKTLLYIEGLGRQLYPQLDLWDTAKPFLQNWLNEQIGMKATFKKLKAKLPYLQEHLPDFPETLMDALKQQKFISQQLVEINKKLAKQQRWQKKMFVLIVGIVIFSVTLWQFAALPLAISAGLFLVGFLVWLIGFLLP

SEQ ID NO: 49158 - protein, 177 aa, Citrus unshiu
MSSRERDPLIVGRVVGDVLDNFTRTIPMRITYSNKDVNNGRELKPSEVLNQPRAEIGGDDLRTFYTLVMVDPDAPSPSDPSLREYLHWLVTDIPATTGASFGQEIVNYESPRPTMGIHRFVFVLFRQLGRQTVYAPGWRQNFSTRDFAELYNLGPPVAAVYFNCQRESGSGGRPVRR

SEQ ID NO: 49159 - protein, 402 aa, Oryza sativa (indica cultivar-group)
MDHEADAYRTDLMTITRYVLNEQSRNPEARGDLTILLSHIVLGCKFVASAVNKAGLAKLIGLAGETNVQASVPGNNCHLSQFLVSEIEIGEEQKKLDVLSNEVFVKALVSSGRTCVLVSEEDEEATFVDPALRGKYCVCFDPLDGSSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRYTLSLLSASHFAYGTSNFILINNSEFTKSWNYSVLYEVFPMSFLMEQAGGQSFTGKERALDLVPTKIHERSPIFLGSFEDVEEIKGLYAAQANVIVLRPGTAS

SEQ ID NO: 49160 - protein, 417 aa, Oryza sativa (japonica cultivar-group)
MHSRHQRLASLTKLLTSHVNVGRHRDALAFFSRMVSDPSLPPLSDPSFAYAFPLALKSSSALRLPSAAAAADSLHALAAKCGFLSSPFFASALVASYGACASPALARRLFDELPHRNAIVCSAMISVHIRSGDLAGALRELDLMDVAPTASCFNSVIAAVAESGEHPARAIDLYRRMQRMGVLPSLITLLALVPSCTALGALSSIKEVHGFATRHGMFASCHLGSSLIEAYGRCGSLAGARNVFDQVQERDVVVWSSIVSAYAFHGHADVAMSLFRHMELDNVRPDGIMFLGVLKACGHAGHADDALKYFDVLTKIFGVEACGDHYSCLVDVLGRAGRLRQAYDVIQTMPVKVTAKAWGALLAACRKYGEVGLAEVAGRALFEIEPENAGMGMHDKAEQVRREMEQRVNCSERGNTL

SEQ ID NO: 49161 - protein, 175 aa, Glycine max
MSAYKDQDPRLHGIKTKIRVVPNFPKSGLMFLDITTLLLDPKAFKDSIDLFVERYKGKNISVVAGIEARGFIFGPPIALAIGAKFVPLRKPKKLPGKVISQEYILEYGRDCLEMHVGAVDDLIATGGTLCAAMDLLERVGAEVVECACVIELPELKGRERLNGKPLCVLVEYVDI

SEQ ID NO: 49162 - protein, 476 aa, Geobacter sulfurreducens PCA
MTSDIKAILEQVVISPDVPIAEAIAQLDRAGTGSLVVCSADKKLYGLLTDGDVRRALLKAVDMGAPCGDIANRKPVITFVPLLPIEALRLMNHHDINHLPVLDAEGRVVDFLLRRDLVAEDELAARARRRLDSVVIPCSASIAEAIAQLDRAGTGALVLCSEGDRLHGLLTDGDIRRAVLRGISLDAPCQDVASRRPVTVEPSFSAAQALHLMNQHDINHLPVVDDTGRVVDFLLRRDLIADDQLNLSAVVMAGGYGKRLLPLTEQVPKPMLPVGDRPLLERTIDQLRRSGIREVNLTTHYLPDSIVEHFGDGDSFGVKLNYLKEDHPLGTAGGLKLMKKASDPFLVMNGDILTGVPFQEMFAYHRKNGAEITVGVRKYEVQVPFGVVECDDVRITGLKEKPSLTFFINAGIYLLEPSVCDLIPEGERFDMTDLIQKLLDEGRSVVSFPIMEYWLDVGRHEDYQKAQEDVRSGKIQ

SEQ ID NO: 49163 - protein, 340 aa, Arabidopsis thaliana
MLRLFRKKKKQKKEEEINLQKNGSLLLEELIATSGGIYNPIRTFSSDQILQATNHFDWNYVISEDRFVWYKGMIENRPVLIKKFQDCSVFDADNFYRDIAVSSLMSSHKNVLKLLGCCLEFPRPVLVCEYPEHGALNCIRCGKEGVRSFPWNVRLRIAKEIADAVAYLHTEFPRTIIHRDLKLANIFLDENWSAKLSSFSLSIVLPEGETGVNDMVCRTSSYIEPDYFNTGLVTENVDIYSLGIIMLIILTGKSEYNSEVAVYLPVLPVYVGKFLERGLLTELIDPSILDSTSDDIPKHSRLQMEAFIELAFRCVRFRPGENVPRMIDVAKELKKIEKHI

SEQ ID NO: 49164 - protein, 162 aa, Arachis hypogaea
LFGLALGGQITILTAIFYIISQLLGSIAACLLLKLVTGGLTIPIHNVGSGVGAGEGVVAEIIVTFGLVYTVYATAADPKKGSLGTIAPIAIGFIVGANILAAGAFSGGSMNPARSFGPAVISGDFTNHWIYWVGPLIGGAVAGLVYSFFYMPTEHAPLAGDF

SEQ ID NO: 49165 - protein, 500 aa, Oryza sativa (japonica cultivar-group)
MEPWAIRVAYFIVFSFLVTARFGSCAPHSEEGRALPGYRESEQDQSIGSLSNWGEGKLIGRVFNLLLKENMFASETPSESKEHSSISESVPHDSAGFEPCRKCLAKTVHNATPRRLLQARELASNQTQTHPKSQSSPVQSSASHLVPRWAIYALPVAGVLFIAAVATAIYVFFSRRKKDNTVMPWATGLSGQLKKAFVTGVPSLERTELEAACEGFINVIGTLPECTLYKGTLSSGVEIAVLSTSVNSSQQWSAQSEEQFRNKISVLSRVNHKNFMNLIGYCACEEPFTRMMVFEYAPCGSLFEHLHIREAEHLDWKTRLRIIMGVAYCLEHMSQLDPPPLLPTNLSSSSIYLTEDNAAKIADIEFWKDDINKQDDQESVVYKFGILVLEVISGRRPFSEDDRLLVLWASSYLDGKRPLSAMADRTLVRSSSAAPEKDVAALCDVVRQCVRRPEAGKRAISMGEVARLVRGIAGLSPEQAAPREKPLWWAELEIASSETA

SEQ ID NO: 49166 - protein, 510 aa, Thermoplasma volcanium GSS1
MPSATLKREIHILLKLYPVFRRYLKDRKRAKENDEWDYEIQRNGELAVKAFMDLGPTFIKLGQVLSARPDLMPKEYLAAFRKLQDQVDPDPFPLVKQIIERNLGKIDQVFDEFDENAISGASLGQVYRATYKGRLVVVKVNRFNIEDRLKSDLIAIRRLLKHAKGRIENFLYLSIENVIMDFNKRIFDEIDYRKEVSNMNLIRSNLHEDDRVIIPQVIEGLSSKEVLVMEYISGTKIDNVQILKEKNIDTKELALRVDTVFMRMLLKDTIFHADPHPGNISVADDGSIILYDFGMVGFINDDLRFKLLLLYDGLLNKDSDEIIDALLSLGALSPAANRGIVKRGIDMAIANFYGRTPEDLEIRELLDVANDVIFQFPFRLPRALVLYMRMSSLLEGVCQQLDPDFKFIRVLQKLLYDEGLIQTLYKKRLTNFLDDTLISLEKAVQLVPLLKRKLEYEEEPIKRKDYKIPASIFLGFLLLSFFQMEKIHPITSSILIAIDAILFIYIIIKK

SEQ ID NO: 49167 - protein, 169 aa, Synechococcus sp. RS9917
MAADPNETTAQETAAEVATAASEASATAGDQSGAEAPAPKAETPAAAAVAKLGPEALIREFEAAQLKSDLPDLYVGDTVRVGVRISEGNKERVQPYEGVVIAKRHGGINATITVRRIFQGIGVERVFMLHSPQVASIKVERRGKVRRAKLFYLRERVGKATRVKQRFDR

SEQ ID NO: 49168 - protein, 310 aa, Clostridium perfringens ATCC 13124
MNKICVLGSMNMDLVLKVKDMPKVGETILSKSFQKIAGGKGANQAVAAKRSGAEVFMISKIGKDENGRELRDKLVEDNIDVKYVFEDRIEPTGMALIMVNDNGNNSIIVNAGSNMTLTKDEIHSAENLIKESDIIISQFETPEDITIEAFKIAKENGKVTILNPAPAKKIKDELLNYTDIIVPNETEAELLTGIEIKYIEDAKKAGDIFLGKGVKFAIITLGEKGAALIGKDFCEIVPAYRVNAIDTTAAGDSFIGGLSSKLDTKNLGRETLSSSIRFGNKVSSIAVQRKGAQPSIPYLKEVLEVYKGEE

SEQ ID NO: 49169 - protein, 708 aa, Suaeda japonica
MAVSTIALYASPPSSVCSTPHPCSINSHSTSYDFDLSGRSPSTSSQSSSSTSQRPIIGGLSCLLKHSSSLATNDDFQKVGIDDHHHHYCNLSSSFRYSNCSSLSSSLKRDIQSPVSVLQGPVSVSSSCNSVASGSFSGSNSFRVNNTTNLLLNGFVRNSLGSCLDHDVEELTFNMEDHFVFGDAVEELLASAQIRHKIFYDQFVIKAFYEAEKAHRGQVRASGHPYLHHCMETAVLLASIGANATVVAAGLLHDTIDDSFVTYDYILNIFGSGVADLVNGVSKLSHLSKLARENNTASKTIEADRLHTMFLAMADARAVLIKLADRLHNMMTLDALPSHKQQRFAKETLEIFAPLANRLGISTWKEQLENLCFKHLYPNQYDELSSKLVKSFDQARIQSAIDKLEEGLKDEDLSYHDLSGRHKSLYSIHCKMSKKKLTMDQIHDIHGLRLIVENEDDCFRALKVVHQLWSEVPGKFKDYIHCPKCNGYQSLHTVVVGEGMVPLEVQIRTKEMHLQAEYGFAAHWRYKEGESKHSSFVLQMVEWARWVVNWQCETMNKDRSSFGYVDSLKSPCKFPTHSEGCPYSYNPQPNHDGPVFVILIENEKMSVKEFPLNSTMMDLLEATGHGSPRWTTHGFPVKEDLRPRLNHFPVSDPTCKLKMGDVIELTPALPDKSLIEYREEIQRMYNRGLSVSTPAPAATNTSVAGWRS

SEQ ID NO: 49170 - protein, 264 aa, Solanum tuberosum
MCGGAIISDYEPAGNFYRKLSARDLWAELDPISDYWSSSSSSSTVENPYSAQSPVTHSVDKPKKSDSGKSNQLKKGNKTVKVEKEKSTGPRQRKNKYRGIRQRPWGKWAAEIRDPQKGVRVWLGTFNTAEDAARAYDEAAKRIRGNKAKLNFPAPSPPAKRQCTSTVAADPPPALLLESSNIISYNNSPLMNFGYDVQSQTPYYPMEMPVASDDYELKEQISNLESFLELEPADSSDQFSGIVDPDPLNVFLMEDFASTQHQFY

SEQ ID NO: 49171 - protein, 332 aa, Buchnera aphidicola (Acyrthosiphon pisum)
MTIKVGINGFGRIGRVLFRLAQKRSDIEIIAINDLLAPEYIAYMLKYDSTHGVFKKHITFDKDNIIINGKNIRVTSIKDPEKLMWHDLSIDVVIESTGLFLKREQAYKHILAGSKKVVVTGPSKDDIPMFVRGANFHKYQGESIVSNASCTTNCLAPLSKVIDDNFGIIEGLMTTVHASTATQKIVDGASDKDWRGGRGALQNIIPSSTGAAIAVGKVLPNLNGKLTGMAFRVPVSNVSVVDLTVRYKKSATYSEICQKIQQASQKEMKGIMGYTEDEVVSTDFNGEELTSIFDAKAGLSLNKNFVKLIAWYDNETGYSSKVLDLVSLVSKK

SEQ ID NO: 49172 - protein, 368 aa, Aspergillus nidulans FGSC A4
MTIDPVPVKPWTRPPPTTEDLDWAPLAKIDLSRFNEPGGKEALAKQLYDALTRVGFWVVVGHGIDDERVLRQFSFGNAFFEQPLEEKRVFPCNFALGEYFGYRENERWIGDTGVKDNIEMLNIPKAIPEWDHLPRHRIVRENYEEIASFHRELFDKVARKLFVLMSIILDLPENFLANAHAYDKRSDDHLRYMIYNVRSQEEWDRAQVYTKGGHTDFGSLTLLFSQQVAGLQIRTPEGKWKWVKPVEGGITCNAADTLTFLTKALTDAGFIKSTVHRVVTPPRDQINIPRLGLLYFVRPGDSTIMKPVPSPLLDRLGLLTDEDKDPNIPAPTGTEKQEEVVECNRAGQLGLEKMYIVSVAVLISKYAT

SEQ ID NO: 49173 - protein, 426 aa, Prunus avium
MAGICCGVVGEAEASTTIEASSRNSRRRRLELLPLKYIADMAVKPSTVENSRKRQKIDLYRSSSSVPHNAVESSSEAKSKSESEGSKLNATVRFGDDDFDAVNTRGDHQESKSVRVDNEAVQVQALQGSPRFGMTSVCGRRRDMEDAVSIHPSFYQNDGPDSNGAHFYGVFDGHGCSHVALKCKDRLHEIVKQELETEGGYIQWKGAMERSFAKMDDEVQEGNLVAQGPNCRCELQTPQCDAVGSTAVVAVVTPEKIIVSNCGDSRAVLCRNGVAVPLSSDHKPDRPDELVRIEAAGGRVIYWDGARVLGVLAMSRAIGDNYLKPYVISEPEVTIMDRSAEDECLILASDGLWDVVSNDTACGVVRMCLRAQKTTSHSESSGRDAAVRSDKACSDASILLTKLALARQSSDNVSVVVVDLRRPGRC

SEQ ID NO: 49174 - protein, 583 aa, Ustilago maydis 521
MAAATAHNFGLSALVSYLYQWIQILIAYAFAPKLPSQQVKQKPLGHVAVIGAGITGISTASHLIGHGFEVTIFDQAEEIGGIWSRVNSTSGLQISSIMYRFHPAVKWTQAYPHRDEILKNTQKIWKMYELDKRTHLGFKVENVTRHSSSTDPHEHGHARWVINGNENEVFDGIVVSTGTCGKPKKMDLPGEEKFKGKIVHSSQLDGLDCKGKKVLIVGGGASGIEALELAVAQGADRPTILARSDKWIIPRNTIINCALALQPFGRETWLSFIPEFLLKKLHYRDLEQKMAPTKGFYTETPIVNTSALRHIRKGEADYQRGDVLDLDESGIHFNLRKRGQKKGSDGKKIHYEADIIVVATGFEVPSIDFLPQDLFPEDYVRPNMYLQVFPIEDCSVLCTNSTFRNAVGTVGHIHIGIMARTLMLFLMDKSTRPKPRDMRLWVDMIRFIKDRAPGGQLDFFTYMELCIWLISFLFFRFNRLYYFFFVSFGWGFWSREDKADKSGTLVGEPKFHLSIIFYWLQRLAIWLSFRLDSARMTVAPLGKELVTCFEWTIKRLLQNLERLQAIPPAVDAHAQNGIVIVAS

SEQ ID NO: 49175 - protein, 466 aa, Bacillus anthracis str. Ames
MKTVVVIGGGITGLSTMFYLEKFKKDNNIDLNLILVEKEEYLGGKIHSVEEKDFIMESGADSIVARNEHVMPLVKDLNLEGEMVYNETGISYIYSDNTLHPIPSDTIFGIPMSVESLFSSTLVSTKGKIVALKDFITKNKEFTKDTSLSLFLESFLGKELVERQIAPVLSGVYSGKLNELTMASTLPYLLDYKNKYGSIIKGFEENKKQFQSAGNKKFVSFKGGLSTIIDRLEEMLTETVVKKGAVTTAVSKQGDRYEISFANHDSIHADYVVLAAPHDIAETLLQSNELNEQFHTFKNSSLVSIYLGFDILDEQLPADGTGFIVTENSDLHCDACTWTSRKWKHTSGKQKLLVRMFYKSTNPVYETIKNYSEEELVRVALYDIEKSLGIKGEPEVVEVTNWKDLMPKYHLEHNQALQTLQEKMMNLYPNIYLAGASYYGVGIGACIGNGKNIANEIIATLNEPSN

SEQ ID NO: 49176 - protein, 401 aa, Mycobacterium sp. JLS
MPVDRQLANILVVGTGVAGMRAAETLRLDGYRGELTVVGAERHAPYQRPPLSKKLLSGAVHRAGADLAPRMDLEARVLRGASVRELDMSTRTAHLRDGSDDVSVPFDGLVVATGAAARQWPDGPVPDGVMALRTVDDCLAIRERLESRPRVVVVGGGFIGAEVAATCRSMGLSVTLIEKSSAPMASALGEEMAACWERLHRGNGVELRSGVGVESFAGDDRVEAVHLTDGTRLPADLVVIGLGVTPSVDWLSGSDLRIDNGGVVCDATGAVEGVTDVVAAGDVASWWHPRYERYLRIEHWEHAERQGVAAAHTLLAGPERAQEFDALPYFWTDQYDVKMQMLGVPDGYDSVAVVEGSPDRWDFVAAYGRDGRVIAVLSTIPGRVHAYRDAVFGAFPPAPPG

SEQ ID NO: 49177 - protein, 345 aa, Candida albicans SC5314
MGQLLSHPIEEKELDYKSYTNLTYCIGSMQGYRMTMEDAHDVKINEHENLAVFGIFDGHGGKNCSQYLAEHLPKLVFTKLNKIASAVYLKQVKDIDLKDVFDILKNSFFKIDKDLSHHANMVNCGSTATVVTIIANYIVVANTGDSRCIVSRNGHAKPLSFDHKPSNMGERVRIENSNGYILNNRINEVLALSRAFGDFKFKLPYLSSSRNKYIKENQKLLGDKLITLPPELFQVTVEPDIMLYDMQKLDSPEFLVIACDGVWDCFKNGQLVKLIRDKLSLGWRLNKIVEYILNDSLTMANNYTGIGFDNMTLIIVAIHKKEGETMDDWYESMKEKILKEKGITR

SEQ ID NO: 49178 - protein, 64 aa, Magnaporthe grisea 70-15
MTKCIYCGFCQESCPVDAIVESPNAEYATETREELLYNKEKLLSNGDKWEPELAATIRADSPYR

SEQ ID NO: 49179 - protein, 191 aa, Arachis hypogaea
AGCLFCMLRSLCAVLLVANISGGHVNLAVSFGLALGDQITILTAIFYIISQLLGSIAACLLLKLVTGGLTIPIHNVGAGVGAGEGVVAEIIITFGLVYTVYATAADPKKGSLGTIAPIAIGFIVGANILAAGAFSGGSMNPARSFGPAVISGDFTNHWIYWVGPLIGGAVAGLVYSFFYMPTEHAPLASDF

SEQ ID NO: 49180 - protein, 608 aa, Spinacia oleracea
MHHHHHHSSGLVPRGSGMKETAAAKFERQHMDSPDLGTDDDDKAMGCQKAVSPAAETAAVSPSVDAARLEPRVEERDGFWVLKEEFRSGINPAEKVKIEKDPMKLFIEDGISDLATLSMEEVDKSKHNKDDIDVRLKWLGLFHRRKHHYGRFMMRLKLPNGVTTSEQTRYLASVIKKYGKDGCADVTTRQNWQIRGVVLPDVPEIIKGLESVGLTSLQSGMDNVRNPVGNPLAGIDPHEIVDTRPFTNLISQFVTANSRGNLSITNLPRKWNPCVIGSHDLYEHPHINDLAYMPATKNGKFGFNLLVGGFFSIKRCEEAIPLDAWVSAEDVVPVCKAMLEAFRDLGFRGNRQKCRMMWLIDELGMEAFRGEVEKRMPEQVLERASSEELVQKDWERREYLGVHPQKQQGLSFVGLHIPVGRLQADEMEELARIADVYGSGELRLTVEQNIIIPNVENSKIDSLLNEPLLKERYSPEPPILMKGLVACTGSQFCGQAIIETKARALKVTEEVQRLVSVTRPVRMHWTGCPNSCGQVQVADIGFMGCMTRDENGKPCEGADVFVGGRIGSDSHLGDIYKKAVPCKDLVPVVAEILINQFGAVPREREEAE

SEQ ID NO: 49181 - protein, 366 aa, Triticum aestivum
  misc_feature (257)..(257): Xaa can be any naturally occurring amino acid
  misc_feature (308)..(308): Xaa can be any naturally occurring amino acid
MALLSPRVPRLPLAAHSAGAGVGSLLCCGRVAASAARCQVTASGSVAAGSSSSSELEAIRWGSAKLQGAREEMEDEVVLRPDSLLHGFSGVFAAVLDGHAGFSTVPFLRDELFKECAAPLDGGPVLNTKNLGAITDSFRRAFATMDANLSPWLQQMDKGDGSGPPATALFLRTDVLVVSPIGDSCLVISRGGRPQSLTNFHRPYRNNKTSLEEVKRIRAAGGWIRDGRVCGDISVSRAFGDIRFKTRKNEMLVKGVXEGRWTEKFVSRIKFKGDLIISSPDVSLVELGPDAEFVLVATDGLGDYFKSXLDRRSQDNISIVIADLGRTNWQELPVPRPNVLLELSQAVATVGAVSVGIWISSLLTLQ

SEQ ID NO: 49182 - protein, 413 aa, Brassica napus
EECFTKNDVVLANRPNTIASKYVSYDHTTMVTAPYGEHWRNLRRIGAVEIFSAHRLNKFLSIRQDEVRRLIVRLSQNSSHEFAKVEINSMFSDLTFNNIIRMVAGKRYYGDGAEENSEAKLIRQLIADLMNIFGAGNAADYVPILRWVTGFEKRVKELAGRFDEFLQGLVDERRSAKEKGNMMIDHLLSLQETQPEYYTDCTIKGTILSLILAGTDTSAVTLEWALSSLLNHPEKLRKAREEIDSKIGLDRLVEESDISNLPCLQSIVSETLRLYPAGPLMVPHVASEDYKVGGYDMPQGTTLLVNLWAMHRDLQLWDDPETFKPERFEKEGEAHKLMTFGLGRRACPGSGLAQRLVSLTLASLIQCFEWERTGEEEVDMTEAGGVTMPKARPLVAMCRTRTTLVGKIVHESA

SEQ ID NO: 49183 - protein, 468 aa, Pseudomonas aeruginosa PAO1
MNARLHATSPLGDADLVRADQAHYMHGYHVFDDHRVNGSLNIAAGDGAYIYDTAGNRYLDAVGGMWCTNIGLGREEMARTVAEQTRLLAYSNPFCDMANPRAIELCRKLAELAPGDLDHVFLTTGGSTAVDTAIRLMHYYQNCRGKRAKKHVITRINAYHGSTFLGMSLGGKSADRPAEFDFLDERIHHLACPYYYRAPEGLGEAEFLDGLVDEFERKILELGADRVGAFISEPVFGSGGVIVPPAGYHRRMWELCQRYDVLYISDEVVTSFGRLGHFFASQAVFGVQPDIILTAKGLTSGYQPLGACIFSRRIWEVIAEPDKGRCFSHGFTYSGHPVACAAALKNIEIIEREGLLAHADEVGRYFEERLQSLRDLPIVGDVRGMRFMACVEFVADKASKALFPESLNIGEWVHLRAQKRGLLVRPIVHLNVMSPPLILTREQVDTVVRVLRESIEETVEDLVRAGHR

SEQ ID NO: 49184 - protein, 272 aa, Kineococcus radiotolerans SRS30216
MTRQGSTLPARTSVATAANTTDTVSRSSASDTGASTSRRGLLRWGALLGGGTLLAACGSGEGEVVAGAAPERPEEITDPDQALDLLRQGNARFVAAREQHTAHTIERRLHVASGQHPFAIVLACADSRVPPELVFDQGLGDLFVVRTAGQVLAPPVLGSIQYGVEHLHVPLILVLGHEKCGAVSATLEAVQTGAAATGTAIDSLVEAIRPAVERARAGSDEDHLLAEAVRSNVTDEVETLVTDPLLAEAVAAGHLRIAGATYDLDEDVVTFL

SEQ ID NO: 49185 - protein, 389 aa, Mannheimia succiniciproducens MBEL55E
MSVIKMTDLDLAGKRLFIRADLNVPVKDGKVTSDARIRATIPTLKLALEKGAKVMVTSHLGRPTEGEFKPEDSLQPVVDYLKDAGFNVRLAQNYLDGVEVNEGEIVVLENVRINKGEKKNDPELGKKYAALCDVFVMDAFGTAHRAQASTYGVAEYAPVACAGPLLAAELDALGKALKEPQRPMLAIVGGSKVSTKLTVLDSLSKIADQLIVGGGIANTFIAAEGHNVGKSLYEEDLIPEAKRLAAATNIPVPVDVRVGTEFSENAPATEKSVTEVQADESIFDIGDKSAEELAKIIKSAKTILWNGPVGVFEFPNFRKGTEVISNAIAEATANGAFSIAGGGDTLAAIDLFGIKDKISYISTGGGAFLEFVEGKVLPAVEILEKRANG

SEQ ID NO: 49186 - protein, 336 aa, Streptococcus suis
MVVKVGINGFGRIGRLAFRRIQNVEGVEVTRINDLTDPVMLAHLLKYDTTQGRFDGTVEVKDGGFEVNGKFVKVSAEREPGNIDWATDGVDIVLEATGFFASKEKAEQHIHANGAKKVVITAPGGNDVKTVVFNTNHDILDGTETVISGASCTTNCLAPMAKALHDAFGVQKGLMTTIHGYTGDQMVLDGPHRGGDLRRARAAAANIVPNSTGAAKAIGLVIPELNGKLDGAAQRVPVPTGSVTELVATLDKKVTAEEVNAAMKAAATESFGYTEDQLVSSDIVGISFGSLFDATQTKVIEVDGEQLVKVVSWYDNEMSYTAQLVRTLEYFAKIAK

SEQ ID NO: 49187 - protein, 537 aa, Triticum aestivum
  misc_feature (190)..(190): Xaa can be any naturally occurring amino acid
MSGFLAVAGKIVTFLLWVLFLILQTATKVVGGLLQVAPPAEPQEEPQPEAAPRPRSPPAARNSAGGGPADPYDPRSQPWDPPPPPHTAPVTDEYHSSSIYRRRVSAPQAAEDLVVSSSSYSRSAVAAVPASPAHAVSAPPVSRTIKTPAVASKRPKLERKYSKIVDQYRSLDEVIEALAQAGLESSNLIXGIDFTKSNEWTGKRSFNGVSLHHIGDAPNPYEQAISIIGQTLSAFDEDNLIPCYGFGDASTHDQDVFAFNPDERPCYGFQEALARYREIVPHLRLSGPTSFSPIIEMATTIVEQSGGQYHVLVIIADGQVTRSVNTEFGQLSTQEQMTVDAIVQASEFPLSIILVGVGDGPWDMMNEFDDNIPARSFDNFQFVNFTGIMSKKISQSNKETEFALSALMEIPLQYKATLQLGILGRRLAKSPEQVPLPPPFASYNTTSRAAPSWANNFRSVPSNLREEATLDSTITPSVTPPPAADARASELQFCPVCLAKPRDMAFGCGHQTCSGCGPQVVDCPICRRPIDTRVKLY

SEQ ID NO: 49188 - protein, 433 aa, Synechococcus sp. RS9917
MTAPTLNTSRSQAIFSAAQALMPGGVSSPVRAFKSVGGQPIVFDRVKGSYAWDVDGNKYIDYIGSWGPAICGHAHPEVISALQEAIEKGTSFGAPCELENTLASRVIDAVPSVEMVRFVNSGTEACMAVLRLIRAFTGRDKVIKFEGCYHGHADMFLVKAGSGVATLGLPDSPGVPRSTTANTLTAPYNDLEAVKQLFAENPEAIAGVILEPIVGNAGFITPEPGFLEGLREITKEHGALLVFDEVMTGFRISYGGAQAHFGVTPDLTTMGKVIGGGLPVGAYGGRREIMEMVAPAGPMYQAGTLSGNPLAMTAGIKTLELLKQPGSYEKLAATTERLISGIIEAAGAAGLPITGGSVSAMFGFFLCDGPVRNFEEAKTADTERFGRLHRAMLQRGVYLAPSAFEAGFTSLAHSEADIDATLQAFRETFAEIA

SEQ ID NO: 49189 - protein, 134 aa, Zea mays
MALAGKASVALFLAVNLAVFIAMASACGGNCPTPTPSTPSTPTPTPASFGKCPRDALKLGVCANVLGLIKAKVGVPPTEPCCRLLEGLVDLEAAVCLCTAIKGEVLGIKLNLPVDLSLILNHCGKTVPTGFKCL

SEQ ID NO: 49190 - protein, 329 aa, Cyanidioschyzon merolae
MLGFVSGTASLTKKRGGRSAQACGSAVTRLRLQAGEPQPVLAKGRLPSVTAFAAAVLLAAATHSAVLEPVQALTAQDVRQLSYEQVKGTGLANRCPEVVSSKGKISLDKTKKYKVVDLCLEPKQFLVEEEVGRRRGESKREFVDTKLMTRATYTLANIEGELVNENGTWKFIEKDGMDYAATTVQIPGGERVPFLFSIKKLVASLNNADDGISTSTELGGEFKVPSYRTGMFLDPKGRGMANGYDMAVALPALEADGAVGQEVLRKENDKVFQETSGRIELAVNKVDPTSNEIGGVFVSEQLSDTDMGAKEPKKLLLKGVFYARILPSD

SEQ ID NO: 49191 - protein, 178 aa, Cryptococcus neoformans var. neoformans JEC21
MSDVAYIKSLLGVHPDFPKKGITFLDIFPILRDPIAFETLITHFVSHIFNTHKVKPDVIVGLDARGFLLGPVIAMRLGAAFVPVRKAGKLPGSVEVVTYEKEYGVDQFEMQSDAVTPGQKFIIIDDLIATGGSAAAAGELVKKSGGETLEYLFIVGLPFLKGHEKLDAPVYSMIEAED

SEQ ID NO: 49192 - protein, 213 aa, Coprinopsis cinerea okayama7#130
MCIGVWTLDHPDYALILCENRDEFIDRPTEDAHWHSFGDVQKQDEPGNVLSGRDIKAGGSWFGLNKEGRVALLTNITEPLGRYSSSRGALVSSFLLSKSNHPLEDELGKIVSPNAAFAGFNLLLLSPTLRSDDTISYDALFVTNHGGGGVLTSRRLTPEEQRCGCMSNGIDGKDASQWPKVIHATREFSAVLQSLSQEATETEIADHLFNVLA

SEQ ID NO: 49193 - protein, 276 aa, Novosphingobium aromaticivorans DSM 12444
MMIRSGLVGRSILASRSPDLHQGEGRALGLEVSYELFDFTARDLPDSALAEVIGTLRDDGFAGFNVTYPFKQAIVPLLDELDESALAVGAVNTVAIREGRLIGYNTDMIGFRLSMEQGLPGARLERVVQLGAGGAGAAVANALLSLGVRRLVLVDVDPARAEQLRSELAARFPGQDVECGAPGTLDTTGADGIVNATPIGMNGKPGMPLPPEKIAARQWVADIIYFPRETELLRVAKSKGCATINGVGMVVGQAARAFEIITGHAADARRMRAMLD

SEQ ID NO: 49194 - protein, 195 aa, Burkholderia sp. 383
MRVAEVVRNTSETQIRVKLNLDGTGQQKLATGVPFLDHMLDQIARHGLVDLEVEAHGDTHIDDHHTVEDVGITLGQAVAKAIGDRKGIRRYGHSYVPLDEALSRVVIDFSGRPGLEFHVPFTRARIGTFDVDLSIEFFRGFVNHAGVTLHIDNLRGINAHHQLETVFKAFGRALRAAVELDERAAGQIPSTKGSL

SEQ ID NO: 49195 - protein, 436 aa, Saccharomyces cerevisiae
AVSKVYARSVYDSRGNPTVEVELTTEKGVFRSIVPSGASTGVHEALEMRDGDKSKWMGKGVLHAVKNVNDVIAPAFVKANIDVKDQKAVDDFLISLDGTANKSKLGANAILGVSLAASRAAAAEKNVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLAVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 49196 - protein, 497 aa, Arabidopsis thaliana
  misc_feature (366)..(366): Xaa can be any naturally occurring amino acid
MEMILSISLCLTTLITLLLLRRFLKRTATKVNLPPSPWRLPVIGNLHQLSLHPHRSLRSLSLRYGPLMLLHFGRVPILVVSSGEAAQEVLKTHDHKFANRPRSKAVHGLMNGGRDVVFAPYGEYWRQMKSVCILNLLTNKMVESFEKVREDEVNAMIEKLEKASSSSSSENLSELFITLPSDVTSRVALGRKHSEDETARDLKKRVRQIMELLGEFPIGEYVPILAWIDGIRGFNNKIKEVSRGFSDLMDKVVQEHLEASNDKADFVDILLSIEKDKNSGFQVQRNDIKFMILDMFIGGTSTTSTLLEWTMTELIRSPKSMKKLQDEIRSTIRPHGSYIKEKEVENMKYLKAVIKEVLRLHPSLPXILPRLLSEDVKVKGYNIAAGTEVIINAWAIQRDTAIWGPDAEEFKPERHLDSGLDYHGKNLNYIPFGSGRRICPGINLALGLAEVTVANLVGRFDWRVEAGPNGDQPDLTEAIGIDVCRKFPLIAFPSSVV

SEQ ID NO: 49197 - protein, 436 aa, Saccharomyces cerevisiae
AVSKVYARSVYDSRGNPTVEVELTTEKGVFRSIVPSGASTGVHEALEMRDGDKSKWMGKGVLHAVKNVNDVIAPAFVKADIDVKDQKAVDDFLISLDGTANKSKLGANAILGVSLAASRAAAAEKDVPLYKHLADLSKSKTSPYVLPVPFLNVLNGGSHAGGALALQEFMIAPTGAKTFAEALRIGSEVYHNLKSLTKKRYGASAGNVGDEGGVAPNIQTAEEALDLIVDAIKAAGHDGKVKIGLDCASSEFFKDGKYDLDFKNPNSDKSKWLTGPQLADLYHSLMKRYPIVSIEDPFAEDDWEAWSHFFKTAGIQIVADDLTVTNPKRIATAIEKKAADALLLKVNQIGTLSESIKAAQDSFAAGWGVMVSHRSGETEDTFIADLVVGLRTGQIKTGAPARSERLAKLNQLLRIEEELGDNAVFAGENFHHGDKL

SEQ ID NO: 49198 - protein, 249 aa, Triticum aestivum
  misc_feature (121)..(121): Xaa can be any naturally occurring amino acid
  misc_feature (213)..(213): Xaa can be any naturally occurring amino acid
  misc_feature (219)..(219): Xaa can be any naturally occurring amino acid
  misc_feature (239)..(240): Xaa can be any naturally occurring amino acid
NKFVQKSRLVPVRNSRDIVDPRVRTGSTKVGQMVQQQVSARFGKCLLELSGNNAIIVMDDADIPLAVRSVLFAAVGTAGQRCTTCRRLLLHESIYQTFLDQLVEVYKQVRIGDPMEKGTLXGPLHTTASKESFLKGIQNIRSQGGKILLGGSAIESEGNFVQPTIVEISPAAPVVREELFGPVLYAMKFQTLKEAIEINNSVPQGLSSSIFTXKPDLFXWSALYMCYDVIPYVNVNIPXXGAKIGGAFG

SEQ ID NO: 49199 - protein, 138 aa, Burkholderia sp. 383
MNTETNALPAWLDKVRWDDNGLVPVIAQEASTNDVLMFAWMNREALAKTIETQRAVYYSRSRKRLWFKGEESGHVQHVHEVRLDCDEDVVLLKVEQVSGIACHTGRHSCFFQKFEGTVDNGDWVAVEPVLKDPEHIYK

SEQ ID NO: 49200 - protein, 121 aa, Burkholderia sp. 383
MTQSTEDTLLRLAAVIDSRKGGDPDQSYVSRLFHKGDDAVLKKIGEEATEVVLAAKDVRQGGAPTALVGEVADLWFHCLVMLSHFDLSPADVIAELERREGLSGIEEKALRKRREREENGG

SEQ ID NO: 49201 - protein, 379 aa, Staphylococcus aureus subsp. aureus MRSA252
MAKRDYYEVLGISKDASKDEIKKAYRKLSKKYHPDINKEEGADEKFKEISEAYEVLSDDNKRASYDQFGHDGPQGFGGQGFNGSDFGGFSGFGGGGFEDIFSSFFGGGRQRDPNAPQKGDDLQYTMTLTFEEAVFGTTKEISIRKDVTCETCHGDGAKPGTSKKTCSYCNGAGHVAVEQNTILGRVRTEQVCPKCNGSGQEFEEACPTCHGKGTENKTVKLEVKVPEGVDNEQQIRLAGEGSPGVNGGPAGDLYVVFRVKPSETFKRDGDDIYYKLNVSFPQAALGDEIKIPTLNNEVMLTIPAGTQTGKQFRLKEKGIKNVHGYGYGDLYVDIKVVTPTKLTDRQKELMKEFAQLNGEEINDQPSNFKDRAKRFFKGE

SEQ ID NO: 49202 - protein, 856 aa, Debaryomyces hansenii CBS767
MDDTTQINEQPIDAVFGDRVRRFQEFLDKIDVEGTQYRTEIKDMLMKGRYRLCVSLDEIREFDKEFWRGLLNTPADYLPACERALRDTVLTIYDPTDSRYEVMDENQQFYLSFKGSFGDHQVSPRSINSHHLSQMVSIEGIVTRASLVRPKIIRSVHYAEKTSRFYAREYRDQTTSFDPISTAAIYPTEDLDGNKLTTEYGYSTYRDHQKISVQEMPETAPAGQLPRSVDVILDDDLVDLTKPGDRIQIVGVYRALGGAGNASASFRTVILANSVYPLHARSTGVASQEKLTDQDIRNINRLSKDKKIFEILSNSLAPSIYGFEYIKKAVLLMLLGGVEKNLDNGTHLRGDINILMVGDPSTAKSQILRFVLNTASLAIATTGRGSSGVGLTAAVTTDKETGERRLEAGAMVLADRGIVCIDEFDKMSDVDRVAIHEVMEQQTVTIAKAGIHTSLNARCSVIAAANPVFGQYDVHKDPHKNIALPDSLLSRFDLLFVVTDDVQATKDRIISEHVLRMHRFIPPGLLEGEPIRERSNLSLAVGDDSTNEQEELEQPIFEKFNSLLHSGVRSTKSNKTPTILSIPFMKKYVQYAKQRIKPVLSSKASEYIVNTYSALRNDLIDNNQRHTAPITARTLETLIRLASAHAKVRLSKTVEVKDAKIAEELLRFALFKEVTKKSKSKKQKTHHASDSEEEEEEEEAAEEEESDNEDLPPRNTRTRSRFRGQEQAAQDSPPADPASSPNEAEMEEHLDNLHITQPEQDAQDVKPLAETNESNRSASGISGERYSTFVRLMARAMQSSIFENESGAAPIEQVIDSINQDLEQEDVFAEDEITAAFDRMEAENKIMVGEGKVWKI

SEQ ID NO: 49203 - protein, 197 aa, Arabidopsis thaliana
  misc_feature (48)..(48): Xaa can be any naturally occurring amino acid
  misc_feature (65)..(65): Xaa can be any naturally occurring amino acid
  misc_feature (72)..(72): Xaa can be any naturally occurring amino acid
  misc_feature (107)..(107): Xaa can be any naturally occurring amino acid
  misc_feature (112)..(112): Xaa can be any naturally occurring amino acid
  misc_feature (146)..(146): Xaa can be any naturally occurring amino acid
  misc_feature (150)..(150): Xaa can be any naturally occurring amino acid
  misc_feature (153)..(153): Xaa can be any naturally occurring amino acid
  misc_feature (159)..(159): Xaa can be any naturally occurring amino acid
  misc_feature (161)..(161): Xaa can be any naturally occurring amino acid
  misc_feature (165)..(165): Xaa can be any naturally occurring amino acid
SPPPPQPYRTPDHRRSHQDNEDFEAMYELDGDLIPRNSSPPSPLHPAXSHSPPPPQPYRTPDHRXSHQDNEXDFEAMYELDGDLIHQKSAPPSPVHGPYYSSSDDDXHSTYXYPEIRSPLRSRIVSENSTPVHHNYQIVAAETYEXDKQXEPXELPDEXQXFTMXEITKMRGLKNYESGKEESQSMISEAYVSRREL

SEQ ID NO: 49204 - protein, 436 aa, Mannheimia succiniciproducens MBEL55E
MAKIVKVIGREIIDSRGNPTVEAEVHLEGGFVGLAAAPSGASTGSREALELRDGDKSRFLGKGVLKAVGAVNNEIAGAIVGKDASNQAEIDQIMIDLDGTENKSKFGANAILAVSLATAKAAAASKGLPLYAYIAELNGTPGVYSMPLPMMNIINGGEHADNNVDIQEFMIQPVGAKTLREALRIGAEVFHNLAKVLKAKGLNTAVGDEGGFAPNLGSNAEALACIKEAVEKAGYVLGKDVTLAMDCASSEFYNKENGKYEMKGEGRSFTSQEFTHYLEELCKQYPIVSIEDGQDESDWEGFAYQTKVLGDKVQLVGDDLFVTNTKILKEGIEKGIANSILIKFNQIGSLTETLAAIKMAKDAGYTAVISHRSGETEDATIADLAVGTAAGQIKTGSMSRSDRIAKYNQLIRIEEALERAGTPAPFLGLKAVKGQA

SEQ ID NO: 49205 - protein, 477 aa, Cyanidioschyzon merolae
MIAFVINSATKAAVSPLKGQICRGLPKNPSFAASTWLGQAALSTRPRSSQGRGRSGVRESAATRARAPVCVQTSDVAMRVRSIRDLQDAEIRGKRVFVRSDLNVPLDGKRITDDTRIRASVPTIKYLADKGAKVIVVSHLGRPKGGFEDKYSLAPVAERLSELLGKKVRMAKDCIGDAVATEVAAMSPGDVVLLENVRFYPEEEKNDPDFARKLAANADLYVNDAFGTAHRAHASTEGVTAFLKPAVAGFLLEKELDYLSNAIESPKRPFAAIVGGSKVSTKIAVLEKLLQKCDTIIIGGGMVFTFLRARGLKTGSSLVEEDKIELARVIEEEARKRGIELLLPLDVVVADKFANDANTKVVPVEEIPDGWMGLDNGPETTRMIQEKLRTMKTVLWNGPLGVFEMPNFAKGTFAIAETLAEITQNGCITIVGGGDSVAAMEQSGKADKVSHISTGGGAALELIEGRVLPGVAALQRA

SEQ ID NO: 49206 - protein, 288 aa, Methylococcus capsulatus str. Bath
MATQRIPLTLAESLARVYVPLAAWVLTHRDNGPFVLGVNGAQGSGKSTLCDFLSLILREGYGCKVAGFSIDDLYKTRSERERLAREVHPLLMTRGVPGTHDVELGLQTLDRLTKIGPEVSVALPAFDKSVDDRRPLSAWPQITAPVDVVIFEGWCVGCIPQVGEDLVRPINALESGEDADGSWRTYVNEQLGGPYAELFDRLDRLIMLKVPDLECVYRWRGLQERKLAAAVRGNGSSSHRLMDEAALRRFIMHYERLTRHMLAEMPARADITLFLDENHRFVRAHINE

SEQ ID NO: 49207 - protein, 333 aa, Kineococcus radiotolerans SRS30216
MNLSAVLQAPHQLVIEDRDTPRPGRHDVLVRVEAVGICGSDVHYYEHGRIGSYVVRAPMVIGHEAAGTIVAVGDGVDASRVGQRVALEPGVPDRTCEQCLAGRYNLCPNVVFFATPPVDGAIAQLVTIDAAFAHPAPEQLSPEQAAMAEPVSVGVWAARRARIAPGDRVLVTGAGPIGLLAAQVALAFGADSVTVTDVSDFRLKVARELGLRAQAATQELTGSFDVLLECSGAPAAWRSGLGALAPAARAVLVGMGADELPIDVPLVQGREITITGIFRYAGTYPTALSLIASGRVSTEAIITHRFPLAQAEDALTVGRREDRSLKAVVLPQQ

SEQ ID NO: 49208 - protein, 475 aa, Mannheimia succiniciproducens MBEL55E
MANPNAIQRVAKLIEDNDVKFVLLRFTDIKGKEHGVSLPVNLVADELEDFFEEGKMFDGSSVEGWKAINKADMLLMPMPETAVIDPFAQITTLSIRCSVYEPNTMQSYDRDPRSIATRAENYLKSTGIADQALFGPEPEFFLFDDVRFSTEMNNVSYKIDDIEAAWNTNRKFEDGNNAYRPLKKGGYCAVAPIDNAHDIRSEMCLILEEMGLVIEAHHHEVATAGQNEIASKFNTLTLKADETQIYKYVVQNVALEYGKTACFMAKPFAGDNGSGMHCNMSLSKDGKNVFQGDKYAGLSETALYYIGGIIKHAKALNAFTNPTTNSYKRLVPGFEAPVLLAYSASNRSASIRIPAVTSPKAIRVEARFPDPLANPYLAFAALLMAGIDGIINKIHPGDAMDKNLYDLPPEELKEIPAVCSSLEEALDSLQADHEFLIQGGVFSKEFIDAFVAIKRKEVERVNMTPHPVEFEMYYA

SEQ ID NO: 49209 - protein, 583 aa, Penicillium marneffei
MYNAHRGMVPAPNNRLTELLEQLRQEFESQSRSTGEFEHQLTGQIQEMEMIRQKVYQLEQAQIKIKAEYENEIRVLRHELESRGVQTVPSHVGGPTHAGPSQAPPALGHGTNNLFGGIMANQGGSGPGLAPPPPQEQQPPQHGLQQPAPAAQQGPPQPPQSSYGGYQPSAGVNGYGPPPPPTASPGPGKGRGRAPPGPATPQQTHQLNYPAPGASPQIPRPTPTGQLVRERPGNTLANWNPDDLPASQKREGPDWYAVFNPEVQRVLDVELVHHLVHDSVVCCVRFSRDGKYVATGCNRSAQIFDVATGQNVATLQDESVDKDGDLYIRSVCFSPDGKYLATGAEDKQIRVWDIATRSIKHVFTGHEQDIYSLDFAGNGRYIASGSGDKTVRLWDVLEGKLVYTLSIEDGVTTVAMSPDGHYVAAGSLDKSVRVWDTTTGYLVERLENPDGHKDSVYSVAFAPNGRDLVSGSLDKTIKMWELTAPRGMLPGTGVKGGKCVRTFEGHKDFVLSVCLTPDGHWVMSGSKDRGVQFWDPNTGSAQMMLQGHKNSVISVAPSPTNNLFATGSGDMRARIWRYVEFPE

SEQ ID NO: 49210 - protein, 340 aa, Arabidopsis thaliana
MLGGNNENPVPQVLMNNSQFHYQSNTSLNQLHLLGTMRAGCTIDPVNYFANDNLAPMNRHNSTRGRETENNNIMQRQQKLQISLNYNYNNNNTVVQDEVPKQNLVSTGLRLSYDDDERNSSVTSANGSITTPVYQSLGDNIRLDLNRQNDELDQFIKFRADQMAKGVRDIKQRHVTSFVTALEKDVSKKLQEKDHEIESMNKKNRELVDKIKQVAVEAQNWHYKAKYNESVVNALKVNLQQVMSHGNDNNAVGGGVADHHQMKEGFGDSEIDDEAASYNYLNIPGMPSTGMRCKLCNVKNVSVLLVPCRHLSLCKDCDVFTGVCPVCQSLKTSSVQVFFF

SEQ ID NO: 49211 - protein, 523 aa, Yarrowia lipolytica
MSNALNLSLALGVFLLAYYGFSVIQYRIKTRKLEKKWKCGKPKDISRFPFSASFFIPFLVESKKNRLLEFVQWMFESQVYPGYTCKTTVFGVDMYHTVDPENLKAVLATQFKDFCLGERHAQFLPVLGNGIFTLDGQGWQHSRAMLRPQFARDQVSDVEMIEEHIQYMTSRIPKDGSAFDAQELFFNLTLDTATEFLFGQSVGSQTVETNPTAVPTDMPVHLRKSFQEDFNTAQEHLGQRARLQMFYWAWRPRELYSSGERVHAFVDHYVKKALEESEKHVDDGKYVFLRELAKETKDPIVLRDQALNILLAGRDTTASLLSWCLYLMARRPEVYAKLREEVIENLGDGEDLSTITFESLKRCDYLRYVLNEVLRLYPSVPANMRYATRDTTLPRGGGPDGMQPIVVRKGNLVSYHVFTTHRLKEFWGEDAEEFRPERWYEDGASQAKGWEYLPFNGGPRICLGQQYALTEAGYALARIAQLYDTIENADDKPEPPVKFHALTMCHHTGVLVKLYNSKTTKAQ

SEQ ID NO: 49212 - protein, 121 aa, Burkholderia sp. 383
MSHDPNCLFCKIAAGEIPSTKVHEDEEFVAFRDIRPAAETHVLVIPRQHLPTLSAASDADAPMLGRLMLLVSRLASQLGVAYTGGETGFRTVINTGPGGGQEVYHLHAHILAGPRPWQRMG

SEQ ID NO: 49213 - protein, 278 aa, Streptococcus agalactiae 2603V/R
MIVGEQEARALIKPRPKSSHKGDYGSVLLIGGFYPYGGAIIMAALACVKTGAGLVTVATQSCNIPSLHSQLPEVMAFDSDDYKWLEKSIVQSDVIVIGPGLGVSESSRKILNQTMEKIQSHQSVILDGSALTLLSEGAFPQTKAKNLVLTPHQKEWERLSGIAVSQQTKENTQTALKSFPKGTILVAKSSHTRIFQDLDEKEIIVGGPYQATGGMGDTLCGMIAGMLAQFKEASPLDKVSVGVYLHSAIAQGLSKEAYVVLPTTISDEIPKEMARLSK

SEQ ID NO: 49214 - protein, 444 aa, Saccharomyces cerevisiae
MKQRFIRQFTNLMSTSRPKVVANKYFTSNTAKDVWSLTNEAAAKAANNSKNQGRELINLGQGFFSYSPPQFAIKEAQKALDIPMVNQYSPTRGRPSLINSLIKLYSPIYNTELKAENVTVTTGANEGILSCLMGLLNAGDEVIVFEPFFDQYIPNIELCGGKVVYVPINPPKELDQRNTRGEEWTIDFEQFEKAITSKTKAVIINTPHNPIGKVFTREELTTLGNICVKHNVVIISDEVYEHLYFTDSFTRIATLSPEIGQLTLTVGSAGKSFAATGWRIGWVLSLNAELLSYAAKAHTRICFASPSPLQEACANSINDALKIGYFEKMRQEYINKFKIFTSIFDELGLPYTAPEGTYFVLVDFSKVKIPEDYPYPEEILNKGKDFRISHWLINELGVVAIPPTEFYIKEHEKAAENLLRFAVCKDDAYLENAVERLKLLKDYL

SEQ ID NO: 49215 - protein, 1044 aa, Thermoplasma volcanium GSS1
MPKREDISKILVIGSGPVVIGQAAEFDYSASQACRSLREEGYEVVLLNSNPATIQTDHEIADRVYIEPITVEAVETIIRKEEIDAIEPHMGGQTALNLVVSLKKMGIIDKYGIKIIGTPVESIEISEDRQKFHDFLISIGERDPERYRISRSNYKEEIEKIPFMPVIVRTSFSLGGSGGNIVKTKEELKAYAEELFRGIDEDYIEVNRSLAGLKELEYEMIRDSIGNCITVCNMENLDPMGVHTGESIVVTPSQTLSDIQYHMLRDAAIKIVSGLGIVGACNIQFALDGNDYYVVEVNPRTSRSSALASKATGYPIARIAAKIAVGYNLTEIRNPITKNTFAAFEPSLDYVTVKIPRWPFDKFSVDRTIGVQMKSIGEVMGIGRTFEEALMKAIASLDIDLSYRLRLYVSDEEIWNLVRTPNDRRIFAIFEALFRDFPVDRIMEESMYDRYFIEKMQNIVDYLKTLEFGHIPENLISLKKLGISDEIIGRTCGIDPDEITRYRITNRILPVFKEIDTCSGEFEVIAPYLYSTYEDEDELPGISGFVAIIGSGPNRIAQGLEFDYGAVKAITALRKMGVGSVMINSNPETVSTDFDVSDALFFEPITVEHVSNILAKANLRGLIVQFSGQTGQNIARRIENVLGSSVVMGTSSESIDRIEDRSLFSKRLEAMGIDQPKFEVATNAEEAINKSLALGLPVILRASHVIGGRAMDIIYDYDFLVERSREVFENVNSVLVSKYLENAVEIDVDFVSNGEDFQICGILVHIEEAGVHSGDATMIFGPKIVPQAAEEKIKSIVGKLVREFNLIGISNLQAAIKDDEVYVIELNARSSRSIPFISKATGYNWVELAVSAIMTGKLEKVSVSSKGYFVKVSVFPFSKFNDMDVSLGPEMKSTGEAMYPGFTMEEAIRKSILRDIKSVFISVRDDDKPRIIEAASIMKQNGLKIYATMGTSRYLRERGIECETVYRIKDERKPRIYDMILAGYIDLVINTPEMNAGSVRDGFKIRRLCVRKGIPLVTNINLANAYSKCLSYTNIDYREISSYH

SEQ ID NO: 49216 - protein, 396 aa, Chlamydomonas reinhardtii
MEGIANSRWLLTLCVPFSPLPQAWRAAMPRVVPFYAVKCNPEPGILKLLNALGAGFDCACKGELDMMLRMGVSPNRIIFAHPCKRASDIRYAREHNVQYTTFDTVSELHKIAQMNPDFKCVLRIRADDPDARVPLGLKYGAEVSEADVLLRTAKELGLQVVGVSFHVGSACQNLSTFSGAIVNARKVFDEAGALGFNMELLDIGGGFTGHFDEMGNVMFGVIANTINAALATNFPPEMGVRVIAEPGRYFAETSSTLLTPVYGQRDRVAADGSVKKDYWLTDGLYGSFNCILYDGQNPGYKVVRSPLMADSTDSRTFLSTLWGPTCDSADCVYKDVTLPVLRNGDWLMWNNAGAYTVAGACDFNGIEFTTPGKLYVWSDSAVDAAEEGADEQVMNA

SEQ ID NO: 49217 - protein, 409 aa, Thermoplasma volcanium GSS1
MENDNPFVWNGDDMLVEGYSVKAIVETFGTPVIIYSAPRIVKNVSSLFGAMPKVTKCFYSVKANSNPNLVRLIGRQGCGSEVTSLGEIQIAMISSIDPDDILFTPNNVSKEEMDFALDRGIKITFNSPGQFELVSNRVEEATFRINPGIGHGEHPGTTTGGHGSKFGIDPETALKLYTRAKELGIRKFGIHMMVGSNNTDADLMLTFYKKFFDMASEIEKTAHLQFSYIDIGGGFGVPYNDEQRSLDIKKLGSGLKELVDQYGIERLFIEPGRYIVADAGILVGKVYDVYNGFVGTDIGMNINIRHALYGAEHRFYALTGRSDEAEYIVTGQICENTDVTGRLTGKVQIGDLVAMYDAGAYIYSMSSNYNGRFRPTEVIVDHDGVYRIRRRETVNDILATVTGMEKVNV

SEQ ID NO: 49218 - protein, 341 aa, Kineococcus radiotolerans SRS30216
MRAVVMHAPRDVRVEDRPEPRIQKPTDAIIRLAATCICGSDLWPYRGADEVSEPLPMGHEYAGVVEEIGADVHDIEVGDFVVGSFFASDNTCEICRAGYQTSCLHREVLGTGGGAQAERMRVPLADGTLVATPAMPDADLIPSLLAASDVLGTGWFGAVAAEAGPGKTVAVVGDGAVGLSAVLAAKQLGAEKIVLFSRHADRQALGREFGATDVIEERGDEGIAKLKELTGGLGAHSVVEAVGTHESMHQAIGSTRPGGHVGFVGVLHDVAITGEDIFMTHVHLHGGPAPVRRFLPELIDLIWTRRIDPGKVFDLELPLDEAAEGYRAMDERRATKVLLRP

SEQ ID NO: 49219 - protein, 298 aa, Mannheimia succiniciproducens MBEL55E
MSSTRPLFYGSIVALITPMDGHGEVNYDELKKLVEYHIASGTHAIVSVGTTGESATLSIDENVKTIQKTVEFAAGRIPVIAGTGANATSEAITMTKLLNNSGVAGCLSVVPYYNKPTQEGMYQHFKAIAECTDLPQILYNVPGRTGSDMKPETVGRLSKIENIVAIKEATGDVSRVKQIKELAGEDFIFLSGDDATGLESIKLGGQGVISVTNNLAAADMAKMCELALAGNFDEAEAINQRLMGLHHDLFIEGNPIPVKWAAYKLGLIKEPVLRLPLTTLSEAAQPKVLEALKQAGLI

SEQ ID NO: 49220 - protein, 332 aa, Saccharomyces cerevisiae
MIRIAINGFGRIGRLVLRLALQRKDIEVVAVNDPFISNDYAAYMVKYDSTHGRYKGTVSHDDKHIIIDGVKIATYQERDPANLPWGSLKIDVAVDSTGVFKELDTAQKHIDAGAKKVVITAPSSSAPMFVVGVNHTKYTPDKKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLEKEATYDQIKKAVKAAAEGPMKGVLGYTEDAVVSSDFLGDTHASIFDASAGIQLSPKFVKLISWYDNEYGYSARVVDLIEYVAKA

SEQ ID NO: 49221 - protein, 576 aa, Schizosaccharomyces pombe
MQPQEVDLMENSTMRNGARVLPPEAISKRHIGPYIIRETLGEGSFGKVKLATHYKTQQKVALKFISRQLLKKSDMHMRVEREISYLKLLRHPHIIKLYDVITTPTDIVMVIEYAGGELFDYIVEKKRMTEDEGRRFFQQIICAIEYCHRHKIVHRDLKPENLLLDDNLNVKIADFGLSNIMTDGNFLKTSCGSPNYAAPEVINGKLYAGPEVDVWSCGIVLYVMLVGRLPFDDEFIPNLFKKVNSCVYVMPDFLSPGAQSLIRRMIVADPMQRITIQEIRRDPWFNVNLPDYLRPMEEVQGSYADSRIVSKLGEAMGFSEDYIVEALRSDENNEVKEAYNLLHENQVIQEKSHLSKSKRVDSFLSVSPPAFSEYTSELQKKSKQELIDPTLEGPRWTVSDPPTYAKQTIDSNICVLVPTAEKNKLEMRTLADAASAVDTSQSTRKKSRRNKWHFGVRCRGDAPEILLAVYRALQRAGAQFTVPKPVNGKYRSDMYTIKSRWEIPHCKREGKNTYAYIELQLYEVMPGCFMLDVKSNGYKDIYSHPERTADHGMDDLKSSSPFSDLCAMLVCKLFSA

SEQ ID NO: 49222 - protein, 478 aa, Glycine max
MASSDSKLPLKPIPGSYGLPFFGPMSDRHDYFYNQGRDKFFAERIKKYNSTVIRTNMPPGPFISSNPRVIALLDGVSFPILFDNSKVDKRDVLDGTFMPSTSFTGGYRACAFQDTTEPSHALLKRFYLNFLASKHETFLPLFRNNLSDHFSDLEDKLAGKSGKASFNSSVGSATFNFLFRLLSDKDPSETIIGSDGPSLVQTWLAAQLAPLATLGLPRIFNYVEDFLIRSIPFPAWTVKSSYKKLYEGLSTAGTAILDEAERVGIKRDEACHNLVFMLSFNAQGGLVNQFPILIKWLGLAGEGLHKQLAEEIRTVVKDEGGVSLRALDQMTLTKSVVYEVLRIEPAVPFQYAKAREDLVVESHDAAYEIKKGEMIFGYQPFATKDPKIFENAEDFVAHRFLGHDGEKLLRHVLWSNGPQTEEPTPDDKQCPAKNLVVLMCRLYLVEFFLRYDTFTFDFKPVVLGPDVTIKSLAKASSF

SEQ ID NO: 49223 - protein, 106 aa, Glycine max
SMIFFPAGTTVNRAGARMGGSFTGLKFMGGFPTKKNNHDLTFIGCNRGRIPCMPVWAPIGKKKFETLFYLPDLDDAPLGKEVEYLLRKGWISCVEFELEHRFVYRE

SEQ ID NO: 49224 - protein, 302 aa, Rhodococcus sp. RHA1
MTYGDSASPVERPFGTVSTAMVTPFTSDGKLDVDAGVRLAAYLVDNGCDSLVLAGTTGESPTTTENEKLELLRAVIDAVGNRAKIIAGAGSNDTAHSVELARDAARAGAQGLLVVTPYYSRPPQAGLFAHFTAVANATDLPVMLYDIPPRSVVPIETETIRRLAENPRIVAVKDAKGDLNAGAELIGTTDLQFYSGDDPLNLPWLSVGATGFVSVIGHLVPGRLRELHTAFAAGDIARARAINLSLIPVIRSVARLGGVSASKAGLRLIGLDVGEPRLPQVAPTHDQLDLLAADLHAAGVLA

SEQ ID NO: 49225 - protein, 441 aa, Glycine max
MKLEESVSSSNIIARLLPPEDPNPQNGSISGAVFNITTTMIGAGIMSIPATMKVLGIVPGLVVIVLVALITDVTVEFMLRYTSSGKSSTYAGMMAESFASIGSLAVKICVIISNLGVLIIYFIILGDVLSGNESNGITHLGILQEWFGINWWTSRAFALLIVALFIMLPLVMLRRVDSLKYSSAIAILLAFVFVVICSSMAVSALLSGKTQTLRIVPDFSQATVLDLFTTIPVFVTGFGFHVNVHPIRAELGKVAHMGLAARISLIICVAIYFAIGFFGYLLFGDSIMPDVLVNFDQNSHTSAGRLLNTIVRLSYALHLALVFPIMNYSLRANIDELIFSNKNKPPLASDTPRFVSLTLTLLALTYFVAVAIPNIWFFFQFLGSTTIVCTSFIFPAAIVLRDMHGISKTKDQVMAIVVIVLAVGTSGIAIWTNLNGSGAAQ

SEQ ID NO: 49226 - protein, 174 aa, Brassica napus
MAAASVDPLVVGRVIGDVLDMYIPTANMSVYVGPKHITNGCEIKPSVAVNSPKVNISGNSDELYTLVMTDPDAPSPSEPNMREWVHWIVVDIPGGTNPSKGKEILPYMEPKPPVGIHRYIFVLFRQISPVGLMVQQPPSRANFSTRMFAGHLDLGLPVATVYFNAQKEPASRRR

SEQ ID NO: 49227 - protein, 1498 aa, Emericella nidulans
MSFLGSISPNLPRSQSVVSHNLPQAHGLDENDDIYHNHSTTAQPGASEKDKSEDGETLHENEPDGEARVTLLARQLTRHSTRLTAKSTLENPFFLDDSDSTLNPNSPNFRVRDWMKMLLEIRSRDPERYPDRTAGIAFKNLSVHGFGSPTDYQKDVMNVLLEIGTIARRLAGMKMPKIQILRDFEGLVRSGEMLVVLGRPGSGCSTFLKTIAGEMNGIQVSDDAVLNYQGISSKNMQNSFRGEAIYTAENDIHFPQLSVGDTLMFSALARAPRNRLEGVSRKQYAEHMRDVVMAMLGLSHTINTRVGNDFIRGVSGGERKRVSIAEATLSQAPLQCWDNSTRGLDSANALEFCKNLALMSKYTGSTACVAIYQASQSAYDVFDKVTVLYEGRQIYFGNTKDAKKFFVDMGFECPERQTTADFLTSLTSPAERLVRPGYEGRVPCTPDEFAAAWKRSEERAKLMAEIEEYERQYPIGGPSYDAFVDARKAMQSKRQRVNSPYTISIWQQVSLCVVRGFQRLRGDFSLTTTSLIGNFMMALIIGSVFFDLPDDTSSFYYRGALLFFAVLLNAFSSALEILTLYSQRPIVEKQSRYAFYHPFAEAVASMICDTPYKLINSFTFNVPLYLMTNLRRDAAAFFTFWIFSVVTTFTMSMIFRTIASTSRSLSQALVPAAMLILGMVIYTGFTIPTQNMLGWSRWMNYINPIAYSFESFMVNEFDGRQFECVSIIPSGDEYNNVSMQYRICSTVGAESGSRIVDGGQYLELSYQYTKSHLWRNMGILIGFMVFFAFTYLLGTEYISEQKAKGEVLLFRRGRQPDLSTTEADPENPIQPSNAPKTEESAPQNTARIQRQTAIFHWEDVCYDIKIKGQPRRILDNVDGWVKPGTCTALMGVSGAGKTTLLDVLATRVTMGVVSGSMLVDGRLRDQSFQRKTGYVQQQDLHLATSTVREALRFSAILRQPAHLSRQEKLDYVEEVIKLLGMEAYADAIVGVPGQGLNVEQRKRLTIGVELAAKPQLLLFLDEPTSGLDSQTSWSILDLIDTLTQHGQAILCTIHQPSAMLFQRFDRLLLLASGGKTIYFGEIGPNSSTLSNYFVRNGSHGLPPGDNPAEWMLEVIGAAPGSNTEIDWVKTWRESPEYAKVREHLAELRATLSAKPADSSDPSALSEFAAPFSVQLWECLVRVFAQYYRTPTYIWSKAALCALTALYIGFSFFNAPTSIQGLQNQMFSVFMLMTIFGNLVQQIMPNFVTQRSLYEARERPSKAYSWKAFMAANIIVELPWNSLMAALIFFCWYYPIGLYNNAKPTDAVTERGGLMFLLIWTFLLFTSTFAHMIIAGIELAETGGNVAQLLFSLCLIFCGVLSTPDAMPGFWIFMYRVSPFTYLVSAMLSTGLSGTDVECEPVEYLTFAPPNNQTCGDYMRAYIDEVQSGYLLDPSATDQCSFCSMDKTDTFLLSVGSTFDEAWRNFGLMWAYILFNIVGAVFIYWLARVPKGKKMAGTA

SEQ ID NO: 49228 - protein, 332 aa, Gibberella zeae PH-1
MSNQPPYPLHESVVGRIDPEYAAFYNKHIIDKQQVHLQPIEASRASGVLIPGSGPLQPVASTVDYKVERRESQGPDVSVRCFTPNGEKPEAGWPVCIYYHGGGWVLGTIETENVIASHLCARGKCVVVSVDYRLAPENPFPAAVHDSWEAVLWVIGEGKDILGLDTSKLATGGSSAGANLAAVMCQRAADLGSPQFSLQLLSVPVMDNTADISNNESWKENQNSPALPAPKMLWYRNHYLPNKEDWSHPEASPLFWKGDFSKLPPACFVVGELDVLRTEGEQFAKKLVDAGVKAEVNMMKGQPHPFIAMDAVLEAGSRAITLFCDALYKTIK

SEQ ID NO: 49229 - protein, 631 aa, Oncidium Gower Ramsey
MEGCDCIEPQWPADELLVKYQYISDFFIALAYFSIPLELIYFVKKSSFFPYRWVLIQFGAFIVLCGATHLINLWTFTMHSRTVAIVMTVAKVSTAGVSCATALMLGHIIPDLVSVKTRELFLRNKAEELDREMGLIRTQEETGRHVRMLTHEIRSTLDRHTILKTTLVELGRTLDLAECALWMPLRTGLHLQLSHTLNNKIPVGSVVSINLPIVNQIFNSSRAGRIPNTCPLARFQPYTGRYVPQEVVAVRVPLLHLSNFQINDWPELSPKSFAVLVLMLPSDSARKWHAYELELVEVVADQVAVALSHAAILEESMRARDLLMDQNVALDLARREAEMAIRARNDFLAVMNHEMRTPMHAIIALSSLLLETELTPEQRLMVETILKSSNLLATLINDVLDLSKLEDGSFELEATIFNLHTVFREAVNLIKPIAAVKKLSLFVSLAPDLPSCAIGDEKRLLQIMLNVVGNAVKFTKEGTIFITVNIAKPDSLRDPDFYPAPTDGHFYLRVQVKDTGCGISPQELPHLFTKFAHTQNGSDKGYSGSGLGLAICKRFVNLMKGHIWLESEGIGKGCTTIFIVKLGMSEDPTLRYQQKLLPPIRAGQAEADPFGLKPAALKDELMPKIRYQRSL

SEQ ID NO: 49230 - protein, 268 aa, Staphylococcus aureus subsp. aureus MRSA252
MKFAVIGNPISHSLSPVMHRANFNSLGLDDTYEALNIPIEDFHLIKEIISKKELDGFNITIPHKERIIPYLDHVDEQAINAGAVNTVLIKDGKWIGYNTDGIGYVKGLHSVYPDLENAYILILGAGGASKGIAYELAKFVKPKLTVANRTMARFESWNLNINQISLADAEKYLAEFDIVINTTPAGMAGNNESIINLKHLSPNTLMSDIVYIPYKTPILEEAERKGNHIYNGLDMFVYQGAESFKIWTNKDADINSMKTAVLQQLKGE

SEQ ID NO: 49231 - protein, 438 aa, Bacillus sp. TB-90
MKKNYGMARIVSLGLQHVLVMYAGAILVPLIVGGALHLSSNELAYLVSIDLLTCGIATLLQSWKNRFFGIGLPVVLGTSFVAVTPIIGIGTQYGMGAIYGSIITAGIFILIFSPFFGKLAKLFPPVVTGSVVTIIGVSLVPAGIKNMAGGEGNPHFGDPENLLLSFGVFIFILLINRFFHGFIRTISVLLGIIAGTIVAAFMGKVDFTNVAQASWFHMPELFYFGAPSFEWGPMITMTLVGIVIIIESTGSFFALSKICEQNMNEQDLVLGYRAEGLSFILGGLFNAFPYSTFAQNVGLVQLTNIKTRNVTIAAASLLVLLGFIPKIAAFTTIIPTPVLGGAMIVMFGMVVSSGIKMLSSVDFGQQSNLLTVACSVALGLGATVVPDLFSKLPQFMRILVGDGIVTGSLTAIILNLFFNLSSKKKPTVSSTLETTIES

SEQ ID NO: 49232 - protein, 1073 aa, Saccharomyces cerevisiae
MDSTDLFDVFEETPVELPTDSNGEKNADTNVGDTPDHTQDKKHGLEEEKEEHEENNSENKKIKSNKSKTEDKNKKVVVPVLADSFEQEASREVDASKGLTNSETLQVEQDGKVRLSHQVRHQVALPPNYDYTPIAEHKRVNEARTYPFTLDPFQDTAISCIDRGESVLVSAHTSAGKTVVAEYAIAQSLKNKQRVIYTSPIKALSNQKYRELLAEFGDVGLMTGDITINPDAGCLVMTTEILRSMLYRGSEVMREVAWVIFDEVHYMRDKERGVVWEETIILLPDKVRYVFLSATIPNAMEFAEWICKIHSQPCHIVYTNFRPTPLQHYLFPAHGDGIYLVVDEKSTFREENFQKAMASISNQIGDDPNSTDSRGKKGQTYKGGSAKGDAKGDIYKIVKMIWKKKYNPVIVFSFSKRDCEELALKMSKLDFNSDDEKEALTKIFNNAIALLPETDRELPQIKHILPLLRRGIGIHHSGLLPILKEVIEILFQEGFLKVLFATETFSIGLNMPAKTVVFTSVRKWDGQQFRWVSGGEYIQMSGRAGRRGLDDRGIVIMMIDEKMEPQVAKGMVKGQADRLDSAFHLGYNMILNLMRVEGISPEFMLEHSFFQFQNVISVPVMEKKLAELKKDFDGIEVEDEENVKEYHEIEQAIKGYREDVRQVVTHPANALSFLQPGRLVEISVNGKDNYGWGAVVDFAKRINKRNPSAVYTDHESYIVNVVVNTMYIDSPVNLLKPFNPTLPEGIRPAEEGEKSICAVIPITLDSIKSIGNLRLYMPKDIRASGQKETVGKSLREVNRRFPDGIPVLDPVKNMKIEDEDFLKLMKKIDVLNTKLSSNPLTNSMRLEELYGKYSRKHDLHEDMKQLKRKISESQAVIQLDDLRRRKRVLRRLGFCTPNDIIELKGRVACEISSGDELLLTELIFNGNFNELKPEQAAALLSCFAFQERCKEAPRLKPELAEPLKAMREIAAKIAKIMKDSKIEVVEKDYVESFRHELMEVVYEWCRGATFTQICKMTDVYEGSLIRMFKRLEELVKELVDVANTIGNSSLKEKMEAVLKLIHRDIVSAGSLYL

SEQ ID NO: 49233 - protein, 631 aa, Oncidium Gower Ramsey
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILKTTLVELGRTLDLAECALWMPLRTGLHLQLSHTLNNKIPVGSVVSINLPIVNQIFNSSRAGRIPNTCPLARFQPYTGRYVPQEVVAVRVPLLHLSNFQINDWPELSPKSFAVLVLMLPSDSARKWHAYELELVEVVADQVAVALSHAAILEESMRARDLLMDQNVALDLARREAEMAIRARNDFLAVMNHEMRTPMHAIIALSSLLLETELTPEQRLMVETILKSSNLLATLINDVLDLSKLEDGSFELEATIFNLHTVFREAVNLIKPIAAVKKLSLFVSLAPDLPSYAIGDEKRLLQIMLNVVGNAVKFTKEGTVFITVNIAKPDSLRDPDFYPAPTDGHFYLRVQVKDTGCGISPQELPHLFTKFAHTQNGSDKGYSGSGLGLAICKRFVNLMKGHIWLESEGIGKGCTTIFIVKLGMSEDPTLRYQQKLLPPIRAGQAEADPFGLKPAAPKDELMPKIRYQRSL

SEQ ID NO: 49234 - protein, 631 aa, Oncidium Gower Ramsey
MEGCDCIEPQWPADELLVKYQYISDFFIALAYFSIPLELIYFVKKSSFFPYRWVLIQFGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILKTTLVELGRTLDLAECALWMPLRTGLHLQLSHNLNNKIPVGSVVSINLPIVNQIFNSSRAGRIPHTCPLARFQPYTGRYVPLEVVAVRVPLLNLSNFQINDWPELSPKSFAVLVLMLPSDSARKWHAYELELVEVVADQVAVALSHAAILEESMRARDLLMDQNVALDLARREAEMAIRARNDFLAVMNHEMRTPMHAIIALSSLLLETDLTPEQRLMVETVLKSSNLLATLINGVLDLSKLEDGSFELEATIFNIHTVFREAVNLIKPIAAVKKLSLFVSLAPDLPSCAIEDEKRLLQIMLNVVGNAVKFTKEGPIFITANTAKPDSLRDPDFYPAPNDGHFYLRVQVKDTGCGISPQEFPPLFTKFAHTQNGSDKGYSGSGLGPAICKRFINLMKGHIWLESEGTGKGCTTIFIVKLGMSEDPTLRYQQKLLPPIRAGQSEADPFGLKPAAPKGELLPKIRYQRSL

SEQ ID NO: 49235 - protein, 345 aa, Magnetospirillum magnetotacticum MS-1
GLFAILDEVGALAGWNVTVGGGMGMTHGEADTFPRTADVMCFCEPEDALKVAEVVMTVQRDWGNRKSRKNARLKYTIERFGLDAFRAEVERRVGKAFAEPKPFRFENNGDRYGWTEGEDGRHHLTLFIQNGRVRDFKGGPQLLTGLRRIAEVHQGEFRLTANQNVLVANVPAEKRAEIEALVAEHGLTAHAGTLRRNSMACVALPTCGLALAESERYLPTLIDELEACLARHGLAEDEITIRMTGCPNGCARPYIAEIGLVGKGPKRYNLYLGAAFDGSRLGKLYAEDVADSAIVEVLDPLLAAYKVQRSYGERFGDFLVRTGYVAMTTNGPNFHEQTGCLRGLS

SEQ ID NO: 49236 - protein, 574 aa, Oncidium Gower Ramsey
FGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILKTTLVELGRTLDLAECALWMPLRTGLHLQLSHTLNNKIPGGSGGSINLPIVNQIFNSSRAGRIPNTCPLARFQPYTGRYVPQEVVAVRVPLLHLSNFQINDWPELSPKSFAVLVLMLPSDSARKWHAYELELVEVVADQVAVALSHAAILEESMRARDLLMDQNVALDLARREAEMAIRARNDFLAVMNHEMRTPMHAIIALSSLLLETELTPEQRLMVETILKSSNLLATLINDVLDLSKLEDGSFELEATIFNLHTVFREAVNLIKPIAAVKKLSLFVSLAPDLPSCAIGDEKRLLQIMLNVVGNAVKFTKEGTIFITANIAKPDSLRDPDFYPAPTDGHFYLRVQVKDTGCGISPQELPHLFTKFAHTQNGSDKGYSGSGLGLAICKRFVNLMKGHIWLESEGIGKGCTTIFIVKLGMSEDPTPRYQQKLLPPIRAGQAEADPFGLKPAAPKDELMPKIRYQRSL

SEQ ID NO: 49237 - protein, 266 aa, Candida albicans SC5314
MSRNKEKAQSSLNRFYQSQSSAPINYHYHQRPKNIHSITQLSQAEGWRRSIIGEISKQLTEINDFEISDIKVRELNDQLNELFNEKRRWEYHIRDKLHGNDYIRHNGNTKNDLINTGIRVNNSDKGKYYRYFGRAKDLPEVKLMIEENKKNRKNHKRDDIDDSDQSKRRRKVDQYKSTDNSIDMNYYGFYDEEEDEYLDDSEAQLGDPLVVYEEKRTKELNDAEIQQQDTENLEQIRMSFNDIPTNEVVTKWLVNKRREQLLSKFR

SEQ ID NO: 49238 - protein, 570 aa, Shewanella sp. MR-4
MLTDMDISRRAPLKDIAVLGAEFGLLPDEMQLFGKTKAKVDLRVQQRLAEQQQGKLIIVTAVTPTPHGEGKTVTTIGLTQSLKALGNKVCACIRQPSMGPVFGVKGGAAGGGYAQVVPMQELNLHLTGDIHAVSNAHNLGAAAIASRLYHETRLGKAEFELQSGQNYLDIAPNGIRWHRVVDHNDRCLREIEVGLGENNGPAYTSGFDITAASELMAILALSRNLADMRARIGKLVLAVNRQGAAISAEDLGVAGAMTAIMADAVKPTLMQTLNGAPCLIHAGPFANIAHGNSSVIADDIALKLADFVVTEGGFGSDMGFEKFCNIKARQSGLTPSAAVLVTTLKALKANSGLTSDADINAPDQARLEAGFANLNWHINNVARYGIPVVVAINRFATDTDAELNWLIEAVAGTAAFGCELSEAFSQGEAGALALAQTVMRACEQPSEFTLLYPDDMALEAKLSTLAEVGYGAAGVSLSEAAKLQLQELSALGYADLPVCMAKTPLSISHDPQLKGVPQGFIVPVRELVLNAGAGFITALVGNVMTMPGLGLVPGYLKIDIGADGEITGLG

SEQ ID NO: 49239 - protein, 172 aa, Triticum aestivum
LLQSEHCRGKIVMELINANPVIHEKRERRIRQAPENIDENAPEAIDQLEIFDHIRDIKDPEHPYSLEDLNVVNEDSVEINDELSHVRVTFTPTVEHCSMATIIGLCLRVKLMRSLPPRYKVDIRLTPGSHATEAAVNKQLSDKERVAAALENSNLLDIVEECLSTDTRLSPG

SEQ ID NO: 49240 - protein, 520 aa, Pyrus communis
DVQYLTGHVDERKPPQLADFLNWFLHDKKGTSTLSKPSSTGHRPHHVRVTGRLSTSCHLVDEDRELLLPRRHHNDDDHDNHVSSIFIDQSLTDGGEGGQIIKETSLLPGDQTRFGLESSLMRLELKGNSPHCLVQSDIPPCVQGDASEALDVTATAVASLEECARLSEENDVVQQAYRKEIVVSRNQVIRNSVEQPKVTLYNQSDLEGVHSELVKQGRITAVTNPRYLNLEPTLAMDWLEISWDELNIKERVGAGSFGTVHRAEWNGSDVAVKVLTVQDFHDDQLKDFLREVAIMKRVLHPNVVLFMGAVTKRPHLSIVTEYLPRGSLYRLIHRPASGELLDQRRRLRLALDVAKGINYLHCLNPPIVHWDLKSPNLLVDKNWTAKVCDFGLSRFKANTFISSKSVAGTPEWMAPEFLRGEPSNEKSDVYSFGVILWELATMQQPWGNLNPAQVVAAVGFKNKRLEIPRDLNPNVAAIIEACWANEPWKRPSFAVIMDSLTPLIKAPVTQPSRADMPLLT

SEQ ID NO: 49241 - protein, 310 aa, Mannheimia succiniciproducens MBEL55E
MDKIMKKLTVLGSINADHVISVPHFVKPGETLTGSNYHIAYGGKGANQAVAAARLGADVDFIACIGDDDIGKAMKAAFERDGIHTHTISTIPHQTTGIAMIQVAESGENSIVISAGANAHLTEELLAQHQESIAHADCLLMQLETPISAVEKAAVFAKRNGTKVVLNPAPAQPLSDHLLAHIDMITPNETEAEILTGVQVTDEQSAAEAAQVFHHKGIETVLITLGSKGVFFSSRGVQRIIPGFRVKAVDTTAAGDTFNGALITALLEDKSMEEAIRFAHGAAAISVTRKGAQPSIPSREETLAFLNEQH

SEQ ID NO: 49242 - protein, 567 aa, Shewanella sp. MR-4
MSITGIIVSSGIAFGQALHLTHAEHHLDYRPIPLSRLPQQQTKFVKALQALQQQLNHSQTKLDPQSENYQLIEADLLLLEDEELIAQVKEAIRTLQLSASVAVERVFAHQANELESLDDPYLANRAQDVRCLGQRLVSAINGRLDQGLAQLTEPTILLAQDLTPAEFALLPKEQISGIVLKTGGLTSHTAILARAAGIPAILNCQFDAEFIPNGTPLVLDALSGELFVNPAPEQQARLTVTLHHEQARRAALQTYRDVPAKTQDGHLVGLMANVGNLNDITHVSDVGADGIGLFRTEFMLMHTSTLPDEKAQYNLYCEALHALGGKTFTIRTLDIGADKELPCLCQEVEDNPALGLRGVRYTLAHPELFKTQLRAILRAANHGPIRLMFPMVNQVEELDQIFALIAECQDALEEEEKGFGELSYGIVVETPAAVMNLASMLPRLDFVSIGTNDLTQYAMAADRTNPQLTRDYPSLSPAILGLIKMTVEQAKAAGVKVSLCGELASSPQMVPLLIGMGLDELSVNLSALLEVKAAVCQGQLAKFSALAHTAMQQNRISELQQCITNYK

SEQ ID NO: 49243 - protein, 329 aa, Bdellovibrio bacteriovorus HD100
MAQFDKKIQKIGVYTSGGDAPGMNAAIRAVVRVGISQKLEVYGIHNGYVGMIENKIEPLQLRDMANIIQRGGTILKTGRSTEFMRPEGRARAAQNIKNLGLDALVCIGGDGSFRGAHALWEEHQIPVVGVPGTIDNDIFGSDKTIGFDTAVNTALEAIDRIRDTAASHDRLFIVEVMGRNSGFIASHVGLAGGAEEIFTPDANTTVEKAIDRINEAKSRGKTSSIIITAEGQKPGRAYDLADAIRKKSGMDAKVCILGHQQRGGSPTAADRILASRMGAAAVDALFKGYCDVMIGTEGERLIQVPLDLVYKNEKKNQLDLISLASVLAT

SEQ ID NO: 49244 - protein, 482 aa, Yarrowia lipolytica CLIB122
MISLLPDLDHLTGDEQAWFLTFASSVACILGCLILYVDSVIYGFRRLKGWITGEPAGETEDLWNSKGFLIISLSLSGGILIFTALYRLFPQALVYLEHSELLTPQQSNFLVLVMFTSGVIVCAGINYLVHAATSKSIVHCVHGDERKDSAVTATSSSSHTHTELPPPRAHTQTRTHSHVHGGHHHVHHQDSPLTHATHTHVIPAGEMSESTPLLHVAPRKRSILDLAHETIKGAAPVGECRGYTCGDCCAPEDQVICDPDPFEEPFAYPGEEFRFQDDHAHVHHDREDIDDIDPLDDHHHDHDHHDHDHDTDLEHQVHHHHVSTRRSHLYSIALQTGLAITLHKLPEGFITFATSHADKELGLNVFLSLVVHNFTEGFTIAFPFYASLRKKWQAVLLASILGGCSQPLGAVVAWLMFRHQNLHTDATDILYGSIMGMTCGFLCIIGLQMYGTAIGFGGTQKVCLTSAFAGMFIVGSCYALTA

SEQ ID NO: 49245 - protein, 574 aa, Oncidium Gower Ramsey
FGAFIVLCGATHLINLWTFTMHSRTLAIVMTVAKVSTAVVSCATALMLVHIIPDLLSVKTRELFLRNKAEELDREMGLIRTQEETGRHVRMLTHEIRSTLDRHTILKTTLVELGRTLDLAECALWMPLRTGLHLQLSHTLNNKIPVGSVVSINLPIVNQIFNSSRAGRIPNTCPLARFQPYTGRYVPQEVVAVRVPLLHLSNFQINDWPELSPKSFAVLVLMLPSDSARKWHAYELELVEVVADQVAVALSHAAILEESMRARDLLMDQNVALDLARREAEMAIRARNDFLAVMNHEMRTPMHAIIALSSLLLETELTPEQRLMVETILKSSNLLATLINDVLDLSKLEDGSFELEATIFNLHTVFREAVNLIKPIAAVKKLSLFVSHAPDLPSCAIGDEKRLLQIMLNVVGNAVKFTKEGTIFITANIAKPDSLRDPDFYPAPTDGHFYLRVQVKDTGCGISPQEFPHLFTKYAHTQNGSDKGYSGSGLGLAICKRFVNLMKGHIWLESEGIGKGCTTIFIVKLGMSEDPTPRYQQKLLPPIRAGQAEADPFGLKPAAPKDELMPKIRYQRSL

SEQ ID NO: 49246 - protein, 372 aa, Ostreococcus tauri
MRTAQHIRCSAKTMGASKRRAAAKPVRRDVRAHEYGASSTSMYTTTEKQESYPSLENILERHCKDEMLRKVIVEMLDCCADITEALRSALVTVEGSSNAFGDSQLSVDVIADNLMWDCVKSSDVVAYGASEEEPEIVACNPNGEYTVCWDPLDGSSIVDNNWAVGTIIGIWDSKSGTGADGLLGATGRDQRTSLVALYGPRTTVIVALDDGVFEFSYGCTPEGCQLPDGSFEPWICSRLDIKIKEDSKIFSPANMRAAQDTEGYKNLLDYYMDSRYTLRYSGGLVPDVYQQFTKNQGVFSNPTSAKSPAKLRLAFEAAPFGLLVEKAGGKTSDGVTGGSILDVQINAVDQRCALCIGSANEVDRFNKIVLGK

SEQ ID NO: 49247 - protein, 130 aa, Sporobolus stapfianus
GAAQALARESYFMAIDAGEGGSVSGSTGSKKRSFPDLNGSNSSKSAEALVKNVSKESLQWGLAAGVHSGLTYGLTEVRGTHDWRNSVVAGAVTGAAVALTSDRASHEQVVQCAIVGAALSTAANVLSGVF

SEQ ID NO: 49248 - protein, 266 aa, Aspergillus nidulans FGSC A4
MAHSHSHSHSHDNIADHGHSHEILDGPGSYLNREQPLIEDRDWSDRAFTIGIGGPVGSGKTALMLALCRALRDEYNIAAVTNDIFTREDAEFLTRNKALSPDRIRAIETGGCPHAAVREDISANLLALQNLHRQFQTDLLLIESGGDNLAANYSRELADFIIYVIDVAGGDKVPRKGGPGITGSDLLVVNKIDLAEAVGADISVMERDAAKMREGGPTVFAVVKKDQGVDHIVNLILSAWKASGAYELSLQRWKNGAPRGSGSVEP

SEQ ID NO: 49249 - protein, 191 aa, Magnetospirillum magnetotacticum MS-1
AVLVPGDIGDRPIASASSSGVEAFGRVDVLVNNAAHQATFTDPEEISDEEWEKTFRVNIHAMFYLTKAVLPHMREGAAIINTTSVNADTPSPQLLAYATTKGAIQNYTGGLAQMLAERGIRVNCVAPGPIWTPLIPSTMPAEKVKQFGSQVPMKRPGQPRELAPIYVMLASDESSYVSGATVAVTGGKPII

SEQ ID NO: 49250 - protein, 423 aa, Thermoplasma volcanium GSS1
MDINIGTTHKVFHVLSKIGPAWIVMMADVDVASIITGLQSGAEFGFHMIFVMLILIPPLFIVQNAAGYLGIYSGMGVGEAIRQRYGRRLALLAAIPMASTDILSYIAEYSGIAIGLYMVGVSPYISVPVVFVIHNLIVLMRRYGRIESILMIVSVGLVLFIIVSVALMKPSWHSVILTGLNPIQPYGNHDFDIMIIANLGAIIMPFMIFYQAGASVQKSLLDQDIKISRNETAIGSIVSEVLMVMIVIAGTFIGGYATEPKMLAAALLPFGTYAYYITAAGFVTAGFLALIVISLASSWGIAEALGWKLYSGRRRGMHKAQMKGLTEERSDCDRRKFIYLYMGESIPAAAIALSFSAYLLPLVIDLMIVFVLVLAPVGVLLGLLVSDQKIMNGHRLSKRYMALFWFTLAIIEIAGLYSIITSI

SEQ ID NO: 49251 - protein, 167 aa, Pyrus communis
MIGLLFGVSSAVTGAFEAEGAGLPPEEKPRLCDNSCEKELLKVPMVTTESGLQYKDIKVGQGPSPPVGFQVAANYVAMVPSGQIFDSSLEKGQVYIFRVGSGQVIKGLDEGILSMKVGGKRRLYIPGSLAFPKGLNSAPGRPRVAPSSPVVFDVSLEYVPGLDIEEE

SEQ ID NO: 49252 - protein, 364 aa, Vibrio cholerae
VTKLGRTLGRKGRANVTLVDRNSSHLWKPLLHEVATGSLDEGVDALSYRAHAKNHSFDFQLGSLASIDRESKTITLSELKDEHGELLMPKRDLEYDILVLAIGSTSNDFNTPGVKEHCIFLDSPEQANRFRTEMNNEFLKLHAKNGQGSVDIAIVGAGATGVELSAELHNAVKELRTYGFGDLDSSKLNVNLIEAGERILPALPPRISAAAHQELTKLGVNVRTMTMVTKAEKDGLTTKDGEKISAHIMVWAAGIKAPDFMKDIAGLETNRINQLVVKGTLQTTRDDDIFVIGDLAQCTQADGKFVPPRAQAAHQMASLAFRNIVAKMYGRELKAYVYKDHGSLVSLSRFSTVGSLMGNLTRGS

SEQ ID NO: 49253 - protein, 506 aa, Pyrus communis
MSPPEIAILILVFLTFLWSLLRLINVSSRQSRTLPPGPAALPIIGNLHMLGDLPHRSLQNLAKKYGPIMSMRLGSVPTIVVSSPKTAKLFLKTHDTIFASRPKLQASEYMAYGTKAMAFTEYGPYWRHIRKLCTLQLLCPSKIESFAPLRREEVGLLVQSLKVAAEAGEVVDFSEKVGELVEGITYRMVLGRKNDDMFDLKGIIEEALFLTGAFNISDYVPFLSPLDLQGLTKRMKRVSKTVDQLFEKIIQDHEQVSRSEQGNHHKDFVDVLLSSIHQTLKPNDEEVYMLERTNAKATLLDMIAGAFDTSATAIIWTLAELLRHPKVMKRLQEELQSVIGMDRMVEESDLPKLDYLSMVVKESFRLHPVAPLLVPHQSMEDITVDGYHTPKKSRIFINIWTIGRDPKSWDNAEEFYPERFMNRNVDLRGHDFQLIPFGSGRRGCPAMQLGLTTVRLALGNLLHCSNWELPSGMLPKDLDMTEKFGLSLSKAKHLLATPTCRLYNES

SEQ ID NO: 49254 - protein, 647 aa, Oryza sativa (japonica cultivar-group)
MASECDSFVRTMSEETHVEAYSLPMQNEDLHTSTNGAKGRAKRSSNFNRKEDIQLCISWQSISSDPIIGNEQPGKAYWQRIAEHYHANRDFESDRNTFSLEHRWGNIQKEVSKFQGCYEQIERRHPSGIPHQELLRNSPKFQTLKSHKRPRSRKSSTPIESAGEEDEEGDDARKSTTPDLSQPSAKKRPMGRKEAKEKLKNGGEDGPYKEAMKDLLDAKEKEAKVKEERWKETKEIQEHKLLFAERKLVWDQEQKIMFCDVSTLEPDVRTYVLAMRAQIAASKVAALNGGFDGSSGFGGKIVILFTSINVVFRLDKYRWMWVYPTESEVTHRDRSEADFIEYYNTEVRNEFRCAGVSVRRLVIESRGLALPVYANAHKLLYIIQGHGVFGMALPGCPETFQSVQYAFEQSSTQKLSDEHQQLHKFRQGDVIAVPAGVAHWLYNNGDSPMVAFLVIDFGNNANQLDPIPREFFLAGKPTSWQQEQYSYQAEQQSDNQNIFAGFNPDLLGEALGNALLTPHWTVNAHIVMYVTAGQGRIQVVDHRGRTVFDGELRQQQILLIPQNFAVAVKARQEGFSWVSFKTSHNAIDSQIAGKRSILRALPVDVVAKAYLLSREESRSLKFNRGDEMAVFSPRLHQQLYAEWQNSK

SEQ ID NO: 49255 - protein, 447 aa, Oceanobacillus iheyensis HTE831
MSKKIIIVGGVGGGATVAAQIRRTNKTAEILVLERNGYVSFANCGMPYYLGGTITDRQKLIYPEEKFAQKYDLTVQTHANVTKINREQKSVVYEKYKTEHKADYDILILSPGASPVLPDIAGLQQSNTFPLRTIEDMDNIEQFIQSNNPQSAAIIGGGFIGLEMAESLCHRGFSCSLVDRSEHVLKRIDKEMAIHIDEHLQEKGIALYVNDGLKSFSDNGTTLHLSSDKTIQADMTIMAIGIKPNTELAIDAGLEIGETGGIKVNQYMQTTDPTIFALGDAVEVTDFITREPAHIALAWPAHRQAFIISSFLSGNPISDDGIIGSSILRVFDLTVAATGQNKQTLIDNEIAFEETIMKGYSHAAYYPGSKELWMQIVYDKNTGQLFGGSVIGFDGADKRMAVLATAIKGKLTVADLASLELGYSPIYSGAKDPLNILGYKAMEQLED

SEQ ID NO: 49256 - protein, 178 aa, Solanum virginianum
TNRGCKAIFVSGGATSILLRDGMTRAPVVRFATAKRAAEMKFFVEDPINFETLSLVFNKSSRFARLQSIQCAIAGKNLYMRFSCSTGDAMGMNMVSKGVQNVLDYLQNEYPDMDVMGISGNFCSDKKPAAVNWIEGRGKSVVCEAIIKEEVVKKVLKTEVAALVELNMLKNLTGSAMA

SEQ ID NO: 49257 - protein, 497 aa, Oceanobacillus iheyensis HTE831
MTALTLETDVLKNFIDGKWVDVNNTTAVTNPANGERIVQVPLSDQSHVEEAVQAAIKAQKEWALVPAPQRAEVLYRVGMIMKDKKERLSRLLTMENGKVLEEARGEVQEGIDMAFYMAGEGRRLFGQTTPAELKDKFAMSQRVPVGVVGIITPWNFPIAIATWKSFPAIVAGNAVVWKPATETPIMAYELAKIFEEAGLPSGVINVVFGKGSEVGDSMVQHKDIRVISFTGSNDTGRNIASDCGKQLKKVSLEMGGKNAVIVMDDADLDLAVEGILWSAFGTSGQRCTACSRVIVHHKVKKTLEERLLAAMDHLTIGNGLEDGIKVGPIINEAGLNKIKKYIEVGKQEGATLLAGGTEWETNNPGYYFTPTLFTDAKPDMRIAQEEIFGPVVSLIEVSSFEEAIEVNNQVTFGLSSSIFTKDVNRVFKAQRDLDTGIVYVNAGTTGAEIHLPFGGTKGTGNGHRDSGVQALDVFTEWKAIYVDYSGKLQRAQIDTEE

SEQ ID NO: 49258 - protein, 643 aa, Triticum aestivum
MAALQPSFSSLMAMNNSCNTMKFPKTALLPGFGGISRPQDVQDRNASLTCSRPKAVSVTDQSVAEPAKPRQTKHTVDPAAPEFLPLPAFEDCFPRSTKECSEVVHEETGHALKVPFRRVHLTGDSGHFDTYDTSGPQNISPRLGLPKIRKEWIDRREKLGSPRYTQMYYAKQGIITEEILYCAKRENLAPEFVRSEVARGRAIIPSNKRHLELEPMIVGRNFLVKVNANIGNSAVVSSIEEEVHKLQWATMWGADTVMDLSTGRHIHETREWIIRNSSVPIGTVPIYQALEKVNGIAEDLSWEVFRDTLIEQAEQGVDYFTIHAGVLLRYIPLTAKRMTGIVSRGGSIHAKWCLTYHKENFAYEHWDDILDICNQYDVALSIGDGLRPGSIYDANDSAQFAELLTQGELTRRAWEKDVQVMNEGPGHIPMHKIPENMEKQLEWCNEAPFYTLGPLTTDIAPGYDHITSAIGAANIGALGTALLCYVTPKEHLGLPNRDDVKTGVISYKIAAHAADLAKRHPYAQAWDDALSKARFEFRWLDQFALSLDPVTAMSFHDETLPSDGAKVAHFCSMCGPKFCSMKITEDIRKYADEHGYGTVEEAVRQGMSEMSAEFLAARKTISGEQHGEAGGEIYVPESYVVQK

SEQ ID NO: 49259 - protein, 273 aa, Triticum aestivum
  misc_feature (247)..(248): Xaa can be any naturally occurring amino acid
DVYKARDTVSGKIAPRKKVRFDNLEPESVRFMAREILILRRLDHPSVIKIDGLVTSRMSCSLYLVFEYMEHDLAGLVASPDIKFTEPQVKCYMNQLLSGLEHCHDRGVLHRDIKGSNLLLDNNGMLKIADFGLASFFDPSHKQPMTSRVVTLWYRPPELLLGATDYGVGVDLWSAGCILAELLAGRPIMPGRTEVEQLHKIFKLCGSPTEEYWKKSKLPHATIFKPQQPYQRRIMDTFKDFPQSALXXLIETLLAIDPADRLTASSALRSDFF

SEQ ID NO: 49260 - protein, 151 aa, Brassica napus
MSDLKDRLLPPPLRGDSFSRPSSSGRQPLLGLDVSGLKKRGQGLKSWIRVDTFANTQLIEVDKFSMMRRCDLPARDLRLLDPLFVYPSTILGRERAIVVNLEQIRCIITADEVLLLNSLDDYVLGYVVELQQRLKASSVGDTFPDYLPFEF

SEQ ID NO: 49261 - protein, 195 aa, Vigna unguiculata
MATATVTLGGITDVPGAANSVEIANLARFAVDDHNKKQNGVLEFVRVISAKQQVVSGILYYITLEAKDGETKKVYKTKVWVREWLNPKEVQEFNLVTDSAIGTKDGGVGDVPSDTLHIENLARFAVDQYNKNENANLEFVRVIDAKEQVVEGFIYYITLEAKDGESKNVYEAKVWERSWLNSIELLEFKPVDVAV

SEQ ID NO: 49262 - protein, 350 aa, Oryza sativa (japonica cultivar-group)
MGAVLGTGRVGTLTRVALTIVVFLLLLPSHALAAAVAKDTSATLVETLPLPTTLVGPESVAFDKFGDGPYSGVSDGRILRWDGADEGWTTYSHSPGYNVAKCMAPKLHPAELTESKCGRPLGLRFHNTSGNLYIADAYKGLMRVGPRGGEATVLATEADGVPFKFTNGVDVNQVTGEVYFTDSSTRFQRSQHEMVTATGDSTGRLMKYDATTGYLDVLQSGMTYPNGLALSADRSHLVVALTGPCKLVRHWIDGPKAGTSEPFAELPGYPDNVRPDGKGGYWVALHREKTESPYGSDTHLLAVRIGRKGKILQELRGPKNVRPTEVIERGGGKLYLGSVELGHVAVVKAT

SEQ ID NO: 49263 - protein, 134 aa, Geobacter metallireducens GS-15
MSANKELYVGHMSYEATEDDLRRLFTVAGTVTSVHLITDRDTGEFKGCGYVRMATIEEAKEAVETLDGALLRNRAITVTLARPQKQTTRPGGRGGKGGPGPRTGGSRGKGGPAAGSGGPRGKSGPGTRPARGKK

SEQ ID NO: 49264 - protein, 1085 aa, Helicobacter pylori J99
MPKRTDISNILLIGSGPIVIGQACEFDYSGTQSCKTLKSLGYRVILINSNPATVMTDPEFSHQTYIQPITPENIAAIIKKEKIDAILPTMGGQTALNAVMQMHQRGMLEGVELLGAKIEAIKKGEDRQAFKEAMLKIGMDLPKGRYAYSELEALEAISEIGFPAIIRASFTLAGGGSGVAYNIEEFQELAKNALDASPINEILIEESLLGWKEYEMEVIRDGKDNCIIVCCIENIDPMGVHTGDSITIAPSLTLTDKEYQRMRDASFAILREIGVDTGGSNVQFAIHPETLRMVVIEMNPRVSRSSALASKATGFPIAKVATMLAVGFSLDEIKNDITNTPASFEPSLDYIVVKIPRFAFEKFAGVSSTLGTSMKSIGEVMAIGGNFLEALQKALCSLENNWLGFESLSKDLEAIKKEIRRPNPKRLLYIADAFRLGVSVDEVFELCQIDRWFLSQIQKLVKAEEGINSSVLTDAKKLRGLKNLGFSDARIATKIKENENLEVSPFEVELARSNLQIAPHFEEVDTCAAEFLSLTPYLYSTYAPNPLPPIGNKQEKQEKKILIIGSGPNRIGQGIEFDYCCVHASFALKDLNIKSVMLNCNPETVSTDYDTSDTLYFEPIHFECVKSIIQRERVDGIIVHFGGQTPLKLAKDLAKMQAPIIGTPFKVIDIAEDREKFSLFLKELDIKQPENGMAKSVDEAYSIANAIGFPIIVRPSYVLGGQHMQILENIEELRHYLESVTHSLEISPKNPLLIDKFLEKAVELDVDAICDKKEVYIAGILQHIEEAGIHSGDSACFIPSTLSPEILDEIERVSAKIALHLGVVGLLNIQFAVYQNSLYLIEVNPRASRTVPFLSKALGVPLAKVATRVMVLEDLKEALKFYDKKNIVEYSKGVYKPKMPHFVALKEAVFPFNKLYGSDLILGPEMKSTGEVMGIARSLGLAFFKAQTACFNPIKNKGLIFVSIKDKDKEEACVLMKRLVELGFELCTTEGTHKALEKAGVKSLKVLKISEGRPNIMDLMMNGEISMAINTSDHKSQDDAKLIRASVLKNHVSYFTTLSAIEVLLLALEESSQEDELLALQDYLK

SEQ ID NO: 49265 - protein, 324 aa, Aspergillus nidulans FGSC A4
MSSSLEQLKATGTVVVCDSGDFATIDKYKPQDATTNPSLILAASKKPEYASLIDAAVEKGKKQGGSVDDQVDATLDYLLVEFGKKILDIIPGKVSTEVDARFSFDTKASVDKALHIIKLYEEAGISKDRILIKIASTWEGIQAAHILQSQHGINCNLTLMFSLVQAIAAAEAGAFLISPFVGRILDWYKAAHKRDFSKEEDPGVKSVQSIFNYYKKFGYKTIVMGASFRNVGEITELAGCDYLTISPGLLEELYNSKDAVPKKLDAASATTLDITKRSYLNDEALFRFDFNEEAMAVEKLREGISKFAADAVTLKDILKQKVQA

SEQ ID NO: 49266 - protein, 228 aa, Sulfolobus tokodaii str. 7
MKAVILAGGYGKRLRPLTDDKPKPLVEVAGKPIIEWQIHWLKSFGITSFFVLAGYKKEALIEWISKNQQRLNVSIATLTEEEPLGTGGAIRRLKDFISDDFIVINGDILTNIDINKMVLKDCIVAIALVPLRSPYGIVSIDDNGKIIRFVEKPLLKEYWINAGVYKMKPEVFEYLPEKGDIEKITFPSLAEKGLLKGVTYENVYWRSIDTIKDYEEASVEIPEVFKKL

SEQ ID NO: 49267 - protein, 677 aa, Streptomyces virginiae
MPDAAPDAKKKKAKSSENVLSRAGGTGDTIPRDRRAAFLEQMMLSRECDRRSGIVLRQGQAWFHISSAGHEALAALCELLEPEDLIFPHYRDRTLMLARGMDAEGQARDLMAKGGSHSAGRNMSSHFSHRPGNVFSLASPTGSQCLPAAGAAWASVLSGERKVVVCSIGDASTRQGEFFEALAFAVERKLPVVFLVSDNRYGISTPTDGLSPQRLGLMPDAITKVVDGSDPDAVHAAAAAVLPDVRAGRGPAVLWCRLDRLDSHTSSDDQRLYRTKDELAAMRDPVALFTDRLEAEGTIVPGWADQVRARLADDVEEVFDRVAGEPSADPGEVMDHLFAAADEQPTAPADTRPCGGTMVEAVNRALRTGLENDPTLVLFGEDIEDPKGGVFGFTKGLGTLAGPRMTNSPLAEATIVGAAVGLAAAGMRPVVELQFVDFAGPAWNQIASQLTTLRWRTASAWRCPVVIYAPWGGYLPGGGIWHSQSNESLFTHLPGLRVVVPSTPEDTEAVFLESFASPDPTLILLPKHLMRRQHPPQPGPAPARGARLLRTGADVTIATWGNGTELATEAADRLAAEGVGTEVIDLRWLTPVDREAVAASVRRTGRLVVVQEDNRTSSFGATVLADLLGSDDEFYSLLAPPRLVSRRDVHIPFHPDLESAVLPAADDVVAAIRSVLA

SEQ ID NO: 49268 - protein, 331 aa, Oceanobacillus iheyensis HTE831
MVQGSVNLNTERGKEWLQDYVDNWVNFYQKQTDEGKVASYIPRLEHADPNALGISIIGKNGTVIRSGDTDLEFSIQSISKVLSFIVACMERGLSYVLQRVDVEPTGESFNSIMHLEINQPKKPFNPLVNSGAITVSSLLNGRTSDQKLEPLYQLLEKILGHRPEIDVEVYVSERDTSMRNRAIGYYLLEEGYLESDLSITLETYFKHCSLNVTVDDLAMIGLVLSNDGVHPNTDEPLIPKQIARVAKSLMLTCGMYDASGKFASYVGIPAKSGVSGGILAVVPPRVRDQNLPFLEGCGIGVFGPALDKQGNSIAGIKLLRHIANQWDLSLF

SEQ ID NO: 49269 - protein, 191 aa, Brassica napus
  misc_feature (139)..(139): Xaa can be any naturally occurring amino acid
MGKKRKATATSLDEVDRTVYASFRTAANSLSQLYTQSMNHQKLSFQAGERHGLEKLYQWIWRQQEGGSRVTSMDIINYIQNELECCTEEPPISPRAPPTQPAMNVTSSGLMASSGTSCPTAVPVVRSEQCENQAKNSVXSNALSSPIRRSLQNYQIPQGGGYISVGTRSSELNRGSNSPGSFDSSMDMHAD

SEQ ID NO: 49270 - protein, 379 aa, Shewanella sp. MR-4
MSNEKPQFIKSKAAVAWGPGQPLKIEEVDVMLPKAGEVLVRIVATGVCHTDAFTLSGDDPEGVFPAILGHEGGGIVEQVGEGVTSVQVGDHVIPLYTPECGECKFCLSGKTNLCQKIRATQGKGLMPDGTTRFYKDGQPIFHYMGCSTFSEYTVLPEISLAKVNKTAPLEEICLLGCGVTTGMGAVMNTAKVEEGATVAIFGLGGIGLSAIIGATMAKASRIIAIDINESKFELARKLGATDCINPKHFDKPIQEVIVEMTDGGVDYSFECIGNVNVMRSALECCHKGWGESVIIGVAGAGQEISTRPFQLVTGRVWRGSAFGGVKGRSQLPKIVEQYLAGEFKLDDFITHTMGLEQVNEAFDLMHEGKSIRSVIHFDK

SEQ ID NO: 49271 - protein, 241 aa, Ostreococcus tauri
  misc_feature (126)..(132): Xaa can be any naturally occurring amino acid
MRIPTPMDNCGPAPKIPRCSGGASSLMYIGTTMDTKPTPIPTSARPKRMPSRVVAVAHAALPSAHAAPESPNAFTQRPDRRKEQHRAHDGALRRDVVRDSDVSREILQRRIHHTAVIPERKRPERXXXXXXXRRVARAEGGKGGVKTPAATGTASETHARGLNYAKGGSDPELGPDDAYPSWLWTILETKESLGGYERRIAALKAEGLDWRNEFSEEDAKRYRKLERVNRIKTNNALRAKK

SEQ ID NO: 49272 - protein, 493 aa, Geobacillus kaustophilus HTA426
MRIKQHYPLFINGQYVESSNGEVFETVNPATEEVIATVAKATKEDVDHAVEAARTAFESGKWPKMTGAKRARLLNQIANLMRERFDDLVYAEVLNSGKTVDAAKGQIMQAIEDFEFYAAAAITLQGDVNQVPNGFFNYTVKEPVGVCGQIIPWNYPLMMAAWKLAPALAAGCTVVLKPASYTPITAYMLAEICQEAGVPDGVVNVIAGSGSEIGPYMTEHPGIDKVAFTGETETGKDIMRRASETLKRVTLELGGKSPNIVFDDCDIEAAVNGSLYGIFYNTGQSCEARSRLFVHENIYDEFMEKLIEKASRIRVGNPFEKGVHMGAVISRSHQQVIDSYVKLAVEEGGEILYGGKIPEGEEFAKGYWYMPTIIGNVRNDMRVAQEEIFGPVVVVMKFHDEEEVIELANDTIFGLGSAVWTKDHGKAHRVAACIRAGIVMINSPISAFPGTPFGGYKQSGFGRELALETLNLYTETKSVVSYIGAKPLNLFGI

SEQ ID NO: 49273 - protein, 169 aa, Pseudomonas fluorescens Pf-5
MPCAETFGSEYFLAQGSPVNSTATPPEPLPPFLQPGDRVLLFDGVCKLCNASVRFVIRHDSQRRIKLASVQSPQGQALLAWFGLPTEQFDSVVLIEEGRLSQRSDAFIRLMAQLPAPWRWLRLLRGVPRPLRDWVYDLIARNRYRLFGRLDVCLLPSPDHQGRFLDDPS

SEQ ID NO: 49274 - protein, 291 aa, Magnaporthe grisea 70-15
MAERQLQQILTQLKSQQLAYADAAKLLSKAKLLLLQLGALTPKTTTTTSSSTSSGKGKSSSSGGASPSAAQLALARETYEQGALYSIRAKNADGFTRYVQQLSPLYELPANVLPPNLPERNKVTGLYLLLLLTQGRYAEFHSELEALSTREGGGGSVDVEGDRYLGYPIRLERWLMEGSYDRVWKAMKKGEVPCEEYGVFSEILTIQIRAEIASSSERAYPSLPISSTKSLLFLESEGAVVEFAKRRGWTVRDGHIYFPTAGAEDGEPEKPVSLSFIENTLGYARELETIV

SEQ ID NO: 49275 - protein, 396 aa, Robiginitalea biformata HTCC2501
MTIDKFDFKDKKALVRVDFNVPLNEDFQVTDTNRIEAAKPTIIKILEDGGSAVLMSHLGRPKGSPNPDLSLSHIVDTVSDIIGVEVKFASDCIGDSAAAEVEALQSGEILLLENLRFHGEEEAGDREFARKLSQWGDIYVNDAFGTAHRPHASTTVVAEFFPEKKCFGYLLAREIEAIDKVMETGEKPVTAILGGAKVSSKITIIENILDKIDHLIIGGGMTYTFVKARGGSVGDSICEPDKTDLALSILEKAKAKGVAVHLPVDVVAADAFDNDAESRIMAVDAIEDGWQGLDAGPETLERFRKVILESRTILWNGPVGVFEMPNFAKGTIAVGNYVAEATRNGAFSLVGGGDSVAAVKQFGFDEKVSYVSTGGGAMLESLEGRTLPGIAAIRGS

SEQ ID NO: 49276 - protein, 681 aa, Debaryomyces hansenii CBS767
MSDANDTSGNLSPGFENLNIRTPKAVNTESTQSPQRVSHSQINGDIQARILAFQQKRTKPVNGGHGALNPISKSTSHLSEAPDKPLPPLPPLPTLPTMLLQQRSYSLGDTSDPGLIPSPMETENIQNTNHSVNRSMGQSMSQVMGQGISRTSSLKKQEPQQLPFELLKKPSLSQRRGMKLNLSEMSSPTSASSPDDTSPIGDGKESLVFLNAPKGSVLDNNAMNTTGDLTRRVSERKNKPNFKLNLANTGGPGVSGMNPQSTSNSNSNSTISSLNSSGSSSTMATNNETNQSKKPQLQGLFANYSKYVDIKSGSLNFAGKASLHSKGIDFLSGLLFRISLEELEFLEELGHGNYGVVLKVLHKPTGVLMAMKEVRLELDETKFTQILMELEILHKCDSPYIVDFYGAFFVEGAVYMCMEYMDGGSLDKIYGKDDGVNDEACLAYITECVIRGLKELKDEHNIIHRDVKPTNILVNSLGKVKLCDFGVSGNLVASLAKTNIGCQSYMAPERIKSLSPTDNTYSVQSDIWSLGLSILEIAAGHYPYPSETYGNIFSQLSAIVDGDPPRLDPKAFSKDAQLFIKSCLNKNPDLRPSYATLLKHPWLVNHRDIDPHMDKFVTKKLEELEEQKNKKNLSRSNSVNSSTTTAKPPKESVRSLLKGKVQAPALHRGGLMNSNRNSVNR

SEQ ID NO: 49277 - protein, 322 aa, Saccharophagus degradans 2-40
MQNLQGMLRDQRVAQDLQEVIFSIELACKDIAKKVQLGALAGVLGATESENVQGETQKKLDVISNDILKASLAANSNVLALASEEEDNVVAANAGGRYVVAFDPLDGSSNIDINGQIGTIFTIFEALDGVAANSGKHFLQQGNKQVCAGYVLYGASTLMVITVDGPTSCLTLDPATQTFSLTNTALQVPDQTQEFAVNLANERFWLPKFKSYVADLKLGEEGVRGKRFNMRWNASMVGDVHRVLMRGGIFMYPSDTRNPKQPAKLRLLYEANPMALLIERAGGKAFNETQRILDVTPCALHERIAVILGSEQEVATCLEYLN

SEQ ID NO: 49278 - protein, 327 aa, Vigna unguiculata
PRVRAAATETAGGIIDVSGSANCLEIAILARFAVDDHNKKQNGVLEFVRVISAKQQVVSGILYYITLEAKDGETKKVYKTKVWVREWLNPKEVQEFNLVTDSAIETKDGGVGDVPSDTLQSGRRESDEEQRNMATATVTLGGITDVPGAANSVEIANLARFAVDDHNKKQNGVLEFVRVISAKQQVVSGILYYITLEAKDGETKKVYKTKVWVREWLNPKEVQEFNLVTDSAIGTKDGGVGDVPSDTLHIENLARFAVDQYNKNENANLEFVRVIDAKEQVVEGFIYYITLEAKDGESKNVYEAKVWERSWLNSIELLEFKPVDVAV

SEQ ID NO: 49279 - protein, 364 aa, Vibrio cholerae
VTKLGRTLGRKGRANVTLVDRNSSHLWKPLLHEVATGSLDEGVDALSYRAHAKNHSFDFQLGSLASIDRESKTITLSELKDEHGELLMPKRDLEYDILVLAIGSTSNDFNTPGVKDHCIFLDSPEQANRFRTEMNNEFLKLHARNGQGSVDIAIVGAGATGVELSAELHNAVKELRTYGFGDLDSSKLNVNLIEAGERILPALPPRISAAAHQELTKLGVNVRTMTMVTKAEKDGLTTKDGEKISAHIMVWAAGIKAPDFMKDIAGLETNRINQLVVKGTLQTTRDDDIFVIGDLAQCTQADGKFVPPRAQAAHQMASLAFRNIVAKMYGRELKAYVYKDHGSLVSLSRFSTVGSLMGNLTRGS

SEQ ID NO: 49280 - protein, 787 aa, Neisseria meningitidis FAM18
MQFSYSWLKTQADTELSADKLEHLLTMSGLEVEEAETAAPAFAGVVVAEVKSVEKHPDADRLNVTRVDAGTGELVQIVCGAPNVKAGIKVPCSLPGAVLPGNFKIKPTKMRGVPSNGMLCSTNELGLPDDGVNGLHILPEDAPVGINIREYLDLDDTLFTLKITPNRADCLSVKGIAREVSALTGCAFRQPEIHTAPITGSRKQPVQINAPADCGRFISRVIENVNAKAATPDWMKQRLERSGIRSISVLVDIGNYVMLEIGQPMHVFDADKLSGSLHIRRAREGETLECLNEKTVSLSENTLVVADEKGALSLAGLMGGAASAVSDGTQNIVLEAAWFAPEIIAGKSRQYGFGSDSSFRFERGVDYRLQADAIERATELVLQICGGAAGEMVEAQGELPEAKQVGLRLDRLKTVLGVDIPAEQVETILQHLGLQPEKTAEGFRVTAPSFRFDIEIEADLIEEIGRVYGYENIPDDYTSGRLKMLELPETRRSRFAVYNEMAARGYREVVSYAFVDEQWEQDFAANADPIRLQNPLAAQYAVMRSTLIGGLVEILQNNLNRKQNRVRVFEIARVFGKGSDGRFVQNERIGGLWYGAAMPEQWGGKTRNADFYDIKADVENLLKNKAVEFVKTGYPALHPGRAANIVSDGKVIGFVGELHPKWLQKYDLPQAPLVFEIDMAAVLECGKTRYRAVSKFQPVRRDLAFVMPEAMSHDDLLLVLKGAANKLVQEISVFDVYRGMGLPEGMKSVAVKVILQDMENTLTDEAVEPLIGKLIGAATAAGARLRS

SEQ ID NO: 49281 - protein, 121 aa, Arabidopsis thaliana
  misc_feature (83)..(83): Xaa can be any naturally occurring amino acid
MASFMVFFTGGGTFPAQATMVASFTGLESFASFPGTRKGHHHLTFITSHGRRSSCVKGGPPIGKKKVETFFYLPDLNDLELAXKEVTTLFRTRGFPGVKSKWNPELGSRNPGTLPGSYNGQ

SEQ ID NO: 49282 - protein, 123 aa, Brassica napus
ITHLIKFKDVNSMVGLESARSHRFPPTIREKCNRLFKDSETSRLPDDKINLLISYVLVLTLHVDKFKTDFEDIAKDLRMSSVDLRKHFENLGCKFAVENSIRVATLPVPLKFPQIMRRRTKRR

SEQ ID NO: 49283 - protein, 499 aa, Shewanella sp. MR-4
MAQDLSSLPTALYTQQQVRSAELLAVSEGETTLYQLVERAGRAAFECFTEQRELHPQLEGMPLLVLAGSGNNGADALVCARLALEAGHQVKVYLLKTQGTAEFEQALSAYLNQGGVIDSPNIEAIQQAPVIIDGLLGTGVKGAVREDIAALIHAVNQSEAWVLSLDLPSGIVADTGVVAQAAVMADVTLCFGGLKQGLLTSKARHHCGHLTFADLGLTPFFDTESATRVGGEMLKSHFAARARDSHKGQSGKVTLIGGDFGMAGAIRLASEACLRAGAGLVTVISRPEHQLTVNVSRPELMFWGCELVDMEVYLRLGWAQVVVLGPGLGKHDWGYNLFKAAGLSDKPCVLDADALNLLSQEPRRQTNWVLTPHPGEAARLLGCSVADIEQDRFAAVRALQQKYGGVVLLKGAGTVIFDGKQMVVAPVGNPGLASGGCGDVLSGIIGALMAQGMDNMQATVVGVVVHGCAADLAAVQGERGMLASDLMPFIRQLVNSDLL

SEQ ID NO: 49284 - protein, 384 aa, Mycobacterium sp. MCS
MARDYYGLLGVSKGASDQEIKRAYRKLARELHPDVNPDEEAQARFKEISAAYEVLSDPEKRRIVDLGGDPLESAGASGGNGFGAGFGGLGDVFEAFFGGGGGSRGPIGRVRPGSDSLLRMRLDLAECATGVTKQVTVDTAVLCDLCHGKGTHGTSTPATCDTCGGRGEIQTVQRSLLGQVMTTRPCPVCGGVGEVIPDPCHRCGGDGRVRARREISVKIPAGVGDGMRVRLAAQGEVGPGGGPAGDLYVEVHEKPHDVYVRDGDDLHCTVSVPMVDAALGTTVSVDDILGGPLELTIAAGTQPGAVSTLRGHGMPHLRSGVRGDLHAHIDVVVPAKLDHTDIELLRQLKEHRSRDVAEVRTSSSPAASNAGGLFSRLRETFTGR

SEQ ID NO: 49285 - protein, 491 aa, Escherichia coli
MMSRMAEQQLYIHGGYTSATSGRTFETINPANGNVLATVQAAGREDVDRAVKSAQQGQKIWASMTAMERSRILRRAVDILRERNDELAKLETLDTGKAYSETSTVDIVTGADVLEYYAGLIPALEGSQIPLRETSFVYTRREPLGVVAGIGAWNYPIQIALWKSAPALAAGNAMIFKPSEVTPLTALKLAEIYSEAGLPDGVFNVLPGVGAETGQYLTEHPGIAKVSFTGGVASGKKVMANSAASSLKEVTMELGGKSPLIVFDDADLDLAADIAMMANFFSSGQVCTNGTRVFVPAKCKAAFEQKILARVERIRAGDVFDPQTNFGPLVSFPHRDNVLRYIAKGKEEGARVLCGGDVLKGDGFDNGAWVAPTVFTDCSDDMTIVREEIFGPVMSILTYESEDEVIRRANDTDYGLAAGIVTADLNRAHRVIHQLEAGICWINTWGESPAEMPVGGYKHSGIGRENGVMTLQSYTQVKSIQVEMAKFQSIF

SEQ ID NO: 49286 - protein, 458 aa, Nocardia farcinica IFM 10152
MEAGRKIARMAVLDEKLHEVYEEILRRNPGEIEFHQAAFEVLESLGPVVAKHPEYTDGAVLRRLCEPERQIIFRVPWVDDQGRVQINRGFRVEFNSALGPYKGGLRFHPSVYLGIVKFLGFEQIFKNSLTGMPIGGGKGGSDFDPKGRSDGEVMRFCQSFMTELYRHIGEYTDVPAGDIGVGGREIGYLFGQYKRITNRYESGVLTGKGLTWGGSQVRPEATGYGTVFFVDEILRSRGDSFEGKKVVVSGSGNVAVFAIEKVEQLGGTVVACSDSGGYVVDDKGIDLDLLKDLKQVRRGRMCDYVEERGGTARYVENQSVWDVPCDIALPCATQNELDGEAAATLIRNGVRIVAEGANMPCTPEAARAFTEAGVTFAPGKAVNAGGVATSALEMQQNASRDSWSFEHTEERLAEIMRGIHDRCLETADEYGSPGSYTAGANIAGFTRVADAMLALGII

SEQ ID NO: 49287 - protein, 219 aa, Shewanella sp. MR-4
MTTGTTSSCCQGPASAELVNSLDWEKQQGLIPAVIQNHLSGKVLMLGFMDKAALQHTLVTGDVTFFSRSKQRLWTKGETSGHTLKLVAIDKDCDNDSLLVQVLPNGPTCHKGTESCWLDGNAHPFLNNLAELIASRKGQNPESSYTASLFARGTKRIAQKVGEEGLETALAAATHDKEELINEASDLMYHLLVLLEDQSLSLSDINANLLARHQKAQQK

SEQ ID NO: 49288 - protein, 439 aa, Pseudomonas fluorescens Pf-5
MKFSLPKIATAPFCPPEVAGSVAVDPGASLWRRLLRFAGPGLLISIGYMDPGNWATAIEAGSRYGYNLLFVVLLASLAGMAVQCLCSRLGIATGRDLAQLCRERYSTRSARTQWLLAEVSIIATDLAEVLGCALAFHLLLGVSLSTGIVITAFDTLLVLALQNRGFRRLEAIMLALVATIGVCFFIELLLIKPYWPDVARGFVPSLSAIGDAAPLYLAIGILGATVMPHNLYLHTSVVQTRLVGNDRASRADAIKLARIDTIGSLALALLVNAAILILAAAAFHNTGHSDVVEIQDAYHLLDPLVGGALASVLFGVALLASGQSSTFTGTIAGQVIMEGYLNLRIPCWQRRLITRGLALIPAFIGVWLLGDGAVGQLLVLSQVVLSLQLPFALYPLIRMTNDRRLMGEFVNRWPTRILAWSLFAIIGAANAWLILQMAL

SEQ ID NO: 49289 - protein, 522 aa, Oryza sativa (japonica cultivar-group)
MGCCGSSLRVGSHAPEKPPRRARPPPPPPQPHHPRRPSFTLNAHQAAASSSAASAAPAPAFAEFSLAELREATGGFAAANIVSESGEKAPNLVYRGRLQGAGGGGRAIAVKKFGKLAWPDPKQFAEEARGVGKLRHRRMANLIGYCCDGDERLLVAEFMPNDTLAKHLFHWENKAIEWAMRLRVAYNIAEALEYCSNEERPLYHDLNAYRVLFDENGDPRLSCFGLMKNSRDGKSYSTNLAYTPPEYLRNGRVTLESVVFSFGTILIDLLSGKRIPPTLALDMIRSRSIQAIMETNLEGKYSIEEATTLVDLASKCLQYEPRDRPDIKKLVSILQPLQTKSEVPSYVMLGVPKPEEVPKAPPAPQHPLSPMGEACSRMDLTAIHQILVSTHYRDDEGTNELSFQEWTQQMRDMLDARKRGDFAFRDKNFKQAIDCYTQFVDVGTMVSPTVYARRSLCHLMCDQPDAALRDAMQAQCVYPDWPTAFYMQAVALSKLNMQSDSLDMLNEASQLEEKRQKSIKGP

SEQ ID NO: 49290 - protein, 363 aa, Shewanella sp. MR-4
MNPVFTPNVAQKILFIDRDGTLIEEPITDKQVDSLAKLVFEPQVIPALLRLQKAGFRLVMVSNQDGLGTPSFPQEDFDAPHNMMMQILSSQGVKFEDVLICPHFNDENCSCRKPKLGLVKDFLTQGTIDFTQSAVIGDRHTDVELGNAMGIKSFQYQRGSLGWDAIADALLNKGRTATVVRTTKETDIRVTVDLDNASKGTINTGIGFFDHMLDQIATHGNFKMEVNVDGDLEIDDHHSVEDTALAIGDALRQALGDKRGIARFGFSLPMDEAKGECLLDLSGRPFIKFAAQFEREKVGEMATEMVPHFFRSFADGLRCTLHVAAEGDNDHHKVEALFKVLGRALRHAIKVEGDVLPSSKGVL

SEQ ID NO: 49291 - protein, 401 aa, Rhodococcus sp. RHA1
MVAPGERLTWPRTVGIGMQHVIAMFGATLLVPTITGFPVTTTLLFSGIGTALFLLITRGRIPSYLGSSFAFIAPLTASQSSGPAAQLGGVAAAGLLLLVVGIAVKLAGSRVIDAVMPPVVTGAVVALIGLNLAPTAVDSFESQPLIAGVTLLAILLVTVLGPGLLGRLGILVGVVVGWVFAAVIGGLAEERVTALREAAWFGVPELRGPTFEWSVIALTLPVVIVLVAENVGHVKAVSAMTGRSLDDVAGDALVADGLATTLAGFGGGSGTTTYAENIGVMAATRVYSTAAYWVAAATAVVLAFSPKFGALVFTVPNGVIGGATLVLYGLIGVLGVRIWMDAEVDFTDPVNLTVVAAALVAGIGDLTLTIGSVELGGIAWGSVGILVAYPVMRSLARFRKP

SEQ ID NO: 49292 - protein, 518 aa, Ostreococcus tauri
MTLETLEDDEHAHHGTHDVLHEVMDMTSSAMEALSRSALVGDADGTVKRHGTVVGSTATLANCAIGAGVLAIPFAIRELGYALGGIVVLVAAMLVAYTLLVLVRAGSAFGSTSYQGLVKDAFGLNVSRAVSVVLIVYLFGSCVAYLIIIGDSYTKVVSAFAGDAASAWWANRRFAIAIIGAFVVTPLSLLREMSRLALASAMAVMALGYTATVIMCKGLTPAADSTALATAFKLDIGSISAVPIVVFAFQCHIQVLAIFSELGSSETAQSGEIIELHDSSASERRRMKRMRVVIALAVGVCFVGYISVGEFAYISHPDVTSNVLDSYDKNDKAMLLATILMGCSAVSSFPVNHHAARAALDDLLASAFGWEECAPGQSPATRHVSQTLGFVLIAAVVSFAVTDLGKVFELVGATCGSLVMFVIPALLLVHPEMRAENRDTLDPLEDLAGLDDVTRELLSSARDLLERDFGEDAGDIEEDVVGISRLNSPGVGAIVTATTLCLIALFVATSNVYVIFFR

SEQ ID NO: 49293 - protein, 245 aa, Bacillus anthracis str. Ames
MIKLVLIRHGQSLWNLENRFTGWTDVDLSENGLSEAREAGAILKKNGYTFDVAYTSVLKRAIRTLWIVLHEMDLAWVPVHKCWKLNERHYGALQGLNKDETAKKYGEEQVHIWRRSIDVRPPALTEDDPRYEMNDLRYKALKKGEFPLTECLVDTEKRVLDYWHSEIAPKLKNGNKVIISSHGNTIRSLVKYLDNLSSDGVVSLNIPTSIPLVYELDENLRPIRHYYLSMDGEVPEGEIPKHITF

SEQ ID NO: 49294 - protein, 375 aa, Glycine max
MSKTSEIITCKAAICWGIGKPVTVEEIQVDPPKATEVRVKMLCASICSTDISSTKGFPHTNFPIALGHEGVGIIESVGDQVTNLKEGDVVIPTYIGECQECENCVSEKTNLCMTYPVRWTGLMPDNTSRMSIRGERIYHIFSCATWSEYMVSDANYVLKVDPTIDRAHASFISCGFSTGFGAAWKEAKVESGSTVAVFGLGAVGLGAVIGSKMQGASRIIGIDTNENKRAKGEAFGITDFINPGDSNKSASELVKELSGGMGADYSFECTGVSTLLSESLEATKIGTGKAIVIGVGIEITLPLGLFAILLGRTLKGSVFGGLRAISDLSILADKGHKKEFPLQELFTHEVTLADINKAFELLKQPNCVKVVINMP

SEQ ID NO: 49295 - protein, 171 aa, Triticum aestivum
  misc_feature (110)..(110): Xaa can be any naturally occurring amino acid
  misc_feature (131)..(131): Xaa can be any naturally occurring amino acid
MAPAVMASSATTVAPFQGLKSTAGLPVSCRSGSTGLSSVSNGGRIRCMQVWPIEGIKKFETLSYLPPLSTEALLKQVDYLIRSKWVPCLEFSKVGFVFREHNSSPGYYDXRYWTMWKLPMFGAPTHTVLNXWRSQEGVPDAYVAYRFTHRKMSSCLRHKLQESGRLMKITI

SEQ ID NO: 49296 - protein, 248 aa, Triticum aestivum
MDSEHWISRLAAAKRFYAAQLGHIDDMAGMGMEEVDMDMEDDGEMDMEMEMQLEEARWPEVACPYCYEDYDLGSLCVHLEEDHPYEPHPAPCPICSEKITRDMLNHITMHHGYLFKNGSRLRRFVIPERRALSLLSRDLRDAHLQALLGGGHSHRSRNTTTATTNIYADPLLSSFGLGFATSDAEEPLKSSVPVLDDTSILKEAPPQPWESSIDSSLTSEEREQKRKQATSRATFVQDLVLSTLFGDD

SEQ ID NO: 49297 - protein, 756 aa, Ostreococcus tauri
  misc_feature (668)..(674): Xaa can be any naturally occurring amino acid
MAASTAETRDSPRTRLLESGYASDDDVDGGRDAREAREERGGAVSRRKTFAARTHSLYLGLELERADEEEECESLDFHDVDSHWARRSRGRFPRGWAKWIVAAVIGVIVGLIAFAIDVAVSALFRGRRALFELCRDRVHLALAVFAHIALGVVTAAFAGLLTVYMSPSAKGSGVHYVMAVLNGVHVPKAFDGLTLVVKSIGTIFAVGSGLMIGPEGPLVHIGAAIAMQFTHGGSFGMAELFRSDEDRSDFISAGVSAGLGAAFGAPIGGVLFSLEEASSFWRESTTQRALFSSTIATFVLSVCRAVMSGSAVKEHTAMKQPGLIALGEFDATYYLVEMPFFGALAGVCGVISGLITKLIVVLSEFAPIRNSHRFAQVVVVTAATLGAFYLAAAAGSCVKTSPDETTKWSEASIRLWCKPGEYADVGSILLANKQDVISWVLGAPANAHAAHALLVAFFVTLFGMVSAANLFVPAGLFMPTILWGGLLGRFTAILCNHHAYALVGSAAALAGTFRATVSVVIILLEGVGKSAFLFPLLTAVACSNFTRRMFGASLYVEQLRQAKIPFLHTKPPKSLDDTLCASDICSRDIVYFRTIEKVGVIEDALANTRHNGFPVCSSKSKRVLGVVLRKQLLVLLSRRAFVENLVHAPRAEDGLADESVLGGRTPDXXXXXXXERRCDLGVFMQLAPPTTRADASARAAWETFTRLSLRHLPVVADDDRGAVIGVITRIDLIVAAARRPSTHDGDGDDDDDDDGV

SEQ ID NO: 49298 - protein, 338 aa, Glycine max
MDQKLVSSWFHLHSSVPLSYVQPPESRPGMVEASSKRKIPVVDLGLHDRAETLKQILKASEEFGFFQVINHGVSKELMDETLDIFKEFHAMPAEEKIRESSRDPNGSCRLYTSREINDKDVVQFWRDTLRHICPPSGEFMEFLPQKPAKYHEVVAKYAQEMRTLGLKILELLCEGLGLDQNYCCGELSDSPLLLAHHYPPCPEPTLTLGAPKHRDPNLATILLQENDINALQVFKDGEWIVVEPIPYAFVVNIGLMLQIISNGRLVGAEHRVVTNSGIGRTTVAYFIRPTNKQIIEPAKPLLSSGARPIYGSITYEEFLRNFLSKGPEIEQELLLKPS

SEQ ID NO: 49299 - protein, 348 aa, Petunia x hybrida
MKTAQGVSATLTMEVARVQAIASLSKCMDTIPSEYIRSENEQPAATTLHGVVLQVPVIDLRDPDENKMVKLIADASKEWGIFQLINHGIPDEAIADLQKVGKEFFEHVPQEEKELIAKTPGSNDIEGYGTSLQKEVEGKKGWVDHLFHKIWPPSAVNYRYWPKNPPSYREANEEYGKRMREVVDRIFKSLSLGLGLEGHEMIEAAGGDEIVYLLKINYYPPCPRPDLALGVVAHTDMSYITILVPNEVQGLQVFKDGHWYDVKYIPNALIVHIGDQVEILSNGKYKSVYHRTTVNKDKTRMSWPVFLEPPSEHEVGPIPKLLSEANPPKFKTKKYKDYVYCKLNKLPQ

SEQ ID NO: 49300 - protein, 337 aa, Xylella fastidiosa Dixon
MNAPQAPVLVADIGGTNARFALANPTLTSAPLLNDSMREFAVIEFPSLGEAAQHYLHHIGIHTTKGVFAIAGHVDGDEARITNHPWVITRTRTATMLGFDTLHLINDFVAQAMAISVLGPQDVIQIGSAKWEQFPLSAATRNYGIIGPGTGLGVGGLVIRNGRCYPLETEGGHVSFPPSTPEEIRILEILSQQFGRVSNERLISGPGIVNIHRALSEIDGIDPGPLRPQDITMRAADGDIRATRTINLFCNIFGAITGDLVLIQGAWDGVFLTGGLVPKLLNSIQHSGFRQRFEHKGRFSAIMARIPSLAVIHPHPGLLGAAVYARDTEQVPQEIKA

SEQ ID NO: 49301 - protein, 363 aa, Vibrio cholerae
VTKLGRTLGRKGRANVTLVDRNSSHLWKPLLHEVATGSLDEGVDALSYRAHAKNHSFDFQLGSLASIDRESKTITLSELKDEHGELLMPKRDLEYDILVLAIGSTSNDFNTPGVKEHCIFLDSPEQANRFRTEMNNEFLKLHAKNGQGSVDIAIVGAGATGVELSAELHNAVKELRTYGFGDLDSSKLNVNLIEAGERILPALPPRISAAAHQELTKLGVNVRTMTMVTKAEKDGLTTKDGEKISAHIMVWAAGIKAPDFMKDIAGLETNRINQLVVKGTLQTTRDDDIFVIGDLAQCTQADGKFVPPRAQAAHQMASLAFRNIVAKMYGRELKAYVYKDHGSLVSLSRFSTVGSLMGNLTRG

SEQ ID NO: 49302 - protein, 292 aa, Kineococcus radiotolerans SRS30216
MPTPPTGPVVVLTGATSGLGCLAALDLAARGAHLILPARDPDRAQATVDAVRARNPSARTEVVEVDLTRLHQVRAAGRRIAQQHEHVDVLVNNAGVHAFTPRTTVDGLPQMVAVNYLAPWVLTQALLPALRRSAAARVVTVASEASRRHGTLSLPDDLTDLSPFTARGSSPRYGKTKLLDIMFTLELAERLRGTSVVANCLDPGFNVTGLGRDLRLARPLELLLTRLRIGDPRRGAGLIVHLATHPSYGNVSGRYVTVRGPREITPAAPADDPAARRRLWNVTEELLHERVP

SEQ ID NO: 49303 - protein, 547 aa, Aspergillus nidulans FGSC A4
MGGAGDTSAALDAAAQIRKVNLKASSGLPGLIQNKKVFGVAMFACLGGLLYGYNQGVFSGVLVMHSFEEHMGDAVTNETKKGWLTSILELGAWLGALYSGVLCERFSRKYTILAHVCIFCIGVVIQLTAAAGSGSSSNILGGRFVTGMGVGSLSMSVPMYNAEIAPPEVSFWINYGTNHIGGTGETQKDTAWLLPLALQLVPAVILGVGMIFMPFSPRWLVHHGREEEALKVLTSLRGLEADDPVLQLEFLEIKAQSVFEKRTEKERFPHLERSSLWSYLKLEAAGYKSLFTSWPMFKRVIVATVTMTFQQWTGVNAILYYAPTIFEQLGMSSNTTSLLATGVVGVAMFLATIPAVIWVDNVGRKPILLIGAIGMAACHFIIAGIFAENETQWESHRAAGWGAVAMVWLFVIHFGYSWGPCSWIIIAEIWPLSVRAIGTSLGASANWMNNFIVGQVTPDMLAGIRYGTYIFLGLMTTLGALFIFFFVPETKQVSLEEMDVIFGSEGTAVADHERQAEISREIGLDEALARFSTRSGATLAEVEPKNA

SEQ ID NO: 49304 - protein, 125 aa, Helicobacter pylori J99
MKEVIHSTLAPKAIGPYSQAIATNDLVFVSGQLGIDVSTGEFKGADIHSQTTQSMENIKAILKEAGLGMDSVVKTTILLKSLDDFAVVNGIYGSYFKEPYPARATFQVAKLPKDALVEIEAIAIK

SEQ ID NO: 49305 - protein, 192 aa, Triticum aestivum
MSKRQGPPKHQNAYAWKPNLGRKINETEPGGRFRPLSEITGVCQRCRDQIDWKRKYGKYKPIVEPAKCQKCSKRNVRQAYHNVCTGCSKELGICAKCCTSVKQLVGRDAEEANSERKELEEAIRYARERERRTLLRLMNKNKDEESGTSVPKIADRDREGDLFPVASLDEYAEQAVQKDESDEEDARDFVKD

SEQ ID NO: 49306 - protein, 505 aa, Nitrosomonas europaea ATCC 19718
MNTRPIYTTAEIRKIESLVLSVPHSPPLMEKAGLAAAKVAHTRLLTDDKQRILILAGPGNNGGDALVAARHLREWGRQVTLVLTGEAERLPQDARQALEQWQSAGGTVIPELPDGGQWDAAIDGLFGIGLNETRLLAESYRQLIRQINQLNLPVLALDIPSGLLSDSGRVPDVAVKAAITTTFIALKPGLLTHDGCDYCGEIVVCDLELDVAALIPPQNWLLDRAGIVQRLPSPRRANSHKGTYGRLGILGGATGMIGAALLTGRAALKLGAGRVYLGLLAQDDVPVVDPVQPELMLRSPSDFFNPDFLEGLVIGPGFGSEIAACICLERALQTCLPLVLDADALNLIAQHTELSSALQARKAPAILTPHPAEAARLLNTSVTEIQRNRLEAARNLARKFNCAVVLKGAGSICAFPNGHCHFNTSGNPGLSSAGTGDVLSGFLGALLVQGLLPENALLLAVYLHGAAADVLLKQQNGPLGMVASEIIPAARNLLNCWIEEENPGW

SEQ ID NO: 49307 - protein, 115 aa, Brassica napus
  misc_feature (86)..(86): Xaa can be any naturally occurring amino acid
  misc_feature (95)..(95): Xaa can be any naturally occurring amino acid
  misc_feature (103)..(103): Xaa can be any naturally occurring amino acid
MFKKIMKGGHRKPSKSEANEPPSSYGPGSNVVVSHASRGALVQSPVTAATPQPPPMTSVEPLPLFRDVPVSERQALFLRKVQNCCXLFDFTDTVXNAREKDIXRQTLLELVIHTA

SEQ ID NO: 49308 - protein, 271 aa, Nicotiana tabacum
MDDYLNLFIEETSFYNRVVLGTFLPESWWGPLPHWFQGWLRNYIGGVLLYFISGFLWCFYIYRLKRNVYIPKDAIPSNRAMLLQIGVAMKAMPFYCALPSLSEYMIVNGWTKCFSRISDVGWLSYLIYMAVYLVIVEFGIYWMHRELHDIKLLYKYLHATHHIYNKQNTLSPFAGLAFHPLDGILQAVPHVVALFLLPEHFTTHIALLFIEAIWTANIHDCKHAKVWPVMGAGYHTIHHTTYRHNYGHYTIWMDWMFGTLRDPVEDEVKKM

SEQ ID NO: 49309 - protein, 304 aa, Kineococcus radiotolerans SRS30216
MNANWTARHVPDQSGRVAVVTGANTGLGLETARTLAERGATVVLAVRDVDKGARAAAGLTGNAPGNVVVQRLDLSSLESIRAAASALRDAHPRIDLLVNNAGVMYTPRQTTRDGFERQFGTNHLGHFALTGLLLERMLPVPGSRVVTVSSTGHRIRAAIRFDDLQGERSYSRAAAYGQSKLANLMFTYELQRRLAAHGTTTVAVAAHPGVANTELVRNSPAAVRAAVDRLAPLLTQPAAMGALPTLRAATDPSVLGGQYYGPGGRGEVRGYPRLVTSSPQSYDLADQRRLWAVSQELTGVEFPL

SEQ ID NO: 49310 - protein, 255 aa, Mannheimia succiniciproducens MBEL55E
MARRPLVMGNWKLNGSKAFTKELIEGLKAELAGVEGCDVAIAPPVMYLAEAEAALAGSKIVLGSQNVDVNVKGAFTGDISTEMLKDFGAKYIIIGHSERRTYHKESDEFVAQKFGALKEAGLTPVLCIGESEAENEAGKTEEVCARQIDAVINALGVEAFNGAVIAYEPIWAIGTGKSATPAQAQAVHAFIRGHIAAKSQAVADQVIIQYGGSVNDANAAELFTQPDIDGALVGGASLKAPAFAVIVKAAAKAKA

SEQ ID NO: 49311 - protein, 351 aa, Oryza sativa (indica cultivar-group)
MGASPPEEQHSPVEEVVVVRRNQKRTKNFSGKEDEGLVSAWLNVSKDVVQGIEQSRCAYWKRIYDYFHANKDFTSDRSQNSLMHRWSTIQENVTKFEGCLSRIGDRKQSWVSSQDKIMHACALYKAEDENHRPFHMMHCWNLLRNQQKWIDRSSQLPSHKKQKITNNSSLGMSTTTTDDTAAAPPPPGFELSKTPESINAPPRCELSERPESRNAPPRCELSERPENRKGEKEKLRRGGDVVFVEDLDDLLAKKKEADAEKELKKDERYIQSHALEQEKVALEQAKVANETKNLEMRSKELEFKTKEIDLKRMLEEERIMTMDISAMSGLQQQYYKSLQEEIVTRRFNSSG

SEQ ID NO: 49312 - protein, 549 aa, Magnaporthe grisea 70-15
MTLLALKEDRPTPKAVYNWRVYLCASIASFASCTIGYDSAFIGTTLALPSFTDEFQFASYSASDLALLKANIVSLYQAGAFFGSLFAYVSSYFLGRKKSLMMFSLIFMVGASLMLGATRERGLGLILGGRVLAGLGIGGMSNMTPIYISELSPPAVRGRLVGIYELGWQIGGLVGFWINYGVNSTLPPSHSQWLIPFAVQLIPGGMLLLGAIYIPESPRWLFEKGQREKAIKVLSWMRNLEPDHQYIVEEISYIDEGLEQQRREIGAGFWKPFAALKARRVQWRFILGGLLFMWQNGSGINAINYYSPTVFQSLGITGTNTGFLTTGLFGVVKTVLTVIWLMWMIDHWGRRPLLIMGGIGGGACMWFIGAYIKIAQPEKNPNSGGLPPGGIAAIFFFYLWTAFYTPSWNGTPWVINSEMFDQNTRSLGQANAAANNWFWNFIISRFTPTMFEEWGYGVYFFFASLMFVSVVFIFFLVPETKSIPLEKMDRLFEIRPVHRANATVMSELGHHSDGSAPVLGGEPEKGEAGIVEDGQVTPPPTYARKDGVA

SEQ ID NO: 49313 - protein, 588 aa, Novosphingobium aromaticivorans DSM 12444
MTPGVFLADGATRFSVRSPRAEALTLCLFEDEAEQRIAMTRVGDNWIVEIPRDLRGIRYGYRASGEWNPPDGLWFDPAKLLVDPYAIELDGSFVQHTSLSTYGADTSKIVPKAVVTAPPVISHLSPLFRHGGLIYEVNVRGLTMLHPDVPQPLRGTVAALAHPAIIGHLKQLHVSAVELMPIVAWIDERHLPPLGLTNAWGYNPVAPMALDPRVCPGGVRELRETVATLRAEGIGVILDIVLNHSGESDVLGPVLCLRGLDDAAYTKAPDGRLINDTGCGNTLDFGNPAVRALALDTLRHFTRHCGVDGFRFDLAPILARSPGFAADAPIFREIAADPVLADRVMIAEPWDIGPGGYQLGGFPSNWLEWNDRFRDDVRRFWKGETGVGALATRIAGSSDIFGKACRTVNFLAAHDGFTLADTLAYEQRHNWANGEENRDGHGENFSWNNGMEGETDNLDVLSRRAALVRAMLGTLFISTGTILLTAGDEFGRSQRGNNNAYAQDNEITWIDWDRRDRALEAWTFGLSAWRHLRISSFTRFPEDGTWRDLNGTELHTSAWESDLTQGFFWQNGSYGFVVDRTAPMAGPV

SEQ ID NO: 49314 - protein, 244 aa, Impatiens hawkeri
  misc_feature (198)..(198): Xaa can be any naturally occurring amino acid
MGRGRVELKRIENKINRQVTFAKRRNGLLKKAYELSVLCDAEVALIIFSNRGKLYEFCSSPSMLKTLERYQKCNYGAPEANISSRGALELSGQQEYLKLKQRYETLQRTQRNLLGEDLGPLDGKELDTIERQLDTSLKHIRSTRTQHMVDQLEDLQRKEQILNEANRALKQRLLESSFNWMQNGQHVDYSGPAVQPNXDELFHPLECEPTLQMAMGYQTHHDPTSVEAAGAGPSMNNYFPGWLS

SEQ ID NO: 49315 - protein, 542 aa, Novosphingobium aromaticivorans DSM 12444
MTRTVPSTPCSGQKPGTSGLRKKVKVFQQPNYAENFIQSVFDVVERAPGSALVVGGDGRYHNRTVIQQAIRIAAANGYGKVLVGRGGILSTPAASNVIRKYGASGGLILSASHNPGGPDEDFGIKYNIANGGPAPEAVTEAIYARTQTIDRWLTVDAPDVDLDRLGSTQVEAMTVDVIDSVSDYAELMESLFDFNAIRANVEGGFTMAFDAMSAVTGPYAIEILENRLGFPKGTVRNGIPLEDFGGHHPDPNMVHAHELFDTMFGPDAPDFGAASDGDGDRNLIVGRHRFVTPSDSLAMLAANAHLAPGYAGGLNGIARSMPTSAAADRVAEALGLPCFETPTGWKFFGNLLDAGMATICGEESAGTGSDHVREKDGLWAVLLWLNILAVRRIGVDQLAREHWARFGRNYYARHDYEALPTDRADALMAELNQSLSSLSGKPFGNLTISTADNFSYLDPVDGSTSSNQGVRILFEGGSRVVFRLSGTGTEGATLRVYLERYEPVGGDLDRETPEMLADLIRAADAIAGIARHTGRTAPDVVT

SEQ ID NO: 49316 - protein, 419 aa, Novosphingobium aromaticivorans DSM 12444
MRDTYSQPLARDAMAYVLAGGRGSRLKELTDNRAKPAVYFGGKSRIIDFALSNAINSGIRRIGVATQYKAHSLIRHMQRAWNFMRPERNESFDILPASQRVSEHQWYEGTADAVYQNLDIIASYAPKYMVILAGDHIYKMDYELMLRQHVESGADVTIGCLVVPRIEATGFGVMAVDTSDTITAFVEKPANPPGIPGNEDMALASMGIYVFDTKFLFDILREDAADPSSSRDFGNDIIPKIVRNGKAVAHRFTASCIRAAEEIEEYWRDVGTLDAYFEANLDLTDVVPKLNMYDRDWPIWTDQIIAAPAKFVHDEDGRRGMAISSLISQDCIVSGAIARRSLLFTGVKMGSFSSCEEAVILPYCNIGRGARLSRVILDSGVRIPEGLVVGEDPELDARRFQRTESGVCLITKRMIDQLA

SEQ ID NO: 49317 - protein, 410 aa, Rhodococcus sp. RHA1
MSMASALWHGFADMGAVEQKGAFVVSRGEGAYIWDDRGNRYLDATAGLWFTNVGHGRAEIADAVAQQLRTVAHFSNFGDFVPETTAALADRLATIAPVPGSKIFFTSGGSDSVDTAAKLARRYWHELGKPSKTIVVGRQKAYHGMHVAGTALAGIPANREGYGELMADAATVAWNDAKSLLELIEKIGADTIAAFFCEPVIGAGGVYLPPEGYLAEVRDICREHDILFVVDEVVTGFGRIGGEWFASTRFDLQPDMMTTAKGLTSGYVPMGAVFIAPRVAEPFFAGGVWWRHGYTYGGHAGAAAAALANLDIIERENLLAESKRLESSLHEHLAPLADHPRVEEVRSGLGAVAAVQLADPAEALPFVNTLREHGISGRAAGQGAMQISPAFVMTDEQVAQLADGIRRALG

SEQ ID NO: 49318 - protein, 390 aa, Corynebacterium efficiens YS-314
MVMNPSPLSNRSNVPPFRVMQMLDQVHRRRREGHSIIMLCAGQPATGAPEAVLAEAEIVLRSGPLGYTEVVGDREFREAVAAWHSATYGVQTSADNVIITTGSSGGFMAAFLATLDHGDRVALSVPGYPAYRNILQTLGAEILDLRCTAETRFQPTAQMLEELPEVPKAVIVTSPGNPTGTIIDVEELERIARWCDANGTVLISDEDYHGMSFGRPLATARQFSDNAIVVGTLSKYFSMTGWRVGWIIVPDELVTPIENIQASVSLCAPAIGQAAGKAAFTLEAAAELDAHVEVYREARDIFVDKLPEIGLDTFADPDGGLYLWVDVSKYTDDSEAWAHELLEQAGVAVAPGVDFDPTEGHKWVRLSLCASPADTLEGVRRIGEFLNRVV

SEQ ID NO: 49319 - protein, 103 aa, Burkholderia sp. 383
MDTQQRIKQIVDENQVVLFMKGNAQFPMCGFSGRAIQVLKACGVDQFKTVNVLEDDEIRQGIKAFSNWPTIPQLYVKGEFIGGSDIMMEMYQSGELQQLFAAA

SEQ ID NO: 49320 - protein, 251 aa, Arabidopsis thaliana
MIFKKEVSKEDVECVETLLMMSNSKPTREEYNKLQLCILRRNKSSTITTPSTVMESKSHIHDHSLRESPTRRSRNRHDLPPMSPPMEQRKSKKAKRSTDASSSKTREPTPGWLISLMRSKNGGDVEGNSKKIIDKELFQTDVDPHQSRLSIPVSQIVELEFLNHEEKRAIEEDANRVRKEGVDAILVDSHLREFPVNLRLRDMRGILLYNLVAGWNQVVTDCLLEENTNIRLWSFHADDTLYFALVPLYAN

SEQ ID NO: 49321 - protein, 590 aa, Triticum aestivum
  misc_feature (157)..(157): Xaa can be any naturally occurring amino acid
  misc_feature (349)..(349): Xaa can be any naturally occurring amino acid
  misc_feature (403)..(403): Xaa can be any naturally occurring amino acid
MAMVDEPLYPIAVLIDELKNEDIQLRLNSIRRLSTIARALGEERTRKELIPFLSENNDDEDEVLLAMAEELGVFIPYVGGVEHAHVLLPPLETLSTVEETCVRDKAVESLCRIGAQMKENDIVDYFIAVVKRLAAGEWFTARVSSCGLFHIAYPSAXPRPLKTELRTIYGQLCQDDMPMVRRAAASNLGKFAATVEQSHLKTEIMSIFDDLTQDDQDSVRLLAVEGCAALGKLLEPQDCVAHILPVIVNFSQDKSWRVRYMVANQLYELCEAVGPEPTRADLVPAYVRLLRDNEAEVRIAAAGKVTKFCRILSPQLAIQHILPCVKELSSDSSQHVRSALASVIMGMAXPVLGKDATIEQLLPIFLSLLKDEFPDVRLNIISKLDQVNQVIGIDLLSQSLLPXAIVELAEDRHWRVRLAIIEYIPLLASQLGVGFFDDKLGALCMQWLEDKVFSIREAAANNLKRLAEEFGPEWAMQHIIPQVLEKINNPHYLYRMTILQAISLLAPVMGAEITCQKLLPVVINSSKDRVPNIKFNVAKVLQSLVPILDQSVAEKTVKPCLVELSEDPDVDVRYYANQALQACDQIMMSS

SEQ ID NO: 49322 - protein, 118 aa, Saccharophagus degradans 2-40
MSAEKSIFTKIMDGDIPAQKVYEDEDCICIKDISPQAPTHLLIIPRKPIPRLVDATIEDKALLGHLLLKVGDLARLSGVDEAFRVVINNGEGAGQTVFHLHLHLLGNKAFDEGSLGMH

SEQ ID NO: 49323 - protein, 126 aa, Glycine max
  misc_feature (105)..(105): Xaa can be any naturally occurring amino acid
  misc_feature (107)..(107): Xaa can be any naturally occurring amino acid
  misc_feature (114)..(114): Xaa can be any naturally occurring amino acid
  misc_feature (119)..(119): Xaa can be any naturally occurring amino acid
MSTEKEKTSSPSPSVELCKGFNGLEKVLLRESRGSSAEVYLYGGHVTSWKNDHGEELLFLSNKAIFKPPKAIRGGIPLCFPQFGFLGTLDQHGFARNRFWTIDDXPXSFPTNTXAKPFXDLILKPT

SEQ ID NO: 49324 - protein, 332 aa, Saccharomyces cerevisiae
MVRVAINGFGRIGRLVMRIALQRKNVEVVALNDPFISNDYSAYMFKYDSTHGRYAGEVSHDDKHIIVDGHKIATFQERDPANLPWASLNIDIAIDSTGVFKELDTAQKHIDAGAKKVVITAPSSTAPMFVMGVNEEKYTSDLKIVSNASCTTNCLAPLAKVINDAFGIEEGLMTTVHSMTATQKTVDGPSHKDWRGGRTASGNIIPSSTGAAKAVGKVLPELQGKLTGMAFRVPTVDVSVVDLTVKLNKETTYDEIKKVVKAAAEGKLKGVLGYTEDAVVSSDFLGDSNSSIFDAAAGIQLSPKFVKLVSWYDNEYGYSTRVVDLVEHVAKA

SEQ ID NO: 49325 - protein, 405 aa, Shewanella sp. MR-4
MSVDMKLNRAQFDAVMVPNYAPAAVIPVRGEGSRVWDQEGNEFIDFAGGIAVNCLGHCHPALVNALKTQGEKLWHLSNVMTNEPALELATKLVNSTFAERVYFANSGAEANEAALKLARRYALEKFGVEKDEIIAFDKAFHGRTFFTVSVGGQAAYSDGFGPKPQSITHLPYNDVAALEAAVSDKTCAIMLEPLQGEGGIIDADPAFLKAVRELANKHNALVIFDEVQTGVGRTGELYAYMGTDIVPDILTTAKALGGGFPIAAMLTTAEIAEHLKVGTHGSTYGGNPLACAIGNAVLDVVNTPEVLNGVKHREQLLRDGLNKINEKYHVFSEIRGKGLLLGAVLNEQYQGRSRDFLVASVAEGLMSLMAGANVVRFAPSLVIPEADIAEGLARFERAVASIAAA

SEQ ID NO: 49326 - protein, 560 aa, Mycobacterium sp. MCS
MTETPTRPAKPVKRPRGEGQWALGYREPLNANEQSKKDDNPLNVRERIENIYAPGGFDTIDKGDLRGRFRWWGLYTQRKPGFDGTWTGDENTDMLEDEYFMLRVRSDGGALTAKALRTLGEISTEFARDTADISDRQNVQYHWIDVRNMPEIWRRLDEVGLQTTEACGDCPRVVLGSPLAGESLDEVIDGTPAVNEIVKRYIGKPEYSNLPRKFKTAISGLQDVVHEVNDVAFIGVVHPEHGPGFDLWVGGGLSTNPMLGQRVGAWVPLDEVPDVWEGVVSVFRDYGYRRLRSKARLKFLIKDWGVEKFRQVLETEYLKRPLIDGPAPDPVTRPIDHVGVQKLKNGLNAVGVAPIAGRVSGTILSKVADLAEAAGSDRIRFTPYQKLIVLDVPDEKLEELRAGLDALGLPSTPSHWRRNLMACTGIEFCKLSFAETRSRSQVLVPELEKRLEDINAQLDVPVTININGCPNSCARIQVADIGFKGQMVDDGDGPQEGFQVHLGGSLGLDSGFGRKLRQHKVLATELGDYIERVVRNFVKQREDGERFATWALRADEADLR

SEQ ID NO: 49327 - protein, 667 aa, Arabidopsis thaliana
MAGPLLRSLWSNTTRRSFSSHSSPSKFGYSLSSLRSFSAATASTAAAGAPNSSLDPNRLRNVAVIAHVDHGKTTLMDRLLRQCGADIPHERAMDSINLERERGITISSKVTSIFWKDNELNMVDTPGHADFGGEVERVVGMVEGAILVVDAGEGPLAQTKFVLAKALKYGLRPILLLNKVDRPSVTEERCDEVESLVFDLFANCGATEEQLDFPVLYASAKEGWASSTYTKDPPVDAKNMADLLDAVVRHVQPPKANLDEPFLMLVSMMEKDFYLGRILTGRVTSGVVRVGDRVNGLRKTDSGSEKIEEAKVVKLMKKKGTTIVSIDAAGAGDIICMAGLTAPSIGHTVASAEVTTALPTVELDPPTISMTFGVNDSPLAGQDGTHLTGGRIGDRLMAEAETNLAINVIPGLSESYEVQGRGELQLGILIENMRREGFELSVSPPKVMYKTEKGQKLEPIEEVTIEINDEHVGLVMEALSHRRAEVIDMGPVPGNEGRTRLSLTCPSRGLVGYRCVFSSDTRGTGFMHRAFLTYEEYRGPLGNVRKGVLVSMARGTITAHSLMSLEARGILFVSPGLDSYDGMIIGEHSRETDLDLNPVKAKELTNIRSAGKDENVKLSPPRLMTLEEAIGYVASDELIEVTPKTIRLRKRCLDVNKRKSQSKRAKD

SEQ ID NO: 49328 - protein, 403 aa, Triticum aestivum
  misc_feature (234)..(234): Xaa can be any naturally occurring amino acid
  misc_feature (263)..(263): Xaa can be any naturally occurring amino acid
  misc_feature (282)..(282): Xaa can be any naturally occurring amino acid
  misc_feature (293)..(293): Xaa can be any naturally occurring amino acid
  misc_feature (302)..(302): Xaa can be any naturally occurring amino acid
RTQPRLPQAGTLLKKTIFLNDKPFVIATASSRSLHEIDSNSKPINGLQIFSLEVIANLSASKVETGQQMEGGTHNITNVTENATSGWSIVKEELTFSAGSAPFSSCHASTIVEIGKDNFLVAYFGGSKEGAPDVKIWLQRYSDGHWHPPELADEQNGVPMWNSVLFQLPSHELLLFYKIGQEVQKWSGAMNRSLDGGISWSERENLPSVILGPIKNKPFLLEDGRLLCGSSAKXWNSWGARLEVTKNGGRTWRKPRSYLLERXTLGVIPPGPYQNGNGDTRXLPGFFETNGRXVCLPNSAAXRVTWSYAHKTELPNPNSGIDGVKMKDGRVLVAYNTFSRGTLKIAVSMDDGDSWNEVMTLEDTKGMEFSYPAVIQTMDELVHITYTYNRTQIKHVVFRHSET

SEQ ID NO: 49329 - protein, 432 aa, Oceanobacillus iheyensis HTE831
MKFTNSEKLHQEALQHIVGGVNSPSRAYKAVGGGSPVYMERGQGAYFWDVDDNKYIDYLAAYGPIITGHAHPHIAKAIAHAATTGVLYGTPTCLENEFAQMLKEAIPSLEKVRFNNSGTEAVMTTIRVARAYTGRTKIIKFAGCYHGHFDAVLVEAGSGPSTLGTPDSAGVPASTASDVITVPFNDIEAYKAALNKWGDQVAAVLVEPIVGNFGIVEPFKGFLQEVNELTHRAGALVIYDEVITAFRFTYGSAQQIYGVEPDMTAMGKIIGGGLPIGAYGGRKDIMEQVAPLGPAYQAGTMSGNPASMAAGIACLEVLKEEGVYEELDRLGKRLEEGILEQAREHGIHITVNRLCGALTVYFGVDQITNYAEADASDGEAFAKFFQLMLREGINLAPSKYEAWFLTTEHKDSDIENTIDAVGRSFAEMAKTL

SEQ ID NO: 49330 - protein, 579 aa, Nostoc sp. PCC 7120
MTTTDDLQKLLDILPQDLRQILENHPKRDSLVEVVLDLGRRPEARFPNQAEYLSETPVTQAQIDDCVQRVGNFGGDNRAGIEQTLHRISGIRNRSGKIIGLTCRVGRAVFGTIGMIRDLVETGKSILMLGRPGVGKTTALREIARVLADELHKRVVIIDTSNEIAGDGDVAHPAIGRARRMQVAHPELQHQVMIEAVENHMPEVIVIDEIGTELEALAARTIAERGVQLVGTAHGNQIENLIKNPTLSDLVGGIQAVTLGDDEARRRGSQKTVLERKAPPTFEIAVEMLERQRWVVHESVADTVDTLLRGRQPSPQTRTVDEQGKVAITRQLSVVNGRGGQLATPEESFAPARPSNGWRASGQMLAIPSLPLERERISGQSEFDRLLDESFNYPEAIDFGSSARQPGPNGEDLPLHVYPYGVSRHQLEQVISVLTLPVVLTKDIDNADAILALRSHVKNHAKLRQMAKARHVPIHVIKSSTIPQITRGLRRLLNMEDPEVADDRELQLFLHNGSDDEMDALEEARLAVEQIVIPKGQPVELLPRSPQVRKMQHELVEHYRLKSHSFGEEPNRRLRIYPA

SEQ ID NO: 49331 - protein, 632 aa, Nitrosomonas europaea ATCC 19718
MKTPVSKLEKFTNDNARVDTAAVQPLPNSRKIYIQGSRADIQVPMREITQSDTATGRGAEKNPPIYVYDTSGPYTDPDTRIDIRHGLPPLREKWIDERGDTEILTGLSSSYSLKRLQDPALTKMRFNLMRPVRHARNGANVTQMHYARRGIITPEMEFIALRENQRRERVADLASNELLNRQHPGQSFGAIIQEWITPEFVRDEVACGRAIIPANINHPETEPMIIGRNFLVKINANIGNSALGSSIQDEVEKMTWAIRWGGDTVMDLSTGKNIHETREWIIRNSPVPIGTVPIYQALEKVDGKAEELTWEIFRDTLIEQAEQGVDYFTIHAGVRLPFIPMTAKRMTGIVSRGGSIMAKWCLAHHQESFLYTHFEDICEIMKAYDVSFSLGDGLRPGSIYDANDEAQFAELKTLGELTEIAWKHDVQVMIEGPGHVPMHLIRENMDLQLKYCHEAPFYTLGPLTTDIAPGYDHITSAIGAAMIGWYGTAMLCYVTPKEHLGLPDKDDVKDGIITYKIAAHAADLAKGHPGAQVRDNALSKARFEFRWNDQFNLSLDPDKAREFHDETLPQEGAKLAHFCSMCGPNFCSMKITQDVRDYAAQQGISETVALQEGMARKANEFIEKGGELYSKQ

SEQ ID NO: 49332 - protein, 189 aa, Zea mays
MAALTSAKGALLPSWARSSSSGHGGDLWRVLGKALATAGGGGGGGCSLLLPRRWQSSLPQLDHVADRSNEESGGGGEIDWDNLGFGLTPTDYMYVTRCSPEDRSDFPRGELCRYGNIELSPSSGVLNYAQGLFEGMKAYRRPDRAGYTLFRPEENARRMQRGAERICMPAPSVEQFVHAVRQTVLANRR

SEQ ID NO: 49333 - protein, 466 aa, Novosphingobium aromaticivorans DSM 12444
MQFERINPMTGAVASQAEAMKASDIPSIAARAGQAFPAWAAMGPNARRGVLMKAAAALEARADAFVEAMMGEIGATRGWALFNLGLAASMVREAAALTTQISGEVIPSDKPGCISMALREPVGVILGIAPWNAPIILGVRAIAVPLACGNAVILKASETCPRTHALIIEAFAEAGFPEGVVNVVTNAPADAAEVVGALIDAPEVRRINFTGSTNVGRIIAKRAAEHLKPCLLELGGKAPLIVLDDADLDEAVKAAAFGAFMNQGQICMSTERIIVVDAVADAFADKFKAKVASMAVGDPREGTTPLGAVVDAKTVAHCRSLIDDALAKGARLLTGGETTHNVLMPAHVVDGVTQDMKLFRDESFGPVVGVIRARDEAHAIELANDSEYGLSAAVFTRDTARGLRVARQIRSGICHVNGPTVHDEAQMPFGGVGASGYGRFGGKAGIDSFTELRWITMETQPGHYPI

SEQ ID NO: 49334 - protein, 380 aa, Geobacillus kaustophilus HTA426
MNVMLSPNMSQGLDLFFQMREHEQVVFCLDEATGLRAIIAIHSTALGPALGGCRMHPYATTEEALADALRLSKGMTYKCLAADVDFGGGKAVIIGDPRKDKSPELFRAFGQFVESLGGRFYTGTDMGTTPDDFVHALKETNCIVGVPEAYGGSGDSSVPTAEGVVYGIQATNDVVFGSKHLHGKTYAVQGLGKVGKKVALRLLEEGADLYVCDLNEAAVKEVVAYGKQIGASVKPVNGTDIYRVEADVFIPCAFGGVINDETIAELRVKAVVGSANNQLADKRHARMLKEKGIVYAPDYIVNAGGLIQVADELYGANKERVLAKTKAIYDTLLAIYARAESEGITTIEAADQFCEERLEKRKRRNHFFTHQKRPKWDIRR

SEQ ID NO: 49335 - protein, 197 aa, Oryza sativa (japonica cultivar-group)
MVAHKERVVVAVYHSSFVDDTGITKACGCPLLPLKTHIRGPAPAFDQEPCQAADLCRAITDKADIVDEAITFFRANVFFKNFNVKSPADKLLIYLTFYINIALKRLEGCRTLAVGTKAIINLGLEKVPVPGEPGFPFPGLFTLPQSQEEAELLRNYLKQIREETSGRLLNCAYRANGTPNKWWLAFAKRKFMNIVIL

SEQ ID NO: 49336 - protein, 188 aa, Zea mays
MVLVLALGDLHIPHRVPDLPAKFKSMLVPGKIQHIICAGNLCIKEVHDYLKSLCPDLHITGGEYDEYARYPETKTLTIGQFKLGLCHGHQVVPWGDLDSLAMLQRQLDVDILVTGHSHQFKAYKHEGGVVINPGSATGAYSSITYDVNPSFVLMDIEGLRVVVYVYELIDGEVKVDKIDFKKAATMQA

SEQ ID NO: 49337 - protein, 463 aa, Burkholderia sp. 383
MSGSNTGLGTGLKQRHVTMMSIAGVIGAGLFVGSGHAIAEAGPASILAYAIAGVLVVLVMRMLGEMAVAHPDSGSFSTYADRAIGHWAGFSIGWLYWWFWVLVIPIEATAAATILNAWFPGVATWAFALGITLVLTVTNLFSVKNYGEFEFWFALIKVVAIVVFLCIGGAAIVGIIPAPAVSGVSNLFVHDGFMPHGAGAVLAAMLTTMFSFLGTEIVTIAAAESDNPQRQIVRATNSVIWRITLFYLGSILVVAAIVPWNDPLLPKHGSYQRAMELIGIPNAKAIIDVIVLVSVASCLNSALYTASRMLFSLSKRKDAPAFLHRTDSTGTPRAAVLASTAFGFVTVIANYLMPEQVFGFLLATSGAIALLVYLVIAISQLRMRKTLESTGADLTLRMWLFPWLTWLVIVFICGTLTVMLVSEDHRMEVGATAVLALIVLLASWLNKRGRDAQASEGRRASAM

SEQ ID NO: 49338 - protein, 175 aa, Zea mays
  misc_feature (12)..(12): Xaa can be any naturally occurring amino acid
RYPGILKHAPAXLLAFTNPTTNSYKRLVPGFEAPVNLAYSQGNRSASVRIPLSGGNPKAKRLEFRCPDATSNPYLAFAAMLCAGIDGIKNQIDPGEPLDVDIYDLSPEELAKIPSTPGSLEAALEALEKDHEFLTGTGVFSPDFVESWIEYKLDNEVNPMRLRPHPYEFSLYYDC

SEQ ID NO: 49339 - protein, 1438 aa, Debaryomyces hansenii CBS767
MVNSSNGSNPLSASSTDLNSAQQQYTNVNNPVSNANHSHRHTAGPKGRRPSLLRNDSSSNSVYTPSNTAGDGSTPMHSSHLKWGSSGTGNNNASSTAINDSHNSTNANSTSLLTPSSNKRQTSHNNSGNNTLSSTGGRARSRSITQTLSHNLQNNNKQYLSQEKAYLKKMKNQFVDDYYTKGITGAEMKEVNNNDEDEDEDEDETNPNGHSDLLADMDDDKYQIDYNLAFTLLKNGKNAININPNRNITQLNADSADDPAVIERLEWQSMLTSVLTGDVVRSEKTKIINNNSPENEQSSFLHATYKENLWFGIHAKLFNRTEDDQRKIIEYRRTLADALFDEVLNFEVNHDDPESNPPRNQVAYILDKYDKCCDLWRTLEDMKNEKPVCRTAEFQDRIDALTAWLSITDAMQRESDSLKVWIGNDEMDITKSRSESGSAPSSEATTPTNTKKIFNEDNKSLAERLMKEKDVYSIFQKRIFFPLAPWMIKSKDTYLRLGHIFETLKLPDYIHDLIQLCLIPMKLIKEIINVRLVYAKKLENPTLMMIDQMIDDFKSYITIALEVKLGIVEYCRPDVGQIWVLSDLFDSENQEFDKVVLKCVKYFFALLNKKLLDSSRSPTNFRTFKEPEELEETWNYLKWLGNLIDGGSVVVAEHITVLTLKLIHRLLAYFNNQIGTPPAKSAGSSDLIRWYSSTTENFGQLRRKLARFTGEISRDFTNSLVFDLSSTPSNRTKNILEVLKSTNHFLVYTGTIETQGTYFFASAELMGNEQEILRIINGSYIGSDPNEANLDFSDLLKMLQLHEDGETDQHPDLVDHLIPNESSDFGYVLALCPPKPIVWEGHIVTIHLENVPITDIKVGQILMITKLPYGSLHMVKEKFLDTVNDFILVGGMMKQVEQRCSLAKVHHELTKINRVFFKMSLSVLDSVKKVRANCKELAAESSCQELINSYFIYARDFGKNSVKNLDSSRKSTVIMKLIQLSIEWVSFVCDDCIPTDRRTFRSCVLALEFAMDMTRGFNVLVLNDEQFYKLKLKVARCMSLLISHFDIMGARSSEAEKKKLLKWSSQRHRIENSADDACIIQAYREDVMREIEEIENYRKDLQEQLLSIGRVLDVTDLEYQFVTLLASSFSSVSIRWQKGRFIGGGTFGHVYAAVNLDTGGVMAVKEIRFHDSQSVKNIVPSIKDEMTILEMLNHPNVVQYFGVEVHRHKVYIFMEFCEGGSLAGLLTHGRIEDEMVIQVYTLQMLEGLAYLHQSGVARRDIKPENILLDHNGVIKFVDFGAAKVIATSGRTLGGGSGGANQGRSMNGTNLNSMTGTPMYMSPEVITGASGSGNGVVDIWSLGCCVLEMATGRRPWTNLDNEWAIMYHIAAGHKPQLPSADQLSEPGRKFISRCLEHDPSNRPGAVELLNDPWIVAIRQAAFVSSDSVSTPSSEVGSDM

SEQ ID NO: 49340 - protein, 262 aa, Polaromonas sp. JS666
MTSDNSSMSVAVITGGARGIGLAIGQWFLKHGHRVALLDIDGDTLAQTAARLNDDHVLAVHCDVSDPQQVQAAVDKVRAAFGRIDALVNNAGVAVFKPIAETTFAEWRHVMATNLDGAFLCTQACAPVMQKTGGGSVVNIASISGLRASTLRVAYGTSKAALIHLTKQQAVELGNVGIRVNAIAPGPVETEMAKLVHSVAIRSDYYDAIPLNRYGTTEEIASVAGFLCSAAASYVNGQVVAADGGFDAAGVGLPTLRKRAAA

SEQ ID NO: 49341 - protein, 417 aa, Marinobacter sp. ELB17
MEFSHVSSALGILHPVCIAKGRNAEVWDEAGQRYIDFIGGIGVLNLGHCHPAIVEAVKTQVDTLMHSAFNALPHRTYLSVVDRLNQFVPVSYPLSCMLTNSGAEATENALKVARGVTGRQAVIAFDDAFHGRTLAALNLNGKVKPYKAGLGALPGPVYHIPFPSRDSGISAEQSLAALDRIFEVEIAPSEVACIIFEPIQGEGGFRLLCPEFAKTLRAICNKHGILLICDEIQSGFGRTGKRFGFSHLGIEPDLMLLGKSIACGLPLAALVGRKEFMDALPKGALGGTYSGNAVACAAALAVMDIMQEDALTAWATEQEEAIVHSYQAWKECGHFPMIGALTGIGAMRGIVFEDTENATGAEHLANLLVAARNAGVLLIASGRKRNVLRLLPPLTTEPEVMAEGLDMIKQALGTLQV

SEQ ID NO: 49342 - protein, 343 aa, Mycobacterium sp. MCS
MSSDRERRSPHRRRRPTMAHVLPVLDLTDADTDPAGFRARLREAAHDAGFFYLVGHGVPVERFERVLRLARDFFTQPPERKNEISQLLSPQFRGYSRLGGELTNGTVDWREQIDIGPERDVIEGAEGYWRLQGPNLWPAQPPGFRAAFEEWGAALSEVGVRLLRHWAVSLGAAEDTFDAAFADRPATLMKVVRYPGTTQTAQGVGAHKDSGVLTLLLVEPGSVGLQVESGPDEWIDVPPLPGAFIVNIGELLEVATGGYLRATRHRVLAPPPGTDRISIPFFLNPALDALIPILPLPPELAVRSRGVETDPDNPIFNTYGENAWKSRTRAHPDVAELHHGITR

SEQ ID NO: 49343 - protein, 296 aa, Oryza sativa (indica cultivar-group)
MADDGFKYHEEYVTNKRGMKLFACQWSPLDHEPKALIFLCHGYAMECSISMRGTGVRLAKAGFTVHGLDYEGHGKSEGLQGYINSFDDVVVDCSNYFASVCERGECKGKKKFLLGESMGGAIVLMLHRKEPTNWDGAILVAPMCKIVEDMKPRPIVITILSKLSNVIPTWKIIPTEDVIDKAIKSEEWRQEVRNNPYCYKGRPRLKTGYELFMASLDIESTLDKVTLPFIIVHGGDDAVTDPSVSEELYTSAQSKDKTLKLYPGMCHALTSGEPASNIDIVFLDIIKWLDERVSVS

SEQ ID NO: 49344 - protein, 432 aa, Coccidioides immitis RS
MNTVDIGQKYKRIVEYLWDPEPKNDDDIIEPVWCLGKEYKTSIPRDSEGAEAPESCNMPGMPFLSPMNQMSLSSRDTQAALSKPATPPHQLGIQRSKSREWPTSFLDDFESKFWFTYRSNFPAIPKSRDPDTPLALTLSVRLRSQFLDTHGFTADTGWGCMIRSGQSLLANALSILNLGRDWRRGSKIKEECELLSLFADNPQAPFSIHRFVDYGASACGKHPGEWFGPSATARCIEALSNECKHTDLNVYVMSDGSDVHEDQFRQIAGPDGIRPTLILLGVRLGIESVTPVYWEALRAIIRYPQSVGIAGGRPSSSLYFIGVQGPYFFYLDPHHTRPAVSWNPDSTLSPENLDTYHTRRLRRLHIREMDPSMLIGFLIKDDDDWKDWKRRLRSVTGNPIIHIFDLERPNFGRHLEREEAVDEVEALDDDSN

SEQ ID NO: 49345 - protein, 514 aa, Shigella flexneri 2a str. 2457T
MSVSKKPMVLVILDGYGYREEQQDNAIFSAKTPVMDALWANRPHTLIDASGLEVGLPDRQMGNSEVGHVNLGAGRIVYQDLTRLDVEIKDRAFFANPVLAGAVHKAKNAGKAVHIMGLLSAGGVHSHEDHIMAMVELAAERGAEKIYLHAFLDGRDTPPRSAESSLKKFEEKFAALGKGRVASIIGRYYAMDRDNRWDRVEKAYDLLTLAQGEFQADTAVAGLQAAYARDENDEFVKATVIRAEGQPDAAMEDGDALIFMNFRADRAREITRAFVNADFDGFARKKVVNVDFVMLTEYAADIKTAVAYPPASLVNTFGEWMAKNDKTQLRISETEKYAHVTFFFNGGVEESFKGEDRILINSPKVATYDLQPEMSSAELTEKLVAAIKSGKYDTIICNYPNGDMVGHTGVMEAAVKAVEALDHCVEEVAKAVESVGGQLLITADHGNAEQMRDPATGQAHTAHTNLPVPLIYVGDKNVKAVAGGKLSDIAPTMLSLMGMEIPQEMTGKPLFIVE

SEQ ID NO: 49346 - protein, 146 aa, Phaseolus vulgaris
MGAFTEKQEALVNSSWEAFKGNIPQYSVVFYTSILEKAPAAKNLFSFLANGVDPTNPKLTAHAESLFGLVRDSAAQLRANGAVVADAALGSIHSQKGVNDSQFLVVKEALLKTLKEAVGDKWTDELSTALELAYDELAAAIKKAYA

SEQ ID NO: 49347 - protein, 258 aa, Corynebacterium efficiens YS-314
MSDNLTIQDIARTRSLLVVSDFDGTIAGFSKDPYQVPINQKSLKAIKDLSRLADTRVVILSGRHLEGLSQVLDLGAYDITTVGSHGSEDSSRPRTLTPGEREELERIHTELERVIDGIEGAYVEVKPFHRVLHYIRVSDPDAIAGIQARAADIDTRDLKVTKGKNIIEYSVSRATKGSWLREHISRTEPTGVIFIGDDTTDEHGFEMLADVPTALTVKVGEGETAAKTRIDSIDDVGIMLEELAYERQQHVEAKALGL

SEQ ID NO: 49348 - protein, 505 aa, Geobacillus kaustophilus HTA426
MATVKQKKMEPMPTKRDFYHLIVNGERVESASGETFVVTNPATGEPVARVAKGTREDAERAVQAARQAFDRGKWRHFPVQKRARILYQIAAIMRERFNELVELEILNTGKALSAAQGQVMQAIEDFEFFAGAIIGHRGAVNPMPGAFHNYTEKEPVGVCAQIIPWNYPLMMAAWKIAPAIAAGCSVVVKPASLTPLTCLVLAEICHEAGVPEGVVNVVTGAGAEVGDYLVEHPLVDKVAFTGSTPVGKEIMEKASKTLKRVTLELGGKSPSLVFADADLEAAVAGSLFGIFYNSGQSCEARSRLYVHESIYDAFMEAFVAKTKQLKLGDPFDAGTHVGAIISRGQLEVIDEYVQSAVADGATVAAGGKEAVVAGFENGYWYEPTILTNVNHQMKAVREEIFGPVVVVMKFRDEAEAIELANDSDYGLAAAIWTKDHGRAVRVAKQLRSGIVMVNSPFSAFPGTPFGGYKQSGFGRELSVEALDLYTETKSVLSYYGPRPLNPFGV

SEQ ID NO: 49349 - protein, 354 aa, Zea mays
YLRLLQTANVQNGLPVQYGLGNDPLTHYLARMSRHQLHEVMAELKFLTTQNKEHSKTLLQGIPQLPKALFQAQIMLGMVTPQMMQMAKSQQPLGSLAQSSSHLNEPYPQPEPDAMVPVVSRPSSLPTNVLPNPVILQEQTAAIHSFPQHQHASQPQVKMFPHGQPSGITAQSPMLHQPLGGSSSVPIQSLVTSVGLTSQVQPPFVPEHPGPPVMPTSVQQLPLTHPHLALVAAAPETLPNEIRVADQASHLTEFTHPSKLRKLEDGTSVPGMVNSSHAIYTAPLQAVGPSGPSGSYSAGAGSLQQPGNEGQITPDVESALLQQVLQLTPEQLSSLPPEQQQQVIELQKMLSAGK

SEQ ID NO: 49350 - protein, 512 aa, Mortierella alpina
MGSLTSPTKRTTRSSSGKSTSMKNPSSAISSSSSSNSDCSDSEAIGRLSISSAASVTSLEDSSSPVIAKHIKEIPKITTKNDFSVLYEPWTITNFYKKLDWVHMLGLVFMPIYGFYMAFTSVPLQQKTAVFAVAYYFFTGLGITAGYHRLWSHRAYNAGPTLQFILMIASTGAMQGSIRWWCRNHRAHHRYTDTEKDPYGAQKGLIWSHILWMLVRQDPTTVGWADVADLKANKLVRFQHDHFLWLAPLISLGLPTMVAGFGWGDYWGGFIYGGIIRQVVVHHATFCVNSLAHWLGDMPFDDRHTPRDHILTALVTLGEGYHNFHHEFPQDYRNAIRFYQYDPTKWLIAFCAFLGLASDLKRFPTNEIKKGEVRMQQQKLDRVKAGLIWGTPIAQLPVFTYEEFEELATEKGQAVTLIEGIIYDIGAFVDEHPGGRSLIKGAIGKDATTSFNGGVYDHSNAARHLLERMRVGVVAGGGFVEHRKSSTAPKQLSTIPLGSYPPASIPVVSRTA

SEQ ID NO: 49351 - protein, 597 aa, Zea mays
MSFGSCPAVAGGATAEELLERARGLVPPALAAARAATGFGGRWKAIAARLGRLPQCLSDLSSHPCFSKNSLCRELLQSVAATLAEAAELGARCHEPPKAGKLQMQSDLDALAGKLDLNLRDCSLLVKTGVLSDATVPAAPAETASAAGAQVDVRELLARLQIGHAEAKHRAVDGLLDALREDEKSVLSALGRGNVAALVQLLTATTPKVREKAATVLCLLAESGSCEGLLVSEGALPPLIRLAESGSLVGREKAVITLQRLSMSADIARAIVGHSGFRALIDMCQTGDSITQSAASGALKNISAVPEVRQALAEEGVVRVMINILDSGVVLGSKEYAAECLQNLTSSNDNLRRAVVSEGGLRSLLAYLDGPLPQEPPVAALRNLVTVVPPDSLVSLCVLPRLAHVLRDGSVGAQQAAAATICKMSSSMDMKRLVGELGCIPLLVGVLEAKSNGAREAAAQAVATLMGCPPNARDMKKDEKSVANLVQLLDPSPQNTAKKYSISSLMCSMTCLSTMSVPDDDNGEEGLVLVDPHGERLDVVASPGEHPGDPVDHAALVPDEHRNRVAPHLVPGGGTGGDRRHSGGGGRGCTSPPAPAA

SEQ ID NO: 49352 - protein, 137 aa, Glycine max
MADLFAWLISFFILIALIVLVIYQLMCLADLEFDYINPYDSSSRINKVILPEYIIVGVLFGFYLVTGHWIMSLICAPYLYYNVRLYRQGKHLVDVTEIFNLLPKEKKQRLFKLFYIVFILFLSLFWMIYTSLDDHDD

SEQ ID NO: 49353 - protein, 458 aa, Xylella fastidiosa Dixon
MFRPSLIHRSMSSLQPMSPVSDSPSLGEMHASVAVSRRGHWGFRFLAFLGPGYMVSVGYMDPGNWATGLAGGSRFGYMLLSVILLSNVMAIVLQALAARLGIASDMDLAQVCRARYSRGTTLALWVVCELAIIACDLAEVIGTAIALNLLLGIPIIFGVLITAVDVVLVLLLMHRGFRALEAFVIALLLVIFGCFVVQIVLAAPPLQEVLCGFVPRWQVVADPQALYLAIGIVGATVMPHNLYLHSSIVQTRAYPRTPVGRRSALRWAVADSTLALMLALFINASILILAAAVFHAQHHFDVEEIEQAYQLLAPVLGVGVAATLFATALLASGINSTITATLAGQIVMEGFLRLRLRPWLRRVLTRGLAIVPVIVVVALYGEQGTGRLLLLSQVILSMQLPFAVIPLLRCVADRKVMGALVAPRWLMVVAWLIAGVIVVLNVKLLGDYAVHLMVGVSN

SEQ ID NO: 49354 - protein, 283 aa, Zea mays
  misc_feature (175)..(175): Xaa can be any naturally occurring amino acid
GRVGWRAAADLTMYIARETSKVWRKVATEVSVELQLLREKWGLLLAGLIFQYIHGLAARGVHYLHRPGPLLQDLGFMALPELGQDKGYLSETIFSSIFISFVLWTFHPFIYHSKRFYTVLIWRRVLAFLVASQFLRIITFYSTQLPGPNYHCREGSKLATLPPPNSVLEVLLINXLLIIASRKHYSVDVVVAWYTVNLVVFFVDNKLPEMPDRTSGLHLLPLSSKEKEGRQKEEKDSKLKDEFHKLLNGNHADPTDRRQRAQMNGRHDEDINHALSEATANGT

SEQ ID NO: 49355 - protein, 491 aa, Helicobacter pylori J99
MAQKTLLIITDGIGYRKDSDHNAFFHAKKPTYDLMFKTLPYSLIDTHGLSVGLPKGQMGNSEVGHMCIGAGRVLYQDLVRISLSLQNDELKNNPAFLNTIQKSHVVHLMGLMSDGGVHSHIEHFIALALECEKSHKKVCLHLITDGRDVAPKSALTYLKQMQNICNENIQIATISGRFYAMDRDNRFERIELAYNSLMGLNHTPLSPSEYIQSQYDKNITDEFIIPACFKNYCGMQDDESFIFINFRNDRAREIVSALGQKEFNSFKRQAFKKLHIATMTPYDNSFPYPVLFPKESVQNTLAEVVSQHNLTQSHIAETEKYAHVTFFINGGVETPFKNENRVLIQSPKVTTYDLKPEMSAKGVTLAVLEQMRLGTDLIIVNFANGDMVGHTGNFEASIKAVEAVDACLGEILSLAKELDYAMLLTSDHGNCERMKDENQNPLTNHTAGSVYCFVLGNGVKSIKNGALNNIASSVLKLMGIKAPATMDEPLF

SEQ ID NO: 49356 - protein, 393 aa, Gluconobacter oxydans 621H
MKALTWQKKGKITCESVRDPEIIEGRDVIIKVTACAICGSDLHLMDGLMPTMKCGDILGHETMGEVVEVGKDNKRLSVGDRIVVPFTISCGECRQCKWGNWSCCERTNPNRRQQAETFGYPLAGLFGYSHITGGFSGGQAEYLRVPYADVGPIIVPEGLEDEQVLFLSDIFPTGYQAAENCEITPESEKTIAVWGCGPVGQMAIRSCFLLGAKRVIAIDEVPERLAMARAAGAETIDFRTQNIQETLVEMTDGLGPDAVIEAVGMEAHGADTMMQKVGSALLSATTLERPFALNQAILGCRPGGILSMPGVYAGALGPVMIGILMNKGLTLRTGQTNTQKYLKPLLERIQKGEIDPSFVISHRSSNLEDGPALYEKFRDKKDRCTKVVFRPHG

SEQ ID NO: 49357 - protein, 231 aa, Hevea brasiliensis
MDVFPQYSDSLPFATHSCSLHYPESSTLSDTCSALRANLSDEEVLLASSYPKKRAGRKKFRETRHPIYRGVRRRNSGKWVCEIREPNKKSRIWLGTFPTEEMAARAHDVAALALRGRSACLNFADSSWRLPVPASREAKDIRKAAAEAAMAFQPEGTEGFSGELKQENKWTTESAPEDVFYMDEEAVFAMPGLLASMAEGMLLPPPQCVAGSGGEDGEMDAADVSLWSFSI

SEQ ID NO: 49358 - protein, 349 aa, Magnaporthe grisea 70-15
MAKTEKAFTNAEKILMAKAWIYGIRPFFKHGKNFNPTRDIPPQTGKTMLVTGGASGIGAAFVAEIARHSPAQVWIADLRPEAAEKAISAISAECPDVKIDFLQIDLGDAESVKRAASEFLSRTERLDVLLNNAGILPAKGWTTKDGYESMFGVNFVGHARLTELLLPRLMETAAIPGADVRVVSVASGGHGVHPKPDGVRLSSGGALLKEPTCGGMTAMQRYAQSKLAVILWVRRLAREFPAITIVSAHPGTVATSIANDLSGSTRQPPAFFVKLTGTKTPEMGCYNQLWCATAPRDQLVSGKYYCPVGLPDQEFGIARDRKKADELEERLWVWLQKELKGDSFVKVDA

SEQ ID NO: 49359 - protein, 474 aa, Nostoc sp. PCC 7120
MTTPQEVLKRIQDEKIELIDLKFIDTVGTWQHLTLYQNQIDESSFSDGVPFDGSSIRGWKAINESDMTMVLDPNTAWIDPFMEVPTLSIVCSIKEPRTGEWYNRCPRVIAQKAIDYLVSTGIGDTAFFGPEAEFFIFDSARFAQNANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNKIHPGEPLDKNIYELSPEELAKVPSTPGSLELALEALENDHAFLTDTGVFTEDFIQNWIDYKLANEVKQMQLRPHPYEFSIYYDV

SEQ ID NO: 49360 - protein, 89 aa, Legionella pneumophila subsp. pneumophila str. Philadelphia 1
MLYMKGTPKMPQCGFSARAVQCIEACGVDFAYVDILANPDIRQVLPQFSDWPTFPQLYVKGELIGGSDIIAEMFQQGELEPMLRDAVAA

SEQ ID NO: 49361 - protein, 352 aa, Nostoc sp. PCC 7120
MKAQVFRGVNQLSYEEIPLPILEPDEVLVQVQVVGLCQSDIKKIRYPLYEPPRIFGHETAGTIAAVGSQVQGWQVGQRVAVMHHIPCMRCAYCMNENFSMCDVYKNISTTAGFNASGGGFAEYVKVPGHIVENGGLIPIPDGISFEEASFVEPTNCCLKAVKKAQIAPGQTVLVTGAGPIGLMFVMLVKYFGAKAIATDLLPSRIEKALNVGAEAAFDARDPDLPAKVHALTNGLGVDVTLLAVPSEKAFFQALECTRKGGKILFFAEFPDELEIPINPNILYRREIDLMGSYSSSYRLQNLSADIVFNRRIDVQALISDRYPLKDLSAAVDQAIAPTPETYKILIYPKIGD

SEQ ID NO: 49362 - protein, 869 aa, Arabidopsis thaliana
MKSLHWFLHLLIIAFTVLRSVEAQNQAGFISLDCGLVPKETTYTEKSTNITYKSDVDYIDSGLVGKINDAYKTQFQQQVWAVRSFPVGQRNCYNVNLTANNKYLIRGTFVYGNYDGLNQFPSFDLHIGPNKWSSVKILGVTNTSMHEIIHVVPQDSLEVCLVKTGPTTPFISSLEVRPLNNESYLTQSGSLMLFARVYFPSSSSSFIRYDEDIHDRVWNSFTDDETVWISTDLPIDTSNSYDMPQSVMKTAAVPKNASEPWLLWWTLDENTAQSYVYMHFAEVQNLTANETREFNITYNGGLRWFSYLRPPNLSISTIFNPRAVSSSNGIFNFTFAMTGNSTLPPLLNALEIYTVVDILQLETNKDEVSAMMNIKETYGLSKKISWQGDPCAPQLYRWEGLNCSYPDSEGSRIISLNLNGSELTGSITSDISKLTLLTVLDLSNNDLSGDIPTFFAEMKSLKLINLSGNPNLNLTAIPDSLQQRSKKVPMVAIAASVAGVFALLVILAIFFVIKRKNVKAHKSPGPPPLVTPGIVKSETRSSNPSIITRERKITYPEVLKMTNNFERVLGKGGFGTVYHGNLDGAEVAVKMLSHSSAQGYKEFKAEVELLLRVHHRHLVGLVGYCDDGDNLALIYEYMANGDLRENMSGKRGGNVLTWENRMQIAVEAAQGLEYLHNGCRPPMVHRDVKTTNILLNERCGAKLADFGLSRSFPIDGECHVSTVVAGTPGYLDPEYYRTNWLSEKSDVYSFGVVLLEIVTNQPVIDKTRERPHINDWVGFMLTKGDIKSIVDPKLMGDYDTNGAWKIVELALACVNPSSNRRPTMAHVVMELNDCVALENARRQGSEEMYSMGSVDYSLSSTSDFAPGAR

SEQ ID NO: 49363 - protein, 449 aa, Parvularcula bermudensis HTCC2503
MKDAYDLIVIGGGTGGNGVARMAAKAGWNVASIDSLPYGGTCALRGCDPKKMLVAVTEGVDWADRMKGNGLKMQPSVDWPEMIAFKRTFTDAMPPRIEAGMEKAGIDVLHGEARFTGADSIELNGEILRAKHFHIATGARPITLNIPGEAYLTTSTEFLELTERPDRIAFVGGGFIAMEFAHIARRAGASEVTVLEMAERPLGTFDDDLVEILVEGTEELGIDLRTKAKVLAIEKQGEEFIVTVEGAGGAETLTCDLVVHGTGRVPNIDGLNLEAAGVEYTRRGIQVNASMRTSNPAVFAAGDCADSGPNLTPVSAFEGRVAGKNLLAGKDERQVKYPPIPSVVFTLPMVATVGLSEAAARKQGLKFDIHFEKTHDWYSSMRVGAKRTAYKVLVEQDTGKILGAHLIGPGAEEQINLFAMAMRAGQTANQIKAMIFAYPSYASDIGSMV

SEQ ID NO: 49364 - protein, 389 aa, Legionella pneumophila subsp. pneumophila str. Philadelphia 1
MSLITSYSPMPVTFTHGEGVWLYDEQGKKYLDGLSGIAVCGLGHAHPDVTRTIQEQAARLIHTSNVFHIKEQELLAAKLTSMARMEQVFFANSGAEANEAAIKLTRLFGHKKGIETPSIIVMEKAFHGRTMATLTASGSRKVQAGFEPLVPGFIRAPFNDLDAIHTIAANREDVVAVMVEPIQGEGGIYPAEEGYLRALANLCEQNDWMLILDEIQTGNGRTGKLYSCMHYDIQPDILTTAKGLGNGMPIGACLMSKRAKDLFKPGNHGSTFGGNPLACATALTVLEVIERDKLCERVTKNSALLMDKLISNLGEHPHVKAIRGKGYMIGIELDRPANDMRVLGLENQVLFNITAETVVRLLPPLIISEDEIDELVNRITRTINQFTNQ

SEQ ID NO: 49365 - protein, 872 aa, Arabidopsis thaliana
MKSIHGFLLFLITAYVILESVQAQDQLGFISLDCGLVPKNATYTEKTTNITYKSDANYIDSGLVGRISAEYKAQLQQQTWTVRSFPEGERNCYNFNLTAKSRYLIRATFTYGNYDGLRQVPKFDIHIGPSKWTSVKLDGVGNGAVLEMIHVLTQDRLQICLVKTGKGIPFISSLELRPLNNNTYLTQSGSLIGFARVFFSATPTFIRYDEDIHDRVWVRQFGNGLKSISTDLLVDTSNPYDVPQAVAKTACVPSNASQPLIFDWTLDNITSQSYVYMHFAEIQTLKDNDIREFNITYNGGQNVYSYLRPEKFEISTLFDSKPLSSPDGSFSLSFTKTGNSTLPPLINGLEIYKVLDLLELETDQDEVSAMINIKATYDLSKKVSWQGDPCAPKSYQWEGLNCSYPNSDQPRIISLNLAENKLTGTITPEISKLTQLIELDLSKNDLSGEIPEFFADMKLLKLINLSGNLGLNSTIPDSIQQRLDSKSLILILSKTVTKTVTLKGKSKKVPMIPIVASVAGVFALLVILAIFFVVRRKNGESNKGTNPSIITKERRITYPEVLKMTNNFERVLGKGGFGTVYHGNLEDTQVAVKMLSHSSAQGYKEFKAEVELLLRVHHRNLVGLVGYCDDGDNLALIYEYMANGDLKENMSGKRGGNVLTWENRMQIAVEAAQGLEYLHNGCTPPMVHRDVKTTNILLNERYGAKLADFGLSRSFPVDGESHVSTVVAGTPGYLDPEYYRTNWLSEKSDVYSFGVVLLEIVTNQPVTDKTRERTHINEWVGSMLTKGDIKSILDPKLMGDYDTNGAWKIVELALACVNPSSNRRPTMAHVVTELNECVALENARRQGREEMHTSGYVDFSRSSASEFSPGAR

SEQ ID NO: 49366 - protein, 556 aa, Legionella pneumophila subsp. pneumophila str. Philadelphia 1
MAIKVTKRGMDILRDPILNKGTAFSLQERDEFALHGLIPTTVETLEQQVVRCLDAYSAKEDPLEKHIYLRALQDRNEVLFYRFIIDNLVHILPIIYTPVVGQACEMFSHIYRQPRGVFLSYPERDKLDSIIQNIASTRSTKVIVVTDGERILGLGDQGAGGLGIPIGKLSLYTSCGGIHPSNTLPIILDVGTNNKERLDDPEYIGWRHARISGKEYDDFVDQFVQSIKRHMPHVLLQFEDFAQQHAYPLLERYKNQLCTFNDDIQGTASVAVAAILAATRVTNTPLKEHRVALLGAGSAGCGISEQLVHAMMNQGLSEEEARSRFYLVDRYGLLHDEMTDLLPFQKGFVRSSTSLQNWKLEKKGEITLTDVINNAQPTILLGVSGQPNQFKEAMIKTMLSYCERPIIFPLSNPTSRAEAIPQDLLNWTAGKALIATGSPFEPVVINGHKIEIAQCNNSYIFPGVGLGVVAGQAKRVTDLMMMAAAVALSELAPAIRTGEGRLLPELNSIREVSQHIARAVILQGIKEGHIEPMNNNKIDDSIKRTMWTPQYEPYVL

SEQ ID NO: 49367 - protein, 135 aa, Neurospora crassa
MAPAKAVLTSKAPKPIPQLSQAVVYNGMVYCSGSLGIDPATGNMVEGTVKDRTRQVFKNLSAVLEAAGSSLKNVVKVNVFLTTMDNFAAMNEAYDEFITAEPKPCRTCVAVAQLPFGSDVEIECTAYLNAPSAKL

SEQ ID NO: 49368 - protein, 424 aa, Ostreococcus tauri
MTGTFARVSRAAVAHHPRVRALGRLVTRKTLDDLPPDASLVMFGVTHWDRETSSGERSNEVGRREWERDWRSRCWMTYRRGFEALGRTKWCTDAGWGCTLRSAQMMLANALSIHSRGRHWRREVQLVAVHENETADDGSKSPAVSFLSGVVNKLKIPQSERTRAGSDAQEDILRLFADEVGAPFSIHRVCEKTTEWGAPPGRWFEPSVMCRAFEALVAEHDLGSELTVHVVSGREGEDGGVPTVDEAEVRAKSADVGKALLLFVPVVLGVGRTINARYLSQLRSMMAFKQSVGIVGGRPNSSLYLVGHSDDVFFYLDPHTVQVASSMVTMDFESYYCPTPLHVCGGDLDPTLALGFYCRDGDDVASLLVDIEALARVNATAPALAIRPADDRYKSISPRHAERASPSVPPTDIRDDEFADWTFV

SEQ ID NO: 49369 - protein, 137 aa, Geobacter metallireducens GS-15
MERTFAIIKPDAVERNIVGKVLEKIEAAGFRIVGMKKIQLSKKEAEGFYYVHSERPFFGDLCSFMSRSPVVVLALERENAIAKWREVMGATNPANADAGTIRKEFGLSIEENTVHGSDSPESAAFEIPYFFSQLELL

SEQ ID NO: 49370 - protein, 341 aa, Glycine max
MAHFTSSGKSDDLTKEDCKGQSALVVCFGEILIDFVPTVGGVSLAEAPAFKKAPGGAPANVAVGISRLGGSSAFVGKVGADEFGYMLADILKQNDVETSGMKFDPNARTALAFVTLRADGEREFLFFRNPSADMLLQESELDKNLIKKAKIFHYGSISLIDEPCKSAHLAAMRFAKESGCILSYDPNLRLALWPSAEAARDGIMSIWDQADVIKISEDEITFLTGGDDPYDDNVVLKKLFHPNLKLLIVTEGSEGCRYYTKEFKGRVAGVKVKPVDTTGAGDAFVSGIIYSLASDQSLFQNEEHLRKALHFANVCGAITVTERGAIPALPTKEAVLQFAAT

SEQ ID NO: 49371 - protein, 441 aa, Geobacter metallireducens GS-15
MALKETLKQKIEEFRPRTTRLVKEFGKVVIDQVTIDQAIGGARDIRSLVTDISYLDPQEGIRFRGKTIPETFEALPKASGSDYPTVESFWYFLLTGEVPTQAQVDEVVAEWKTRQVVPQYVFDAISALPKESHPMVMLSVGILALQKDSKFAGFYNSGKFNKMTAWEYVYEDASDLVARIPIIAAFIYNLKYRGGKQSAIDPTADCGANFARMIGQCKEYEDVARMYFILHSDHESGNVSAHTTHLVHSALSDPYYAYSAGLNGLAGPLHGLANQEVLDWTIKFQQKYCKDVEPTKELVTKALWDTLNAGQVVPGYGHAVLRKTDPRYMSQREFCLKTPGLKDDPLFKLVAMIFETAPGVLMEHGKAKNPWPNVDAQSGVIQWYYGLREWDFYTVLFGVGRALGCMANITWDRGLGYAIERPKSVTTPMLEKWAEEGGRKF

SEQ ID NO: 49372 - protein, 552 aa, Geobacter metallireducens GS-15
MAQHLDFTIGGLLDHMAVTFPDNDALVYPERGLRYSYRQFNDICRQVAKGLLKLGVRKGDHVAIWAYNVPEWVILQFATAKIGVVLVTVNTAYKSAELEYLLDQSDSTTLFMVRSWKDTDYVATLSEVVPELASAEAGLLTTPKLPFLKRVVFIGEDTPAGMLNFEKIAEMGKEVPDEQLAAVESSLDVHDVINMQYTSGTTGFPKGVMLTHYNLVNNGYHIGECMKFTDKDRLCIPVPFFHCFGSVLAVMASVTHATAMVPVEIFDPLKVLQTVEKERCTAVHGVPTMFIAELEHPDFAKFDLSTLRTGIMAGSVCPIEVMKRCVKDMNLTELTSVYGQTESSPGITQTRTEDSVELRVSTVGRALPGAEVKTVDIETGATLPPGKQGELCARGYMVMKGYYKMPEETAKVIDADGWLHTGDLAVMDENGYCKITGRIKQMIIRGGENIYPKEIEEFLYTHPKISDVQIYGVPDRKYGEQVMAAIILKNGVEMTEDEVKEFCRGKIANYKIPKYVKFVAGYPMTASGKIQKFKLREMAIKELGLEGAGDAA

SEQ ID NO: 49373 - protein, 561 aa, Zea mays
MAAASPPPSPPHAKRPKMSSSSDPEADAEPTSASAAVEGADPAQRRPRYKRRKVAILLGYCGAGYQGMQKNPGARTIKGDLEEALYQAGAVPEADRSAPRRYDWARAARTDKGVSAAAQVVSGRFYVDPPGFIDRLNAQLAPQIRAYGYVRVTNSFNAKKFCDRRRYLYLLPVFALDPSAHPDREAVMASMGSGSELTKCLECSERGRKIPGVMGRDGKLPSPGQNGVDAPVEGSSHDESGTLGDAKCDHTSSDGGNPFAHGEVGSNSKEKPDLPVPGDGTEVANAEMGSNGDSDVVSSDIYMGNEEKKLPAATENKAQGMESEKSNGEEKLPTKTTFSYTDEVKERFNRILKYYVGTHNFHNFTTRTKAEDPAAKRFIISFAADRVVSLDGIDFVRCEVVGQSFMLHQIRKMIGLAVAVMRNCAPESIYDVAFRKDVNLNVPTAPEVGLYLDECMFTSYNKKWKDPHEAVFMEPYSEEAEEFKVKYIFTHIAAMEHKEGAVALWLHSLNHRNYPDFRYMETAEHNAGAEVESIAAGAEPKVGAEVENTEEVQMPSDNLSE

SEQ ID NO: 49374 - protein, 428 aa, Polaromonas sp. JS666
MGMLDWKEKSVDVLKQGGVIAPDERLPWPQTAVMGVQHVIAMFGATVLAPILMGFDPNIAILMSGIGTLIFFAVTGGKVPSYLGSSFSFIGVVIAATAYAGKGPNANLGVALGGIIACGVAYTLIGVIVQLVGTGWIERVMPPVVTGAVVAVIGLNLASIPVKNMAASNFDAWMQLVTFVSVALVAVMTRGMVQRLLILVGLLVASIVYAVLTNGLGLGKPLDLSGIASAGWVGLPGIAAPVFSLNAMLLIAPVAIILVAENLGHIKAVTAMTGKNLDVYIGRAFIGDGVATIVSGSAGGTGVTTYAENIGVMAATKIYSTAVFVVAALIAILLGFSPKFGALIQAIPLPVMGGVSIVVFGLIAVAGAKIWVDNKVDFSDNRNLIVAAITLVLGTGDFTLKFGQFAMGGIGTATFGAILLYALLNRQR

SEQ ID NO: 49375 - protein, 305 aa, Haloarcula marismortui ATCC 43049
MVNVDEFIEEAKAEIAEEIGDKHAVIGLSGGVDSSTAAALAYEAIGDQLTAVYVDTGLMRKGETDEIRETFDYMDSLRIVEAQDRFLDELEGETDPEEKRHIIGEQFIREFETVAREVDADYLVQGTIYPDRIESEGTIKSHHNVGGLPERIDFDGIVEPMRDLYKDEVREVARALDLEEIISERMPFPGPGLAVRIIGEVTEEKLAVAREANHVVEEELEEYEPWQALAAVIGKATGVKGDNRVHGWVVAVRSVESRDGMTARAQELDWDTLQRMQSRITGAHENVARVVYDVTHKPPATIEYE

SEQ ID NO: 49376 - protein, 142 aa, Mycobacterium sp. MCS
MRIADVLRSKGSAVATITETTTVTGLLAELATHNIGAMVVVGQDGVVGMVSERDVVRRLHERGAELLRCPVSEIMTSVLVTCTPADPVDDLSALMTNNRVRHVPVLDNGRLAGIVSIGDVVKNRMEQLQTEQEQLQAYITRG

SEQ ID NO: 49377 - protein, 829 aa, Shewanella sp. MR-4
MNRRDFIKANAVIAAAGAAGLALPASASNLITSSEQTKLEWNKAPCRFCGTGCSVIVATRDGKVVATHGDANSEVNRGLNCIKGYFLSKIMYGSDRLTTPMLRMTDGKYDKHGEFTPISWDSAFDIMAQKWKETLKAKGPTAVGMFGSGQWTVWEGYAAVKLMKAGFGSNNIDPNARHCMASAVVGFMRTFGIDEPMGCYDDMEAADAFVLWGSNMAEMHPILWTRVTDRRLSASHVKVAVLSTFEHRSFDLADLPIVFTPQTDLAILNFIANYIIQNDKVNWDFVKKHVNFRQGTTDIGYGLRPTHPLEQKAKNVKTAGDSTPIDFDTFKAFVAEYTVEKVSKMSGVPEAKLIELAKLYADPNTKVTSFWTMGFNQHTRGVWCNNLIYNIHLLTGKISTPGNSPFSLTGQPSACGTAREVGTFSHRLPADMVVTNPEHRKHAEEIWKIPSGIIPPKPGYHAVEQNRRLKDGDLNCYWVQVNNNMQAGPNINEEGLPGYRNPANFIVVSDAYPTVTTQAADLILPTAMWVEKEGAYGNAERRTQFWHQMVQAPGESHSDLWQLMEFSKRFTTDEVWSKEVLAANPQFKGKTLFEVLYQNGNVDKFPLADTDPKYLNNEAKHFGFYVQKGLFEEYATFGRGHGHDLAPFEAYHEAHGLRWPVVDGKETKWRFREGSDPYVKAGTGFEFYGKPDGRAVIFALPFEPPAESPDDEYDMWLSTGRVLEHWHSGSMTQRVPELYRAFPDAVCFMHPEDAKKRGLRRGDEVRVMSRRGEIKTRVETRGRNKPPVGLVFVPWFDASQLINKVTLDATDPLSKQTDFKKCAVKIVKV

SEQ ID NO: 49378 - protein, 472 aa, Escherichia coli B
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETKNVTLEHIERKLMAGEKLRNIGI

SEQ ID NO: 49379 - protein, 109 aa, Zea mays
MDKGSVVVPPAPAAAAAKKAKRFEIKKWNAVSLWAWDIVVDNCAICRNHIMDLCIECQANQASATSEECTVAWGICNHAFHFHCISRWLKTRQVCPLDNSEWEFQKYGH

SEQ ID NO: 49380 - protein, 404 aa, Nostoc sp. PCC 7120
MQFSQRLHPLQSNVFADMDKAKSLALAAGKELIDLSLGSSDLPAEAHVIEAIAKSLYDPSTHGYLLFNGTRDFRQAAANWYEQKFGVKVDPETEVLPLIGSQEGTAHLPLALLNPGDFALLLDPGYPSHAGGVYLASGQIYPMPLKAENDFLPVFADIPTDVLAQSRMMVLSYPHNPTAAIAPLSFFKEAVAFCQEHNIALVHDFPYVDMVFENAGNLNTNLPQSPIPNHQSLVPSILQADPDKSVSIEFFTLSKSYNMGGFRIGYAIGNAQMIQALRQIKAAVDFNQYRGILNGAIAALTGPQAGVEAAVSTFCQRRDAFINALHHIGWYVPTPKATMYIWAKLPSSWSQNSIEFCTQLVRQTGVAASPGAGFGKSGEGYVRFALVHEPSILKIAVERMSNFL

SEQ ID NO: 49381 - protein, 502 aa, Zea mays
MPEPGGRCLGDLGGQRQVLKGWPDLWLVGDKPGLRALSTAAMAAAPQPPPLEADQTLALPDVLLLRVLACLPEPQLTGAASLVCRRWTRLAGRLRRRLAVRDWAFVAHRLPYRFPDLADLDLFPASIAAPTTAVPHGAAASPLLTCGVVSLTLDTSADPPLGACRFIDDDALDRGLAAVAASFPNLSRLSATAASESGGLMAIAVGCPTLQELELHRCTDLALRPVSAFAHLQILRIVAASPALYGTAEGGGVTDIGLTILAHGCKRLVKLELQGCEGSYDGIAAVGRCCAMLEELTIADHRMDGGWLAALAFCGNLKTLRLQSCSRIDDDPGPAEHLGACLTLESLQLHRCQLRDRSALHALFLVCEGAREIQFQNCWGLEDDMFALAGLCRRVKILLLEGCSLLTTRGLESVITSWGDLQSLEVVTCNKIKDEEITPTLAELFSNLKELKWRPDNKSLLAASLVGTGMGKKGRVFFKRLILPAHQRIKGKVLNNSAGVAA

SEQ ID NO: 49382 - protein, 192 aa, Bacteroides thetaiotaomicron VPI-5482
MKLLVFLAKGFETIEFSGFIDVMGWAKTDFGCDVEVVTGGFNEKVISSFNIPVLVDKTIDEISVDEYDALAIPGGFEVFGFYEEAYEEKLLNLIRQFDARKKWIATVCVGALPVGKSGVLKDRKATTYHLGGAVKQKVLQSFGAIIVHEPIVVDDNIITSYGPQTASGVALLLLEKLTSHREMSLVKEAMGF

SEQ ID NO: 49383 - protein, 257 aa, Geobacillus kaustophilus HTA426
MNISPKAIKVRNIWIGGTEPCICAPVVGEDDRKVLREAEEVCRKQPDLLEWRADFFRAIDDQERVLATANGLRNIAGEIPILFTIRSEREGGQPIPLNEAEVRRLIEAICRSGAIDLVDYELAYGERIADVRRMTEECSVWLVVSRHYFDGTPRKETLLADMRQAERYGADIAKVAVMPKSPEDVLVLLQATEEARRELAIPLITMAMGGLGAITRLAGWLFGSAVTFAVGNQSSAPGQIPIDDVRTVLSILQTYSR

SEQ ID NO: 49384 - protein, 410 aa, Pseudomonas fluorescens Pf-5
MAIPFSPAQLVAAARQYGTPLWCYDAATIQARIAQLQAFDVVRYAQKASSNLHLLRLIREAGVRVDAVSLGEIERALLAGFSPVDAGIVFTCDLFDEATLARVVELQVEVNAGSIDMLRQLGEKSPGHRVWLRINPGFGHGHSRKTNTGGENSKHGIWHDQMSEALAVIRQHGLHLVGLHMHIGSGVDYDHLEQVGAAMVAAVKSLDHDLEAFSIGGGLSTPYREGDTPVDVQRYANAWKVARQEIEAYLGHGVRMEIEPGRFLVAEAGCLVSEVRVVKTAGQHHFVLVDTGFNDLMRPAMYGAYHGMSLLDAAGHPVERPQQLTVVGGPLCESGDIFTQDDECLTPRPLPQARVGDLLVLHDTGAYGASMSSNYNSRPLLPEVLFENGQPKLIRRRQPLADLLALELGL

SEQ ID NO: 49385 - protein, 229 aa, Triticum aestivum
MARGLRHLLLLAALLQLLSATSAATAGDVATGRGSEKVHVAIYYESLCPYSVRFVANHLFKAYRDGLLDAANLTLVPYGNAVVRNDGTISCQHGPEECLLNTVEACAIDAWPDVKVHLGFIYCVSDLVLKNKHREWESCFQKQGLDPKPVTECYKGERGHNLSLEYGRQTAELVPPHQFVPWVVVDGKPLYNDYGNFKAYICKAYKGYPLLEACRSLGLEAHDDVYGRL

SEQ ID NO: 49386 - protein, 974 aa, Oryza sativa (japonica cultivar-group)
MHAHLPAARRSSTHLPGYLSIRRLPLLCSRSDRHRRRWIRRWPTIEDGIRWEEEERQQGGSAVLVAATSAELVTVKLFAASPLVGSGSAHTISGDVWARRWPDIEGGRRKQQKLVLDADDDGLHHTGVGGKQQKLVLDAADDGLHLAGVGGKQHNLVVDAGAGGKQQKLVLDAADDGLHLAGVGGKKHNLVLDAAPDGLHLAGVGGKQHNLVLDAGTGRKQQKLVLEDDGLHHTGAGRKQQKLVLDAANDGLHLAGVGGKQHNLVLDAADDGLHLAGVGGKQHNLVVDAGAGAKQQKLVLDAADDGLHLAGVGGKQHNLVLDAGAGGKQQKLVLDAADDGLHLAGVGWKQHNLVLDAGAGGKQQKLVLDTAVDNLVLCTDVDGLLHTGAGGEQNMVCDNVGTIVSGLHDTIARWERNLVFDDVGTAVPWLRHTGVDGKQNLVYHLATATVQSVWRENCMEQFKLVLEALHQPHRHLYIAVDMEFAADAATNVSHRPVTSISCYQHMRRYVNGGGIFQMGLTFAFVGEGEQAPSPLIALEINFDFNVNSPKYHGKSIDFLSSQGHDLTQHSKRGVAPEFVYEGLLRHLPFGDGSVTWVAFHGDYDLAFLLRLLQGGDHGGNCLLPPKLATFLQKVREKFPVVYDVRVLGKLVKDGFNGSLTALAEYLGIPRNGDEHHAGSDALLTLSCFFKIVSLSGHQMHRMDARRGLLAGLEEWNMAIKCARHIDNHTGSIYVVKMLPHKLDEEARRIEELVASNFNIVGVEVIHAQLGKRSYAVEAQQNYELIKTFLKDSDLYEIIVTFMNAEGMLAYSRAWKFCISSRADNACVHPQQFAKFMASCGALGDPNISWVTFHGAHGIARMIRSFLSPQDLPSQWCSYIGHRRAFFPAIYDVALLVRRSFDIITIPWIECKGGLLDVAQALNLKEIEADMEAARVLLTLRCYMRLAERPDFPGTKMAVQGLLKESCCWKCPANC

SEQ ID NO: 49387 - protein, 369 aa, Ostreococcus tauri
MLVLYLTHALLARERGGDSYQGGRPTVGVTRARRIGPTDRDEDMALARTVRSKNYSATNVPKSFYGRAALLKDEAGFPSTPPLVLSSKKPKAYLMRNFLSPQECDHLMMLAKRELAPSTVVGDGGSSVASEIRTSAGMFLRKSQDDTVREIEERIARLSGVPVDNGEGMQILRYDKGQKYDPHFDYFHDKVNPAPKRGGQRVATVLIYLVDTEEGGETTFPNGRLPENFEEDEPDNPFAAHIKHTDCAKNGIPVKSVRGDAILFFSMTKDGELDHGSLHGACPVIAGQKWTAVKWLRVAKFDGGFKDELPMIPLTRRTEREPCVDEWDDCASWARDGWCERNPEFMKFAGARDSHTPACPKSCGLCTST

SEQ ID NO: 49388 - protein, 429 aa, Nostoc sp. PCC 7120 [sequence omitted]

SEQ ID NO: 49389 - protein, 209 aa, Sulfolobus tokodaii str. 7
MIRIGVLGPVGSGKTTLIEFLTEYLVKKEGLSVGIITNDVISSHDALRIYQNLVLKEKLLPKENVIGIVTGGCPHTAIREDPSVNLRALETLMKRTSLDVIFIESGGDNVMSTFSPILADYTIFVLDTAAGDKYPGKGGLGIQESDLLVVNKIDLAPFVGADLEKMRRDAEKIRKDKPTVFISLKTGDGIDDLIKIIRSELELEGLIRS

SEQ ID NO: 49390 - protein, 438 aa, uncultured archaeon GZfos27G5
MEEEKRKAGEKRLSAINKHEPEKVASEYHSYYRGKIEIGLKAPVRSYDDFAIWYTPGVAEPSREIKNSRERVFEYTNKGNSVAIVTDGTRVLGLGDVGAEAALPVMEGKAMLFKYLGGVDAFPLCLDTSDAEDIINTVKWVAPTFGGVNLEDIESPKCYYILQRLQDELGMPVWHDDQQGTALVILAGVINALKVVGKRLSEIAISLVGAGAANMNVAKYLCLAGAKEGNMVMVDSKGILNRERMEDEKRDENKRDMCEKTNKEGRKGGIKEAMRDTDLCIALSTPGPGVIKKEWVADMADDAIVFACANPVPEIWPVEAEEGGARIVATGRSDFNNQVNNSLGFPAVFRGALDVRAARITDEMCIAAANAIARYTEEEGKGKEKGISESRIIPRMEESEMYVCEAVAVGMKAIEQGVAEKGMSMKALEERIREKISD

SEQ ID NO: 49391 - protein, 330 aa, Shewanella sp. MR-4
MQTLAQHLTSKAVNESLSQLILTLADTSKAISHAVRHGALAGVLGATEQENVQGETQKKLDIITNDMLKDALKVDGTVRGLASEEEDHVVEVSANGKYLVCFDPLDGSSNIDINSLVGTIFSVLPAPAGELTETSFLQSGRNQLAAGYVLYGPSTMLALTTGQGVQLFTLHPETNEFLLTNAAMSISPDTQEFAINMSNQRFWEAPMQTYIADLLLGKIGPREKSFNMRWIAAMVGDVHRVLSRGGIFTYPTDNKDPKKPYKLRLMYEANPMALLVEQAGGKASTGYETILDIQPTQIHQRVAVILGSANEVDACLSYHGIDYSEEPTLD

SEQ ID NO: 49392 - protein, 685 aa, Arabidopsis thaliana
MAPYFMLRVKKASLRASFLRFYASLSLLHVRLLLLRFFRSCFPVTVLIFFSLALSQRRCWSDKMAMAVFKAPLKGEFHGARKMEGKQYKHHLLQQQSTGRRRVFVQTDTGCVLGVELDRNDNVHTVKKRLQIAFNFPTEESSLTFGDMVLKNDLSAVRNDSPLLLKRNLMHRSSSTPCLSPTGNDLQRKDRSGPIEILSHSPCFLSLKQTANDIVKAMKMGVEPIPVNGGLGGAYYFRDEKGQSVAIVKPTDEEPFAPNNPKGFVGKALGQPGLKPSVRVGETGFREVAAYLLDYDHFANVPPTALVKITHSVFNVNDGMDGNKSREKKKLVSSKIASFQKFVPHDFDASDHGTSSFPVASVHRIGILDIRILNTDRHGGNLLVKKLDDGGVGRFGQVELIPIDHGLCLPETLEDPYFEWIHWPQASIPFSEEELDYIQSLDPVKDCEMLRRELPMIREACLRVLVLCTVFLKEAAVFGLCLAEIGEMMTREFRAGEEEPSELEMLCIEAKRLTTEQDVLSPKSDGEGETEFQFDIDYNELDSVYGSETETDEFFAKNPFSNGRSSLGELKESIAEEEEDDEEEAKLTLSLSKLSTSMKNNLSNTMGSGYLKPPKDNQTDKALVSHKSANVQLPLSVNFVKLADMKEVEWVVFLERFQELLYSAFAERKTMTLRNTQRLGTSCKF

SEQ ID NO: 49393 - protein, 289 aa, Vitis vinifera
WGVVESTVFPSKYAMGMSSVVYKDWVLTEQALPADLIKRGVAVEDSEAPHGLRLLIDDYPYAVDGLEIWSAIETWVKEYCSFYYKTDEMVQKDSELQFWWKEVREEGHGDKKDEPWWPKMRTVKELIQTCTIIIWVASALHAAVDFGQYPYAGYLPNRPTISRRFMPEEGTPEYEELKSNPDKAFLKTITAQLQTLLGISLIEVLSRHSSDEVHLGQRDTPEWTLDTTPLKAFEKFGRKLADIEEMIIDRNGNERFKNRVGPVKIPYTLLYPTSEGGLTGKGIPNSVSI

SEQ ID NO: 49394 - protein, 323 aa, Triticum aestivum
  misc_feature (280)..(280): Xaa can be any naturally occurring amino acid
  misc_feature (296)..(296): Xaa can be any naturally occurring amino acid
MSSRSLVRSPVSCSAVNECFSYNSRCPRSYYQYSNTMKLQTPQAGQMLLPRKLWKSTRLQTTLLIQRRTVSNCCSDLSTTYTEQLPSYLGLNVLQDQSNAKQNNIRKVLVILNPNSGFRSSREVFYKKVQSTLKLSGFAMEVVETAYAGHAKVLASTVDLSTCPGGIICVGGDGVVNEVVNGLLGRDDLKEALQLPIGIVPAGSDNSLVWSVLGIRDPVSAATALAKGGFTPIDVFAVKWIQAGVTHFGLTASYCGFVADVLQLSENFRLQLGAPPVTSXAGILKVFCPCPNTKFXGGIYPAFQPKIPKLGRSPDLKWPGQFP

SEQ ID NO: 49395 - protein, 787 aa, Oryza sativa (indica cultivar-group)
MENLRVFGFFWFFFGFPLFHARLLTSGHLGAHPGLRARFLDRLALSPHPAALPHALLLLRSLPTPATNDLNAALRGLAASPHPARSLLLLAGRLLPALLPRPDALSLSFALKASARCSDAHTTVQLHALVLRLGVAADVRLLTTLLDSYAKCGDLASARKVFDEMTVRDVATWNSLLAGLAQGTEPNLALALFHRLANSFQELPSREEPNEVTIVAALSACAQIGLLKDGMYVHEFAKRFGLDRNVRVCNSLIDMYSKCGSLSRALDVFHSIKPEDRTLVSYNAAIQAHSMHGHGGDALRLFDEMPTRIEPDGVTYLAVLCGCNHSGLVDDGLRVFNSMRVAPNMKHYGTIVDLLGRAGRLTEAYDTVISMPFPADIVLWQTLLGAAKMHGVVELAELAANKLAELGSNVDGDYVLLSNVYASKARWMDVGRVRDTMRSNDVRKVPGFSYTEIDGVMHKFINGDKEHPRWQEIYRALEDIVSRISELGYEPETSNVLHDIGEEEKQYALCYHSEKLAIAFGLIATPPGETLRVIKNLRICGDCHVVAKLISKAYGRVIVIRDRARFHRFEDGQCSCRDYCGVWAIWFCVKLLGFQKHFIERCHVASSQGFVTFATVEGHDADFVFYTRQEIQDVDGEEDAGRAGETGMISYKIAAHAADLAKCHPYAQAWDDTLSKARFEFRWLDQFALYLDPVTTMSFHDETLPSEGAKVAHFCSMCGPKSCSMKITEDIRKYADEHGYRIVEEAVIPGMNAMSAEFLAARKTISGEQHGEAGGEIYVPESYTARK

SEQ ID NO: 49396 - protein, 154 aa, Zea mays
AQAAEHGCEQVVWLDAIERRFIEEMGGMNLFFVFGSGADARLVTPELSGSLLPGVTRDSLLSLSVDAGIAVEERKVSVEELRKGVASGDITEVFACGTAAVITPVGRVAGDADDYTIGDGTPGQVTTALRDTLTGIQRGTFADTHGWMTPLYGA

SEQ ID NO: 49397 - protein, 134 aa, Mycobacterium sp. MCS
MAIRSFTFTPDDGVPPAVAPFAHATAAGQTLYVTGQMPTDHTGEIVGTGIEAQTDQVLRNLLRVTRLCGGGLDDVVAVRAYLTDWAEYAAFNTAYAAWFPDRLPSRTCVGVTGLAVGARVEIDWTCWRADGWGR

SEQ ID NO: 49398 - protein, 201 aa, Shewanella sp. MR-4
MKLLKPLFDNNRRWAGRIRQEHPDFFEQLAKQQNPEYLWIGCSDSRVPSNQIIDLMPGEVFVHRNIANMVIHTDLNCLSVLQYAIDVLKVKHIMVVGHYGCGGVRAAMGNQRLGLIDNWLGHLRDVYRLHQDELMQMDEAKRFDRLCELNVIEQVANVTSSTIVQEAWARGQELAIHGWIYGIDNGLLTDLDVTVDRAQKI

SEQ ID NO: 49399 - protein, 254 aa, Vitis vinifera
QEVASKKDQQQYWARKEEPYRFDTVKEFAEAFQSFHTGRKVGDELASPYDKTKSHPAALTTKKYGVNKKELLDANMSREYLLMKRNSFVYVFKLTQLAIMAVITMTLFLRTEMHKNSVDDGNIYTGALFFTVVMIMFNGMAELAMAIAKLPVFYKQRDLLFYPAWAYALPTWILKIPITFIEVGVWVFMTYYVIGFDPNVERLFRQYLLLLLVNQMASGLFRLIASAGRNMIVSNTFGAFVLLMLLALGGFILP

SEQ ID NO: 49400 - protein, 512 aa, Oceanobacillus iheyensis HTE831
MLNDKAIRQSKIIYWSSGIVSICGIIFEVLFGALGSYILGDGVKQYTLTISLFLTGMGIGASLSEKFMRNLIIKFVWIEFCVALIGGFSSFIMFGITAFAPAGTDAFYLYSITLIIGALTGVELPILIRKANEIGVTLNKSTARVLFSDYAGGLIGGVLFVFLFRPYFGMVKTAFLVGLINLTVALIVLWLFRKEIRHFIVHAVIGGVIGVLLIAGLFFGEEMAFNFEQKLYQDPIIHMEESSYQKITVTQDEKDIRLYLDGSLQFSSVDEHRYHEVLVHPAMANVETPENVLILGGGDGIAAKEVLKYQDVKQVTLVDLDPAVVELANENRHLLEINEGALMDEKVEVKNMDAFQFLEDTSEWYDVILVDLPDPNNESLNKLYTKEFYSLVRNHLKPEGTLMVQATSPVFAREVYWTISETISSTNLNTENLHVDVPSFGNWGFVMASREEIDLDIMEIPVSTRFLTDDMMPALTAFGKDEDQQIPNFELKANTLIDPHLIQIYEKAWENY

SEQ ID NO: 49401 - protein, 392 aa, Glycine max
MPSTENQGFSLSFSSFGRSIFGVGQEQVHSVEASNESDSCNLELGSFQKRVTDRFQDLSVASDEQFLSIDWIQKLLGAFICCQEEFRAILLNNKEQVTKPPLDRMISEFFERSVKALDICNASRDGIEKIRTWQKHLEIVFCALGSSKRALTEGHFRRARKALMDLALAMLDEKESGSVFSQRNRSFGRHNSGKDHHSSSGHSRSHSWSVSRSWSAAKQLQSIANNLVPPRATEVAATSGLATPVYTMNCILLIVLWTLVAAIPCQDRGLNIHFSVPRQLSWSTPVTSLHERITEESKKRERRNSNGLLKEIYQVEISSRRLTDLIDSAQFPLADDQKTEVERNVMELMRVCEAFRNGSDPLERQVREVFQKIMACRTEGLDYLGTPSHTEQ

SEQ ID NO: 49402 - protein, 338 aa, Burkholderia mallei ATCC 23344
MSTPVNRQLRLKARPDGRVGHEHFTLAEAPLPPLGPGEMLVRVLYLSMDPTNRVWMSDIPQYLPPVAIGDVMRALGIGRVVASNAPGFAEGDLVQGLVGWQDYAHVRADEIAQYTKLPAALGLPLPRLLGACGMSGLTAYYGLTEIAPVQPGETLVVSAAAGSVGSVAGQIGKIHGARVVGIAGGADKCRYLTDELGFDAAVDYKSDDWKRALKDATPDGVHVSFENVGGEIMRAVLSRMAIGGRVALCGVIANYNNGRPADDVSVLIAKRLTMRGFLILDYRKSREAIATLAGWLRDGRLKAEETVADGLTNAPDVLNRLFDGSHRGKLVLRVDPQA

SEQ ID NO: 49403 - protein, 110 aa, Glycine max
  misc_feature (86)..(86): Xaa can be any naturally occurring amino acid
MASSMIWDRAVTTVNRAGAGMVAPFTGLKSMAGFPTRKTNNDITYIASNGGRVQCMHVWPPIGKRKSRLFSTWQNLVNPNLPKEVXFLLRKGWIPCLEFELEHGFLYRGP

SEQ ID NO: 49404 - protein, 1323 aa, Yersinia pestis KIM
MASTTMGVKLDEATRDRIKSAAQRIDRTPHWLIKQAIFNYLEKLESNSELPELATTSSLSLQDTEDAIPQLTENTHQPFLDFAEHVLPQSVTRAAITAAYRRPETEAIPMLLEQARLPADLAQATHKLAYSIAEKLRNQKSAHGRAGMVQGLLQEFSLSSQEGVALMCLAEALLRIPDKPTRDALIRDKISNGNWHSHLGRSPSMFVNAATWGLLFTGRLVSTHNEAKLSGSLNRIIGKGGEPLIRKGVDMAMRLMGEQFVTGETISEALANARKLEDKGFRYSYDMLGEAALTEADAQAYLLSYQQAIHAIGKASNGRGIYEGPGISIKLSALHPRYSRAQYERVMDELYPRLLSLTLQARQYDIGINIDAEEADRLEISLDLLERLCFEPQLAGWNGIGFVIQAYQKRCPSTIDAVIDMAQRSRRRLMIRLVKGAYWDSEIKRAQIDGLEGYPVYTRKVYTDVSYLACARKLLAVPNLIYPQFATHNAHTLSAIYHLAGQNYYPGQYEFQCLHGMGEPLYEQVVGKVAEGKLNRPCRIYAPVGTHETLLAYLVRRLLENGANTSFVNRIADATLPLDELVADPVSAVEAMAAAEGQLGLPHPRIPLPRELFGKDRANSSGVDLANEHRLASLSSALLASASQVWRAEPVIDAEQDNGDALPVINPAEPADVVGYVREATEGEVSRALDAAARAGAIWFATPPAERAAILIRAAELMENQMQTLMGILVREAGKTFSNAIAEVREAVDFLHYYAGIVRDNFANDSHRPLGPVVCISPWNFPLAIFTGQVAAALAAGNSVLAKPAEQTPLIAAQAVRILLDAGIPQGVLQLLPGRGDSVGALLVNDARVRAVMFTGSTEVATILQRSIAGRLDPQGRPTPLIAETGGLNAMIVDSSALTEQVVTDVVASAFDSAGQRCSALRILCIQDDVAEHTLQMLRGAMAECRMGNPERLSTDIGPVIDAEAKTGIERHIQAMRAKGRKVYQAARTNSLDEKEWQRGTFIKPTLIELDSFDELQKEVFGPVLHVVRFQRQHLNELVDQINASGYGLTLGIHTRIDETIARVTEKAKVGNLYVNRNMVGAVVGVQPFGGEGLSGTGPKAGGPLYLYRLLSSRPDDALANTLAHQDGEQQQNVAGREALLTAHRAFTQWATEQQHDSLATLCQRYASLAQGGTVRLLPGPTGERNTYALLPRERVLCLADTESDTLTQLAAVLATGSQVLWPENDVQKALLPQLPTEVQSRITLTHDWQTANITFDAVIYHGDADQLRTLCEQVAQIDGPIVSVQGFARGETNILLERLLIEHSLSVNTAAAGGNASLMTIG

SEQ ID NO: 49405 - protein, 147 aa, Medicago sativa
MPIRNIAVGTPQEATHPDTLKAGLAEFISTFIFVFAGSGSGIAYNKLTNDGAATPAGLISASIAHAFALFVAVSVGANISGGHVNPAVFGAFVGGNITLLRGIVYIIAQLLGSIVCSALLSLLPLRLFQHSDYQRVLELDQLWCWRL

SEQ ID NO: 49406 - protein, 222 aa, Zea mays
MVSLRRRRLLGLCSGKDSLPVDLPKPIENEKTVEVAHSNVKPFSVHPLPLAKTSDVLIKSSNGSDDSKEEKTQYYPGKEIKCRKRHRRKQYVDQEPCIMRGVYFKNMKWQAAIKVDKKQIHLGTVGTQDEAARLYDRAAFMCGREPNFVLSEEEKQELRRYTWEDFLAVTRNTITSKKQRKVGSLRRSKADLFMGQSDGDTEMANGGGSSNSDNGDAGTSAS

SEQ ID NO: 49407 - protein, 259 aa, Candida albicans SC5314
MFNRSIRISRSPLLRSRTILPRTFVTNTHRLSYRLKQRNPSTIFKQSAMTLITISQSLDEAYTKHKVIPEVVDQFDTQGLLSIEYGPTELVTLGNTLSVEGTQEVPKIQLTLNSPTEDGKIESISENDKFILVMTDPDAPSNSDHKWSEYLHWLVTDLKLPHTKNEDGEPEISHFIDVKEGRELVPYMGPGPPPKTGKHRYVFLLYKQDPNAGELTAPKDRPNWGTGVPSSGVKDWIEKNAPNSKLLSVNFFFAQNEDN

SEQ ID NO: 49408 - protein, 319 aa, Polaromonas sp. JS666
MTTSPVRTTLDATPLDPAFAGFLAQAAAQGAPPLEALPPPIARQVYRDLANALGLPAPAIGKVEDKSIPGPGGVLPLRAYSPTTQGPWPVLLYVHGGGFVMGDLQTHDEVCRTLCHLTGMLVVAVDYRLAPEHPFPAAPDDAEAALRWICVHADTLGGDPHRIAVAGDSAGAQLALVAVRRVQSPAVRALGLIYPVAQHPDEPSPSYQENEGKFLTKGVMQWFTASYLGGPSPTPPDHPDVALLKSELAALPATWVATMGHDPLRDEGHALALRAEAAGVLVAHQHYPSAIHACIHFSAVSPIGPQVLADLAQWLREQA

SEQ ID NO: 49409 - protein, 397 aa, Guillardia theta
MPNYKYKSKLRNELEKKLEIIELENKNIRISNSNNNYEKIKLKDMKKELQEKIKSSSTLPHLVATISEIIYNQNRKIDGIILKTSNRLNIFLSNEGLIDKKNLNLNSIYGVNKDSYYLISRLPPEYDFRVRAMEVDENPNQTYQDIGGLDNQIQELIEAIVLPLTQIIKFNKIGIIAPKGVLLYGPPGMGKTLLARACASQTNAKFFKIGGPNLVQMYIGEGASLVRETFKYAKETQPSIIFIDEIDAIGMKRSISDSNGDHEVQRTMLELLNQLDGFSLNSNVKIIAATNRIDILDPALLRSGRLDRKIEFPYPTLGSRLKILKIHCRKIRISEYLELLEIAKITENFNGAQLKALCVEAGIIAIRKHKKIVIYDDFMEAFLKIKYRKDVQLKYII

SEQ ID NO: 49410 - protein, 245 aa, Guillardia theta
MKISNILHLNKYAEIVKNKMIKILILSGSLLSSYTNGKIPKILKILPHLKYFEELIWYTRPDKWSLVALFKITSIYEKKIDEIKFYRYLNMIFIPRIIEMIIQKKKITPQIFNFIIKIANNHDETLVFIFALMLNANSFNSDKIKFLTKLLSKSNLKNKRIIILIHVLIQIQPDKKKLMLLKLLIRKIKIHSSKTIDLVLDYFIKHKDSSCRKFIQSIIKIFYNKYIDKLSIEEKKSINGLLNYR

SEQ ID NO: 49411 - protein, 501 aa, Xanthomonas oryzae pv. oryzae KACC10331
MAGGALRRRPMAATPWTLLCMFPGEPMSSASIDGAPDAGENTRFIILISCVATIGGFLFGFDSGVINGTVDGLKQTFQSTAAETGFEVASMLLGCAIGAFFAGRLADRSGRRAVLIISAALFLLSAIGAGASHSSGFFIFARVMGGFAVGAASVISPAYIAEVASARYRGRLATMQQIAIISGLFCAFLSNYLLANAAGASTEPLWAGQAAWRWMFWMQAVPSLLFLLLLLVIPESPRYLVVKGRREQALVVLKRLYGNAAAQTKLGEISASMSADRHKPKFSDLINQATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDLNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKCVYETKGKELEQMEG

SEQ ID NO: 49412 - protein, 373 aa, Haloarcula marismortui ATCC 43049
MTAFSRRVEQVSISGIREVFEAAGEDAINLGLGQPDFPTPEHAREAAVEAIQAGKVDAYTSNKGTEELREAIAAKHERDNDLEVDPGDIIATSGGSEALHIALEAHVDAGQEVIFPDPGFVSYDALTHLAGGTPRPVPLREDLTMAPETVEEAITDDTAAFVVNSPANPTGAVQSPEDMREFARIADEHDVLCISDEVYEHQVFEGEHRSPAEFSETGNVVIVNACSKAYSMTGWRLGWVTGATDRIERMLRVHQYAQACASAPAQYAAEAALTGPQEPVAEMREAFKERRDVLLDGLNEMGLDCPTPKGAFYAMPKVPDGWVDEVIDRGVVVVPGDAFGEHGAGYARISYATDMETLEEAIDIMADATAALR

SEQ ID NO: 49413 - protein, 495 aa, Mycobacterium avium 104
MVTDRFDAIIVGAGFGGIGAAIQLKRLGFDNIVILDREDDLGGTWHVNHYPGIAVDIPSTTYSYWFEPNPGWSRLFAPGGEVKQYAADVADKYDVRRHMRFNTTVEGAQWDEDAEVWRVALAGGESLTTRFLITATGFLSQPHTPDIPGIGSFGGKVVHTTAWDHDYRYQGRRIAVIGTGASAVQVVPELAKEAEELTVYQRTATHVLPKVDFEFDPAVRRLFARVPAAQRALRWVTDVLLEIIMIVGALHFKESRGRGNISASDLAKINRFRWIRDKELRAKLTPDYDCGCKRPTFSNSFYRVLTQPNVHLETNPIERIEPDGIVTADGRKNVIDTLVLATGFDLWEANFPAIEVIGRKGRNLGKWWRETRFQAYQGVSMPYFPNYLSLASPFAFSGLSFFHTIEYQMRHMDRLLGEVKRRGATTFEVTEEANDRFMERMTKLLDNSVFYAGNCATSRSYYFSPSGEASLLRPTSTLNSIREASSFPLSDYVIA

SEQ ID NO: 49414 - protein, 338 aa, Oryza sativa (indica cultivar-group)
MAAPSKPQHGAIGPVPFKDVIGDAMAQRSSPEEEYAGVVSSLPSYPKLRLRHYQGMWLMEYTLPGIMAIQRSFVPRRHGDVVLASPGKCGTTWLKALAFAVLARSAYSPASDRHPLLRLNPHDCVPFMEGAISEGWGGKIDELPSPRLMSTHMQHAALPKSIADEPGCKVVYICREPKDILVSAWHFFRIIEPDLSFQEVFEAACDGKFLTGAIWDHIIGYWNACKANPEKVLFLVYEDLLRDPANIVRKLADFLGQPFSSTEEESGLVTDIVRLCSFENLKSLEVNKMGEASFAFPNASYFRKGKAGDWKIHMTPEMVECFDTIVKEKMHGSGLVFA

SEQ ID NO: 49415 - protein, 82 aa, Guillardia theta
MIPFDYISGCVRNDKSVMIILRNNKRMIGKIINYDKHLNLLLENVNEIKFVGENFSELIKIKSKFIPKVFLRGDNIVLILII

SEQ ID NO: 49416 - protein, 202 aa, Glycine max
MLGNPPSFREDVAEYSRKMRGLSLKLLEAISESLGLERDYIDKALGKHGQHLAINYYPPCPEPELTYELTYGLPAHADPNAITILLQNQVPGLQVLHDGKWLTVNPVPNTFIVNIADQIQVISNDRYKSVLHRALVNCEKERMSIPTFYCPSPDALIKPAPQLVYKEHPAQYTNFTYREYYDKFWIRGLSKETCVDMFKAQD

SEQ ID NO: 49417 - protein, 403 aa, Oryza sativa (indica cultivar-group)
MAAPSSLASSSHLSRRATAAASPSIPPPSPPHPPQRLRCGWVGRAAPPTRRAPGVAAVDVPAATIPDAAATGVGVAERTSVSSLLEVVADDLLKLNNNLKSLVGAENPVLVSAAEQIFGAGGKRLRPALVFLVSRATAELAGLLELTTEHQRLAEIIEMIHTASLIHDDVIDDSGMRRGKETIHQLYGTRVAVLAGDFMFAQSSWFLANLENIEVIKLISQVIKDFASGEIKQASTLFDCDITLDDYLLKSYYKTASLIAASTRSAAIFSGVSTAICEQMYEYGRNLGLSFQVVDDILDFTQSAEQLGKPAGSDLAKGNLTAPVIFALQDEPQLREIIDSEFSETNSLATAIELVHRSGGIKRAHELAREKGEIAIQSLQCLPRSEFRSTLENMVKYNLERID

SEQ ID NO: 49418 - protein, 341 aa, Glycine max
  misc_feature (236)..(236): Xaa can be any naturally occurring amino acid
  misc_feature (249)..(249): Xaa can be any naturally occurring amino acid
QDTPHSPSRFVLQQLFTSIPTASTTELDAVSAFSEIVPDTVVFDDFEKFPPTAATVSSSLLLGICGLPDTIFRNAVEMALADSECYGLENPNARLSCFVNKAFANIGSDMAKLVPGRVSTEVDARLAYDTHAIIRKVHDLLKLYNDSNVPPKRLLFKIPSTWQGIEAARLLESEGIQTHLTFVYSFAQAAAAAQAGASVIQIFVGRIRDWARNHSGDTEIESAQLRGEDPGLALKXDIHFSDPSLSQQXVTKAYNYIHKYGHKSKLMAAAVRNKQDLFSLLGVDYIIAPLKVLQSLKESIASPDEKYSFVRRLSAQSAAKYTFSDEEVWFQSLMSFAFPLY

SEQ ID NO: 49419 - protein, 159 aa, Glycine max
MRSSIIFLCILASASVTISESLSQQEQLSAYEVLEKYDLPVGLLPKGATGYELNEKNGHFTAYLNGTCYFSIESYELKYKSTIKGVISKGKLSKLKGISVKIEVLWLNIAEVTRDGDDLQFSVGVASAGFSVDSFSESPQCGCGFACDNFNQNGDVSSL

SEQ ID NO: 49420 - protein, 842 aa, Nostoc sp. PCC 7120
MRAVLMAGGSGTRLRPLTCDLPKPMVPILNRPIAEHIINLLKRHHITEVIATLHYLPDVLRDYFQDGGDFGVQMTYAVEEDQPLGTAGCVKNIAELLDETFLVISGDSITDFDLGEAIAFHKQKQSKATLILTRVPNPIEFGVVITDEAGKIKRFLEKPSTSEIFSDTVNTGTYILEPEVLEYLPSNTECDFSKDLFPLLLAKDEPMYGYVAEGYWCDVGHLDAYREAQYDGLDRKVKLDFAYRENSPGLWIGQNTYIDPSAHIEAPAVIGNNCRIGARVQIEAGTVIGDNVTIGADANLKRPIVWNGAIIGEEAQLSACVISRGTRVDRRAHVLEASVVGSLSTVGEEAQISPGVRVWPSKKIESGAILNINLIWGNTAQRNLFGQRGVQGLANIDISPEFAVKLGAAYGSTLKPGAKVTVSRDQRNVSRMVTRSLIAGLMSVGVDIQNLDATAIPIARTVIPTMGVAGGIHVRVHPDRADYILIEFMDHKGINISKAQEKKIEGAYFKEDMRRALTHEIGDVAYPSQVIDLYCTAFEKLLNVSTLNNSRAKVVIDYVYAVSGAVLPQMLDKFGADAVVLNASLNKNAVTTTDRETLLTQLGHVVEALKANFGVQVSANGEQLILVDESGYPIRGELLTALMVDMILTSNPRGTVVVPVHASSAVEQVARRHDGRIIRTKANATALMEACQKNPNVVLGGSGETGFIFPQLHPGFDSMFCIAKIIEMLTIQERSLATVRSELPRVIYRTHTIRCPWSAKGALMRYLVETHPAQNLELIDGVKIRQPFDDSWLLVLPDASEPLVHLYANSHERDWVDETVRDYRSRVQSFVERQQEYHPAEV

SEQ ID NO: 49421 - protein, 282 aa, Phalaris coerulescens
MSNTKRFHVSNSPPSRPRNIPRPSPPPSSVLIHGTPQHHYKKERKPILLPPPPPINQTTALRRRPAKRATYDQERRPSMTPTTTTTGDSVALHVNPPSRVKEPLNCPEIRQLVVFVSLPAALGAKIPAPDPRAFRGPFAQCCVLVCRLKFTMGGCVGKDRGIVEDKLDFKGGNVHVITTKEDWDQKIAEANKDGKIVVANFSASWCGPCRVIAPVYAEMSKTYPQLMFLTIDVDDLVDFSSTWDIRATPTFFFLKNGQQIDKLVGANKPELEKKVQALGDGS

SEQ ID NO: 49422 - protein, 389 aa, Oryza sativa (japonica cultivar-group)
MEAAAAAAAEEEAGNPDGVEGAAVAAVAPEAAAEGPSEPNAGEASREPDAGQASREPGAAGPSREPDVAGPSREPDAAGPSREPGAAGGSREPGAAGGSRQPVPDAAQLAVVPYVEDIDRYLRSLEAEQTRRPMINYVQEIQGGIINMDVRGILVDWMADVAYVFNLQEETLHHAVSYVDRFLSKIAFPGDKLKLLGTTALFVASKYEEIHPPHVRNFSAVTVNTYTTQQVSKMELDILRFLNFDVGSPTVITFLRKFLTSCCGGNNSSNRKLELMCNYLAELSLLDDYYIRFLPSIVAAACLFVGKFTLNPNTRPWFGSVSTITPPENIKGGVEKYMVSRIYMCVFDLPMLFLMETWSSSGVSNHTKLQLKQNMMELPIENPTFISAS

SEQ ID NO: 49423 - protein, 403 aa, Picrophilus torridus DSM 9790
MAENFNRFNKIKFYLKFGGPAWLVMMADMDASSTLGAAETGVTFKYNLIWFILLLIIPLYIIQELSGRIGIATSKGFGDVIRENYSKRTSVLMSFPMAISDVVTYAIEYIGIAIGLNLIGIPIIVSLPAVYIIHLFVVSKRKYARTERILIPISFVLILAFIIDLFLRGFIDSNPVYIKFSYSYIFMLAVNVGAVIMPFMLFFQASATADKYKFVRNAFSMANIKNVALKSMRRETFLGAVVSELLMVIVEMVFSGIKYNGSFASAVELSGALDNVAGPFSPYLFGIGLISAGFIALIVISLGSAWGIVESLGIDKKHTFKVYIIESLPAVMAGMVLPPSFLINIVLYLLVVFVFVLIGPGIILGIIGINKDIMGNLKLSKANAIAYFFSIAFVITFGILAII

SEQ ID NO: 49424 - protein, 130 aa, Guillardia theta
MSKFNVLANALKTISNAEKIGKSEVLLKKISSLVVKFLKIMQKKGYIGKILKIEDHRCGKVIVELIGRINKCRVISPRFDIKLDDFETWINKVLPSRQYGFIILSTSLGMMDHRTASIKKTGGKILGFFY

SEQ ID NO: 49425 - protein, 465 aa, Triticum aestivum
MNQSAVGSLVPRQAPGSYGLPFVSAIRDRLDFYYFQGEAKYFESRVEKHGSTVLRINVPPGPFMARDPRVVAVLDAKSFPVLFDVDKVEKKNLFTGTYMPSTSLTGGFRVCSYLDPSEPTHTKVKQLLFSLLASRKDAVIPAFRSHFSSLLATVESQLVLAGKSNFNTLNDFTSFEFIADAYFGVLPSASDLGTTGPTKAAKWLIFQLHPLVTFGLPLILEEPLLHTVLLPPIFVSGDYKALYKYLYAAATKALDMAESLGLNRDEACHNLLFATVFNSYGGLKVMLPGILGRIAEAGEKFHQRLAAEVRTAVADAGGKVTIEALEKMELTKSAVWEALRLEPPVKFQYGRAKADMNIESHDAVFAVNKGEMLFGYQPCATKDPRVFGSTAREFVGDRFVGERSKLLQYAYWSNGRETESPSVDNKQCPGKNLVVLVGRLLVVELFLPVRHLHRRRRGRPAGHQG

SEQ ID NO: 49426 - protein, 293 aa, Ralstonia metallidurans CH34
MKRDSRAGYCASSPELEHWLTRHIAQGFDAESLVLSMLRSGYDAAFARHAVSAAIGHPPAVASAAAPAPVAKAAATPTVTGGNAFRHKDREMPILFRLDSPRILLLQNLLDDAECDAVVALARDRLQRSPVVNPDTGDENLIDARTSMGAMFQVGEHALLQRIEARIAAVTGWPVEHGEGFQVLNYKPGGEYQPHFDFFNPKRPGEARQLRVGGQRVATMVIYLNSPASGGATAFPRIGLEVAPVKGNAVLFSYGLPDGALDERTLHAGLPVEAGEKWIATKWLREHPYRSRG

SEQ ID NO: 49427 - protein, 164 aa, Glycine max
  misc_feature (91)..(91): Xaa can be any naturally occurring amino acid
GCRPNLLGYYNVHLRSCIPYRYKEDIDGKMSNELEVLVVSSQKGRGLMFPKGGWELDESVEEAACRESLEEAGVLGIIESELGQWNFISKXKWHEGHMFPMFVKEQLDTWPEKNLRRRIWMTVAEAREVCQHWWMKEALDILVQRIVSSQQRKEDIALDDSLSF

SEQ ID NO: 49428 - protein, 412 aa, Solibacter usitatus Ellin6076
MFAYSHNDYYCEQVPLADLAHRVGTPVYVYSSAVILGNYRAYADAFAGLPNTICYAVKANSSLAILALLAKAGAGFDIVSGGELYRVLAAGGDPSKVVFSGVGKTAGEVEYALSSGIRSFNCESESELALIDAMAARLGKQASFSIRVNPDVDAVTHPYISTGLSQHKFGIAIADAPAVYERARQFRHLVAEGVSCHIGSQILDLSPIQEAVDKVLALANALREQGHPIRHLDLGGGLGVPYRPTEIAPAIADFVCGLRKRVTASNLAVTIEPGRSIVGAAGILLTRVLYRKRNGDKEFMVVDAAMNDLIRPSLYRAHHEILPLRRNALPPVTVDVVGPVCETGDFLARDREMANAMPGDYLAICTAGAYGFVLSSNYNSRPRAPEVLVTGDTWRVIRERECYADLVRGEEI

SEQ ID NO: 49429 - protein, 466 aa, Shigella flexneri 2a str. 2457T
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKQGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 49430 - protein, 134 aa, Nostoc sp. PCC 7120
MPTMVSPTPKAFSYPQTTIERARRSLICSPFNIGLFATMRSQSVSVGAIANETGVKNGYTKNSLPELVCDNELDWLIQVGLLRREVDGQGITDGFRLTPLGHQLIEKYQGKNLPAPSWRDRLYDIVIRWFRLPF

SEQ ID NO: 49431 - protein, 313 aa, Haloarcula marismortui ATCC 43049
MTGWTIEDMPPLRDRTVVVTGANSGLGLEGSKAFARRGATVVMACRSVERGESAAAEIREAVPNATLDVRECDLADLSNVASFADGLRADYDAVDILCNNAGVMAIPRSETADGFETQFGVNHLGHFALTGHLLDLLGAADGESRIVTQSSGAHEMGEIDFDDLQRERSYGKWSAYGQSKLANLLFAYELQRRLGNHGWDDVLSVACHPGYADTDLQFRGPREMGSTLRTAAMGVANAVFAQSAEQGALPMLYAATAEDVIGGEYVGPGGLFDMRGSPEFQQSNDASQDEETAEQLWAVSTDLTGVEYDFERT

SEQ ID NO: 49432 - protein, 232 aa, Burkholderia mallei ATCC 23344
MTIEVGLLLFPQVQQLDLTGPHDVFASLPGVTVRLVWKTREPVASSSGLVLAPNATFDDCPPLDVICVPGGIGVADLMEDADTLAFLRRHAAHARYVSSVCTGALVLGAAGLLRGRRATTHWAFHSLLAPFGATPVRERVVRDGNLVTGGGVTAGIDFALTLAAELVGEDDAQAVQLQLEYAPAPPFAAGDPDTVPARIVERMRERSKPVLARREQVVARAVAALERQRADG

SEQ ID NO: 49433 - protein, 456 aa, Xanthomonas campestris pv. campestris str. 8004
MSARYDYDVVVLGGGSGGLAAAFRAAKHGARVAIMEPGELGGTCVNLGCVPKKAMWLAADLASKIELAGALGFDVVRPTLTWQELVTHRQGYIGNIHASYRRRLDDDGVVLIPQRGVLQDRHTLMGADGVPVTAEHIVIATGAHPLRPHVEGAEHGHVSDDFFNLCHAPDHVAIVGGGYIAVEIAGLLQALGSRVHLFVQGERLLERFDAELTLQLADNLRHLGVRLHFGFRTTGVQRDDTGKLRMRGHSAHPGELGNDVFDQVFFAIGRLANTAGLGLEALGVELGKKGEIVVDDGQTTNVPNIHAVGDVDGKVGLTPVAIAAGRKLMDRLFGGQPDARMDYDNVPSVVFSHPPLGAVGLTEEQARERYDGAVRVYRSNFRPMLHALADAPQRSVFKLVCVGEEERVVGVHLLGESADEMLQGFAVAVKMGATKRDFDETVAIHPTSSEEIVLMH

SEQ ID NO: 49434 - protein, 162 aa, Xylella fastidiosa Dixon
MNRVMHYFKSLLLLELLAGLWLTLKYTFRPKYTVLYPMEKFPQSPRFRGLHALRRYPNGEERCIACKLCEAVCPALAITIDSAKREDGTRRTTRYDIDLFKCIFCGFCEESCPVDSIVETHILEYHFEKRGENIVTKPQLLAIGDRFEAEIAERRAADAAFR

SEQ ID NO: 49435 - protein, 545 aa, Xanthomonas oryzae pv. oryzae KACC10331
MGALELHRIHDRVEIEVITEFQEIIAQCGDVHVGRHTDRYLRRKHLRTGLHGKVARALQVFDGDALAVEEIGQLEQDARLVGSDDLDNVRQQVGLGLFGAGAVPHQLEAFFAFEPGQHGFELGNRIPGAGRQCGDRDVAPHRGQASVQEITAAVGDAAGDGQQRGLRMRRVGVDQEVIFGRRRPGGRVGQRGFRHCIRLNGRPGRRPGGDQHTCPWFRAASNMQVVSTRARAGLFLSRKSSRILSLSGIITALATPFGPDGALDLDAWRRLLEQQLHGGVQGIVVAGSTGEAAALSEDEYDTLLRAAVAQVAGRVPVLAGTGLSGTEKTIAQTRRAAALGAQYALVVTPPYVRPTQAGLKAHFLAIADHGGLPVVMYNVPGRTGCDLLPETVAELVVHSNIVGIKEARSEPGRVAALVALRSDSFVVLSGDDGSAAQSMLSGAAGLISVASNALPAAYRRLCDLARDGQREAATAWDARLSEYHSFCGIESNPIPVKALLQRAGIGHGLRLPLLPLSAAHQPAADRLAADAVALEALSSREMLAA

SEQ ID NO: 49436 - protein, 413 aa, uncultured archaeon GZfos28B8
MNERKKIGIITSGGDCGGLNAVIKGVSSMANYYGLENVVIPNGYAGLYNLIDFETDDLISLDYIRMGLFHSNIAGSEAGHSRVKISKLDDETKYDRIKQGLDKHSIDALVVSGGDDTGSVALDLLNNGIAINHVPKTMDFDLQSYSVGGDSAINAISKMAANLRTTARSHNRIMILEVFGRYAGHAAFRGGIAADADCIIIPEVAPDFDVIYEDMFAKYTERIKKSDVKAGSYLIVVSEALKGNKPEDDVDERGFLIDKTRGSDAFGHYPLAGSGKTIEAELKKRMKNDVKMKQFMEQVHMYVQGQYEIPEIRVIRPTHLVRCGDSSAYDANFGKECGAGAVILLMQNITGATVTGVRNGVVEYMDISEAIKQNTVNLDQVALHEALGICFGRKTQKTGFEKKMKLDTVNRYL

SEQ ID NO: 49437 - protein, 343 aa, Brucella melitensis
MQAIIDAEQSFKFPVLVGDIGGTNARFSILVDSNAEPKEFPVLQTADYATIDEAIQHAILDQTAIQPRSVILAVAGPVDGDEIDLTNCDWVVRPKKMIADLGFEDVTVLNDFEAQALAVVSLEGHHMEQIGGKPEEAVATRVVLGPGTGLGVAGLVCTRHAWVPVPGEGGHIDIGPRTERDYQIFPHIERIEGRVTGEQILSGRGLRNLYLGICAADKITPTLETPVDITSAGLDGSNPQAAETLDLFATYLGRLAGDLALIFMAHGGVYLSGGIPVRILSALKAGSFRAAFEDKAPNKAIMRDIPVRVITYQLAALTGLSAFARTPSRFEVSTEGRRWRMRR

SEQ ID NO: 49438 - protein, 435 aa, Xylella fastidiosa Dixon
MNQIRQAPAASASNATESKQEIRNYTMNFGPQHPAAHGVLRLILEMDGETVVRADPHIGLLHRGTEKLAESKPFNQSIGYMDRLDYVSMMCNEHAYVRAIETLIGIQAPERAQYIRTMFDEITRILNHLMWLGSNALDLGAMAVMLYAFREREELMDVYEAISGARMHAAYYRPGGVYRDLPDTMPKYKQSRWHKGKALKRLNAAREGSMLDFLEHFTDTFPQRIDEYETLLTDNRIWKQRTVGVGVIEPDVAKAWGMTGVMLRGSGIAWDLRKKQPYAKYDAVDFDIPLGTCGDCYDRYLCRVAEMRESNRIIKQCVQWLKVNPGQVMVENFKVAPPKRESMKDDMEALIHHFKLFSEGYCVPAGETYSAVEAPKGEFGCYLISDGANKPFRVHLRAPGFAHLSSMDAVVRGYMLADVVAMIGTYDLVFGEVDR

SEQ ID NO: 49439 - protein, 334 aa, Aspergillus nidulans FGSC A4
MSSHPSTIRPPLDPELAVAQKSFPRTPLRESLSARRKAAILTWESISGGREALISHSEVDIPGPAGTLRTSVLRSTKAEHQAQPASKTVGIVHFHGGGHVTADRFVGLNTLFDIIEKLGAVVVSAEYRLAPEHPQPAQVEDSYAALRWAHSHASELGFNPDKLVTCGGSAGGNLTAGVSLLARDRAGPKLLGQMLFYPWVDDATTSHSIEQFGDVAPWTKDDNAYGLDLALGKNREYASIYSLPARAAETQQGLSGLPPTYLDVGEADVFRDQDMEFAGNLWKAGVQTELHVWPGAWHAFDTFAPEASVSKRAFKARLEWLEKLLEATDAGISA

SEQ ID NO: 49440 - protein, 325 aa, Ralstonia metallidurans CH34
MSQSSATALLAPVAADMRAVDAVIRRRLSSEVPLIEQIGEYIIGAGGKRLRPVILLLSARAFDYEGHRHHELAAVVEFIHTATLLHDDVVDESELRRGRDTANAVFGNAASVLVGDFLYSRAFQMMVEAGSMRIMEILSNATNVIAEGEVLQLLNMHDPEVTVERYLQVIRYKTAKLFEASAQLGAVLAGADAEMEEAAAEYGRRIGTAFQLIDDMLDYTASAEQMGKNAGDDLREGKPTLPLLHLLEHGTAQQRELARDAIVQGGTEHFDAVFSAIHASGALDVTFAAAQREAEAAEKAAMQFPDSPLKQTLIDLCAFSLQRQS

SEQ ID NO: 49441 - protein, 455 aa, uncultured archaeon GZfos28B8
MENEVKKNNSELIEEEGVKKTEKLQMEAVRQHSSYAGKIQIMPKCSIHSLDDFAVYYTPGVAGPCKIIEKEKEKAYELTNKWNTVAVISDGTRVLGLGDIGPEAGLPVMEGKALLFKYLGGVDAIPICLDTKNAEEIIQAVKWLQPSFGGINLEDIANPKCFQILDTLREEMEIPVWHDDQQGTAAVTLTGLTNALKIVGKKLEDARIAFIGAGAANVAISRVLFSAGVKPRNCIVADSKGILHTGRKDIEERKDEYRDKWRLCRITNPEGITGGMDIALKDVDVCLALSKPGPGVIKPEWVNTMNEAAIVFACANPVPEIWPQEAKEAGAEIVATGRSDFANQVNNSIGFPGIFRGALDVRAKTITDEMCIAAANALALFAQKRGINEDYIIPTMEDSEAFVEEAVAVGLQAQKDGVARLNISSKELYHKAESIISNAQKSTSLLMKEKLIPSY

SEQ ID NO: 49442 - protein, 443 aa, Mycobacterium avium 104
MTDHLWLHFARHGPGITPPIITRGHGVTIYDDRGNSYLDGLSGLFTVQVGHGRAELAEAAARQAGTLAFFPLWGYATPPAIELAERLAGYAPGDLNRVFFTTGGTEAVETAWKLAKQYFKLTGKPGKHKVISRAVAYHGTTQGALAITGLPRYKAPFEPVTPGGFRVPNTNFYRAPEAFANDPKGFGLWAADRIAEAIEFEGPDTVAAVFVEPVQNAGGSIPPPPGYFERVREICDRYDVLLVSDEVICAFGRIGSMFACADFGYVPDMITCAKGMTSGYSPIGAMIASERLFEPFADGDTMFPHGYTFGGHPVSAAVGLVNLDIFEREGLNDRVRTLAPTFRATLEKLYDLPIVGDVRGEGFFYGVELVKDRATKQTFTDSERRALLGRVGAALFEAGLYCRTDDRGDSVIQLAPPLISGQAEFDTIEAALRGVLSDECRRL

SEQ ID NO: 49443 - protein, 146 aa, Brassica napus
IKDWPGEILKSLPALVCLKLDNNLLKQISLDGFQTVSGLQILDLSGNPASLGTGVHPKFSFLPQLQELYLSRVQLSEVPEDILNLSNLLILDLSQNLLQSIPKDIKKMTSLKHLDISNNNISSLPPELGLLEPTLEVLRLDGNPLR

SEQ ID NO: 49444 - protein, 162 aa, Parasponia andersonii
MSSSEVNKVFTEEQEALVVKAWAVMKKNSAELGLQFFLKIFEIAPSAKNLFSYLKDSPVPLEQNPKLKPHATTVFVMTCESAVQLRKAGKATVKESDLKRIGAIHFKTGVVNEHFEVTRFALLETIKEAVPEMWSPEMKNAWGVAYDQLVAAIKFEMKPSST

SEQ ID NO: 49445 - protein, 140 aa, Nostoc sp. PCC 7120
MTNTVDSLFDTGLERYKAGEPAADLIPVFKEVCDRAPKASAAWICLAWLYLLEDKPNLALKAAQKAVKINPQDPQARVNLAVAMLETGQKGLRQHIDITQQLMLVNPDWRDEIQNSIADGLSRKPDWQSLAKVKGWLFNE

SEQ ID NO: 49446 - protein, 516 aa, Oryza sativa
MASSGFSWTLPDHPKLPKGKTVALVVLDGWGEANADKYNCIHVAQTPVMDSLKNGAPERWRLVKAHGTAVGLPSEDDMGNSEVGHNALGAGRIFAQGAKLVDLALASGKIYDGEGFNYIKECFDKGTLHLIGLLSDGGVHSRLDQVQLLLKGASERGAKRIRVHILTDGRDVLDGSSVGFVETLESDLSQLRDKGIDARIASGGGRMYVTMDRYENDWDVVKRGWDAQVLGEAPYKFQNAVEAVKTLRAETKASDQYLPPFVIVDESGKSVGPVVDGDAVVTFNFRADRMVMLAKALEYADFDKFDRVRVPKIRETVKFGHVTFFWNGNRSGYFDETKEEYVEIPSDIGITFNVKPNMKALEIAEKARDAILSGKFDQVRVNLPNGDMVGHTGDIEATVVACKAADEAVKIILDAIEQVGGIYLVTADHGNAEDMVKRNKSGQPLLDKNGGIQILTSHTLQPVPVAIGGPGLHPGVKFRSDIQTPGLANVAATVMNFHGFEAPADYEPTLIEVVDN

SEQ ID NO: 49447 - protein, 389 aa, Oryza sativa (japonica cultivar-group)
MAPPAPATARRPMAAVRCSAAKRSYNVTLLPGDGIGPEVVAVAKDVLSLAGALEGVEFRFQEKLMGGAAVDAYGVPLPEETLAAAQASDAVLLGAIGGYKWDNNEKHLKPETGLLQIRAGLGVFANLRPAAVLPQLVDASTLKKEVAEGVDIMVVRELTGGIYFGQPRGFGKNDKGEDTGFNTEVYSASEIDRITRVAFEVARKRRGKLCSVDKANVLEASMLWRKRVTSLASEFPDIELSHMYVDNAAMQLIRNPKQFDTIVTNNIFGDILSDEASMLTGSIGMLPSASVGESGPGLFEPIHGSAPDIAGQDKANPLATILSAAMLLRYGLGEENAAKRVEAAVTETLNNGFRTGDIYSPGTTLVGCKRMGEEVLKTVESQSAVALNS

SEQ ID NO: 49448 - protein, 144 aa, Parvularcula bermudensis HTCC2503
MRAKDMLKDKGRDVVTIDHKASLAEAIEVLASKNIGAVVVTSPGKAVAGILSERDVVRVLSGAPTGFRESPVTDIMTREVFTAGLEASVDQLLDLMTDRRIRHVPIVDGDGLVGLLSIGDVVKCRIRQAVGEADALKEYISAAG

SEQ ID NO: 49449 - protein, 351 aa, Glycine max
MAGNIIASSVPKSVQEMSMDGDEPPSRYVVNGNSFGSKDSSVQFPIPIIDVRLLSSEDELEKLRSALSSAGCFQAIGHGMSSSYLDNIRETAKQFFALPEEEKQKYARAVNESEGYGNDRVVSDKQVLDWSYRLTLRVFPETKRRLSLWPKIPTDFSEKLEEFSTKVKSMMEYLLRCMARSLNLEEGSFVDQFGEQPLMLSRFNFYPLCSRPDLVLGVKPHTDRSGITVLLQDKEVEGLQVLIDDNWINVPTMPDALVVNLGDQMQIMSNGIFKSIMHRVVTNTEKLRMSVAMFNEPEAENEIGPVEGLIDESRPRLYRNVKNYGDINYKCYQEGKIALETVKIADNSNQR

SEQ ID NO: 49450 - protein, 510 aa, Sinorhizobium meliloti 1021
MNIAAKKIDVASEAAALLDKMGVAKDLYTGGDMPSFSPVTGEKIASLKTVSAAEAAGKIEKADEAFRAWRLVPAPKRGELVRLLGEELRAFKADLGRLVSIEAGKIPSEGLGEVQEMIDICDFAVGLSRQLYGLTIATERPGHRMMETWHPLGVVGIISAFNFPVAVWSWNAALALVCGDAVVWKPSEKTPLTALACQAILERAIARFGDAPEGLSQVLIGDRAIGEVLVDHPKVPLVSATGSTRMGREVGPRLAKRFARAILELGGNNAGIVCPSADLDMALRAIAFGAMGTAGQRCTTLRRLFVHESVYDQLVPRLKKAYQSVSVGNPLESAALVGPLVDKAAFDGMQKAIAEAKNHGGAVTGGERVELGHENGYYVKPALVEMPKQEGPVLEETFAPILYVMKYSDFDAVLAEHNAVAAGLSSSIFTRDMQESERFLAADGSDCGIANVNIGTSGAEIGGAFGGEKETGGGRESGSDAWKAYMRRATNTVNYSKALPLAQGVSFDIE

SEQ ID NO: 49451 - protein, 410 aa, Sinorhizobium meliloti 1021
MTINATVKEAGFQPASRISSIGVSEILKIGARAAAMKREGKPVIILGAGEPDFDTPEHVKQAASDAIHRGETKYTALDGTPELKKAIREKFQRENGLAYELDEITVATGAKQILFNAMMASLDPGDEVIIPTPYWTSYSDIVHICEGKPVLIACDASSGFRLTAEKLEAAITPRTRWVLLNSPSNPSGAAYSAADYRPLLEVLLRHPHVWLLVDDMYEHIVYDGFRFVTPAQLEPGLKNRTLTVNGVSKAYAMTGWRIGYAGGPRELIKAMAVVQSQATSCPSSISQAASVAALNGPQDFLKERTESFQRRRDLVVNGLNAIDGLDCRVPEGAFYTFSGCAGVLGKVTPSGKRIKTDTDFCAYLLEDAHVAVVPGSAFGLSPFFRISYATSEAELKEALERIAAACDRLS

SEQ ID NO: 49452 - protein, 405 aa, Mesorhizobium sp. BNC1
MEEFHKVRRLPPYVFEQVNRLKASARSRGADIIDLGMGNPDLPTPKAIVDKLCEVVRDPRTHRYSSSRGIPGLRRAQAAYYARRFGVKLNPDTQVVATLGSKEGFANMAQAITAPGDVVLCPNPTYPIHAFGFIMSGGVIRSIPAEPDHNFIPVLERAVRHSIPKPLALILNYPSNPTACLASLDFYKDVVAFARKHDIIILSDLAYAEIYFDTEAPPSVLQVPGAMDVAVEFTSMSKTFSMPGWRMGFAVGNERLIAALSRVKSYLDYGAFTPIQVAATAALNSDGTEIEEVRSVYHRRRDVMVDAFGRAGWQVPPPPATMFAWAPIPEPFRQLGSLEFSKLLVEKADVAVAPGIGFGEHGDDYVRIALVENEHRIRQAARNIKRFLATAAEHPSNVVPFAATR

SEQ ID NO: 49453 - protein, 249 aa, Xylella fastidiosa Dixon
MRPKIVVGNWKLHGSHAFAQALVAQVAAGLPLPGVSVIILPPLLYLSDLTQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 49454 - protein, 445 aa, Sinorhizobium meliloti 1021; identical to SEQ ID NO: 1092

SEQ ID NO: 49455 - protein, 710 aa, Candida albicans SC5314
MNLVIAYFLSWVFFATSVKAGKNAKFQLYGDITYFYTCNLQISSSVSYCATPYNATCLCANKNALATYAGCLAFDNRNTTTAVNYMMNYCEENGNVTVEKDWYEKSYQYFLSNAKTEKEIPNFNKTIPIDVPFKLDEAEMKLYERAYKQFLGNYDDSLYYGAGILGYWLLIMCIGAIVNWGKVMFPSLTKKLTSKPINLWRQYVSMPATFRKKKAEELRIFKFFDSLIPSRFESIVIFLFYIVVLMIHAMNMHYVDGDPVFENNKYNSQARNVADRTGITGTIMMPLVFLFSSRNNFLQWLTGWNYSTFVTYHRHIARVMFILIALHSILFTVLLRDDMSEFSETYMIWGVLATVSGGIILFQAMLFFRRRWYEIFLLIHILFAALYVAGTWIHVDELGYVWFVYPAVAVWCADRVVRIARLVIFGFPKARVSLLADDTIKVEIPKPSYWKTIPGGHAFIHFLKPTYFWQSHPFTFVESPADTHIILYCKVKGGITHSLYQLLVRSPGQAITMRVGVEGPYGEPTPARYADTAVFIAGGNGIPGIYSEVMDMTRRMPNETKNAMKLYWIIRDYKSLEWFNDELTLLGNTNIETTIYVTKPDLSNLLTGDGSDDTSSKKESDSQDMNLESKESLQGVDLVKSRFSHITFKEGRPSIEDIVDLEIKESNGSVAFVACGHPAMVDETRYFCSRNVDNPQKKRVDFYEQVQVWT

SEQ ID NO: 49456 - protein, 715 aa, Candidatus Kuenenia stuttgartiensis
MIEINKNKGDRITMPIQWHKTTCPYCGFGCGLMAGVENGKIIEIKGMPGHPANDGMICTLPANSVPVFCAEDRLTKPMIRRDGKLSPVSWEEAITHVASRFQEIIETHGPGAIAIHSGATCTTEEYYLMNKLIKGCIGSNNIESSTRLCMASSAMGFMSTIGADAPPACYADIEQADLFFIAGNNMAISVPALFARVARSKRKNDAKVIVVDPRRSETTGIADIHLQIRPGTDVALNNSIAHVLLKEGYVNEEKVAEYASGIKDLKELSEEYPPSRASEITGCPEQLIIDAARMVGRSKAMLIFWFQGYNHSTQAVFKNNTLHNLWLLTNNFCKPGAGPLSITGECNALGCRWVGGLSHLLPGMRMVANPQHRQEVADFWGIPTEKLHPVPGRSIMDIVSGLHSGDVRALWVIAANPAASLPNTKWILDGLSKAEMLVVQDIFHPTETTKLADVVLPAAQWCEKAGTFISSERRIELADKIIDPPGEAKPDCEILWLVARAMGFEKEFPYSSPEDVFGEFKQITSGRICDMNGVTYERLRGNTGIQLPCPDVNHPGTPRLFTDRYFPRADGRAALLPREYLPPKETINEIYPFVLITGRQQWHFNTGVRTKRIPYLHQRAPDNFVEIHPHDAAQLRIQNGDEVEVSSSRGTTKGFAQISGRVLQGNIFMPIHYGGAINNKDARLANLVTNNICDIHSKQPEYKFSAVNLKKSQPC

SEQ ID NO: 49457 - protein, 133 aa, Triticum aestivum
  misc_feature (14)..(14): Xaa can be any naturally occurring amino acid
FPRMEPRMAFGPHXPDMVLLPPQVEVGFPPGRPPEKPPAPLLEFGKTQNGRPPPPMALPVGVPAPIGALLLFPNKVPRKGVVRPLEPGIFLPALEILEASGLQLVERVGPLGCPDGVRIFRVFFLPPPRPWVN

SEQ ID NO: 49458 - protein, 246 aa, Thermotoga maritima
MKMKEFLDLLNESRLTVTLTGAGISTPSGIPDFRGPNGIYKKYSQNVFDIDFFYSHPEEFYRFAKEGIFPMLQAKPNLAHVLLAKLEEKGLIEAVITQNIDRLHQRAGSKKVIELYGNVEEYYCVRCEKKYTVEDVIKKLESSDVPLCDDCNSLIRPNIVFFGENLPQDALREAIGLSSRASLMIVLGSSLVVYPAAELPLITVRSGGKLVIVNLGETPFDDIATLKYNMDVVEFARRVMEEGGIS

SEQ ID NO: 49459 - protein, 432 aa, Escherichia coli O157:H7 EDL933
  misc_feature (144)..(144): Xaa can be any naturally occurring amino acid
MSKIVKIIGREIIDSRGNPTVEAEVHLEGGFVGMAAAPSGASTGSREALELRDGDKSRFLGKGVTKAVAAVNGPIAQALIGKDAKDQAGIDKIMIDLDGTENKSKFGANAILAVSLANAKAAAAAKGMPLYEHIAELNGTPGKXSMPVPMMNIINGGEHADNNVDIQEFMIQPVGAKTVKEAIRMGSEVFHHLAKVLKAKGMNTAVGDEGGYAPNLGSNAEALAVIAEAVKAAGYELGKDITLAMDCAASEFYKDGKYVLAGEGNKAFTSEEFTHFLEELTKQYPIVSIEDGLDESDWDGFAYQTKVLGDKIQLVGDDLFVTNTKILKEGIEKGIANSILIKFNQIGSLTETLAAIKMAKDAGYTAVISHRSGETEDATIADLAVGTAAGQIKTGSMSRSDRVAKYNQLIRIEEALGEKAPYNGRKEIKGQA

SEQ ID NO: 49460 - protein, 421 aa, Brucella melitensis 16M
MTTENLLESALVRLDEAASHINIDADVIEKLKFARETMKVRLMIRMDDGSRKSFIAWRCRYDDTRGPTKGGIRYHPDSTVEEVETPAFWMTFKCAVMNLPYGGGKGAIQVDPRQLSKAELERLSRAYIQAFSGIIGPDRDIPAPDVYTNSMIMGWMADEYSQIVGQSSPAVITGKPIALGGSLGRNDATARGGFYLVRHLSHDLGLASVLRVAIQGFGNAGQFMAKLMAGDGHKIVAVSDSAGAVYCADGLDVDLLLAAKADGKSVISTAGHKGHEAISADELVAADCDVLVPSAMENMIHAGNAASIRAKLIVELANGPVTGDADKILAEKGVMVLPDILANAGGVTVSYFEWVQNRQGYYWTLEEIHERLKTIMEREGRAIWNHARERGVTLRTAAYVHALERLAQAIEAHGTQNDFAA

SEQ ID NO: 49461 - protein, 319 aa, Yersinia pestis KIM
MSKIVSLGIHVLDVLGRHVNRFPPGGELDIINEIRLTVAGTAAGMSVDLAKLGGDVYAMGAVGLDESGNFIIDTLRRYGGNTDHIVRKSEVQTSCSMLPIRPNGERPVLHVLGANATYRLEDIHWDVIASADILHFGGTYLLPGLDGPPTATILKFAKEHGVTTTLDLLVNAQPDLLAKLEPALPYIDYFMPGLDEARAICGLEKRADVIAFFLNRGVGHTVFKMGAEGSSIASLEMAEILIPAYKAQVVDSTGCGDSYCAAFIMGLTKGWDLATSGRFASAAASLVVSGLGSDAGIIDFEHTLKVMNTAETLPIAQET

SEQ ID NO: 49462 - protein, 216 aa, Oceanobacter sp. RED65
MDNESRSLQDLIENNRAWSDKISEQDPEFFPTLAKQQAPDYLWIGCSDSRVPANEIVGLLPGELFVHRNVANMVVHTDMNLLSVLQFAVEVLKVKHVIVVGHYGCGGVKAAMENKKLGLIDNWLLEIRDLYHQKQAMFKGLESEEERVNLLCELNVVRQVYNLCHTNIVQEAWARGQKLAVHGWVYGLDDGKINNLNVTVNDNSQINDVYRLDIKE

SEQ ID NO: 49463 - protein, 341 aa, Parvularcula bermudensis HTCC2503
MKALVKAHAEPGIWLQTVPEPEIGATDVLIKVKKTAICGTDIHIYEWDDWAQSTIPVPLTIGHEFMGEVVAVGSDVTNVALGDRVSAEGHITCGVCRNCRAGKRHLCRNALGLGVSRAGAFAEFVAVPAFNIYHLPDAVSDELGAIFDPFGNAVHTALSYDLVGEDVLITGAGPIGAMAAAIARFVGARHIVVTDINDFRLDLAAQMGATRTVNIGREALPDVMAELGMTEGFDVGLEMSGAAAGFRDMLDTMNHGGKIALLGLLPKGTGIDWSKVIFKGLDLKGIYGRRLFETWYKMGALTQSGLDLSPIITHRLPIEDFENGFEIMRSGRSGKIVLEWP

SEQ ID NO: 49464 - protein, 617 aa, Candida albicans SC5314
MSEQAQTQVSADQQQHQHNHHHHHHHHHNENQSQQQVPIDPAANPANRIGRYQILKTLGEGSFGKVKLAQHLGTGQKVALKIINRKTLAKSDMQGRVEREISYLRLLRHPHIIKLYDVIKSKDEIIMVIEFAGKELFDYIVQRGKMPEDEARRFFQQIIAAVEYCHRHKIVHRDLKPENLLLDDQLNVKIADFGLSNIMTDGNFLKTSCGSPNYAAPEVISGKLYAGPEVDVWSAGVILYVMLCGRLPFDDEFIPALFKKISNGVYTLPNYLSAGAKHLLTRMLVVNPLNRITIHEIMEDEWFKQDMPDYLLPPDLSKNKNSKIDVDEDVIRALSVTMGYDRDEIVNVIEKANKQVAAGNSSSQQSKSSNEILDAYLLMKENHALVKDLKKSKSENIESFLSQSPPPSPFPNAGSTSSAPGVQQSLTYQTLATVPDLSTLPNSTIAILPTSLPSIHRAYMAETKQNGDPSQQHAPPPTKKSKTRWHFGIRSRSYPLDVMGEIYRALKNLGAEWAKPTEEELWTIRVRWKYDTSAQFECGSAPNLMKMQIQLFQLEPNNYLVDFKFDGWESAHGNAGTDSPQSHRQQDLDEVGSFSAYPFLHLATRLIMELAVNSQSG

SEQ ID NO: 49465 - protein, 217 aa, Zea mays
CDAVSLTEAGTNAKPVGKENGREPAAAPAAAADPRLQGISDAIRVVPHFPKQGIMFNDITTLLLRPRVFKDAVDLFVERYRGMGIDAVAGIEDRGFVFGPAIALAIGAKFIPLRKPRKLPESCADTGSRKQLLLLLLEGEVISEKYVLEYGTDCLEMRVGAIERSGERVLVIDDLVATGGTLCAAIRLLERAGADVVECACVIGLPKFKVPRCWIHN

SEQ ID NO: 49466 - protein, 513 aa, Arabidopsis thaliana
MSSSPSLEILVREAEGFTVWNGPPFTNGQPTLKLERVSCSNTKFSVDGSKLMAMKSDGVISIYDATSLTEVRSFTIANVTAAELSPCGTYLQTFQKPTTPQEKNVSIWNTETGDLAHSHYQKSITKASWPSIRFCPDESSACRLATNEVQFFDPKDFSKGITSRIRVPGIAAFELSKTPASHVAVFVPESKGSPGSVQIFGCGEELQSQPSARRSFFRCSSVQFSWNHGSTGLLVVVQSDVDKTNQSYYGETKLHYLTIDGTHEGLVPLRKEGPVHDVQWSFSGSEFAVVYGFMPACVTIFDKNCKPLMELGEGPYNTLRWNPKGRVLCVAGFGNLPGDMAFWDVVNKKQLGSNKAEWSVTSEWSPDGRYFLTASTAPRRQIDNGMKIFNYDGKRYYKKMFERLYQAEWKPESPERFGDISELIKSVESLKLGEGKSQGQGSAQKKTIAPNPIAQKPAAYRPPHAKHAAAVQAELLGISTTGEMSKNALKNKKKRENKKAAAAAAAASGSNNA

SEQ ID NO: 49467 - protein, 458 aa, Anabaena variabilis ATCC 29413
MTFDYDLFVIGAGSGGLAASKRAASYGAKVAIAENDLVGGTCVIRGCVPKKLMVYGSHFPALFEDAAGYGWQVGKAELNWEHFITSIDKEVRRLSQLHISFLEKAGVELISGRATLVDTHTVEVGDRKYTADKILIAVGGRPLKPELPGMEYGITSNEIFHLKTQPKHIAIIGSGYIGTEFAGIMRGLGSEVTQITRGDKILKGFDEDIRTEIQDGMTNHGIRIIPNTVVTAVEQVPDGLKINLSGDQEPIIADVFLVATGRVPNVDGLGLENAGVDVVASSVEGPGYSTMNAIAVNEYSQTSQPNIYAVGDVTDRLNLTPVAIGEGRAFADSEFGNNRREFSHETVPTAVFSNPQASTVGLTETQAREKLGDEGVTIYRTRFRPMYHSFTGKQERIMMKLVVDTNTDKVLGAHMVGENAAEIIQGVAIAVKMGATKKDFDATVGIHPSAAEEFVTMR

SEQ ID NO: 49468 - protein, 504 aa, Sinorhizobium meliloti 1021
MVMTVVVRPKALGDYDTREFRMLIDGQWVDGAEGRTIERVAPGHGVVVSRYQAAAKADAERAIAAARRAFDEGPWPRMTASERSLILLRAADMIAARADELAFLDAVESGKPISQAKGELAGAADIWRYAAALARELSGESYNTLGEGTLGVVLREPIGVVSIITPWNFPFLIVSQKLPFALAAGCTTVVKPSELTSASTLVLGEILEAAGVPQGVVNIIVGTGPEAGAPLTTHPHVDMVSFTGSTGIGQLTMANAAQTLKKVSLELGGKNPQIVFPDANLDEFIDAAVFGAYFNAGECCNAGSRLILHRDIAEEVTARIASLSAKVKVGDPLDPETQVGAIITPQHLQKIAGYVSSASNEGARIAHGGTTLDLGMGQFMAPTILSAVRPEMAVAREEVFGPVLSVLTFEKTEEAIRIANSIDYGLSAGVWSRDFDTCLTIGRRVRAGTVWMNTFMDGASELPFGGYRQSGLGRELGRHAVEDYTETKTLNMHIGRRSNWWMPR

SEQ ID NO: 49469 - protein, 126 aa, Acinetobacter sp. ADP1
MPKEIILPEGTPPPLAPYVPATKADNIVYVSGILPLDENNDVVHVGDAAAQTRHVLETIKHILSNAGGSLKDVTFNHIFLRDWADYPAINQVYAEYFPEERPARYCVQVGLVKPDALIEIASVAHV

SEQ ID NO: 49470 - protein, 408 aa, Arabidopsis thaliana
MSQAPNPEEEDDTIEIREVWNHNLEQEMALIEQSIDDFPYVAMDTEFPGIVCKTVTANPNPNPYSIHYEYNYDTLKANVNMLKLIQLGLTLSDEKGNLPTCGTNKQCIWQFNFREFNVISDMFALDSIELLRKSAIDLEKNNECGVDAKRFAELLMGSGVVLNDKIHWVTFHCGYDFGYLLKLLSGKELPEEISDFFDQMEKFFPVVYDIKYLMGFCTNLYGGLEKIAELLGVKRVGISHQAGSDSLLTLRTFIKMKEFFFTGSLLNDEAAPVVVPPPVAEPAAIPEDMDLMTALELTLRKARAYGGVVRGLHECAKLIEKRVAQLVVLAEDCNQPDYVKLVKALCADHEVRLLTVPSAKTLGEWAGLCKIDSEGNARKVVGCSCLVVKDFGEETTALSIVNKHIASQ

SEQ ID NO: 49471 - protein, 209 aa, Pyrococcus furiosus
MEIEKLLEQVNWEKNNGIVPVIVQDEKGEVLTLAYMNKEALRKTLETGIAHYYSRSKGRIRMKGEVSGNIQTVKEIKIDCDNDALLLIVSPKGPACHTGNYSCFYRKLGEPERVLPIDYSLSILKELEEIIKRRKETPVEGSYTSKLFKEGREKIYKKFGEEAIEVLVAEKRERIIYEVADLLYHLLVLLTYNDISLGEVMNELRRRRK

SEQ ID NO: 49472 - protein, 454 aa, Acinetobacter sp. ADP1
MSSQEPWFAKFKPYQGDLEHHPVQIDEYLPAGKSIVLGLQHAFAMFGATVLAPLLMGFDPNLTIFITGFGTILFFLITGGRLPSYLGSSFAFIAAVAAATGYNGVGTNPNLALALGGTVVCGVIYAAIGLIVMRTGTAWIEKLMPPIVTGAIVMIIGLNLAPVTIKGVSGNGFDTWMAVLTILCISAVAVFTRGMLRRLLLLVGLCAAYFAYFILANVFGLGKAIDFSPIAQAAWLGIPNFHTPVFQANAILLIAPVALILVAENLGHFKAVSAMTGRNLSPYMGRGFFADGVCTTLSASVGGTGMTTYAENIGVMAVTKVYSTTVFVVAGVFAILLGLSPKFGAVIHTIPVALLGGASIVVFGLITVAGAKIWIDHKVDFTQNSTLIIAAVSLIMGAGNFSLHIGAFDLGGIGTATLAAIVLNLLLNRDSGKRSQLEPNAQPEKIIQPVSPQS

SEQ ID NO: 49473 - protein, 353 aa, Oryza sativa (japonica cultivar-group)
MASLLIASTGGAHRLAWKDAAALGPAPRLARPWPAAVAAPAPLLRTSTADITSLRVITAVKTPYLPDGRFDLEAYDSLINMQIDGGAEGVIVGGTTGEGHLMSWDEHIMLIGHTVNCFGAKVKVVGNTGSNSTREAIHATEQGFAVGMHAALHINPYYGKTSIEGLISHFEAVLPMGPTIIYNVPSRTGQDIPPAVIEAVSSFTNLAGVKECVGHERVKCYTDKGITIWSGNDDECHDSRWKYGATGVISVASNLIPGLMHDLMYEGENKTLNEKLFPLMKWLFCQPNPIALNTALAQLGVVRPVFRLPYVPLPLEKRVEFVRIVESIGRENFVGENEARVLDDDDFVLVSRY

SEQ ID NO: 49474 - protein, 424 aa, Staphylococcus aureus subsp. aureus MW2
MEITMPKLGESVHEGTIEQWLVSVGDHIDEYEPLCEVITDKVTAEVPSTISGTITEILVEAGQTVAIDTIICKIETADEKTNETTEEIQAKVDEHTQKSTKKASATVEQTFTAKQNQPRNNGRFSPVVFKLASEHDIDLSQVVGSGFEGRVTKKDIMSVIENGGTTAQSDKQVQTKSTSVDTSSNQSSEDNSENSTIPVNGVRKAIAQNMVNSVTEIPHAWMMIEVDATNLVNTRNHYKNSFKNKEGYNLTFFAFFVKAVADALKAYPLLNSSWQGNEIVLHKDINISIAVADENKLYVPVIKHADEKSIKGIAREINTLATKARNKQLTAEDMQGGTFTVNNTGTFGSVSSMGIINHPQAAILQVESIVKKPVVINDMIAIRNMVNLCISIDHRILDGLQTGKFMNHIKQRIEQYTLENTNIY

SEQ ID NO: 49475 - protein, 223 aa, Glycine max
MASSLIISPRKLRSDLYSYSYQEDHYSTPLVINVLASLIERSMARTERIVKNGSRSLSKAISTNIFDCREILDMTIQSYLERIFRYTRAGPSVYVVAYVYIDRFCQNNPGFRINARNVHRLLITTIMLASKYVEDMNYRNSYFGRVGGLTTDELNKLELEFLFLMDFKLHVNVSVFESYCCHLEREVSIGGGYHIERTLRCAEEIKAKHREERGYTHIARVML

SEQ ID NO: 49476 - protein, 404 aa, Haloarcula marismortui ATCC 43049
MTDTVDEVDMPYDDDASQQQKIEALQERLEVLESQNEEMRDKLLDANAENNKYQQKLERLTHENKKLKQSPLFVATVQELSSDGVIIKQHGNNQEALTEVTDEMREELEPDDRVAVNNSLSIVKQLDDETDVRARVMQVDQSPDVTFADIGGIEEQMEEVRETVEMPLKSPEMFEDVGIDPPSGVLLHGPPGTGKTMLAKAVANETDATFIKMAGSELVHKFIGEGAKLVRDLFELARQEEPAVVFIDEIDAIAAKRTESKTSGDAEVQRTMMQLLSEMDGFDDRGDIRIIAATNRFDMLDRAILRPGRFDRLIEVPNPDLEGRKQIFQIHTRSMNVADDVDFEALAEDIQDASGADVKAICTEAGMFAIRDDRTEVTMADFHNAWEKIQQEETDDEDVSRTFA

SEQ ID NO: 49477 - protein, 431 aa, Nostoc sp. PCC 7120
MLSIPINQHLPYTPRLVTSLPGPRAKAIVERDRAVTSPSYTRDYPLVVNRGEGCMVEDVDGNVFLDMTAGIAVTSTGHAHPEVVRAIQEQSARLIHMSGTDFYYEPMVELAENLASQAPFVHDTKVFFTNSGAESNEGAIKLARYYTKRSLIIAFLGAFHGRTYGAMSLTGSKTVQRANFGPLVPGVTHIPYGTHASLDYLENNLLTTIIPAHEVAAIVVEPIQGEGGYIVPEDGFLQRIRNICDRYGILMVVDEVQSGMGRTGRLFAIEHWNVTPDIITTAKGIASGMPLGAILARAELMTWPPGSHATTFGGNPVACAAGIVTLKLLESGLMDNATQMGELLQTGLTQLHEQFPRMSLPRGKGLMVAVDLLDEDGNFDSTLRDRIIQEAFYHGLLLLGCGKAAIRFCPPLVINREQIQTSLDILAGILR

SEQ ID NO: 49478 - protein, 169 aa, Zea mays
MEVEALQAILMDDIKGFTASSKPFVMGTRAVDSNFLSKFDRCYVAFQLALIFAHTEKYPDEPPLLNVKSVRGIKPHDLASLKEKLQREEDVDESSCMTVTLCADVTIAEHEVEELGSRITVVNVAIEVANVKAATHEVMSAKRRRGDDKDALKQLSCRGQCRGRHNQGR

SEQ ID NO: 49479 - protein, 355 aa, Haloarcula marismortui ATCC 43049
MRAAVLEAYGEPLAVRDRDPPTPNPDGAVVAVEACGICRSDWHAWQGHGDWADDDVPIGQVLGHEPAGRVTATGNQVTTVSVGDRVVVPFNLGDGTCGYCRNGHGNVCTDGWALGFESDAPGAFAEQVAVPQADYNLVGLPDGVSSDAAAALGCRYVTAFHALAHRADIAAGDRVAVHGCGGLGLAAVQIASALGASVIAVDIRDEPLAMARDAGASTVVDASAVEDVPAAIEGETDGGAEVSVDALGRAETCQNSVRSLRPRGTHVQVGLTTNAERGEVALPTDWITRWDIDVLGSRGMPPSRYDELLRLVADGPLDPGALVTRRVALEAVSERLAAMTDYGTDGIELVTEFGR

SEQ ID NO: 49480 - protein, 328 aa, Picrophilus torridus DSM 9790
MKDFYDWQYSMRSKIAEINQRLLDSIQTDEKYLYDMARYTIEAGGKRFRPLLTILSFEIASGESYEKILDLAAGYELIHTASLIHDDIIDHSDMRRGRYTLSYKEGINNAIVVGDYLFAKAYELGSRYGKEVSKIMADASSNLAEGQILEAENIGNLNMNEETYLKIIENKTARFFAACALGATKAAGADFEISNRLSNFAYNMGMAFQITDDILDIIGNEKDMGKPAMVDLGHDVITLPIIYSLKNNYYNNKIRDILTGNYKSPDLKDKFKNIMMETGAIEYSFKVAKDYINKSVSYLSGIGRSRDLDLLMELAMIVIERIDEAGLM

SEQ ID NO: 49481 - protein, 491 aa, Triticum aestivum
MGSLPVPAFPSKHCLDESSHIDEATLSALFKSQQSHLNFFFDHIDHSQTLAFTRALLNAAGTVFFTGVGKSGFVAHKISQTLVSLGVRSAFLSPVDALHGDIGILTNRDVLILLSKSGATEELLRLVPCARAKGALLIALTSVEGNALAAACDMSVHLPLQRELCPFNLAPVTSTAIQMVFGDTVAIALMEARNLTKEEYAANHPAGKIGKSLIFKVKDVMKKQDELPICRESDLIMDQLVELTTKGCGCLLVIGDGYRLIGTFTDGDLRRTLRARGEAIFKLTVGQMCNRNPRNLIGPEAMAVDAMKKMEAPPSPGSVFCLVINDEKFLLGGCESLDPLLGFLAGLAGFGGGPAGRFFFFGNFLAPFFPLGGFFPPHLALWGPPPPIFPQGGGFPPGFLGGAPFLGAPPPPPKGDCGGFFQKTFFFFFFFPPPQKKKKKKKKKKKFFFFFFPGENTPPPGGGGGAPPPKTPPKFFPPPFYWGGGAFFCGP

SEQ ID NO: 49482 - protein, 169 aa, Triticum aestivum
MAPTVMASSATAVAPFQGLKSTATLPVARRSTTSFAKVSNGGRIRCMQVWPAYGNKKFETLSYLPPLTEEQLLKQVDYLLRNNWVPCLEFSKEGFVYRENSTSPCYYDGRYWTMWKLPMFGCTDASQVYKELQEAIASYPDAYVRILGFDNIKQTQCVSFIAYKPAGSE

SEQ ID NO: 49483 - protein, 521 aa, Fragaria x ananassa
MASSSMAANGVPTLRLSTSNIATNQTQKTNRGLSFSGSHLSGTKIPTPATCLRTCSPSPSTRRAPLVVSPKAVSDSKNSETCLDPDASRSVLGIILGGDGRTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQCLWLFEEHNVLEFLVLAGDHLYRMDYEKFIQAHRETDADITVAALPMDEKRATAFGLMKIDDEGRIIEFAEKPKGEQLKAMKVDTTILGLDDERAKEMPYIASMGIYVVSKNVMLDLLREKFPGANDFGSEVIPGATSIGLRVQAYLYDGYWEDIGTIEAFYNANLGITKKPIPDFSFYDSSSPIYTQPRYLPPSKMLDADITDSVIGEGCVIKNCKIHHSVIGLRSCISEGAVIEDTLLMGADYYETDVDRRLMAKKGSVPIGIGKNSHIKRAIIDKNARIGDNVKIIKSDNVQETARETDGYFIKSGIVTVIKDAWIPSGTVI

SEQ ID NO: 49484 - protein, 507 aa, Fragaria x ananassa
MDSWCVTLKPNTHLRQPTQAGLCCGANGFLGQRIRESFGNRGWVHGSEKTRPGVVSSVVTTKDFETTLKVPTYHRPRVDPKNVASIILGGGAFTQLFPLTRRAATPAVPVGGCYRLIDIPMSNCINSNINKIFVLTQFNSTSLNRHLARTYFGNGINFGDGFVEVLAATQTSGEAGMDWFQGTADAVRQFVWVFEDAKNRNVENILILSGDHLYRMDYMDFVQSHVDSNADITLSCAVVGDSRASDYGLVKIDSRGKIIQFAEKPRGAGLKAMQSDTTLLGFSPQDALKSPYVASMGVYVFKTDILLELLKKSYPNSNDFGSEIIPAAVEERNVQAYIFIDYWEDIGTIQSFYDANLALTEEFPKFQFYDPKTPFFTSPRFLPPTKIDNSRVVDAIISHGCFLQECFVQSSIVGERSRLDYGVELKDSIMMGADSYQTESEIAALLARGKVPIGIGRNTKIRLCIVDLNAKIGKDVIIMNKDGIQEADRPEEGFYIREESLSLWRRE

SEQ ID NO: 49485 - protein, 353 aa, Fragaria x ananassa
VEVLAATQTPGESGKKWFQGTADAVRQFHWLFEDARSKDIEDVLILSGDHLYRMDYMDYIQNHRQSGADITISCLPMDDSRASDFGLMKIDKKGKVLSFSEKPKGNDLKAMAVDTTVLGLSVEEALKKPYIASMGVYVFKKEILLNLLRWRFPTANDFGSEIIPASANEFFMKAYLFNDYWEDIGTIRSFFEANLALTEHPNKFSFYDAAKPMYTSRRNLPPSKIDGSKIVDSIISHGSFLTDCLIEHSVVGIRSRINTNVHLKDTVMLGADYYETDSEVLSLLAEGRVPVGIGENTKIKDCIIDKNARIGNNVVIANTEGVQEADRSSEGFYIRSGVTVILKNSTIEDGLSI

SEQ ID NO: 49486 - protein, 430 aa, Nostoc sp. PCC 7120
MSIHEIFMPALSSTMTEGKIVSWVKSPGDKVEKGETVVVVESDKADMDVETFYEGFLAHIIVEAGDSAPVGAAIAYVAETEAEIEAAKSLGSSGAAAATPPAAPQPVATTAAVGVPATSQNGSNHREGRLIASPRARKLAKELKVDLTSLKGSGPYGRIVADDIESAVGKVKQPATTPSAPTPTFTPAAPPAPRTPAPAPAPIAAAPGQVVPFNTLQNAVIRNMVASLDVPVFRVGYTITTDGLDKLYKQIKSKGVTMTALLAKAVAVTLQKHPLLNASYSDQGLVYHPDINVAVAVAMDGGGLITPVLKNADKIDIYSLSRTWKSLVDKARSKQLQPDEYTGGNFTLSNLGMFGVDTFDAILPPGQGSILAIGASRPQLVATGDGLFGVKQQMQVNITSDHRIIYGADAAAFLQDLAKLIETDAQSLTL

SEQ ID NO: 49487 - protein, 486 aa, Comamonas sp. JS765
MLAKQILNFINGEFVATGKWFDNRTPISNAVIGQVAEAGQAEVDAAVAAARAALKGPWGSMTLAQRVELLEALVAEITRRFDEFLEAECADTGKPRSLASHIDIPRGAANFKVFADVVKNVPTEFFEMATPDGRGAINYGYRKPVGVVGVICPWNLPLLLMTWKVGPALACGNTVVVKPSEETPRTAALLGEVMNHVGIPKGVYNVVHGFGPGSAGEFVTSHPGIDAITFTGETRTGEVIMKAAAKGARPVSLEMGGKNAAIVFADCDFDAAIEGTLRSAFVNCGQVCLGTERVYVERPIFDKFVAALKQQVEGWKIGVPEGADTQLGPLISKEHQAKVLSYYQLAVQEGATVVTGGGVPDMPGELKDGCWVQPTIWTGLPETARVIKEEIFGPCCHIAPFDTEDEVLAKANDNEYGLATAIWTRDLSRAHRVAQRMEVGISWVNSWFLRDLRTPFGGSKQSGIGREGGVHSLEFYTELKNVCIKL

SEQ ID NO: 49488 - protein, 335 aa, Ustilago maydis 521
MPSKRGGSGGLDIGLIFAHKILTVLFILSTVGWIVAFIGQCAAEADGVGRQGVLWFAIFLQLFLIIGKYLGVMSDSLGTSRLQLTAFTAVALVFSVFGINSGIYSSNSADEAVAAGWFLITIANVIWLLFLTTEEDSVLYPIVNIANAGITPPAARTSSRYNGAGGAGSGGQSMRMAGSGGVGTGLGGGYGAGNGSAYGGFQGGSGYQPAYGNSPSAADITTANGTGLGAPKISSASIRSRGANDAGATQDAPSVASHGAPASPAQVGSKSTDLPDYGYKARALYAYQANADDPTEISFSKGEVLDIVDNSGKWWQARRSNGETGIVPSNYMQLL

SEQ ID NO: 49489 - protein, 216 aa, Thermoanaerobacter ethanolicus
MENILKELKFDDRGLIPVITQDYKTNEVLMMAYIMKRPLKKSLETGKVHYFSRSRNKLWLKGETSGHFQLIKSISIDCDADTLLIKVEQVEAACHTGHYSCFYREISGNELKETSDKVFDEQKVYEAENAKILQEIYDVIVDRTIHPKEGSYTNYLFEKGLDKILKKVGEEAAEVIIGAKNRDKGEIVYEISDLIYHLLVLMVERGIKLEDIYEEA

SEQ ID NO: 49490 - protein, 216 aa, Illicium floridanum
KRIENTTNRQVTFCKRRNGLLKKAYELSVLCDAEVALIVFSTRGRLYEYANNSVKGTIERYKKACTDTSNSGCITEANSQYYQQESSKLREQIGILQKANRHLMGDGISSMSIKELKQLENRLEKGIGKIRTKKNELLYAEIEYMQKRETDLQKDNMYLRAKITENERAQQHMNMLPGPEYDMMPQFDSRNFLQVNLLEPSHHQYSHQEQTTLQLG

SEQ ID NO: 49491 - protein, 477 aa, Brucella melitensis 16M
MTFHQNLIAGEWVGGDDIANINPSDTNDVVGTYARATAEDTKAAIAAAKAAFPAWSRSGILERHAILRKTADEILARKEELGRLLSREEGKTLVEGIGETIRASQIFDFFAGECLRLAGEVLPSARPGIGVEVTREPVGVVGIITPWNFPIAIPAWKIAPALCYGNTIVFKPAELVPGCSWAIADILHRAGLPKGVLNLVMGKGSVVGQTILDSADVNAATFTGSTGTGKRVAAASIEHNRRFQLEMGGKNPVVVLDDADLNVAVESVVNSAFFSTGQRCTASSRIIVTEGIHDKFVAAAIEKLKTVVVDNALKPGTHIGPVVDETQLQQDMDYIELGRKEGAKLAFGGERLNRETPGFYLQPALFTEATNQMRISREEIFGPVASVIRVKDYEEALATANDTSFGLSSGICTTSLKYATHFKRNSEAGMVMVNLPTAGVDFHVPFGGRKGSSFGPREQGRYAAEFYTTVKTAYTLA

SEQ ID NO: 49492 - protein, 170 aa, Triticum aestivum
  misc_feature (92)..(92): Xaa can be any naturally occurring amino acid
  misc_feature (121)..(121): Xaa can be any naturally occurring amino acid
MASLVAVQPVAVRGLAGSSISGRKLAVRPASAAVSRSTRRARGAAVVAKYGEKSVYFDLDDIANTTGQWDLYGQRRRRPPYNGLQEQSFFNXTFAGGPLTKRRLLLKVLLLGGGSLLAYVXSANASPDLLPIKKGPQLPPTPGATWKDLKLICSQGHLPPSRSVLVCRGI

SEQ ID NO: 49493 - protein, 332 aa, Anabaena variabilis
MTKNLLEQLREMTVVVADTGDIQAIEKFTPRDATTNPSLITAAAKMPEYQEIVDQTLLQAKKDAGAGASKGQIVSLAFDRLAVSFGLKILQIIPGRVSTEVDARLSYDTEATITKARELIAQYKAAGIGPERVLIKIASTWEGIKAAEILEKEGIHCNLTLLFGLHQAIACAEAGITLISPFVGRILDWYKKETGRDSYPSAEYPGVISVTTIYNYYKKFGYTTEVMGASFRNIGEITELAGSDLLTISPGLLGELQATIGELPRKLDPAKAATLDIEKISIDKATFDKMHAADRMAYDKLDEGIKGFSKALEELETLLAERLARLEVVASH

SEQ ID NO: 49494 - protein, 333 aa, Glycine max
MKSLFKPKPRTPSDIVKQTRDLLLRLTSRDDDNMPDLTKNLRDLKSILYGNSESEPVPEACAQLTQEFFADNTLRLLIQYLPKLNLEARKDATQIVANLQRQQVQSKLIASDYLDTNLDLMDVLVSGYENTDMALHYGAMLRECIRHQIVAKYVLDSPHMKKFFDYIQLPNFDIAADAAATFKELMTRHKSTVADFLSNYYEWFFDEYNSKLLESSNYITRRQAVKLLGDMLLDRTNSAVMTRYVSSRDNLRILMNLLRESSKSIQIEAFHVFKLFAANQKKPADIISIFVANRSKLLRLLGDLKTDKEDEQFEADKAQVIKEIAALEPRDLA

SEQ ID NO: 49495 - protein, 227 aa, Sinorhizobium meliloti 1021
MPQERVDETGLPMDIQGFPEHLLTGYRNFMSGRFNEQQQRYKTLAESGQKPKTMVIACCDSRAAPETIFDSGPGELFVVRNVANMMPPYEPDGHYHSTSAALEFAVQSLRVTNIVVMGHGRCGGIKAALDPDAEPLSPGDFIGRWMNLLKPAAEQIQSNDVMTQAERQRALERVSIRNSIANLRTFPCVNILESKGKLRLHGAWFDISTGELWVMDAKTGDFSRPGM

SEQ ID NO: 49496 - protein, 156 aa, Zea mays
  misc_feature (154)..(154): Xaa can be any naturally occurring amino acid
MSHFGRSGPPDISDTYSLLVLNITFRTTADDLYPLFAKYGKVVDVFIPRDRRTGDSRGFAFVRYKYKDEAHKAVERLDGRVVDGREITVQFAKYGPNAEKISKGRVVEPPPKSRRSRSRSPRRSRSPRRSRSPPRRRNPRRSRTSRRRPRDDFXGK

SEQ ID NO: 49497 - protein, 694 aa, Picrophilus torridus DSM 9790
MLMIEQAEIDLIKKRWADFFDRYDYESDINRLRERYPDERSLYISYKDLSSFDIDFADNIRKDPVTYLSAGEDYLKTYIGRTREKISRLNIRLKDIPERNFKYEIRNVRSTNVDTFISVTGIIRKNTEVLPRLDIAVFRCPNCGSIISETEYYRKMNEPAKCDSCNYHGKFILEIDQSTFIDTQKLEIQENPDTLDGTSQPQRMTVIMEDDITGRIFPGDRVTIYGILKADQKFIGSIKLTEFNIFLYANNFKKETKDFEDIRITDEDEENIKKLSSCPDIIDRLSRSIAPSIYGLEVIKKALVLQLFGGVRKVLKDGTTIRGDIHILMVGDPGTAKSQLLRYMTSLAPRSVFAFGKGSSAAGLTAAAVRDDFGEGRWTLEAGALVLADNGFAAIDELDKMDQRDTASMHEAMEQQSVTISKAGIMATLKSRCSILAAANPKFGRYDVTRTIAEQIDFPPPLLSRFDIIFKLVDTPNKDNDSRLAEHILMTHRIGEIYRSIENTNINIDIPDEEKYIPEIDKDLIRKYISYAKNRIFPRLSDEAIRILREEYVNTRSSGVDSIPITARQLESTIRLAEAAARARLSSIVTEADALLAKSIVDYYLKDVSAINGKVDIDILNTGMSSRQRNEAELIMDVIKELKNENKRPPEIDDVIEYLASRGISRKDAENSIQKLKIGGFLYEPSSNRIDVIK

SEQ ID NO: 49498 - protein, 175 aa, Triticum aestivum
  misc_feature (14)..(14): Xaa can be any naturally occurring amino acid
MAPTVMASSDTSVXPFQGLKSTAGLPVSRRSSSAGLSSVSNGGRIRCMQVWPIEGIKKFESLCEVPPLSTEALLKQVDYLIRSKWVPCLEYSKVGFVFREHNSSPGYYDGRYWTMWKLPMFGCTDATQVLNEVEEVKKEYPDAYVRVIGFDNLRQVQCVSYIAFRPPGCEESGMA

SEQ ID NO: 49499 - protein, 496 aa, Triticum aestivum
  misc_feature (13)..(13): Xaa can be any naturally occurring amino acid
  misc_feature (66)..(66): Xaa can be any naturally occurring amino acid
  misc_feature (68)..(68): Xaa can be any naturally occurring amino acid
  misc_feature (125)..(126): Xaa can be any naturally occurring amino acid
  misc_feature (138)..(138): Xaa can be any naturally occurring amino acid
  misc_feature (144)..(144): Xaa can be any naturally occurring amino acid
  misc_feature (147)..(148): Xaa can be any naturally occurring amino acid
  misc_feature (256)..(256): Xaa can be any naturally occurring amino acid
  misc_feature (260)..(260): Xaa can be any naturally occurring amino acid
  misc_feature (262)..(262): Xaa can be any naturally occurring amino acid
  misc_feature (264)..(266): Xaa can be any naturally occurring amino acid
  misc_feature (274)..(274): Xaa can be any naturally occurring amino acid
  misc_feature (276)..(276): Xaa can be any naturally occurring amino acid
  misc_feature (278)..(279): Xaa can be any naturally occurring amino acid
  misc_feature (281)..(281): Xaa can be any naturally occurring amino acid
  misc_feature (283)..(283): Xaa can be any naturally occurring amino acid
  misc_feature (285)..(285): Xaa can be any naturally occurring amino acid
  misc_feature (288)..(290): Xaa can be any naturally occurring amino acid
  misc_feature (299)..(300): Xaa can be any naturally occurring amino acid
  misc_feature (303)..(304): Xaa can be any naturally occurring amino acid
  misc_feature (309)..(313): Xaa can be any naturally occurring amino acid
  misc_feature (315)..(316): Xaa can be any naturally occurring amino acid
  misc_feature (318)..(318): Xaa can be any naturally occurring amino acid
  misc_feature (323)..(324): Xaa can be any naturally occurring amino acid
  misc_feature (328)..(330): Xaa can be any naturally occurring amino acid
  misc_feature (332)..(334): Xaa can be any naturally occurring amino acid
  misc_feature (338)..(338): Xaa can be any naturally occurring amino acid
  misc_feature (344)..(344): Xaa can be any naturally occurring amino acid
  misc_feature (346)..(346): Xaa can be any naturally occurring amino acid
  misc_feature (348)..(350): Xaa can be any naturally occurring amino acid
  misc_feature (353)..(354): Xaa can be any naturally occurring amino acid
  misc_feature (356)..(356): Xaa can be any naturally occurring amino acid
  misc_feature (360)..(360): Xaa can be any naturally occurring amino acid
  misc_feature (363)..(363): Xaa can be any naturally occurring amino acid
  misc_feature (365)..(365): Xaa can be any naturally occurring amino acid
  misc_feature (371)..(371): Xaa can be any naturally occurring amino acid
  misc_feature (377)..(378): Xaa can be any naturally occurring amino acid
  misc_feature (385)..(386): Xaa can be any naturally occurring amino acid
  misc_feature (390)..(390): Xaa can be any naturally occurring amino acid
  misc_feature (394)..(394): Xaa can be any naturally occurring amino acid
  misc_feature (398)..(398): Xaa can be any naturally occurring amino acid
  misc_feature (424)..(424): Xaa can be any naturally occurring amino acid
  misc_feature (460)..(460): Xaa can be any naturally occurring amino acid
  misc_feature (472)..(472): Xaa can be any naturally occurring amino acid
MAGTGVFADVLDXEVYKYYADGEWRASASGKTVAIVNPTTRQTQYRVQACTQEEVNKVMDAAKVAXKXWARTPLWKRAELLHKAAAILKEHKTPIAECLVKEIAKPAKDAVSEVVRSGDLVSYTXXEGVRILGEGKLXVSNSFXGNXXNKYCLSSKIPLGVVLAIPPFNYPANLAGSKIGPALIAGNALVLKPPTQGAVAALHMVHCFHLAGFPKGLISCVTGKGSEIGDFLTMHPGVNCISFTGGDTGIAISKKXGMVXLXMXXXGKDACIVXEXAXXDXVXAXIVXXXFSYSGQRCXXVKXXLIMEXXXXXVXXKXNAKLXXLKVXXXEXXXDITXVVTESXAXFXXXSGXXCXGERXNFXPXVQEKGXLIWPLXXDHVRPDXXIAWXEPFXPVLXVIRINSVEEGIHHCNASNFGLQGCVXTRDINKAIMISDAMESGTVQINSAPARGPDHFPFQXLKDSGIGSQGIXNSINMMTKVKSTVINLPSPSYTMG

SEQ ID NO: 49500 - protein, 410 aa, Bacillus clausii KSM-K16
MGTIVMPKLGMTMSEGTIVNWCKEVGEPVTKGEAIVEISSEKLTQELEAQEDGILLAKYGDVDAVMKVGEVLAHIGQEGEEIPETAATPSTAPQLSTSETDTASKTPAKQGQKKGEERIFITPLARKLAKEHNVNIEEVEGTGGNGRITKRDILREASNQISTQAVKQAANENAQVAHSDDIGEGLSPIRKTIARNMRASLHNTAQLTLHRKAHANALLAFRRLLKTESESHQLQLKLSVTVLIARATILALQQVGAMNSRYENGQLKEFENVHLGIATSLDDGLVVPVIRNADHLSIGQLATKIEKIAANARSGQSNPDELSGSTFTITNLGASSIEYFTPILNPAETGILGVGSLQQELALSEDGQVEPVQKMPFSLTFDHQIVDGVLAAQFLDAVVKYVENPHLLIL

SEQ ID NO: 49501 - protein, 347 aa, Bacillus clausii KSM-K16
MTERIVTFMTAINEAMAQAMRKDDNVILIGTDVAGGAEVDHLVQDDGRYDDAFGGVFGLSKGLVTEFGRERVIDTPIAEHGYFGAAVGAAATGLRPIAELMFNDFIGFALDPILNQGAKMRYMFGGKARMPLTVRTVHGAGAGAAAQHSQTLYGMFGAIPGVKVVVPSNPYDAKGLMLAAVEEDNLVVFSEDKLLYGMKGHVPEDYYTVEIGKANVIREGKDMTIVAIGKMVQVAEETAQMLAKDDISVEVIDLRTVAPWDEETVMDSVKKTGRLIVIDESNPHNNTATDIASVVADKAFDYLDGPIKTVCAPHTPVPFATNLEQAYIPDAAKVLRVADEIIADLKQ

SEQ ID NO: 49502 - protein, 560 aa, Ralstonia metallidurans CH34
MEKLWLKNYPAGVPAEIDASQFRSLAQLLEESFRTYADRRAFICMDHAITYGELDQLSHAFAAWLQSRGLRPGARIAIMMPNVLQYPVVLAAVLRAGYVVVNVNPLYTPRELEHQLKDSGAEAIVILENFASTLQAVLSATPVKHVVVASMGDLLGTVKGAIVNFVVRNVKKMVPAWELPHCVRFKDVLAEGRKMTLKPVNTGPDDVAFLQYTGGTTGVSKGATLLHRNIVANVLQSEAWMQPALAKGAPIDQVVTITALPLYHIFALTVCCLLGMRSGGLSILIPNPRDIPGFIKELQKYKFHMFPAVNTLYNALLNHPDFAKIDFSGLRVANGGGMAVQEAVAKNWLAKTGCPIIEGYGLSETSPSATCNPTDTDAFSGTIGLPLPSTDVSIRDDDGNELPLGQPGEICLRGPQVMAGYWNRPDETAKVMTADGFFKTGDIGVMDERGYTKIVDRKKDMILVSGFNVYPNEVEGVVAECPGVLEVAAVGVPDQHSGEVVKLFVVKKDPALSEADVIAFCKDRLTGYKRPKYVEFRTELPKTNVGKILRRELRDSRKAA

SEQ ID NO: 49503 - protein, 505 aa, Brucella melitensis 16M
MNKVEFSRTVKPAFAKRYGNFIGGKWVEPRSGRYFENTSPVNGQVLCEVARSDAADVEAALDAAHAARELWGRTSVAERALILNRIADRIEENLPALAAAETWDNGKPIRETTNADLPLAVDHFRYFAGVIRAQEGGISEIDHDTVAYHFHEPLGVVGQIIPWNFPLLMATWKLAPALAAGNCVVLKPAEQTPASILVLMELIADILPPGVVNIVNGFGLEAGKPLASSPRIAKIAFTGETTTGRLIMQYASQNLIPVTLELGGKSPNIFFKDVAAEDDDFLDKAIEGFVMFALNQGEVCTCPSRALIQESIYDRFMEKALKRVEAIVQGDPLDPATMIGAQASSEQLEKILSYLDIGRQEGAEVLAGNERNMLPGDLAGGYYVKPTVFKGHNKMRIFQEEIFGPVVSVATFKDDAEALSIANDTLYGLGAGIWTRDGTRAYRFGRAIKAGRVWTNCYHAYPAHAAFGGYKQSGIGRENHLKMLDHYQNTKNMLVSYSPKKLGFF

SEQ ID NO: 49504 - protein, 130 aa, Zea mays
MVRVSVLNDALKSMYNAEKRGKRQVMIRPSSKVIIKFLLVMQKHGYIGEFEYVDDHRAGKIVVELNGRLNKCGVISPRFDVGVKEIEGWTARLLPSRQFGYIVLTTSAGIMDHEEARRKNVGGKVLGFFY

SEQ ID NO: 49505 - protein, 541 aa, Oenococcus oeni
MTDQVSILNDPFINKGTAFTEAEREELGLNGLLPAKVQALQEQVDQTYAQFQSKVSNLEKRLFLMEIFNTSHVLFYKLFSQHVVEFMPIVYDPTIADTIENYSELFVEPQGAAFLDINHPENIQSTLKNAANGRVIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYEDKIATFNDDIQGTGIVVLAGVLGALKISGQKLTDQTYMSFGAGTAGMGIVKQLHEEMVEQGLSDEEAKKHFFLVDKQGLLFDDDPDLTPEQKPFAAKRSDFKNANQLTNLQAAVEAVHPTILVGTSTHPNSFTEEIVKDMSGYTERPIIFPISNPTKLAKAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLKWEPKY

SEQ ID NO: 49506 - protein, 562 aa, Aspergillus oryzae
MTVDTSSDREANDFQHVQVAKTSMWRSLMNNPKVLFIAFFASFGGFEYGYQQGVLGQSLVMTRFMENFPSVVNSSTATGWLTSILQLGGVVGSLSAGVLGELYSRKYTMFVACCWVILGSYLYVGATEGNPSLLYAGRFFTGLGVGLFSGVGPLYNAELAAPEMRGLLVSFYQFATILGIMISFWVGYGSNYIGGTGETQSDMAWRLPSIVQGIPAVFLACGIWFMPFSPRWLVKQDRDEEALTTLAWIRKLPQDHELVQMEFLEMKAEALFEKRAFAKATPWLAERENKNVFMSQIAQYANCFRTMGNFKRVCTAWLVMFFQQWSGVDAIIYYASNVFTSLGLTSGTVALLATGVTGVVFLISTMPGMLVIDKVGRKPMLLVGSLVMLLSMVIVGVIVAKFRHDWPSHEAAGWSAVALIWLYIAGFGATWGPCSWTLVSEIFPLSIRAKGASIGAFSNWINNFAIAFFVPPMLEAWAWGTYIFFAVFLGVGIVWVWFFLPETKNASLEEMDRVFKSNTGEQDAEMLREAQREVGLTACIERLSKGPVPVEKDSYGSHLEQV

SEQ ID NO: 49507 - protein, 541 aa, Oenococcus oeni
MTDPVSILNDPFINKGTAFTEGEREELGLNGLLPAKVQALQEQVDQTYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPDLYLHWDDFGRSNASNILNSYKDKIATFNDDIQGTGIVVLAGVLGALKISGQKLTDQTYMSFGAGTAGMGIVKQLHEEMVEQGLSDEEAKKHFFLVDKQGLLFDDDPDLTPEQKPFAAKRSDFKNANQLTNLQAAVEAVHPTILVGTSTHPNSFTEEIVKDMSGYTERPIIFPISNPTKLAEAKAEDVLKWSNGKALIGTGVPVDDIEYEGNAYQIGQANNALIYPGLGFGAIAAQSELLTPEMISAAAHSLGGIVDTTKVGAAVLPPVSKLADFSRTVAVAVAKKAVEQGLNRQPIDDVEKAVDDLKWDPKY

SEQ ID NO: 49508 - protein, 400 aa, Gordonia sp. TF6
MSAVRVGDSGRDVSVVIVGTGVAGITAAETLRGNGFDGTITVFGEEPHLPYRRTALSKSLVVGDLSDAKITLRPPGYWSERGIDIVTSTRVVDTSSRLVRLADATEAGYDALVLATGGRARQLPGGSSSPSSLRTRRDAEGLREAIADGPVVIVGGGLIGLEIAAAVATAGEGSQVTVVERGSSLLSRVVPASVAEAVATLHRERGVRILTGAEPIALGAQTVTLADGQTLTGTVISAVGMEPELDLARSAGLSVDSAGVVVDDALRTGVPGVYAAGDVAARPHPLTGAPMRAEQWLTATEHGRLVAMTIAADLGSDADTSVPVPRVPLAWTMQYSTNIQVVGWPTSGDRVDVELDDPSSVVRTFAGDRLVGAVCIGRGASGRALRAEIESSLQPAGVGG

SEQ ID NO: 49509 - protein, 395 aa, Anaplasma phagocytophilum HZ
MSDSSDGYAKPMTINFGPQHPAAHGVMRLILEMSGEVIERIDPHIGLLHRGTEKLIEYKTYLQALPYFDRLDYVSPMSQEHAYSLCVERLLGCEVPIRAKYLRVIFCELTRLLNHLLNVACQALDSGATTPLLWIFEEREKILSFYERASGARFHSAYIRPGGLAADVPDGLLDDIHEFTNYFPKLLDSVDDLLTENSIWKQRNVEIGKVTKQQALDWGFSGPMLRACGIPWDLRKSQPYEIYDILDFKVPVGSNGDCYDRYLVRMAEIRESLYILEQCLRDIPSGPVKTDDRKIAPPKREELKYSMEALIHHFKLFSEGYKVPEGEAYAAVEAPKGEFGVYIVSDGTNKPYRCRIRSPGFAHLQAIDAMARGHMLADLPVIIGSLDIVFGEIDR

SEQ ID NO: 49510 - protein, 541 aa, Oenococcus oeni
MTDPVSILNDPFINKGTAFTEAEREELGLNGLLPAKVQALQEQVDQSYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDGEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGIVVLAGVLGALKISGQKLTDQTYMSFGAGTAGMGIVKHLHEEMVEQGLSDEEAKKHFFLVDKQGLLFDDDPDLTPEQKPFAAKRSDFNNANQLTNLQAAVEAVHPTILVGTSTHPNSFTEEIVKDMSGYTERPIIFPISNPTKLAEAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLKWEPKY

SEQ ID NO: 49511 - protein, 479 aa, Escherichia coli CFT073
MSVPVQHPMYIDGQFVTWRGDAWIDVVNPATEAVISRIPDGQAEDARKAIDAAERAQPEWEALPAIERASWLRKISAGIRERATEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKSIYDQFVNRLGEAMQAVQFGNPAERNDIAMGPLINAAALERVEQKVARAVEEGARVALGGKAVEGKGYYYPPTLLLDVRQEMSIMHEETFGPVLPVVAFDTLEEAISMANDSDYGLTSSIYTQNLNVAMKAIKGLKFGETYINRENFEAMQGFHAGWRKSGIGGADGKHGLHEYLQTQVVYLQS

SEQ ID NO: 49512 - protein, 315 aa, Bacillus clausii KSM-K16
MKKKEALWIYQKMNEIRLFEEEVHRKFGEGIIPGFVHLYAGEEAVATGVSVLLDEEDYITSTHRGHGHAIAKGCDINRMMAEIMGKKDGLGGGKGGSMHVADVEKGMLGANGIVGGGFGLAAGAALTIKTLRQNHVAVCFFGDGASNEGLFHEGLNLASILKLPVIFVCENNQFGEGTPFRYASASETVAERAAAYNMPGVRVDGMKVEDVYSATKEAIRRAKAGEGPTLIECDTYRHYGHFEGDEQKYKSEADQNRDRDPIPEFRKVAVEKGWMTNKQADEIEKEAAETIKKASEFAQKSPLPDVESLYTDIFA

SEQ ID NO: 49513 - protein, 350 aa, Oryza sativa (indica cultivar-group)
MAGGTGIGADEQELPLFHPSPCAYYVQSPSAASHTLSHPASESTAIILSPFPDAAFAAPRHSRVVDDATAHDHDVDQEASRLTLSRYSSSRGSNNSFLAADKKLPAGGGHRGRQVLSGRSGGGVDDEEEDDSEGARSGAWRYVKLDPDAPCCCIVFQVAWRVAVSVAFALLVFFVATKPRDPGVTFKVGKIQQFSLGEGLDGSGVITSFLSCNLTVAMAVDNHSRVFTLHVRPPRLDMSFGRFTFATSQGVEEEGSSYDVGARGKRTVRLFVAAEGKPMYAAGRGMQDLLESGGGLPLAVTVRARSRYRMVGSLVRLSYRHDAQCVVRLRRTPRRNNAIDASGYTCSAIR

SEQ ID NO: 49514 - protein, 285 aa, Anabaena variabilis ATCC 29413
MTVKHLAIAPEGKKSLRLNWTNVAFFTTVHALALLAPWFFSWSALGLLLFLHWLFGSIGICLGYHRLLSHKSFQVPKWLEYAIATIGALAMQGGPIFWIGGHRQHHAHTEDVNLDPYSSQRGFWWSHMLWILYPRSEFFDYEIYQKYAPDLARQPFYRWLDRYFLLLQIPFGLLLYAIGGWSFVIYGVVLRAVLLWHSTWFVNSATHMWGYRTFNADDNARNLWWVSIVTYGEGWHNNHHTFPNVAKAGFQWWEVDVTWWSIKLLQTLGLAKKVVLPPSQRMNQG

SEQ ID NO: 49515 - protein, 410 aa, Blastopirellula marina DSM 3645
MSDPYFQQLFADRIGGANYGKGTEIYKFEKIKRAKRKALADHPERKLIDFGIGENDEMAPESVRQVMAAEINKTENRGYADNGIAAFKEAVARFMQRMFGVSLDATTEINHCIGSKTALAMIPACFINPGDVTLMTVPGYPVAGTHTRYYGGEVFRLPLLAENDFLPDLAAIPEDILRRTKLLVLNYPNSPTGKVATKEFYAEVVEFAKKHNIVVIQDAAHTVLTFDGEPLSFLSVPGAKDVGVEIHSLSKGFDMIGWRIGWVCGNPLLVQAFSDVKDNCDSGQFIAVQKAAAAALDDESIPGRTREKYQRRLTKLVSMLKRCGFECEMPGGTYFLYTKSPKGVVGGPTFDSGEAASQYLITEHSICTVPWDDAGAFLRFSVTYVAADEAAEDALMAETESRLKEIQLQF

SEQ ID NO: 49516 - protein, 361 aa, Blastopirellula marina DSM 3645
MNKKLLLLPGDGIGPEIITEVRKLISWINDHTDLTIETEEDYFGGAAIDAYGVPLRDETLAAARKSDAILMGAVGGPKWDNVAYDIRPEAGLLKIRKQLDLFANLRPAIVFDALIDASSLKPEIVKGLDILIVRELTGGVYFGEPRGIEDLGDGERRGVNTQVYTTSEIRRVGKVAFEIARKRQGKVTSCEKANVMESGKLWREEITRLHAESYSDVTLEHMYADNAAMQLCRRPSQFDVIVTDNLFGDILSDEAAMLTGSLGMLPSAALGAPDSPGLYEPVHGSAPDIAGQGIANPLATILSFAMLLKYSFNSVALGEQIEAAVQAVLAQGLRTADIMTEGCQKVTTVEMGDAVIKELAA

SEQ ID NO: 49517 - protein, 234 aa, Yarrowia lipolytica CLIB122
MDTLSKKPEQRPEEITAILSSLDRYNPEKISILQEYATTQCADQHSDIEANLALLKLLQFQQQPNPNKEDIICNILSMALANFLTSDFTTALHVLPSYVLDSPAADTLAESIQKLFHLYTLLDGCRFPEFWAVYERDDAHADITADVADFENLVRISITRAVDISSQAIHKDVFRSWLNLSDNKFADYVKELGWKVEGETVVVPPNKENEAKPATTTESIKIEQISRLLKRTNE

SEQ ID NO: 49518 - protein, 486 aa, Acinetobacter sp. YAA
MKDIKHYINGQYVGSASGKLFDNVNPANGKLISKVHEAGREEVDAAVNAAKAALRGPWGKMTLEERTSILHKVADGINARFDEFLKAECLDTGKPKSMASHIDIPRGAAHFKVFADMIKNVPTESFEMPTPDGTGALNYAVRRPKGVIGVISPWNLPLLLMTWKVGPALACANTVVVKPSEETPTTTALLGEVMKEAGIPTGVYNVVHGFGGDSAGAFLTEHPQVDGFTFTGETVPGEVIMKAAAKGIRDISLELGGKNAALVFADCDMDKAIEGTMRSAFANCGQVCLGTERVYVERSIFDEFVGRLKEAAEGLKIGPPDDAEANLGPLVSLKHREKVLSYYQKAVDDGATVVTGGGVPEMPEELAGGAWVQPTIWTGLPKDSAVITDEIFGPCVHVCPFDTEEEAIELANSLPYGLASAIWSENITRAHRVAGQIEAGIIWVNSWFLRDLRTPFGGSKQSGIGREGGVHSLEFYTEMKNICVKL

SEQ ID NO: 49519 - protein, 95 aa, Pyrus communis
MAAVGAVRDNQGVANSVETESLARYAVDEHNKKENDLLEFVRVLDDKVQVVSGTMHYLKIEATEGGKKKVYEAKVWVKPWENFKQVQEFKPVSDS

SEQ ID NO: 49520 - protein, 456 aa, Brucella melitensis 16M
MTAQPNSLEARDIRYHLHSYTDAVRLEAEGPLVIERGDGIYVEDIAGKRYIEAMSGLWSVGVGFSEQRLAEAAARQMKKLPFYHTFSYRSHGPVIDLAEKLVAMAPVPMSKAYFTNSGSEANDTVVKLIWYRSNALGEPERKKIISRKRGYHGVTIASASLTGLPNNHRSFDLPIDRILHTGCPHHYHDALPGESEEQFATRLANELEQLILAEGPHTIAAFIGEPVMGAGGVVVPPKTYWEKVQAVLGRYNILLVADEVICGFGRTGNLFGCQTFDIKPDILVMSKQLSSSYLPISAFLINERVYAPIAEESHKIGTLGTGFTASGHPVAAAVALENLAIIEERDLVANARERGARMQKRLRELQDHPLVGEVRGVGLIAGVELVIDKEAKTGLEQPGALGARANAALQERGVISRAMGDTLAFCPPLIINDQQVDTMVSALEAALNDVQASLGK

SEQ ID NO: 49521 - protein, 375 aa, Arabidopsis thaliana
MEKKSVPNSDKLSLIRVLRGIICLMVLVSTAFMMLIFWGFLSAVVLRLFSIRYSRKCVSFFFGSWLALWPFLFEKINKTKVIFSGDKVPCEDRVLLIANHRTEVDWMYFWDLALRKGQIGNIKYVLKSSLMKLPLFGWAFHLFEFIPVERRWEVDEANLRQIVSSFKDPRDALWLALFPEGTDYTEAKCQRSKKFAAENGLPILNNVLLPRTKGFVSCLQELSCSLDAVYDVTIGYKTRCPSFLDNVYGIEPSEVHIHIRRINLTQIPNQEKDINAWLMNTFQLKDQLLNDFYSNGHFPNEGTEKEFNTKKYLINCLAVIAFTTICTHLTFFSSMIWFRIYVSLACVYLTSATHFNLRSVPLVETAKNSLKLVNK

SEQ ID NO: 49522 - protein, 748 aa, Escherichia coli O157:H7 EDL933
MLTRLREIVEKVASAPRLNEALNILVTDICLAMDTEVCSVYLADHDRRCYYLMATRGLKKPRGRTVTLAFDEGIVGLVGRLAEPINLADAQKHPSFKYIPSVKEERFRAFLGVPIIQRRQLLGVLVVQQRELRQYDESEESFLVTLATQMAAILSQSQLTALFGQYRQTRIRALPAAPGVAIAEGWQDATLPLMEQVYQASTLDPALERERLTGALEEAANEFRRYSKRFAAGAQKETAAIFDLYSHLLSDTRLRRELFAEVDKGSVAEWAVKTVIEKFAEQFAALSDNYLKERAGDLRALGQRLLFHLDDANQGPNAWPERFILVADELSATTLAELPQDRLVGVVVRDGAANSHAAIMVRALGIPTVMGADIQPSVLHRRTLIVDGYRGELLVDPEPVLLQEYQRLISEEIELSRLAEDDVNLPAQLKSGERIKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLNILLPMVTSLDEVDEARRLIERAGREVEEMIGYEIPKPRIGIMLEVPSMVFMLPHLAKRVDFISVGTNDLTQYILAVDRNNTRVANIYDSLHPAMLRALAMIAREAEIHGIDLRLCGEMAGDPMCVAILIGLGYRHLSMNGRSVARVKYLLRRIDYAEAENLAQRSLEAQLATEVRHQVAAFMERRGMGGLIRGGL

SEQ ID NO: 49523 - protein, 358 aa, Arabidopsis thaliana
MSAFTSKFADELIANAAYIGTPGKGILAADESTGTIGKRLASINVENVETNRRNLRELLFTAPGALPCLSGVILFEETLYQKSSDGKLFVDILKEGGVLPGIKVDKGTVELAGTDGETTTQGLDGLGDRCKKYYEAGARFAKWRAVLKIGENEPSEHSIHENAYGLARYAVICQENGLVPIVEPEILVDGSHDIQKCAAVTERVLAACYKALSDHHVLLEGTLLKPNMVTPGSDSPKVSPEVIAEHTVRALQRTVPAAVPAIVFLSGGQSEEEATRNLNAMNQLKTKKPWSLSFSFGRALQQSTLKTWAGKEENVKAAQEALYVRCKANSEATLGTYKGDAKLGDGAAESLHVKDYKY

SEQ ID NO: 49524 - protein, 377 aa, Oceanobacter sp. RED65
MDLLARAKQFQAEGRDIIHLEVGEPDFPSLPCVISAGQQALANGHTHYTPALGLPQLRQVIAQYYKSRYQVDVDWNRIVITPGASGALQLVTTLLLDESDQIMLADPGYPCNRHFAAVVNAQAQEVVTSAKDDFHLTALQVSQHWQKQTKAVMVATPSNPTGAVMNLQQLQDLQTAIKQQRGVLIVDEIYQGLVFDSAKDITALQLSGDQSNLFVINSFSKYFAMTGWRLGWMVAPEWAMEGLDRLAQNIFLAANTPAQHAALAVFEKEALQQLDERKTELQKRRDFLLPELIKLGFDVVAEPEGAFYIFARISHFNHRHAKDSMAFCLDLLEKTGVAITPGVDFSPSHGHEYVRFAYTQPISELQRAMDKIKHYLM

SEQ ID NO: 49525 - protein, 377 aa, Mimosa pudica
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYMFTTSAEREIVRDMKEKLAYVALDYEQELETAKTSSSVEKNYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 49526 - protein, 587 aa, Brucella melitensis 16M
MYRYDEFDRDFVAARVAQFKDQVARRLSGELTEDQFKPLRLMNGLYLQLHAYMLRVAIPYGTLSSRQLRKLGSIARTYDRGFGHFTTRQNIQYNWPALKDVPQILAELAEVEMHSIQTSGNCIRNVTADHFAGAAADEVTDPRPLAEILRQWSSLHPEFSYLPRKFKIAIVGSEHDRAAIQVHDIGLQLKKNEAGELGLAVYVGGGQGRTPMVAKKIRDFLPIEDMLTYVTAIVRVYNLHGRRDNKFKARIKILVHETGIEQLTREIDAEWEEIRHGELKLPQRDIDVIESYFRMPDLPQRPEGWEILAVAQKADAEFASWVARNVTAHKHPDYAVVTISLKPVGGIPGDASAEQMELVADVAQTCSFDEIRVSHEQNLVLPHVAKADLPAVYDRLQSGGLVTPHAGLITDIIACPGLDYCALANARSIPVAQRISERFADLDRQLEIGDLKIKISGCINACGHHHVGHIGILGVEKKGEELYQITLGGSADENSAIGEITHRARFLVGRGGRCHRNHCRYLSGPARKCGGNFPCRLSPGGNGAFQTRSLWGDKKCCLTPTLPMRMSAVPRKPGFSKQATAHPRRTK

SEQ ID NO: 49527 - protein, 541 aa, Oenococcus oeni
MTDPVSILNDPFINKGTAFTEAEREELGLNGLLPAKVQALQEQVDQTYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGIVVLAGVLGALKISGQKLTDQTYMSFGAGTAGMGIVKQLHEEMVEQGLSDEEAKKHFFLVDNQGLLFDDDPDLTPEQKPFAAKRSDFKNANQLTDLQAAVEAVHPTILVGISTHPNSFTEEIVKDMSGYTERPIIFPISNPTKLAEAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLKWEPKY

SEQ ID NO: 49528 - protein, 541 aa, Oenococcus oeni
MTDPVSILNDPFINKGTAFTEAEREELGLNGLLPAKVQALQEQVDQTYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDGEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGIVVLAGVLGALKISDQKLTDQTYMSFGAGTAGMGIVKQLHEEMVEQGLSDEEAKKHFFLVDKQGLLFDDDPDLTPEQKPFAAKRSDFNNANQLTNLQAAVEAVHPTILVGTSTHPNSFTEEIVKDMSGYTERPIIFPISNPTKLAEAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLKWEPKY

SEQ ID NO: 49529 - protein, 308 aa, Aspergillus oryzae
MEKYQKIEKIGEGTYGVVYKARELAHPNRIVALKKVRLETDDEGVPSTTIREISLLKEMNHPNIVRLFNIHTEGYKLYLVFEHLDSDLKKYMDALPVNDGGRGRSLPNGLSMDMGLGEAMIKKFMSQLIEGIYFCHSRRVLHRDLKPQNLLINRDGSLKLADFGLARAFGVPLRTYTHEVVTLWYRSPEILLGGPQYSTSVDMWSCGAIFAEMCTRKPLFPGDSEIDQIFKIFRLLGTPDEDSWPGVTSFPDYKPSFPKWKRDSDEHLIPGLERHGLRLLDALLEFDPARRMSAKQARSHPYFRHRSS

SEQ ID NO: 49530 - protein, 417 aa, Triticum aestivum
  misc_feature (324)..(324): Xaa can be any naturally occurring amino acid
  misc_feature (346)..(346): Xaa can be any naturally occurring amino acid
  misc_feature (358)..(358): Xaa can be any naturally occurring amino acid
MLGAARRQLGSGPMLGQVLRRLRPAAGASTEAARGYSSAAKEITVRDALNSALDEEMSADPSVFLMGEEVGEYQGAYKITKGLLDKYGPDRVLDTPITEAGFTGIGVGAAYQGLRPVIEFMTFNFSMQAIDHIINSAAKSNYMSAGQINVPIVFRGPNGAAAGVGAQHSQCYAAWFAHVPGLKVLAPYSSEDARGLLKAAIRDPDPVVFLENELLYGESFPVSDEVLDSSFALPIGKAKIEREGKDVTITAFSKMVGYALQAAEILSKEGISAEVINLRSIRPLDRAAINASVRKTNRLVTLEEGFPQHGVGAEICMSVVEESXFEYLDAPIERIAGADVPMPYAXANLERWAVPQIXDIVRAARRACYRALPMAGICVIRDSLYSGPCFFPSPARARKKRVCSHKGIHNLPKLQAS

SEQ ID NO: 49531 - protein, 204 aa, Glycine max
MCAAISEVEQEELLEKLEVFKIKGRDKHGRKILRIIAKFFPARLVSVEVLKKYLEERVFPKLMGKRKFAVLYVHTGVQRSENFPGISGLRWIYDAIPANVKENLEAVYFIHPGLQARLFLATFGRFLFNAGLYGKLRYVSRVDYLWESVRRNEVEIPEFVFDHDEDLDYRPMMDYGLESDHARVYGGAPTMDSPVTTYSMRCIS

SEQ ID NO: 49532 - protein, 219 aa, Yarrowia lipolytica CLIB122
MATISSSRTQVRRLESQLAELLSEYSSFATSHAIAASEDEVRIGRDIEQVIEKTADSLESFERLLDSTPNATATQTGQLQRHRETLAEHRSQYKKINAGIKQERDRANLLSSVRSDIEGHRNRSATPQAEEEYMLHERGRVDNSNNMTDTLLAQAYATREELLTQRASLANIQRRLFNTASSIPGINTVISKINTRKKRDSLILAVIITLGILFILFLR

SEQ ID NO: 49533 - protein, 399 aa, Oryza sativa (japonica cultivar-group)
MFKRDAPSTDMISGLPEGVLHRIMSFLTLREAVQTCVLSRRWRNLWLSMPLINADYKQFFEMTDTKAGYDEALAVAVPMFKRFVNRLLELRDPVASIDKFCLWYSISDDNEDDTESQDAAANRWISQALQKKARVVEVYGDLVFADLYPLVIDHSVFTSSYLTKVVFSSVLLEDGFFKQLESGCPALEDLSLDDCVISGDEISSQTLKVLTIKDTKFSMEHKTSINTPSVTSLTLWRPAHGIVVLKDMASVVTASVKPSEFIDEFDARGLRQYLWALSGVKNLEFYYLGELTIEGNLQLCPKFNNLVNLTLGRWCLDANFYALILFMQNTPRLEKLTLKLHPFRYQQQRIIGELTERSFTCGHLKIVEVICSENDPLINHLVDFFVSSGMTTAQIHIKH

SEQ ID NO: 49534 - protein, 441 aa, Oryza sativa (japonica cultivar-group)
MEEPPGKKGPAMDPAQDSGRDWLSGLPEGVLHRIMSFLDSRQAVRTCVLSRRWRDLWRSIPRVHADIYDFTPDGTIDGEGEEDVEEAEVVVVFNRFVNRLLERRDPTASIETFFFRCCIPDEDDDGSADANRWISYGLQKNAWFLEVVVQLNSLELDRSVFNSIYLRRIAFGNVFMDQGFFKQLQIGCPALERLYLDDCIVADDEISSNTLKVLTFDTTEFCYEHRISISIPTVTTLALRNTICGKPVLKDVASLVSASVVLYCVESGNFDAYDLRHYLWSFSHVKDLIFSYQGRKLTIENNLQWCPKFFNLVGLTLGKWCLNANFYALIVFLQNSPRLEKLTLILAEDNCKTSEVFIGELEEKSFTCEHLTSVEMKCWEDDPLVINVVDFFVGSGMSSSQIHIEYEDDDEDQFHIESDDMFGFEFEYEDEDEDEDEDEDE

SEQ ID NO: 49535 - protein, 1066 aa, Xanthomonas axonopodis pv. citri str. 306
MNAQLDPLASTSVARPLLAPELPAAPGALRAAITAAWLKDETEHVRELLDQARLPVAEQANVQAIAADLVTRVRARSQDQGAIEAFMRQYDLGSEEGVLLMCVAEALLRIPDQDTADKLIRDKLGDADWKKHMGGSDSVLVNASTWGLMLTGQLVQLNDLTRADVPGAFKRLIGRVGEPVIRLAVRQAMKIMGHQFVMGRTIGEALSRSRKGDNANYRYSFDMLGEGALTMKDAQRYLQAYRDAIHAIGRSGSFVGTDVFAAPSISIKLSALYPRYEHAKRARVMAELVPGVLELAQLAKSYGIGYTVDAEEADRLELSLDIIEATFSDPSLDGWEGYGLAVQAYQKRTPYTIDFLADLARRVGRRIPVRLVKGAYWDAEIKRAQIEGHPGYPVFTRKQNTDVSYLACARRMFAHSDALYPMFATHNAQTIAAVRAIAAGKTYEHQKLHGMGDDLYAEVIPADRLDLPCRVYAPVGSHEDLLPYLVRRLLENGANSSFVNRITDEDVAIEDLIRDPVEAVTSFTSIPHPKIPLPADLLRSQNQNRKNSMGANLANDNDLRQLAEQLNAAIKPWKATPLVPGALISTPSQAVLNPADRRETVGQWHPADPDTVQKSLASAVAAQPAWNRTPAASRATILEHAADLLETRMSEFMAICVKEAGKTLPDAVAEVREAVDFLRYYAGQARAQFGAPERLPGPTGESNELQLHGRGVFVCISPWNFPLAIFLGQVAAALAAGNTVIAKPAEQTNLIGFAAVKLLHEAGVPEAAVQFLPGDGATVGAALTNDPRVAGVAFTGSTETARIINRTLAARDAAIGVLIAETGGQNAFIADSSSLPEAVVKDAISSAFISAGQRCSAARVLFVQDDIADKVMTMLAGAMGELKIGDPGLPSTDVGPVIDADALKILDDHAARMDRQARLIGSTALDGSTAHGSFFAPRAYELTSLSQLQREIFGPVLHVIRWKADQLDAVIEQINATGYGLTLGVHSRIDETIDRITSRVAVGNVYVNRNQIGAVVGVQPFGGQGLSGTGPKAGGPHYLLRFATEKVVTVNTTAAGGNASLLTLGD

SEQ ID NO: 49536 - protein, 420 aa, Escherichia coli O157:H7 EDL933
MPHSLFSTDTDLTAENLLRLPAEFGCPVWVYDAQIIRRQIAALKQFDVVRFAQKACSNIHILRLMREQGVKVDSVSLGEIERALAAGYNPQTHPDDIVFTADVIDQATLERVSELQIPVNAGSVDMFDQLGQVSPGHRVWLRVNPGFGHGHSQKTNTGGENSKHGIWYTDLPAALDVIQRHHLQLVGIHMHIGSGVDYAHLEQVCGAMVRQVIEFGQDLQAISAGGGLSIPYQQGEEAVDTEHYYGLWNAAREQIARHLGHPVKLEIEPGRFLVAQSGVLITQVRSVKQMGSRHFVLVDAGFNDLMRPAMYGSYHHISALAADGRSLEHAPTVETVVAGPLCESGDVFTQQEGGNVEPRALPEVKAGDYLVLHDTGAYGASMSSNYNSRPLLPEVLFDNGQARLIRRRQTIEELLALELL

SEQ ID NO: 49537 - protein, 667 aa, Oryza sativa (japonica cultivar-group)
GGGGGGGGGAVGLEERSDAAEDSLVSVLAVYDGFCNLKQINLELKVCGGSSIRKTLVKEAASYGAAHLILGVAKNSLSFSRSSSISVAKYCAKRVPTGCSVLAVNNGKILFHKDAVQQEPYHSASTMTETPRRSYRKLLTSVIGEKLRDECEQDNRSIFRAVTMPPSSPAPTREVSLALVPMKVHRRESPEVATGWSFLRKKFLPDRKPASHDRSKMSVVQWAMRLPSRYSSASPVCSEYRTTTPDGITSASRILRDRVAVPSRSNSGKSSVVIEELDNSSDKEIPEELIALREKFPSVYSTFSHSELAKITSDFSPECIVGQGGTSQVYKGCLENGKELAVKILKYSDEVLKEFVSEIEIVSSLSHKNIISLAGFCFKDTDLLLVYEYLRRGSLEEILHGEKGCDNLFGWTERFNVALGVAHALDYLHGSGNNRPVIHRDVKSSNILISQDFEPKLSDFGLALWDTDATSQITCNDVAGTFGYLAPEYFMHGKVNDKIDVYAFGVVLLELISGKKPLCTGCPKGQESLVMWANSIIQGGKLTQLVDPNLPTEDHANKVERMTLAASLCIRPTPQRRPHIAVVLKLLNGDNGILKWARSEVGLSYESDGDEPVVTLPENNRNIQSYINLAFDVDDDSASVSSNDFIAANTSLEEYLRGRWSRSSSFD

SEQ ID NO: 49538 - protein, 360 aa, Oryza sativa (indica cultivar-group)
MAASCALTLPSAISVSVSVSSNSPRRFRRSRRVVAMASVGQKVYAPGVAVSEGNGGLPKIDLKSPHGRDGINICTALNWICIIWDLGYLLTYPSKFQVTIGFFQLTQQSEAEIYLFGACVTSWKVPSGKDLLFVRPDAVFNGQKPISGGIPHCFPQFGPGTMQQHGFARNMNWSITDSEANEGDPAVTLELKDDSYSRSMWDFSFQALYKVALHSTSLSTTLKITNTDDKPFSFNSALHSYFSASISGVSVKGLKGCKTLNKDPDPKNPLEGKEEREEVTFPGFVDCIYLGAPSELTLDNGLGDKIVISNANWSDAVLWNPHLQMEACYKDFVCVENAKIETLQLGPNQSWVAEQKIELI

SEQ ID NO: 49539 - protein, 406 aa, Glycine max
  misc_feature (330)..(330): Xaa can be any naturally occurring amino acid
MATLFQGLGVVNPSLSSSNSNNFLLPSRTSLSERKDGIFVVRSDARVSSKVLKAGARKHELLVTNAVATKEGSSAASTSKSGHELLLFEALREGLEEEMERDPCVCVMGEDVGHYGGSYKVTKGLATKFGDLRVLDTPIAENSFTGMGIGAAMTGLRPVVEGMNMGFLLLAFNQISNNCGMLHYTSGGQFKIPIVIRGPGGVGRQLGAEHSQRLESYFQSIPGIQMVACSTPYNAKGLMKAAIRSENPVILFEHVLLYNLKERIPDEEYVLSLEEAEMVRPGEHVTILTYSRMRYHVMQAAKTLVNKGYDPEVIDIRSLKPFDLHTIGNXSVKKTHRVLIVEECMRTGGIGASLTAAITENFHDYLDAPIVCLSSQDVPTPYAGTLEEWTVVQPAQIVTAVEQLCK

SEQ ID NO: 49540 - protein, 294 aa, Nostoc punctiforme PCC 73102
MGDFGNVLTAMITPFKADGSVDYGVAAELAVHLANNGTDTLVMCGTTGESPTLSWDEEYQLFVEVLQSVAGKAKVIAGCGSNSTKEAIAATQKASKIGVHGSLQVVPYYNKPPQAGLEAHFQAIAQACPDLPLLLYNVPGRTGQNLQPETVARLAEVSNIVGIKESTGSIDQASEIRRLTPKEFHIYSGDDYMTLPLLAIGAKGVVSVASHLVGNQLQQMIQAFSAGKIEVARDIHLQLFPLFKALFLTSNPIPVKKALKLQGWEVGSTRPPLCEADLEVSQKLEGVLKELSLI

SEQ ID NO: 49541 - protein, 237 aa, Prochlorococcus marinus subsp. pastoris str. CCMP1986
MQYSSNNQTSYQKDLSETSEAFFAASVLVNLKAQVLESDVFQEETLGYEEEIGMDNQEWINQGFDMPKYPEKYLRRRSVAQPVIKRTSTLGELVSQLESIAEIIETQDLLLMKRKRNKKYSDKVLISKVQSLAHREKLPETTKALGKFLDGWEKALQWTDFEYLVNKWQTVVKSDLDKDRLGVFWALLFLSSENRIELKQQYSLYGPIQIKRIIPDGELAQLPIENLEVSETSSTAA

SEQ ID NO: 49542 - protein, 392 aa, Prochlorococcus marinus subsp. pastoris str. CCMP1986
MKAMILAAGKGTRVQPITHIIPKPMIPILQKPVMEFLLELLKEHGFKEIMVNVSHLAEEIENYFRDGQRFGVEIAYSFEGRIEDGEMIGDALGSAGGLKKIQDFQNFFDETFVVLCGDALVDLDLTEAVKNHKKKGAIASLITKKVTREQVSSYGVVVSDENGRIKAFQEKPDVEDALSDSINTGIYLFEPEIFNYIPSGDKFDIGADLFPKLVEMDLPFFALPMDFEWVDIGKVPDYWSAIRNVLLGKVRQVEIPGKEIKPGVFTGLNVAANWDKVNIKGPVYIGGMTRIEDGATIIGPSMIGPSCCICEGATIDNSIIFDYSKIGKGVQLVDKLVFGRYCVGKNGDHFDLKDASLDWLITDSRRLDLTEPSPQQKAMAELLGTDLINIPD

SEQ ID NO: 49543 - protein, 764 aa, Arabidopsis thaliana
MLTSPSSSSTYDPFSSNFSPSLTNAFSSSFTIPMGLKLSRRVTRARIFSRKIKDRSTLKVTCRRAHERVVEEEASTMTETKLFKVSSGEVSPLGVSQVDKGINFALFSQNATSVTLCLSLSQSGKDDTDDDGMIELVLDPSVNKTGDTWHICVEDLPLNNVLYGYRVDGPGEWQQGHRFDRSILLLDPYAKLVKGHSSFGDSSQKFAQFYGTYDFESSPFDWGDDYKFPNIPEKDLVIYEMNVRAFTADESSGMDPAIGGSYLGFIEKIPHLQDLGINAVELLPVFEFDELELQRRSNPRDHMVNTWGYSTVNFFAPMSRYASGEGDPIKASKEFKEMVKALHSAGIEVILDVVYNHTNEADDKYPYTTSFRGIDNKVYYMLDPNNQLLNFSGCGNTLNCNHPVVMELILDSLRHWVTEYHVDGFRFDLASVLCRATDGSPLSAPPLIRAIAKDSVLSRCKIIAEPWDCGGLYLVGKFPNWDRWAEWNGMYRDDVRRFIKGDSGMKGSFATRVSGSSDLYQVNQRKPYHGVNFVIAHDGFTLRDLVSYNFKHNEANGEGGNDGCNDNHSWNCGFEGETGDAHIKSLRTRQMKNFHLALMISQGTPMMLMGDEYGHTRYGNNNSYGHDTSLNNFQWKELDAKKQNHFRFFSEVIKFRHSHHVLKHENFLTQGEITWHEDNWDNSESKFLAFTLHDGIGGRDIYVAFNAHDYFVKALIPQPPPGKQWFRVADTNLESPDDFVREGVAGVADTYNVAPFSSILLQSK

SEQ ID NO: 49544 - protein, 474 aa, Escherichia coli CFT073
MQHKLLINGELVSGEGEKQPVYNPATGDVLLEIAEASAEQVNAAVRAADAAFAEWGQTTPKARAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINVLFGRGKTVGDPLTGHPKVRMVSLTGSIATGEHIISHTAPSIKRTHMELGGKAPVIVFDDADIEAVVEGVRTFGYYNAGQDCTAACRIYAQKGIYDTLVEKLGAAVATLKSGSPDDESTELGPLSSLAHLERVSKAVEEAKATGHIKVITGGEKRKGNGYYYAPTLLAGALQDDAIVQKEVFGPVVSVTLFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 49545 - protein, 208 aa, Prochlorococcus marinus subsp. pastoris str. CCMP1986
MKDFLQKVNSYIKEAFSAGKYLYDGFTVTFDHLRRRPVTVQYPYEKLIPSERYRGRIHYEFDKCIACEVCVRVCPINLPVVDWVMNKETKKKELRNYSIDFGVCIFCGNCVEYCPTNCLSMTEEYELATFDRHNLNFDNIALGRLPTNVTTDPSVKPLRELAYLPKGVMDPHEVPPSDVRVGKLPEEVYDWMKPKLNDIKNPTVEPNK

SEQ ID NO: 49546 - protein, 865 aa, Magnaporthe grisea 70-15
MESTLPLPFIVDASVNLNGEAGLSKEQLACLGTIFFEVTPQNLGDVRSFLQPGTSAFEPYLDVTQLESANDILSLLDSGARKVFVKPEQLKDYEEHGSRVGQAVDGTSLQVSAAENGLLVSGIDASGDVSTLVQQFNSKKGSPLFIRPADGADLELCAALARQVHATVILPSSRLTACTKDATGGKVSISKLLASNWTSDRGDKLLPTVVTDDNGIALGLVYSSEESIGEALRTCTGVYQSRKRGLWYKGATSGDTQELVRISLDCDNDALKFVVRQKGRFCHLDQFSCFGNLGGIAKLEQTLTQRRESAPAGSYTARLFSDEKLLRAKIMEEAEELCDAKTKENVAFEAADLIYFALTKAVASGVSLSDIERNLDAKSWKVKRRTGDAKGKWAEKEGIKPSAPSALAPAPAPAATEATSDRIAMKVLDVSQSSVADIQEALKRPSQKSSDAIMKIIGPIVDDVHTNGDKAVLSYTHKFEKATSLTSPVLKAPFPEEMMRLSPETAKAIDISFENIRKFHAAQKEDKPLRVETMPGVVCSRFSRPIERVGLYVPGGTAVLPSTALMLGVPAMVAGCQRIVLASPPRQDGTVTPEIVYVAHKVGAESIVLAGGAQAVAAMAYGTESVTKVDKILGPGNQFVTAAKMLVSNDTNAGVGIDMPAGPSEVLVIADCDANPAFVASDLLSQAEHGVDSQVVLIAVDLDEAGLKAIEDEVHRQAMALPRVDIVRGSIKHSITISVRNIEEAMRISNDYAPEHLILQLKNAEAVVDMVMNAGSVFIGQWTPESVGDYSAGVNHSLPTYGYAKQYSGVNLGSFVKHITSSNLTADGLRNVGEAVMQLAKVEELEAHRRAVSIRMEYMNKQANQ

SEQ ID NO: 49547 - protein, 472 aa, Escherichia coli O157:H7 EDL933
MVTINTESALTPRSLRDTRRMNMFVSVAAAVAGLLFGLDIGVIAGALPFITDHFVLTSRLQEWVVSSMMLGAAIGALFNGWLSFRLGRKYSLMAGAILFVLGSIGSAFATSVEMLIAARVVLGIAVGIASYTAPLYLSEMASENVRGKMISMYQLMVTLGIVLAFLSDTAFSYSGNWRAMLGVLALPAVLLIILVVFLPNSPRWLAEKGRHIEAEEVLRMLRDTSEKAREELNEIRESLKLKQGGWALFKINRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFVGITFWLIPETKNVTLEHIERKLMAGEKLRNIGV

SEQ ID NO: 49548 - protein, 537 aa, Arabidopsis thaliana
MELSLLRPTTQSLLPSFSKPNLRLNVYKPLRLRCSVAGGPTVGSSKIEGGGGTTITTDCVIVGGGISGLCIAQALATKHPDAAPNLIVTEAKDRVGGNIITREENGFLWEEGPNSFQPSDPMLTMVVDSGLKDDLVLGDPTAPRFVLWNGKLRPVPSKLTDLPFFDLMSIGGKIRAGFGALGIRPSPPGREESVEEFVRRNLGDEVFERLIEPFCSGVYAGDPSKLSMKAAFGKVWKLEQNGGSIIGGTFKAIQERKNAPKAERDPRLPKPQGQTVGSFRKGLRMLPEAISARLGSKVKLSCKLSGITKLESGGYNLTYETPDGLVSVQSKSVVMTVPSHVASGLLRPLSESAANALSKLYYPPVAAVSISYPKEAIRTECLIDGELKGFGQLHPRTQGVETLGTIYSSSLFPNRAPPGRILLLNYIGGSTNTGILSKSEGELVEAVDRDLRKMLIKPNSTDPLKLGVRVWPQAIPQFLVGHFDILDTAKSSLTSSGYEGLFLGGNYVAGVALGRCVEGAYETAIEVNNFMSRYAYK

SEQ ID NO: 49549 - protein, 246 aa, Candidatus Pelagibacter ubique HTCC1002
MTNKYMYFVANWKMYGNLSSLNTLDKVIRFSKSKEIKGGRLIYCPPNTLISSFAKKFNNCQIGIGGQNCHESKDYGAHTGHVNSRMLKNIGAHFVIIGHSENRKQGESDKLINLKIKSALEAKLKVIFCIGETLSEKRKKKTRSILSKQIKIGLKNIKNKSNIFIAYEPVWAIGSGIIPKSYDLFKTIEFIKSKFRDKLPKVLYGGSVNPENITNLKKINNIDGFLIGGASQSAKKFIDIVKKTYS

SEQ ID NO: 49550 - protein, 267 aa, Zea mays
MGDAYAKRVLLTAAGDTVSRGIACTLTKHGCRLVLLGDEGALAATEEEARRCGVGGGCVELVGLDFKACGEAAADAAVDRAWRCFAGLDAFVNCYSYEGEVQDCLSISEDEYMKTIKVNVITPWFLMKAIAKRFQDTKSGGSIVFLTQIIGAERGLYPGAAAYGTSLGAIHQLVRLCAMELGKHKIRVNAACRGLHLQDKFPLSVGKEKAEKATAEVMPLRRWLDPEKDLASTVLYLVGDESRYMTGTTILVDGAQSIVRPRLRSFM

SEQ ID NO: 49551 - protein, 119 aa, Oryza sativa (japonica cultivar-group)
MEIESVKCECCGLREDCTQDYIASVRASFYGQWLCGLCCEAVRDEAGRKKAHPGVEEAVRAHMAFCRMFRSNPAVRVADGMRQMLRRRSGDMSKPDTSKKYSTVQIVKHGLVRNRAKIV

SEQ ID NO: 49552 - protein, 487 aa, Hordeum vulgare
  misc_feature (231)..(231): Xaa can be any naturally occurring amino acid
MLPSFSPAVTAAAMAPPPPKPIPGGYGAPVLGPLRDRLDYFWFQGPEEFFRRRAAQHRSTVFRANIPPTFPFFVGINPRVIAIVDTAAFTALFDPELVDKRDCLIGPYNPSDSFTGGTRVGVYLDTEEPEHERTKAFAMDLLRRSSRVWAPEFLEGVDGMLAAIESDLAAGKEGGASFLVPLQRCIFRFLCRSVASADPAAEGLVDRYGLFILDVWLGLQLLPTQKVGAIXQPLEELLLHSFPFPSILAKPGYDLLYRFVAKHGAESVAVGVTNHGMSEKDAINNILFLLGFNAFGGFSVFLPFLILQIGKDAALRARLRDEVRAALDQHDGEVGFASVKGMPLVRSTVYEVLRMNPPVPLQFGRARRDFVLRSHGGEGFSVAGGEMLCGYQPLAMRDPEVFERPEEFVADRFVGAGGEALLRYVYWSNGPETGEPALGNKQCAAKDVVIATACMLVAELFRRYDDFECTGTAFTSLKKRPQPQPSS

SEQ ID NO: 49553 - protein, 485 aa, Gibberella zeae PH-1
MSYRIPIGSTAGQHLLDPWTHGIGIMRDVCSRWSELDITQIGSLIAIAGTVPTAWRFLNTLWHEAYGTIRRFFLASVTVPGGDPLNRSVVKWIMANRERHYRSFHGRTDVGQNGDRAAALKKTRHSIQYSPHWNTRWLFWGGNLFLVTRRVDDFSSSLSDPSYDGIGGEEITVSCFGWSAEPIKSFIESCREYSDRQTQFFVIIYARDRYGLSWKPKARKPIRYLETVHFDNETKQDLLGDIRNYLDPKTQKRYQSRSMPYRRGYLFYGPPGTGKSSLSVAIAGEFGLDLYEVKIPSVATDADLEQMFQEIPPRCVVLLEDIDAVWTDRSNSDNGQENSSAPNCTLSGLLNVLDGVGSVEGRIIIMTTNHPEQLDSALVRPGRVDMKVLLGNISRKSAEEMFIRMFSPDLGCTAHMDMDEIKELAAQFAKEVPDDTFTPSLLQGFFQLHLESPHDAASSIGAWVKKELERSSEKEFEVITGKRRV

SEQ ID NO: 49554 - protein, 381 aa, Prochlorococcus marinus subsp. pastoris str. CCMP1986
MDTHKLILKPGLEGVPVTNSSICDIDGQKGKLLYRGYSIEELAQKSSFLETAFLLIWGELPSATELRDFEQEVQMHRRLSFRVRDMMKCFPATGHPMDALQSSAASLGLFYSRRAIDDPKYIYNAVIRLIAKIPTMIAAFQLIRKGQDPIQPRDDLSYSSNFLYMLTEKEQDPIAAKVFDRCLILHAEHSLNASTFSARVTASTLTDPYAVIASAVGTLAGPLHGGANEDVIAMLEDIKTPEKAASFLEDAIQNKSKIMGFGHREYKVKDPRAIILQKLAEELFVRFGKDEMYEVAKKLELEAIPRLGGKGIFPNVDFYSGLVYRKLGIPRDLFTPIFAISRVAGWLAHWREQLGANRIFRPSQIYTGSAPRDWITLENRK

SEQ ID NO: 49555 - protein, 516 aa, Escherichia coli CFT073
MFMATYMTFSLKQSGRAMSKHDTDTSDQHAAKRRWLNAHEEGYHKAMGNRQVQMIAIGGAIGTGLFLGAGARLQMAGPALALVYLICGLFSFFILRALGELVLHRPSSGSFVSYAREFLGEKAAYVAGWMYFINWAMTGIVDITAVALYMHYWGAFGGVPQWVFALAALTIVGTMNMIGVKWFAEMEFWFALIKVLAIVTFLVVGTVFLGSGQPLDGNTTGFHLITDNGGFFPHGLLPALVLIQGVVFAFASIEMVGTAAGECKDPQTMVPKAINSVIWRIGLFYVGSVVLLVMLLPWSAYQAGQSPFVTFLSKLGVPYIGSIMNIVVLTAALSSLNSGLYCTGRILRSMAMGGSAPSFMAKMSRQHVPYAGILATLVVYVVGVFLNYLVPSRVFEIVLNFASLGIIASWAFIIVCQMRLRKAIKEGKAADVSFKLPGAPFTSWLTLLFLLSVLVLMAFDYPNGTYTIAALPIIGILLVIGWFGVRKRVAEIHSTAPVVEEDEEKQEIVFKPETSS

SEQ ID NO: 49556 - protein, 215 aa, Oryza sativa
TGVTGGDQVAAAMGIYGPRTTYIIALKDCPGTHEFLLLDEGKWQHVKDTTTIGEGKMFSPGNLRATFDNPEYDKLINYYVKEKYTLRYTGGMVPDVNQIIVKEKGIFTNVTSPTAKAKLRLLFEVAPLGFLIEKAGGYSSDGKQSVLDKVINNLDERTQVAYGSKNEIIRFEETLYGSSRLPAGAHHVGASRLIFCCNASPVSLQASKTLKLQSF

SEQ ID NO: 49557 - protein, 153 aa, Arabidopsis thaliana
MEYSRDSAEMMMETKRNVYSLEDNKIKRHKSSDLSFSSKERKDKLAERISALQQLVSPYGKTDTASVLLEGMQYIQFLQEQVKVLSAPYLQATPSTTEEEVEEYSLRSKGLCLVPLEYTSEVAQTNGADIWAPVKTPTSSHAFNLSSSNSPFQ

SEQ ID NO: 49558 - protein, 745 aa, Gibberella zeae PH-1
MSAVASHVVPPRSKLDSILSSGLEHNIDHDPLEVWDKGVFLNELLKQGIALSTNENGTLDGELVADEGLKKGSYKGTRLALTEIYSILEDAAVSHFDKRGYEPIFPVKRELDLKKRIYQWSDGTDGYPPHLKVDGNDEANLPADERQSKPGSARSEGVGQIFDMQETAFVSKIAQAVSFIIPKDIDHENTPYKGPTLADVEKFNKAQFPKTDGDASNQDNLNKAADIMKGRNIGEYDDWYSDARFAQQHFSGVNPSTIETASQDKIKEYISEAQKQGLDKVKAILEDGKDILIQDYSYFREATGATNEQIFQNTVYELKGTTPTGKTTSRYAAASVVIFQLHEDGRLHPLAITLDYKGSLDNSITIFNRRLSPDDTCDIAEKEDWPWRYAKTVAQTADWARHEVATHLVDTHMIEEAIIVATNRIIPEGELLYEILSPHWFRTLSLNAAARKLLVPGVIARIAGFGPTSPSLDFKGNNAFKLIDWSYKNFNFQDKYIPNDLKKRGFDIKGDKSGKYKNYPYANDMYLLWGIIRNFVKTVIESQYTSDHVVQKDPYIGGWCKEIQTNGQIPTFPTITTVEQLIDAVTMCIHTASPQHTAVNYLQDYYYSFVPAKPPALCTPLPQDLSALQGYTEKDLTAALPIGTEDMKWKDWLLAAQLPELLSYKVQQDYNLITYAKSLYNVNKNRTITENTKFNCKTIKKAAADFYSHLKSAGVEFENYSKGQTAGTVEYPVLQPETTAISILI

SEQ ID NO: 49559 - protein, 543 aa, Blastopirellula marina DSM 3645
MTAAPSLTQTAAWQALQSHYDQLADVQLRDLFANEADRGEKFSLDAVGIYLDYSKNRITAETVSLLIALAEASGLRQRIDAMFRGDKINVTEDRAVLHTALRAPQGATIDVDGENVVPAVHAVLDKMAAFAAKIRGGDWRGQTGKPIKNIINVGIGGSDLGPAMAYDALKHYSDRNLTFRFVSNIDGADMAEAIHDLDPAETLFIIASKTFTTQETLTNAHTARLWCLETLKDEAAIAKHFVALSTNEKEVAKFGIDTANMFEFWDWVGGRYSFDSAIGLSLMIAVGGDHFREMLAGFHEMDEHFRTAPLDQNIPVLMALLNLWYNNFFGAQTQAVLPYDHYLGKFSMYLQQLDMESNGKRVTLDGSPVDYQTGPIVWGTPGTNGQHAYYQLIHQGTKLIPCDFIGFCQSLNPLGDHHDKLMANFFAQPEALAFGKTAAEVKADGVADFQISHRTFPGNRPTNSLLIDKLTPAALGKLIALYEHKVFTLGTIWRVNSFDQWGVELGKVLANRIVPELTSKSEPALEHDSSTNALIARYRKLKR

SEQ ID NO: 49560 - protein, 357 aa, Prochlorococcus marinus str. MIT 9303
MRQHRIVLLPGDGIGPEITAVAKLLLDAAGEQHGFKLNFEQHPIGGVAIDASGSPLPASTLEACQASDAVLLAAIGSPRFDALPREQRPETGLLSLRAGLKLFANLRPVTILPALIDASSLKANVIKGVDLMVVRELTGGIYFGQPKGRIEADGDERAFNTMTYSRTEVDRIAKVAFDLARDRSGKLCSIDKANVLDVSQLWRDRVDALAANYGDVELSHMYVDNAAMQLVRNPRQFDVLLTGNLFGDILSDEAAMLTGSIGMLPSASLGSEGPGLFEPVHGSAPDIAGQDLANPMAMVLCAAMMLRIGLKENDAATALEGSVERVLAAGFRTGDLMSEGCTQLGCAGMGEQLLQAL

SEQ ID NO: 49561 - protein, 1191 aa, Oryza sativa
MAANFSACLVPVAVLALFYLVIFPNDLSQLKSALAPCDAASKSVAAAAAADDDVDFRMFFGILTRPDFYERRALLRMAYALQPPPRRAAIDVRFVMCSLDKEEDAVLVAMEIITHGDILVLNCTENMNDGKTYDYFSALPRLFPAGAEPRYDFAGKIDDDTYYRLGALADTLRRKPRRDMYHGFLNPCHIDPAWQYMSGMGYIVSWDVAEWIAASPELRGREIGYEDDVFGRWLRGAGKGKNRFGEEPRMYDYLDREMYGADVNCFRHELIADTVAVHKLKDRLKWARTLRFFNATDGLKPSKMYHLGMSNKMDGVGVETMQEPMPSTKNMLSWPFASHAPWLIPSLYIWRGAWQGSAPPQPPLPLLYAYDAAASAFPMAQMKQGLDHSAIELSDLQERGMDFHPPGAQQPVNIDSGDEEAPTVRTEKRLTWSTEEDIRLVSAWLNNSNDSISGNFKKNDRYWGDVTAEYNSTTPKNRTRQEKQIKDRFHKIKKNVGRFCCVYKEVKSIYVSGQNDMQLREKAEATYQADYKEGPFSFLHCWNILRDQPKWHAYLEELEKPNKPKMDDEVEVMEQMSTPNSPEDIKRPIGTKTAKAQRNGKGKRKRKAKVYLSDTDDEIDKLKEVQEMANKGRDELLETQRRVASDNLESKKLAHLAAMEHKEAVMLETYQSLMLQNTKDMPDDVRSEHLMALKVMEKIKTKLRIGKIRRKSATRKTIKRDHTAAHHRLIADYFSEDPLYLESIGRQGLSPLQKCTAAMRMLAYGSPADSLDEYLKIGKSTSLQCLDMFARGVIEVFGSEYLRRPTYEDVERMLQVNESRGFPGMLGSIDCMHWRWEKCPTTWRGQFTRGDYGVPTIILEAVATRDLRIWHAFFGVAGIDWAIMMAMKKSFSLLFFLPFLLLAIIYFVIFPNEFRLQSSLAACGDSAPATAADAVAKAAPDIRVLLGVLTRADKYERRALVRLAYALQPAPARAVVHVRFVVCNLTAEEDAALVGLEIAAYGDIIVLDCTENMDNGKTYTYFSAVPRLFAGEPYDYVGKTDDDTYYRLGALADALRDKPRRDAYYGFLTPCHADPRTQYMSGMGYVVSWDVAAWVAATPELQNDLKGPEDKLFGRWLRWGGRGRNVFGAEPRMYDYLDGGMRHGPTCFRHLLQADTVAVHKLKDNLKWARTLNFFNATEGHKASPLFHVDH

SEQ ID NO: 49562 - protein, 226 aa, Magnetospirillum magnetotacticum MS-1
ASVRTNYWGYSTLGFFAPHAAYATRAAQDAGPAAVLDEVRGMVHLLHEAGIEVLLDVVHNHTCEGGADGYHLSWRGLDNAGYYLHDGGTPARLADVTGTGNSLDYRRPAVVRAALDSLRYWAEVVGVDGFRFDLAVTLGRGATGFDPDHPFLVALQTDPVLCGLKLVAEPWDVGPGGWRTGQFPPPLAEWNDRFRDAARQFWLADAREASHGRPGHGVRDLATRLA

SEQ ID NO: 49563 - protein, 337 aa, Lentinula edodes
MAVKVGINGFGRIGRIVLRNALLNPEVNVVAVNDPFIALEYMVYMFKYDSVHGRFKGTVETKGGKLIVDGKEISVFGEKDAGAIPWSSVGAEYIVESTGVFTTIEKASAHLKGGAKKVIISAPSADAPMYVCGVNLDSYDSQHAVISNASCTTNCLAPLAKVIHDKFGIVEALMTTVHATTATQKTVDGPSNKDWRGGRSVNGNIIPSSTGAAKAVGKVIPSLNGKLTGLAFRVPTLDVSVVDLVCRTEKSATYDEIKAAVKEASKGPLKGILGYTEDHVVSTDFIGDNHSSIFDATAGIQLNKNFVKLIAWYDNEWGYSGRVVDLLVFAAKKDGAL

SEQ ID NO: 49564 - protein, 180 aa, Triticum aestivum
YLPCALAPPVMALSGTSVAPFQGVKSTAGLPVSRRSNGGSLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 49565 - protein, 140 aa, Desulfitobacterium hafniense Y51
MGWKISQLQVISDKGDLIMKEIRTAKAPGAIGPYSQGFISGDLVYTSGQIPVDPTSGDVAAGIAGQAEQSCKNVGAILEAADSDFSKVIKTTCFLTDMNDFAAFNEVYARYFVSKPARSCVAVRALPKGVLCEIEAIAEL

SEQ ID NO: 49566 - protein, 661 aa, Oryza sativa (japonica cultivar-group)
MGARWGPRRATVGPHLRDALRHLLFVFLVLLQAQAGRGGATLNGEGMALLELRERVEADPHGALRDWDPADATPCRWSGVHCFDGKVEILNLTGRELVGTLAPEIGRLQLLKSLILRNNNFRGKIPKEFGGLTALEVLDLSSNNLDGTIPEELMAMPLLKQLSLHDNQFQDDISSLHIQDISDEQAGCLSRKLGCWYVGYFGLGEPHIMQNLQSFASAVGRRLLGEVGNLPALSGNYAKSSGPVNSEEIQRAIDVLSLGSGSFSAFPNSEAEVLESAVNTDAAAMQSGAANQSTDEVSGSKHSKWAYFMIIPAAILLISLIVAPILVWRKRGRAAIGPWKTGLSGPLQKAFVTGVPKLNRPELEAACEDFSNIINTFPSCTVFKGTLSSGVEISVVSTAILSLKEWPKSSETCFRKQIDTLSRVNHKNFINLLGYCLENQPFMRMMVFEYAPNGTLSEHLHLKEFEHLDWAARMRIIMGVAYCLQYMHHDLNPPVAITDMRSDTIFMTDDYAAKIADVGIWKEVAIKAKTAKEDSSSRSECPPDIASNVYCFGTLLIEIISGKLPEADDQKSMCNWAAEYLKGKSYSKLVDASLKEHNANELEAVCEVIQECIDPDSDQRPTMRDATRKLRQALNISPEAATPRLSPLWWAELEILSAEAT

SEQ ID NO: 49567 - protein, 461 aa, Burkholderia xenovorans LB400
MQADRTFNIATLIEEQKTGRFAVGLLFWCFLIMLMDGYDQTAVSFAAPAIIKDWHVARGGFGPVFGAGLFGTLVGSFIFGYLGDRLGRKKAIVIGSLFFGVLTWASVWATSLQELMLLRFLAGIGMGGVVPNSVALVAEYAPKRLRATWVTLMFSGFSIGAGSGGLVSSALIHRFGWPVMFAVGGGGSLLVAVLLIFTLPESARLLVVRQRGEETVRALVARLRPDLNIPADAQFVPGEVREKQRFVFRLIFSDGLASITLLLWIVFIANSMALYFLQNWLPILIEGMGVDPRGAGLITTMFSAGGVIGGLILCRFVDRHGVLAIISLPAIGFPVVALLGHGSSQTWLMVAVFAAGFCVVGAQYGLYAVAGMIYPTSFRSAGVGSAISVGKIGSVSGPVVGGLLLSMHLPITQLFYSASLLFVVAAVFSTVLALLYRARFGAQHAAQAAMEPMRRSLARDS

SEQ ID NO: 49568 - protein, 312 aa, Brassica napus
MRPPLTGGRGGGGFSGGRGGGGFSGGRSGGRGRGFGDRGGGRSGRGMRGRGERGRNGRGAPGRGGMKGGSKVIVEPHRHPGVFIAKGKEDALVTKNLVPGEAVYNEKRISVQNEDGTKTEYRVWNPFRSKLAAAILGGVDNIYIKPGAKVLYLGAASGTTVSHVSDIVGPEGCVYAVEFSHRSGRDLVNMAKKRTNIIPIIEDARHPAKYRMLVGMVDVVFADVAQPDQARIVALNSSFFLKTGGHFIISIKANCIDSTVPAEAVFQSEVKKLQQEQFKPAEQVTLEPFERDHACVVGTYRAPKKAKAATAA

SEQ ID NO: 49569 - protein, 625 aa, Arabidopsis thaliana
MPNSILFLLLSFLYLTNCVAQSPSQTCPLDFSHVLTIPWNTTDCQKSDKSADSKNSCCQSLLTLIGIPLAHRLKQTSNFRLPNLATSISCLNNLQTKLSSLSLSSNLTSLCFDPNQFVINNETCAGIQTTQDWVSRLGPSTALDSACSSGLTDLTRCDACVAAGFRVQKQLITLDGNSSHGVYCYHFVVTYAAGIVNKKGPESDDALSCLFSLSLRSPLNSKKKRHTVALALGITGAIFGALVIAGLICLYFRFGKAVKGGEVGWEDQGSRPKWRPNTGSIWFKIEELEKATNNFSQKNFIGRGGFGFVYKGVLPDGSVIAVKKVIESEFQGDAEFRNEVEIISNLKHRNLVPLRGCSMVDDDSESQRYLVYDYMSNGNLDDHLFPRGETTKMPLSWPQRKSIILDVAKGLAYLHYGVKPAIYHRDIKGTNILLDVDMRARVADFGLAKQSREGESHLTTRVAGTHGYLAPEYALYGQLTEKSDVYSFGVVILEIMCGRKALDLSTSGSPNTFLITDWAWSLVKAGKTEEALEQSLLREEGSGLSNPKGIMERFLQVGILCAHVLVVLRPTILDALKMLEGDIEVPPIPDRPVPLAHPSYRMDGNGFTISPALSGLQIHSGDMLR

SEQ ID NO: 49570 - protein, 97 aa, Arabidopsis thaliana
  misc_feature (31)..(31): Xaa can be any naturally occurring amino acid
  misc_feature (37)..(37): Xaa can be any naturally occurring amino acid
  misc_feature (39)..(39): Xaa can be any naturally occurring amino acid
  misc_feature (43)..(43): Xaa can be any naturally occurring amino acid
  misc_feature (47)..(47): Xaa can be any naturally occurring amino acid
  misc_feature (49)..(49): Xaa can be any naturally occurring amino acid
  misc_feature (56)..(57): Xaa can be any naturally occurring amino acid
  misc_feature (60)..(60): Xaa can be any naturally occurring amino acid
  misc_feature (62)..(63): Xaa can be any naturally occurring amino acid
  misc_feature (65)..(65): Xaa can be any naturally occurring amino acid
MASSMLSSATMVASPAQATMVAPFNGLKSSXAFPATXKXNNDXTCMXSXGGRVNCXXVWXAXXKXKGLVWIGGPLSPFRAPVAWVVSDAKARGEGTA

SEQ ID NO: 49571 - protein, 133 aa, Glycine max
MSPSNGLQNGGGGGGNGVSYIEHQVSKLDTLAGVAIKYGVEVADIKRMNGLATDLQMFALKTLKIPLPGRHPPSPSPGPHEEPTKSGDASSERKPLRIGQSAMKEPLQSLRLKPPQPNISPAMSILQKFYGLK

SEQ ID NO: 49572 - protein, 67 aa, Glycine max
HFFFFFVVTLQQPGYDIIAQFMIGYVLPGKPIANLLFKIYGRISTVHARSFLSDLKLGHYMKIPPRC

SEQ ID NO: 49573 - protein, 352 aa, Haemophilus somnus 2336
MSINFVKEGNIMSKYVRSVCLVEPKKVDIKTVLYPKKGECDVLIKVESIGICGSDIGAFRGTNPLVTYPRILGHEIVGTVIEAGVGMPKNINIGDRVILEPYIYCGHCYPCSISRTNCCEALKVLGVHIDGAMQEIVRHPAHMLIKAPDIPIHELALAEPLTISLHAIRRTKVKAGEHVAIIGAGAIGLMAALVAKAYGATPILIDILDKRLDYAKSIGIPNIINPAKENDLEAIKSITNGRMAEVVIEASGANIAVQNTLKYTSFAGRIALTGWPKNETPLPTNLITFKELNIYGARTSKGEFEEALKLLESRKIEPKNIISKVITFDEIPHYIEELSENPDDYLKIIAVF

SEQ ID NO: 49574 - protein, 557 aa, Acinetobacter sp. ADP1
MNKNIEQFPRKTTLTPQQKLEQLMEQHKTVHLTELFDKEQDRFAKYCVGCEDLVFDFSKQRINQPILDALVQLAESKQLNKWIDTLFSQNKINYTEQREAMHWALRLPADNQVYPELAKQVSDQLERMYQLVNKIHEGQYRGATGEVIQDVVNIGVGGSDLGPLMVSHALSDFKVKTAKPLNIRFVSTMDGSQLSDILHQLRPETTLFIVSSKSFSTIDTLSNAHTARKWLEKALGRESSILKSHFIGVSTKPDKMTEWGIHPDNQFLLWDWVGGRYSLWSCIGLPIALTIGVEGFKAFLAGAHGIDEHFRTTEFHQNIPVLMGLMGIWNTNYLNLKTHAVLPYDGRLKYFTSYLQQLEMESNGKSTQRNGQKVENTTCPIVWGEVGPNAQHAFYQLLHQGTQKVSCDFIAPMHRYNANHFTYVENADALIDQHLLALSNCLAQSRLLAFGNDALKVDQREQLPAYKQYEGNQPSTTMLLKELSPRTMGKLIALYEHKVFVQSVIWDINPFDQWGVEKGKEIANDLLPILNGESSDLSHLDDSTQGLIQFLLGKSNG

SEQ ID NO: 49575 - protein, 395 aa, Prochlorococcus marinus subsp. pastoris str. CCMP1986
MAQLETRTEPMVVNFGPHHPSMHGVLRLVVTLDGENVIDCEPVIGYLHRGMEKIAENRTNVMYVPYVSRMDYAAGMFYEAIVVNAPERLANIVVPKRASYIRVLMLELNRIANHLLWLGPFLADVGAQTPFFYIFREREMIYDLWEAATGQRLINNNFFRIGGVACDLPYGWLEKCIDFCDWFAPKIDEYEKLITNNPIFKKRIEGLGTIERDQAINWSLSGPMLRASGVSWDLRKVDSYECYDDFEWEIASEKEGDCYARYRVRVQEMRQSLKIIRQACEMIPGGPTENLEAKRMATEDKKSEIFGMDYQYVAKKVAPTFKIPNGELYTRLESGKGEIGVFIQGNNEVTPWRFKIRAADLNNLQILPHILKGAKIADIMAILGSIDVIMGSVDR

SEQ ID NO: 49576 - protein, 249 aa, Pisum sativum
MGRGRVELKRIENKINRQVTFAKRRNGLLKKAYELSVLCDAEVALIIFSTRGKLYEFCSTSNMLKTLDRYQKCSYGAVEVSKPAKELESSYREYLKLKQRFENLQRTQRNLLGEDLGPLSSKDLEQLERQLDSSLKHVRSTKTQFMLDQLADLQNKEHMLVEANRSLSMKLDEINSRNQYRQSWEAGDQSMQYGDQQNAHSQSFFQQLDCNPTLQIGSDYRYNNVASDQIASTSQAQQQVNGFVPGWML

SEQ ID NO: 49577 - protein, 181 aa, Vibrio vulnificus CMCP6
MTTNTIAQIQASIKSIPDYPKPGILFRDVTSLLEDAQAYQATIQLLVDKYKDMGFTKVVGTEARGFLFGAPLALQLGVGFVPVRKPGKLPRNTIAQSYELEYGVDTLEIHTDAIVEGDKVLVVDDLLATGGTIEATTKLIRQLGGVVEHAAFVINLPEIGGDKRLEGLGLNVYSICEFEGH

SEQ ID NO: 49578 - protein, 436 aa, Yarrowia lipolytica CLIB122
MTQGNIGAWQKSVGDALAPGEVLVEIETDKAQMDFEFQDDGYLAKILLDAGAKDIAVGTPIGVYVEDEADVAAFKDFTIDDAGGVPKPPKTEEQKEEEEYEAEKAEKAEKEAEASKETASPAPSSQSSAPAAPTPPSSRIFASPMAKTIALEKGIKLSEIKGSGPGGRIIKRDVENWTPPAAPAAKAAPAKGAAPAAAAAAGSAYTDIPLTNMRKTIASRLTQSKNTSPDYIVSSTVSVSKLLKLRAALNASSDGTYKLSINDLLVKALAVANTKVPQVNSQWLESEGVIRQFTNVDVSVAVATPTGLITPVVKNANLKGLAEISKEIKALGKKAKDGKLAPEEYQGGTVTISNLGMNHAVSFFTAIINPPQAAILAVGTTERKAIEDVDSEAGFVFDDVVTLTTSFDHRVVDGAVGGEWVKALKQVVENPIEMLL

SEQ ID NO: 49579 - protein, 181 aa, Solanum tuberosum
MASSIVSSAAVATRSNVAQASMVAPFTGLKSAASFPVTKKNNNVDITSLASNGGRVRCMQVWPPINMKKYETLSYLPDLSDEQLLKEVEYLLKNGWVPCLEFETEHGFVYREHNSSPGYYDGRYWTMWKLPMFGCTDGTQVLAEVQEAKNAYPQAWIRIIGFDNVRQVQCISFIAYKPEGY

SEQ ID NO: 49580 - protein, 285 aa, Xanthomonas axonopodis pv. citri str. 306
MSANDNWYIEHFQPTGSAIGFRISGKLDEVQSPFQKIEIYQTTDWGKLMLIDGAVMLTSRDNFFYHEMISHPALFTHPAPKRVVIIGGGDCGTLREVLKHPGVESATQCDIDEQVTRMSEKYFPELCDSNHDARAELLFDDGVAYMANCQAGSVDIVIVDSTDPVGPAEGLFNKAFYESCFKALKDDGILVQQSESPLALLDLINEMRTEMGKAGFQSFKTLPFPQPCYPTGWWSVTMASKQAKADFAFRQDAAQAKGFDTLYYTAHLHTGVLVAPPFVAKALGE

SEQ ID NO: 49581 - protein, 173 aa, Lemna gibba
MMVSTAAVARVRPAQTNMVGAFNGCRSSVAFPATRKANNDLSTLPSSGGRVSCMQVWPPEGLKKFETLSYLPPLSVEDLAKEVDYLLRNDWVPCIEFSKEGFVYRENNASPGYYDGRYWTMWKLPMFGCTDASQVIAEVEEAKKAYPEYFVRIIGFDNKRQVQCISFIAYKPT

SEQ ID NO: 49582 - protein, 144 aa, Zea mays
  misc_feature (18)..(18): Xaa can be any naturally occurring amino acid
  misc_feature (38)..(38): Xaa can be any naturally occurring amino acid
  misc_feature (72)..(72): Xaa can be any naturally occurring amino acid
  misc_feature (84)..(84): Xaa can be any naturally occurring amino acid
  misc_feature (109)..(109): Xaa can be any naturally occurring amino acid
  misc_feature (114)..(114): Xaa can be any naturally occurring amino acid
  misc_feature (135)..(135): Xaa can be any naturally occurring amino acid
TWHTGKLEVLLISTNGLXDTDSLNNMGGLAILTCRTEXQKSRGSNGAGRELEWNETFTFTESDYTPQLHIKXMDSDLTNTRSVXEATMLLEAEFQEGRLPSADHPVVKXDKDCXEVKLVLTLTPSVETGRPYDNXEGSSYSSWS

SEQ ID NO: 49583 - protein, 339 aa, Pseudomonas putida KT2440
MSNESINWDKLGFDYIKTDKRYLSVWRNGEWDKGTLTEDNVLHISEGSTALHYGQQCFEGLKAYRCKDGSINLFRPDQNAARMQRSCARLLMPHVPTDVFIEACKQVVKANEKFVPPHGKGALYLRPFVIGTGDNIGVRTAPEFIFSVFAIPVGSYFKGGMKPHNFQISSFDRAAPQGTGAAKVGGNYAASLQPGAEAKKANFADAIYLDPLTHTKIEEVGSANFFGITANNEFVTPKSASVLPGITRLSLMELAQSRLGMTVIEGDVEISKLDRFVEAGACGTAAVITPIGGIEYNGKLHVFHDLEKVGPVTQKLYNELTGIQSGDVEAPAGWIVKVA

SEQ ID NO: 49584 - protein, 553 aa, Aspergillus nidulans FGSC A4
MTDSKVSSRDQGHDAVIQRRSRAVAEQLAEQESWLEKTLKPKKVSARYPFKGKPLLYATCAFGSLGDALFGYNSGIMSGLLVNPVFVSRFFKDYGGGDGTTSAVNSSITGISVACLQASAAVGALIAGRLGDIVGRKKCVRLGGFIYFFSAFIQMFAPGFATFLAGRTIQGLGVGFLSMTVPIIQTEIASPHSRGLMVGIEYTILIAGYMLSCWVDYGFNFMLPSEMSWKGPFIVQIGLSFILLAMSFFLPETPRWLAKNGFMEESLQTVADLHANGDTQAEHVQQVFTEIQEAVIYETNLGKSTWTEMFTRYRKRTIVGITVQMFAQLNGINIISFYLPSTLASAGFDNRKSLLFTAANAIPYTAATIATWWLADKWGRKPLLILGGLGMAVLLGIVCAFTEASLPVQTKADGQYAFVMLYNIVYGFTWGPMPWLLPAEIFPLRGRSKGMALATTSNWVFNFIIGMVSPDAFSGIHGYFYLIIAGFCLFSAGLVYFYYVETANSSLEEIAALFGDRAFEDEAVVGGHIDECDIKLYDVLCTGSLNWASEMPS

SEQ ID NO: 49585 - protein, 373 aa, Aspergillus nidulans FGSC A4
MTIPLYDQLLSHQAVNEAFVLYPGGSFGYEKRDIPTLQAERDVLVRVVATGLCGSDVHYWQHGRIGRYVVEDPIVLGHESSGIVVQCGSQSGLTVGDRVVLEPGIACNTCHFCRAGRYNLCREMRFAATPPYNGTLATYYRVPAECCYKLPSHVSLRDGALIEPLSVAVHSCRLAGDMQEKSVVVFGAGPVGLLCAGVARAFGASTVVVVDVVMSRLQSAVKYGATHTHQATSESAEENAIAILGTAGLGLGADIVLDATGAEPCMNSGIHALAPGGTFVQVGLGRPNPSLPVGQICDKEIVFKGSFRYGPGDYKTAIGLVSSHRIRLEGLVTHEFSFSQAEEAFHNVASRAGVKSVIYGPGVDEHVARATLS

SEQ ID NO: 49586 - protein, 337 aa, Triticum aestivum
  misc_feature (162)..(162): Xaa can be any naturally occurring amino acid
MDADQSFLDTLGFGYTQTQPQSPIGEQATPSTQHQATPSTHQRSAIIEKGKSNKGKNWSSDEDKVLIAAWANTSLDIVGTDQNRDAYWARISEYYNTHKESSWLERNPNAINCRYTLINRETSKFCGCLQQILNKEESGRTIAEKTNDAHILFKEMDVKKNXPFTLMHCYIEFAKYPKWQTRELETSLKKQKKTIDGSPGTATNDPSDASSVRTDATSIHTDALEHEKRPDGVKKDKRGKADENACKLSLETVWAAKQEKDEIKEAARNARYAQQFELRKEEIALRKKEDARNEREDARRQFELDERVMLIDTSGMTDVQKQFYQAKQNEILARGVG

SEQ ID NO: 49587 - protein, 162 aa, Myxococcus xanthus DK 1622
MVVIIMGVSGAGKTTVGRTLAAELGWRFIDADDLHPRSNVMKMAAGAPLTDEDRAPWLRKLRDEVARALAQGEDVVMAFSGLKQAYRTLLEELDPAHVRWVFLHAPHEVLARRMSQRQGHFMPASLLESQMAAMELPSRALSVDVTPPPADIVKHIRDELGV

SEQ ID NO: 49588 - protein, 1584 aa, Arabidopsis thaliana
MAVLYHYPCHDGVFAALAAHLYFSAKSIPSLFFPNTVYSPITINQLPLQDISHLYLFDFTGPPGFVHQVSPKVDNVVILDHHKTAIDSLGDVSLTCKNVTSVLDIERSGATIAFDYFTQKLVEESRGSCKEMNDFKRMRRVFEYIEDADIWKWELPESKAFNSGILDLKIEYDFNKNQSLFDQLLSLDHESVINRGKQSLSKKHKLIHEVLEQSYEIVLGGDEEFGRCLAVNADEITELRSELGNQLAEKSKNLSLRGVGAVVYRVPELGDENKLKISLRSVAEEDTTPVSQRFGGGGHKNASSFLLNSMEFEQWKAVVSFGVEKLWELLSRESARLNGIDEQVDGLKRQLGRLQSLLKDADAKKNETERVRNFLEDVKDIVYDADDIIESFLLNELRGKEKGIKKQVRTLACFLVDRRKFASDIEGITKRISEVIVGMQSLGIQHIADGGGRSLSLQERQREIRQTFSRNSESDLVGLDQSVEELVDHLVENDSVQVVSVSGMGGIGKTTLARQVFHHDIVRRHFDGFSWVCVSQQFTRKDVWQRILQDLRPYDEGIIQMDEYTLQGELFELLESGRYLLVLDDVWKEEDWDRIKAVFPHKRGWKMLLTSRNEGLGLHADPTCFAFRPRILTPEQSWKLFERIVSSRRDKTEFKVDEAMGKEMVTYCGGLPLAVKVLGGLLAKKHTVLEWKRVHSNIVTHIVGKSGLSDDNSNSVYRVLSLSYEDLPMQLKHCFFYLAHFPEDYKIDVKILFNYWVAEGIITPFHDGSTIQDTGESYLEELVRRNMVVVEESYLTSRIEYCQMHDMMREVCLSKAKEENFIRVVKVPTTTSTTINAQSPCRSRRLVLHSGNALHMLGHKDNKKARSVLIFGVEEKFWKPRGFQCLPLLRVLDLSYVQFEGGKLPSSIGDLIHLRFLSLYEAGVSHLPSSLGNLKLLLCLNLGVADRLLVHVPNVLKEMQELRYLRLPRSMPAKTKLELGDLVNLESLTNFSTKHGSVTDLLRMTKLSVLNVIFSGECTFETLLLSLRELRNLETLSFHDFQKVSVANHGGELLVLDFIHLKDLTLSMHLPRFPDQYRFPPHLAHIWLIGCRMEEDPMPILEKLLHLKSVYLSSGAFLGRRMVCSKGGFPQLLALKMSYKKELVEWRVEEGSMPCLRTLTIDNCKKLKQLPDGLKYVTCLKELKIERMKREWTERLVIGGEDYYKGLKHICLEKSRGAFLRRSIDDIIFELVPAKSIARFRCVSESIHRRPDVTEQSLTKSMSRPRLLFALEVNKDLLFFSSPQPQNPYDNSSLVATPYKRFPKYLPTRICTTLGGLVFLQKWLRKKTRVICNPVSGDYITLPKVKATGVGESYFGFDPITKQFKVLCMTWSRYGTPNTHQVLTLETGKRLWRTIQDPILPHYRSFDRICINGVLYYGADFEESQSSKIVCFDFRFEKFSFINIADEGMFRGSYKWTLFNYKGKLGAHQYSRNGELVLWVLEDAENHKWSKSICILPPIVHNSRIVGVTGTGEIANYESNYAFSLPYFKTLTNYAFSLPYFKTLTNYAFSLPLGFHACASMPKSVALIALEDANGSVRLRTVQM

SEQ ID NO: 49589 - protein, 638 aa, Nostoc punctiforme PCC 73102
MVKSAPSPIASRKPSKVEGIKENSNFLREPVATEILQDTTHFTENAVQLLKFHGSYQQDNRDNRTKGQEKDYQFMLRTKNPGGLVPPQLYLALDKIADEYGNHTLRATTRQGFQLHGILKKNLKSAIATIVKNLGSTLGACGDINRNVMAPPAPFKNRPEYQYAWEYAQNIADLLTAQTGAYYEIWLDGEKAISAEENPEVKAARQRNGNGTIIHDNEEPIYGTYYMPRKFKICVTVPGDNSIDLYSQDLTLVVITNKKKQLEGFNIFAGGGLGRTHGKEETFARLADPIGYVAKDDVYDIVKAIVATQRDYGDRTDRRHARLKYLINDWGLDKFRAQVEEYFGKSVEAFKPLPEFKYYDFLGWNEQGDGKLFLGISIDNGRIKDEGSFQLKTALREIVEQFNLHIRLTANHNLIFYDIEPDSKQAIQDILSRHGIVDDPSKIEPLVRYAMACPALPTCGLAITESERAIPGILERVRALLDKVGLQNEHFVVRMTGCPNGCARPYLAELGFVGSAPESYQLWLGGSPNQTRLAQPYTEKLHHNDLEIFLEPIFVYFKKSRKSKEKFGDFCDRVGFDAIREFAASYDPNTANGANKSRHRVNLKEEVYSKLKEVAESQGKPMTQLVTEALEAYFQNLS

SEQ ID NO: 49590 - protein, 340 aa, Arabidopsis thaliana
MEKLKQQFSKDRLITPSSNLVRNYIDSIPVDLLIDILSRFPPKSIARFYCVSKLWESILRGPDFTELYLTKSVALRRLFFALKVNTELLVFSSPQPQIPDENSSLVVEATPYKCFPKKIPTEICTALGGLVFLGTFLSRQPLVIVNPLTGEFITLPKLKTIGTKRFSFGYDPISKKFKVLCVTWSPCGTLPNIHQVLTLETGERLWRTIHDPIEKVSFVNIDGMCNLRLFNCKGKLGVHQYDVQSRNEKLVFHVLEDAEKHKWSKSICILPSVVSGKRIVEITCTGEIVFSPSGGSLHPFYIFFYNIERKTYTRVQIKGFKKYADCVHTFLDFVEDTKLI

SEQ ID NO: 49591 - protein, 124 aa, Brassica napus
YQNSPPSESEKTLPPEEYLNKINEVRGLLGPLTKKSSEYCSDAAIARYLAARNGHVKKATKMLKETLKWRTQYKPEEIRWEDISREAETGKIYRANCTDKYGRPVLVMRPSCQVWCLKFLIPSS

SEQ ID NO: 49592 - protein, 441 aa, Salmonella typhimurium LT2
MPQPGLTTPDNDALPWQTTLLLALQHVLVVAATPITSVFLIAKALHFTDTVTASVLSATFLMCGLGAILQSLGVKGVGARLPFIMVPGGAPIAIFVAIALQTNIQTAIGAVILTSLFYFIALPIFRRCLHHFPPFIIGIMLLMVSINLIRLYGGLIIGQPGSADFAHPTSIILSLGTILITLIFALAFSGILRQLAVMFGLLAGTLLGMALGSTDFSGVSHGPLFSFPQLLPFGWPIFDLSASLPLLIYAVISMAEATGQTIATAEIVNSTQNVQQAIPRTIRGDAVMSLLGGIFGTSLIITSGENIGVVRTTNVKSRFVTAAAGGLLILIAIFAPLVRLATCLPGSVVCGTAVIVFSIIGVIGIDMIAREPLHTPGKTYALAMGLAMGMLPILVPGLYQNFPAGVQMVFGNGMAAGTLTAILVNSLFNWSEKRTQARVKS

SEQ ID NO: 49593 - protein, 278 aa, Synechococcus elongatus PCC 6301
MTLAIRPKLAFNWPTALFMVAIHIGALLAFLPANFNWPAVGVMVALYYITGCFGITLGWHRLISHRSFEVPKWLEYVLVFCGTLAMQHGPIEWIGLHRHHHLHSDQDVDHHDSNKGFLWSHFLWMIYEIPARTEVDKFTRDIAGDPVYRFFNKYFFGVQVLLGVLLYAWGEAWVGNGWSFVVWGIFARLVVVYHVTWLVNSATHKFGYRSHESGDQSTNCWWVALLAFGEGWHNNHHAYQYSARHGLQWWEFDLTWLIICGLKKVGLARKIKVASPNN

SEQ ID NO: 49594 - protein, 156 aa, Prochlorococcus marinus str. MIT 9303
MVLQQTVKDVMSTPVLSVVPATSLQEAVQLMTDHHISGLPVVNDDGTLVGELTEQDLMVRESGVDAGPYVLLLDSVIYLRNPLNWDKQVHQVLGTSVNDLMRSDTHTCNEALPLPRAAAMLHDRSTQRLFVINDQRKLVGVITRGDVVRALSMQGD

SEQ ID NO: 49595 - protein, 162 aa, Oryza sativa (indica cultivar-group)
MALVEGNNGVSGGAVSFSEEQEALVLKSWAIMKKDSANIGLRFFLKIFEVAPSASQMFSFLRNSDVPLEKNPKLKTHAMSVFVMLRKAGKVTVRDTTLKRLGATHFKYGVGDAHFEVTRFALLETIKEAVPVDMWSPAMKSAWSEAYNQLVAAIKQEMKPAE

SEQ ID NO: 49596 - protein, 181 aa, Nicotiana sylvestris
MAFLIMSSAAAVATGTNAAQASMIAPFTGLKSATSFPVSRKQNLDITSIASNGGRVQCMQVWPPINKKKYETLSYLPDLSEEQLLREVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 49597 - protein, 505 aa, Gibberella zeae PH-1
MALPPKWYQFLVSVFASLGSLLYGYDLGVIAEVIASGNFKSKFGDDPNATGAVVSVFTGGAFFGAMFAGYAGDRLGRKWTIMIGALIFILGGSLQTAADHINYLYAGRCLAGLGVGFLVMIVPVYQGELCHPDIRGRVTALQQFMLGVGALIATAIGYGTYTSIDDSNSGQWRIPLGIQNLPAVILAALILFFPESPRWLIDHGREEEGLKTLAKLHANGDVNDTWVRAEFDQIQERLALEHEASAKSYSELFTDKSCFRRLWLAISVQVAAQMTGVSAIQYYSVAIYAKIGIQGDETLRYQMISSVIALVAQFLCMLFIDRTGRRWPLIGGNILNCITFIIATVLLASFPPGSNNGGGAAGWGFIVVTWIYNFSFSATCGPLSWIIPAEIFDMKTRAKGVSLATMMSFAFNTMIGQTTSVALDDKTGIGWRWYILFIVCNFTNAVYFWAILPETANRPLEEMRYLFTEAPLFVPLMDTAKFAAGQDLERRVEKAEQKQELEHHD

SEQ ID NO: 49598 - protein, 137 aa, Glycine max
  misc_feature (77)..(77): Xaa can be any naturally occurring amino acid
  misc_feature (96)..(96): Xaa can be any naturally occurring amino acid
ARSMISFPAVTTVNRAGAGMVVPFTGLKPMAGSPTINTNNDITFIASRGGRVQCLHVCPPADKNNLETLSYLPDLDXAQSSKREEYLLTTGWLRCXGIRIKHGFVIREHTTLPGFYNGLLGTMWILPIDSCSHASNV

SEQ ID NO: 49599 - protein, 136 aa, Pisum sativum
NTDITSNGERVKCMQVWPPIGKKKFETLSYLPPLTRDQLLKEVEYLLRKGWVPCLEFELLKGFVYGEHNKSPRYYDGRYWTMWKLPMFGTTDPAQVVKEVDEVVAAYPEAFVRVIGFNNVRQVQCISFIAHTPESY

SEQ ID NO: 49600 - protein, 180 aa, Petunia x hybrida
MASSVISSAAVATRTNVAQASMVAPFNGLKSAVSFPVSSKQNLDITSIASNGGRVQCMQVWPPYGKKKYETLSYLPDLTDEQLLKEIEYLLNKGWVPCLEFETEHGFVYREYHASPRYYDGRYWTMWKLPMFGCTDATQVLGELQEAKKAYPNAWIRIIGFDNVRQVQCISFIAYKPPGF

SEQ ID NO: 49601 - protein, 561 aa, Gibberella zeae PH-1
MASSARMPSRRLFAGGAINRLLDLLLPGGSGITSVAFFAYIAPYLIEVATDVFQRQCVSTIEIQGHDEIFTYLMSWVARNNKLSRNNHRLLASSSTSNEPSHPMRGPPRGNENNEEDDSGDDIDPSASLDVLRSKISLYNARPLHWTPSVGTHWFWYENRVVSFTRTAANETPMPFGLRFETVVLSCLGRNPDILKRIIYNARIEYLEKQRGRTSIFRAVQSHGEMHCWARSMSKPTRPMSTIALEEDKKQSLIKDLARYLNPRTKKWYATRGIPYRRGYLFSGPPGTGKTSLALAAAGLMGLNIYMISLSSPTLSEDSLASLFQTLPRTCLVLLEDIDAAGVAASRVEQQKAKAESAGKPRRPGFGFPMISREPITLSGLLNVLDGVGAQEGRVLVMTSNHTENIDPALLRPGRVDYTIKFGLASFETIKQLFQLMYGTSYAETGIELDSENIEALSTEFAQVVPAHTFTPAAIQGYLLMHQDGPSEAVAEAGVWVEEQKRLKEKAEEIEKVEAKEEEDKNESETENDEKTKDKKNPEAKIKVNGVKMSDLLGDLANDVE

SEQ ID NO: 49602 - protein, 253 aa, Helianthus annuus
MGKGRLELKRIENKINRQVTFAKRRNGLLKKAYELSVLCDAEVALIIFSTRGKLYEFSSTSSMLKTLERYEKCSFGPPEQRKPAKEDLQEQSSYQEYMRLKERYDALKQLERNYYGEEIDSLTTNELESLERQLHCSLKQIRTIRTQSLIDKLYEQQKMEHQLYEYNKTLRLRLDEESQAEALQWDVHAHAHANGMVYGHHHQHQVSHPAHGAFYHPTGCETTLQIGYQTEQISGATSSSMSHHHHQMQGWPA

SEQ ID NO: 49603 - protein, 181 aa, Solanum tuberosum
MASSVISSAAVATRTNVTQAGSMIAPFTGLKSAATFPVSRKQNLDITSIASNGGRVRCMQVWPPINMKKYETLSYLPDLTDEQLLKEVEYLLKNGWVPCLEFETEHGFVYRENHKSPGYYDGRYWTMWKLPMFGCTDATQVLAEVQECKKSYPQAWIRIIGFDNVRQVQCISFIAYKPEGY

SEQ ID NO: 49604 - protein, 115 aa, Prochlorococcus marinus str. MIT 9303
MLLMRRLLSALLAITVCFAAPSWVMAADSAHGGQVFSSTCAACHAGGGNIVDPAKTLQKAALEATLSNYGSGHEEAIVAQVTNGKGGMPSFADVLSAADIADVAAYVEAQASSGW

SEQ ID NO: 49605 - protein, 178 aa, Glycine max
  misc_feature (115)..(115): Xaa can be any naturally occurring amino acid
MASSMISSPAVTTVNRAGAGMVAPFTGLKSMAGFPTRKTNNDITSIASNGGRVQCMQVWPPIGKKKFETLSYLPDLDDAQLAKEVEYLLRKGWIPCLEFELEHGFVYREHNRSPXYYDGRYWTMWKLPMFGCTDASQVLKELQEAKTAYPNGFIRIIGFDNVRQVQCISFIAYKPPGF

SEQ ID NO: 49606 - protein, 216 aa, Zea mays
MTTARLVSTSPARLPSTSASPIPRTSLCVVGRAPAFSARALGFSLRLKPSPAMAAAGPPTAHGDSIGSSRIGEVKRVTKETNVHVKINLDGTGVAECSTGIPFLDHMLDQLASHGLFDVYVKAIGDTHIDDHHSNEDIALAIGTALLEALGDRKGINRFGHFTAPLDEAAVEVILDLSGRPHLSCGLDIPTQRVGTYDTQVNCEICKPFVICINIC

SEQ ID NO: 49607 - protein, 174 aa, Triticum aestivum
MAPAVMASSATTVAPFQGLKSTAGLPVSRRSRGSLGSVSNGGRIRCMQVWPIEGIKKFETLSYLPPLSTEALSKQVDYLIRSKWVPCLEFSKVGFVFREHNSSPGYYDGRYWTMWKLPMFGCTDATQVLNEVEEVKKEYPDAYVRVIGFDNLRQVQCVSFIAFRPPGCEESGKA

SEQ ID NO: 49608 - protein, 353 aa, Aspergillus nidulans FGSC A4
MADTFSSIPIIDWRRLQDPSTKAAALDDLREAIFVVGFLYLTNHGLENLISKAHAKLPELFDLPADVKAKCDMINSPSFVGYTRLGAETTAAKTDWREQYDFGTPGMKTWTEDKDIWWRLEGNSQSIQRQYPDVPGVKELVEEYIARSAELSQQFMRYVSECLSLPPDTFAAFKGNMDRLKFIKYPRSPPNSQGVGPHKDSSGLFTFLSQDDTGGLQVLNKNGEWIDAPPIEGSLVVNIQQGLEAITGGICAATTHRVIAPTTKTRYSIPFFLGVRMDLTTEQLRESAAHIVARIPVSDDRKKRAVDVPSEFLSPLYSCFGEAYLRNRILSHPDVGQKWYPHLYEKYTKQVLS

SEQ ID NO: 49609 - protein, 489 aa, Clostridium perfringens str. 13
MSQEQNTNLKRGLKSRHLSMIAMGGAIGTGIFLAMGDTLHQAGVGGAFVAYGIIGVMVYFLCTSLGEMATYMPETGSFGAYATKFVDPALGFALGWNYWYNWAITIAAEMVAGSLLMKFWFPNIPAIVWSALFLVIILTLNLLSAKAYGESEFWFAAVKVATVIIFLIVGVLMIFGILGGDNVGFKNFYENGGPFIGGAKSIFMIFLIAGFSFQGTELVGVAAGESEDPEKNVPKAVNTIFWRILLFYLGTILVIGALVPNAQAGVETSAFTIVFEKLGLAGAASIMNAIILTSVLSAGNSGMYASSRMLYAMAKNGMAPKIFEKTNSRGVPVNAIIITTIIASLCFLTGIYAENTVYVWLVAASGLSGFIAWLGIAICHYRFRKAYVAQGKDMSRLVYKAKLFPLGPIIALILCGIIVLGQGYAYLDVRNGVDWGGLISSYIGLPLFFGLFAYYKIKYKTKIIDLKDVDLSVEHIDTDESIEDEVFSY

SEQ ID NO: 49610 - protein, 193 aa, Lactococcus garvieae
MKRIAVLTSGGDAPGMNAAIRAVVRKAISEGIEVYGINHGYAGMVAGDIFPLTSASVGDKVGRGGTFLYSARFPEFAQLEGQLAGIEQLKKHGIEGVVVIGGDGSYHGAMRLTEHGFPAVGLPGTIDNDIVGTDFTIGFDTAVSTVVDAIDKIRDTSSSHHRTFVVEVMGRNAGDIALWSGIAAGADDIAIPE

SEQ ID NO: 49611 - protein, 281 aa, Myxococcus xanthus DK 1622
MKTQEIEKKVRQQDAQVLAQGYSPAIRAMEIAAIVSFVSLEVALVYRLWGTPYAGTWLLLSAVLLGYLAADFVSGFVHWMGDTWGSTEMPVLGKALIRPFREHHVDEKAITRHDFVETNGNNCLISLPVAIIALCLPMSGPGWVFCASFLGAMIFWVMATNQFHKWSHMDSPPALVGFLQRVHLILPPDHHRIHHTKPYNKYYCITVGWMNKPLTMVHFFPTAERLITWATGLLPRQDDIGAEAARALVVAAGGSEAPVVQAAKELLTQATVQEKPASTRP

SEQ ID NO: 49612 - protein, 1024 aa, Coprinopsis cinerea okayama7#130
MDPLLLPALGFVLLVVQRIVAFWKSLRSIGDILPPIPGVAAGHNHLLLDKFRQYARYGWDAYAEVSWFGKSTVVYVLADAAAIKEVAASRTRFPKPTEHYEVLAIYGQNILTVEGDTWKKYKKLVSPAFADRSNRLVWSETVRILSDLFEDVWGDRKSIEIDHCLELTMPITLYVLGGAGFGSRMTWKEDTVRPGHQLSFKEATHSVSKNLMFNIAVPKWALPLTKRGRDTQMAFAELGLYMNEMLQERLSSPNSDRDDLFSLLLASSTGDFKDDSEKLTHTEILGNTFIFLIAGHETTAHTLCFAFALLALYPDEQEKLYKHIKSVLTDDEPPTYEDMNRLTHSMAVFYETLRFFPPVTGIPKYSAEDTTLEIGNQNGETKTIPIPKGTYLTIDAVGLHHNPRYWKNPEEFRPERFLGDWPRDAFVPFSVGARACIGRKFAETEAVAVITMLVSKYKITIKEEPEFASETFEQRKERILKNYSGVTVTQAESRLLERVAGGFALHDRHAAESCVPRRDVFGCDLGVSEGCVVLESFGVDSGVIGHIVLPSIPGVAAGWNHFFKDKYKLFEYYGWDAYAEVSYLEGPKISYAIADASASKEILSSRSRFPKPVELYDKLEIYGPSVVTTEDEEWRKYRRLVAPGFTDRNNRFVWRESVRVVRELVGDVWGWKEDGGGQRVVVEHCNEITLAIALSVLGSAVFGAKTSWNQENEVAGGGHKLTFKKAIHDACGNIMMKAAIPDWLLGMGVSERLEGIRVSFEEVGVYMKEMLRERVESGDMDRDDLFSILLKNTRGEVKSETLDDVELFGNIFILLVAGHETTAHALCFAFALLALYQDEQEALYEHIKSVLPDGRDPTYDDMPLLTHSMAVFNEALRLFPPVPWVPKYAAEDTTLVIGNPKGETKTIAIPKGTNLSVDMAGLHYNLLIYVTGVVGDAARYWKDPHAFKPERFLGEWDKDAFIPFSAGARACLGRKFSETEAVAVITMLIQKYKVTVLEEPQFASETFEQRKERVLATTGGVTLT

SEQ ID NO: 49613 - protein, 415 aa, Myxococcus xanthus DK 1622
MADTLKPEAPNPDTDAYAHESELDAHLQTKRMVINMGPSHPATHGTVRLKVELEGETIVKIDPEIGFLHRGFQKSCENVTWTQCLPYTDRLNYLSAMMNNFGFLNAVEKLIGLEIPERAQYIRVIGSELHRLTDHLTCVGATGLEMGGFAPFLLAMEFRELLHDRTAELTGARLTTSFGRVGGSNRDLPEGWIPRVHKTLDQGLALLDEMEGLLTNNRIFVDRTKGTGVISAEDAIEYGYTGPALRACGVDYDIRKTKPYWVYDRFDFDIPVGEHGDNYDRYLVRLEEMRQSIRILRQAMDTIPAGPIIVDDWRIALPPKPEVYGTIEGVMSHFKLVMEGIQVPAGEVYDATEASNGELGWYLVSDGRGRPYKVHVRAPGFPVLAAVPHIIEGKMLADLIPTFDTINMIGGEVEQ

SEQ ID NO: 49614 - protein, 428 aa, Clostridium acetobutylicum ATCC 824
MKMSSLYERSLKVIPPVAGRATKLGVVRGEGAYLYTEDGRKVLDFASGVAVCNLGHNNPAVIKAAKEQMDKLIHGGHNVVYYESYVKLAEKIVELTGNKTMVYFSNSGAEANEGAIKLAKYITKRQAIISFKGSFHGRTLATTSITGSSSKYRKNYEGLLPSVYFAEYPYCFRCPYKQNKESCNMECISQFEDMFKKLIEPESVAAIIMEPVQGEGGYIVPPKKFLKAVREICDKYGICLIFDEVQCGFGRTGKIFAHENFEVEPDIFTCAKAIASGFPLSAVIGKKELMEKWPAGAHGGTFGGNPVACAASLATIKELESGVLDNANNMGNYLKEELLKLKDKYACIGDIRGIGLMIGMEFCKENNNPDGDIVTFIREVAVNNNLILLGCGTEHNVLRFIAPLTVEKSEIDMAISIVEKGIVEYLNK

SEQ ID NO: 49615 - protein, 517 aa, Oryza sativa (indica cultivar-group)
MASHAVTDALLLPRSEGAVAGAVDFRGRPASRASTGRWSAAMFVLGVEIAERFAYHGVSANLISYLTGPLGESTAGAAAAINLWSGVATMLPLLVACVADAWLGRYRTIVLASLLFVVSMGMLTLSSALPAFHGDGGGCSYTSKSLSCAPSTAQVAIFYVSLYLVALAEAGHKPCAQAFGADQFDQNDAKESVSRSSFFNWWYFGMCSGTAMTTMVSSYIQDNIGWGLGFGIPCLVMAFALAMFLLGTRNYRYYVSTQSSPFARLARAFVALIRGSKDEYALIDFLSDVDSSTFFTKQAATLDRRIGESFRVPPAALQTFISVTIIAFIPVYDRAFVPVARRFTRASSGITMLQRIGTGLVLALAAMVVAALVEARRLGVARDAGMVDDPKAALPMSLWWMVPQYVLFGLSDVFAMIGLQEFFYDQVPDALRSLGLAFFLSIFGVGHFFSSFIISAIDGATKKSGASWFANNLNRAHLDYFYWLLAGLCAVELVAFVFVSRVYVYKKRVPHNGCDVM

SEQ ID NO: 49616 - protein, 157 aa, Medicago truncatula
MNLIMGLYTSTSILRHHCILRHHKPGYTNYRDSPQVTNNIEVYISKMVQVEVIIQSLVNERLDPNIQQKRKQGTKAAALEDVSCAGLDGTLGLKKKKKSGAKRNRMKITNNTIKHHKASPISEFKFAYTRKPVERVMHGTADAKHDRDVIGWLPEQL

SEQ ID NO: 49617 - protein, 532 aa, Oryza sativa (indica cultivar-group)
MADTVAGAVDYRGRPASRAATGGWKSSVFVMAMEIAERFAYKGVAANLITYLTGPLGQPMARAAASIDAWKGVSQMLPLPLACVADAWLGRYRAIVLASVIFVLSMGTLSMSSAFPVSRAGHVAVFYVALYMVALGEGAHKPCAQAFAADQFDEKDGGECAARSSFFNWWYFGMCAGTAVTTMVSSYVQDNVGWGLGFGIPCIVIVVSLAAFLLGTRSYRFYTARTASPVARVAKAFLTLIKSWRSNRRTNPASGGKGDGDGDAGDLVEEVKSVFRLLPIWASCIIYAIIFSQTSTFFTKQAATLDRRIGRSFNVPPAALQTFISVSIVVFIPVYDRLFVPLARRYTGRPSGITMLQRVGAGLALSLVAVVLSALVETRRLRVAAGAGMADAPKARLPMSLWWMVPQYVLVGVADVFAMIGLQEFFYDQVPDAVRSLGLALFLSIFGVGHLLSSLLISVIDGATARRAGGSWFANNLNRAHLDYFYWLLAGLCAVELVAFFLFSRVYTYKKKGNDADGNCDYRGVDDDGICV

SEQ ID NO: 49618 - protein, 371 aa, Oryza sativa (indica cultivar-group)
MAPSSAPRWFTTLQQPGMTGSSTQGPWLFSTGIGPSTENAEHPDIHALGVDSHPPGGLLKFLRKTTPRTEQHVCNGSSLQPINVGDDCNVGDCVRTEKRLPWTKEEDLRLVSAWLNNSNDPIQSNYKKNDQYWNGVAAVYNITTPKNRARQVKQVKDRFGRIKKRVAWFCASWKEANALWASGESEVNLMDRAVKSYEEDHKKDGPFMFKHCWDVLSKESKWDAYLERLEDLEPDKRKFNVEEGVGHHFSLDDARDERPIGGKQAKEQQKRKRKDQAIIDLEEEFHKLVDAQNIANEGHKEMLETQRRVSSENVEARKLKYLAEKEHRESTMLETYKSLMMQDTTGMPEDVRSEHMLALRCFREKLFGKTD

SEQ ID NO: 49619 - protein, 402 aa, Prochlorococcus marinus subsp. pastoris str. CCMP1986
MSKLSLSSLDKSKLEGKKVLVRVDFNVPLNDSGQITDDTRIRAAIPTIKYLINNSAKVILAAHFGRPKGKVNEKMRLTPVAARLSDILEQKVNLTESCIGEEALAKSNSLNNGEVLLLENVRFYEEEEKNDLDFAKNLASHADMYVNDAFGAAHRAHASTQGVTKFLEPAVAGFLLEKELKYLQGAIDAPKRPLAAIVGGSKVSSKIGVLDSLLDKCDKIIIGGGMIFTFYKARGLDVGKSLVEEDKLELARNLEAKAKNKGVELLLPSDVLLANEFSPDAESKVSQIDAISGDWMGLDIGPQSIKVFQNALAECKTIIWNGPMGVFEFDKFAEGTNAIATTLADLSSFSEVCTIIGGGDSVAAVEKAGLAEKMSHISTGGGASLELLEGKTLPGVAALKDA

SEQ ID NO: 49620 - protein, 574 aa, Escherichia coli CFT073
MDIQKRVSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIIAQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAWTEGNALVATGSPFNPVVWKDKIYPIAQCNNAFIFPGIGLGVIASGASRITDEMLMSASEMLAQYSPLVLNGEGLVLPELKDIQKVSRAIAFAVGKMAQQQGVAVKTSAEALQQAIDDNFWHAEYRDYRRTSI

SEQ ID NO: 49621 - protein, 415 aa, marine gamma proteobacterium HTCC2207
MSITEVSNKPYDLIVFGATSFVGQILSNYLVETIGVNGDISWAIASRSDSKLATLKESLGDAARALPVLIADSHDEASLQALCSQTRVIISTVGPYALYGELLIKACAESGTDYTDLTGEAHWIGMMKDKYNQTAEASGARIVNCCGFDSIPSDMGVFALQQRAQAQFGHPFPHAKLRVKAAKGGASGGTIASMIEALKAAKADPKIRKKMGNPYLLCGSDHKYSIRAKSVSGPQFDKDFDCWVAPFVMEAINSRVVLHSNALLNMAYGRNFSYSEGMLCGKGLKGRLMANLTAIGFGLLAVGLYLSPSRALMERFFLPAPGEGPSPEVQLNGYFDMRVHGRDDQGNQLTVKVTGDRDPGYGSTAKMLGQAGLCLALDIKKENRAGGFLTPSVAMGDALLQRLQTHSGMAFVTCD

SEQ ID NO: 49622 - protein, 751 aa, Oryza sativa (japonica cultivar-group)
MDFFLTVTDSSIGPPGAAQYANGLLGLDARGAAHCWKTRIGRGEGGKWVAARRRGGAAGRGGRWPISPALVERSGVGEASPAAGRRRGGWEAVMETAHEVAIYIDRFHNLDLFQQGWYRLKISAAWEEDEYRAPVSPARVVQYEVPDIGSKGAFGLWKIDDVDNSFYTQPFQIKYSRQDIYLSVMVSFYIPNTEDEGPATSSVILKFELIYVPTLEDRTEIEDPSDIYVPVHEFRIPYKALLGLHAYFPVHFDAFHPVLVDLTMHIVYLKAGVTKSSQKASEQGLCSKSCYIIKALLSSREILLEEVMKMSAGIGKTLEDLDDADLTLGKHEPIDSSKAGLPKYSKGLYIPTKCIGHLTGVLHDLIERSDNVVRSTNDILLYTLSKEDLLELFQAPVQNSSSRAELHRRSIAQMKVGSQSMLKTETICITPKKRILTQIILQINARFIQDMQIYANPSEIPVVHIEQHVMVVPQHGSSKRLGHHLDLRLIRNQWILCDPGAECLLSQTNEDRTCGDFKEMGRRLSNEVVAFLKRKIDRYSRNGGCKDLKLSFVGHSIGNIIIRSALADPKMQPFLKNLYTYMSISGPHLGYWYSSNSLFNSGLWLMKRLKGVQCMHQLTFSDEQDPQNTFFYKLCKLNTLDNFKNIILVSSPQDGYVPYHSARIDSCPASSSDNSKKGQVFTEMLNNCLDQLRAPSSETRVFMRCDVSFDQSSHGRRRSLNTMIGRAAHIEFLENDLYARFIMWSFPDFFR

SEQ ID NO: 49623 - protein, 2229 aa, Gibberella zeae PH-1
MTTLLDALRQATQVDCDTLDANVQAIAFSEISRPLAGEPLLHHDALVKDAIEKARGALKEFQGSATFEEFVVQILTNPKLSYSTDGTMSDAHRIVNIFKALAPEFDTKRVCIKIPATWEGLQACRALEVEGIATLATTMFCMEQATLAADAQCTYIAPYVNELKVHFEAGYVDEHKAFDFCREAQTYYINHSCRTQVLAASLTSVDEVMQLAGIQHITISPNLLNGLASTKLSDWDGKLGDYFAQGPANKSWETRDYNALTKNESAWRMAFTRSGFGTSEGEFLFPVRARLMEKVTDISTSLAADVSDGWLQQTDPPEERVDLMIDPNSKRWTKVHRYFTKVLESDMAIEDVIRRSFTHHQYRMMAPTERTDVKEMQAANTKRYNALLAGRFKGIEDSLATRLTAMYFGLPAAPVDNPLEEIAMMLGLDEKEVPRYNFRPPLHFLTAHDRRNWGKETLKSEEATIDALPLPRAMEPTLSLRGGGDDDDLIGWTDDYTQEYETTALFTDGWTYLHGIYGRLPFVPRKWRSFSKVLRQLLQVKDYEYQDFSLLWYDRKLGKPKVIHDQLPLTKESPAMTFLDEHFADSTRSHKDCCALFIDNIHTDINKGPQHWEPIDGQLQSDTIKIGRSLGNAPNGPEDEVISYAYLAFPKTKVDTFKIGKYGSNQYNAHFCKTLNVLFGAPESSAHHHALFRLVDKKKNKTNWAVPIVYGAMGLPQWAWELLHPVNNPGADWMVECCWLNPGLEAVLLSNYYPKPNPYLITRNSRNGAERFNQAYRQICEMTTEAFDASVCRKIDSVFLIEGHKPKTAGELVIDGFQVRPRRDLKSWKLGIPGTPNDDTPRDLGKKLGESPNFYRTVHVNWRPGHCRLFPGWYSGGDFSVEMPRLSSTVVEFLEAMGELFKLVGPPNLNGTGPEDSCFLLTEAPSFDGLQVQDMDSPSYYIGVGATDDDWHDIRKSITSPFVSVSIVKKPKNTSWSTSISKHNLWGLRLDKEALRQNEMNGGGSRRDALQLYDLDGESVDILHGYPADPVPLEPIDPNNNVSVTTNGKPWTPTSRRRPDAFVPPRLLKIRSKSVGGAEGLHLPSTLVIGGASTPDGEPESDIGILATSRPKFRGFPPPPSEDEDDGDLAGGLAEDDHRRYSMYGDLLSDSGEEDGGGSRNKDADGDEAMEDTSLPSVPQADVIGGGEANDDDEDETPKLFGLQKIPEEKEPEDNPEDRPEQTVPPPSVTTSKPLFQASNTVGADDRAHTWATQPSIFTNEDQRAWPADAEIGLPITAAPVEKIHRLSGNVPMYSKAILTPTEQAELQHGFGDLRNILLKRTNMCPFQGCRFTWRLDQNEELNIHVFTAHAKRKCPFCDDALFGWWDKNQQIKHLGDKHPDEVKKMKVHGVQKGNISVPVTVNAPANLIGEAFAEEIRSWGPQYKLKAPPRLLTYPLLAWYDNFGTTAVKDPPKKCPIPSCSVPHLEHLSSHGVWTHFKNYHTDLEMDACPFCNLSFYVYGEKDKDGVRTVIPRSIDECIMHLDCHVYQLWDLLEPVVDQPTKVNMPSQGNKDFQTISAEKLESMRAEVVSKTVAAALARTGAATQSVADQSPPPQVSYGHVTDASQILRKCVYFEKCGAYVGSMTEKQYRRHVRVNHPKEISTLSSSSEDETDGEDQASTDDGSEDRGDDKPNDGDDGRDGAGKTAALKFGRLKPTSKPAQASTPSKPKEKAVLGKPPSPPDPDEMDISTDDNVVETESSRSEESAVMISEKTPTTKITTPQTPPPDGDSDTNEESGSSVSRGRRSVKALKSKRKAPTKRAEPDVDEDNTEDNGEKEIDDFDEDGEADGSGSKSSHTEGRGRSAKKAGKRRPRGDDDGDYEDEGDQDDDDFVMAGNNGRRYRRRAPSPDWIKVLGPEDPNFDPEDKMYCSKCLRKAPLRRAKSPNRSPIGRAGEIEAHTDKTKCCRIRNGLGSATGLPNRSGWIPANKLPGTLTSLKEDFLNRYPSYMRTMYPTSSRDHHASVWRSDPNNPENDAWFDVPWPPYEGLPPFPGDWIAPGLPWDDTPEGRQRRAMYIGNRVVDENYQYQSETDSDDDLKPDVNDIPDFQADLNPLKRPAEDEEETSDEPAPKKAKKSKTAATKTPKATGTKKTPAPKKAAAPSKTPAKTRSKAPSKAASKAPSKTPSKAASKTPSKAPSKTPSKAPSKAPSKASSKGPSKTPSRASSRKTTPSKTPSTPSTRPPSEAGDE

SEQ ID NO: 49624 - protein, 673 aa, Blastopirellula marina DSM 3645
MPYANGPIHIGHLVEYIQTDIWVRFQRLRGADCRYFCADDTHGTAITISAKRNEVSEEEFIAKMSAEHQTDFAGFAIEFDNYGSTNSEENRELCAQFWKSLRDADLVIEKEIEQLYDPEAQQFLADRFVRGTCPKCGRTNQPGDNCECGHTYTPADLIDPVSVLSGATPELRKATHLFVALEKLHPFLEKWSQSGEHLQTEVANYLKGHFLHEELRDWDISRPGPYFGFEIPDSPGNYWYVWFDAPIGYIASTWEWCKRNGESLDKWWKDPETEVHHFIGKDITYFHTLFWPGMLQTAGFTLPTKVHIHGFLTVGGEKMSKSKGTFVKAAKYLEHLDPAYLRYYYATKLGPRLDDLDLNVAEFAEKIDSDLVGKVVNIASRCAKFVQTTGLSAAYPDDDGRFEYAAQAGEEIAAAYEACDYNRAMRLILELADRANPFIEANKPWELRKDPANAQALQDVCTVGINLFRQIIIYLSPVLPKLATEVGALLNDPITSWDQSQTPLAGTQINKFEHLMKRVDTKRVQAMIDESKEETADADAANPADEIAAKFNDSADVLAAEPLAEECTIDDFMKVDLRVARVLHAEEVTDARKLLKLTLSLGGDERRQVFAGIKAAYKPEDLIGRLVVMVANLKPRQMKFGLSEGMVAAAGEGGAEVFVLTADEGAKPGHRVH

SEQ ID NO: 49625 - protein, 255 aa, Zea mays
MLFKFGNCSGAIGHMPIFCQWYIFPVPRCRLAAPAAVPWRAATRTKRGKTSVEEGKLEKAQQTEKMAARRGREWDGDEQGAALPTPAPLGAPVVCLLSSAGDLAAGAFVGSLVGYGKGLITNQGTKACLSIAGSSAKTFAALAGVQSFIMCLLRRLRGKDDMINAGMAGCCTGIALSFPGAPQAMFHSCVTFAAFSCIMDGLSKQQAAMALTLDVKSPTVKYEEGRVIPPFTLPPLLDALDPLGSFCQTLIKPKH

SEQ ID NO: 49626 - protein, 610 aa, Oryza sativa
MGSGGAAAAAAAVPLRKEKQRSAAGRWPEVEDGVVPATAKRHVRRAWRCGVNVVLAAFVMVVPPMVILLDARGAGAPAVWISSVNAFRRGDGSILQWPAAAAARDKLLGGLLADGLDDGSCHSRYQSAMYRRNNAGKEPSPHLVSRLRRHEELQRRCGPGTAAYSNAVESLRSGKSGGIVSPSPEAECRYLVSISYRGLGNRILAAASAFLYAMLTDRVLLVDPSNEMDELFCEPFPGATWLLPPGFPLANYTSFSVETAESYGNMVKNKVITTDAGDAAPTTAQLPAFAYIHLDHTSTVEDKFFFCDEDQRAIRNIPWLVMRTDSYIVPGLFLVTGFQDELDSLFPETDAVFHHLGRYLFHPTNHVWGLVTRYYDAYLATAQQRVGIQVRVFGAQPESPKLLDQITTCTQKEKLLPEVIAAGEPPVVDVAPANSKSKAVLVTSLKSWYYEKMKSMYWEHATATGEAVSVHQPSHEEYQRFGARSHDGKAWAEIYLLSLSDALVTSGWSTFGYVAQGLAGLTPWVMHKPANDTAAAAGDDPPCRRDVSMEPCFHAPPFYDCRLKRGADTGKVVAFHMAYDGGVVCVWDAESNLEGVQIWYDWLCKVSFLY

SEQ ID NO: 49627 - protein, 339 aa, Oryza sativa (japonica cultivar-group)
MDRDDERLGRALAAFGGGGGGGGGGVWELVDAALACAARDRPDELRARRDGIVERLYAAGGGGGGNCGAAAATTPSPRGAAVAEGEDDDDEAAAAADGLEIKILAIKDFLEDEDQSEDELLSLLQSLADMDITYKALQETDIGRHVNGLRKHPSGEVRLLVKQLIRKWKEIVDDWVRLHNSSGDASNSIITDGNSPEKIQGKNQQSSQVSEFKYSPSPSRHNNSSSERVSNGIASIAATKHRASPAPAHHNARQINNTHHSTTSSSAPARMVKEQKDSHLDLERLDSARKRLQENYQEAQNAKKQRTIQVMDINEIPKPKNRNAFIRKGNGGGFPARHR

SEQ ID NO: 49628 - protein, 177 aa, Lemna gibba
MASSMMASTAAVARAGPAQSNMVAPFNGLRSSVAFPATRKANKNLSTLPSNGGKVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 49629 - protein, 180 aa, Solanum lycopersicum
MASSVISSAAVATRSNVTQASMVAPFTGLKSSATFPVTKKQNLDITSIASNGGRVSCMQVWPPINMKKYETLSYLPDLSDEQLLSEIEYLLKNGWVPCLEFETEHGFVYRENNKSPGYYDGRYWTMWKLPMFGCTDATQVLAEVQEAKKAYPQAWVRIIGFDNVRQVQCISFIAYKPEGY

SEQ ID NO: 49630 - protein, 180 aa, Pisum sativum
MASMISSSAVTTVSRASRGQSAAVAPFGGLKSMTGFPVKKVNTDITSITSNGGRVKCMQVWPPIGKKKFETLSYLPPLTRDQLLKEVEYLLRKGWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 49631 - protein, 180 aa, Petunia x hybrida
MASSVMSSAAVATSTNAAQASMVAPFTGLKSAASFPVSRKQNLDITSIASNGGRVQCMQVWPPYGKKKYETLSYLPDLTDEQLLKEIEYLLNKGWVPCLEFETEHGFVYREYHASPRYYDGRYWTMWKLPMFGCTDATQVLGELQEAKKAYPNAWIRIIGFDNVRQVQCISFIAYKPPGY

SEQ ID NO: 49632 - protein, 391 aa, Candidatus Pelagibacter ubique HTCC1002
MTKKIKTLNLNFGPQHPAAHGVLRLILELDGEVVEKADPHIGLLHRGTEKLIENKTYMQAVPYFDRLDYVAPMNQEHAFALAIEKILKINVPIRAQLIRVMFCEIGRILSHILNVTTQALDVGALTPSLWGFEERETLMTFYERASGSRLHANYFRAGGVHQDLPMGLEEDIGNFCESFPKIIDDLETLLTDNRIFKQRNVDIGIVTKEDALDYSFSGVMIRGSGVPWDLRKSQPYDCYEQLEFKIPVGKNGDCFDRYLCRIEEMRESVSIIKQCLSKMEKGPIKSLDGKISPPPKKDIKQSMEALIHHFKLFTEGYRVDKDEIYTAVEAPKGEFGVYLISDGTSKPYKCKIRAPGFSHLQAMDYLIKGHMLADVPAVLGSLDIVFGEVDR

SEQ ID NO: 49633 - protein, 175 aa, Triticum aestivum
MAPAVMASSATTVAPFQGLKSTAGLPISCRSGSTGLSSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNMRQVQCVSFIAFRPPGCEESGKA

SEQ ID NO: 49634 - protein, 405 aa, Arabidopsis thaliana
  misc_feature (110)..(110): Xaa can be any naturally occurring amino acid
MLSTLMKLLSACLWPSSSSGKSSDSTGKQDGLLWYKDFGQHLVGEFSMAVVQANNLLEDQSQVESGPLSTLDSGPYGTFIGIYDGHGGPETSRFVNDHLFQHLKSEETEXYMHTRLQTNRAETKILFEFSGFAAEQASMSVDVIKKAYEATEEGFLGVVTKQWPTKPQIAAVGSCCLVGVICGGMLYIANVGDSRAVLGRAMKATGEVIALQLSAEHNVSIESVRQEMHSLHPDDSHIVMLKHNVWRVKGLIQISRSIGDVYLKKAEFNKEPLYTKYRIREPFKRPILSGEPTITEHEIQPQDKFLIFASDGLWEQMSNQEAVDIVQNHPRNGIARRLVKMALQEAAKKREMRYSDLKKIERGVRRHFHDDITVVIIFLDTNQVSSVKGPPLSIRGGGMTFPKKI

SEQ ID NO: 49635 - protein, 554 aa, Aspergillus nidulans FGSC A4
MIFEPDLRVPVPNTDILTYIFANPPYDPNKPVYVDVSNPARSISLAQARTIIRQLIAGLRAWGVKEGDCVAIHSFNDIYYSILVLATIGVGGIFTGTNPSYTSHELAHHFRTADVSFVLSEPEILGPVLEAAKVVGIPESSVRIFNPLPEQAVPEGRASWKELYNHGEECWVEFDDEVKSRTTAAARLFSSGTTGLPKAVTNTHRNLIAQQELVFQIHPRDYERRHIFATPVFHAAVAPSTHVGALKSGHTVHLMRRFDLALYLQACLKYQITDLMLVPPLVIALLMNDMAYEKPYLRSVRSAACGAAPLDKNVQGRLRKLLGPGASFTQVWGMTETTCIATSFIYPESDDTGSVGRLIANLEAKLVDDQGKNISAYNTRGELCVRGPTVTPGYFNNPSANAESFDEDGWYHTGDIAYCDAASRKWYIVDRKKELIKVRGFQVAPPELEAVLLSHPLIVDAAVIGIKDKREDGSELVRAYVVRRPGKGEGLTEDEVKEYLGQRLAKYKALTGGVRFVEAIPKNASGKILKRMLRKEAERESKGRESAGENKAKL

SEQ ID NO: 49636 - protein, 709 aa, Arabidopsis thaliana
MVVATTIALYASPPSSVCSTPHQISCDLDLTSRSSSTSSSMASSPQKPIVGGLSSLFSSASVKSSSSSSCSYSTGVDEFSSLRYDRSDDLKDLSFSSSFGYSPAKFVNSFRRDHQSPISVLHGPVSCSCSPPMRMSRDRNLDGSFRLGASGLFNGFVRKALGSCVDYEFGSDSVLVDELTFPMEVDTIKPYARDLLRRAQLRHKIFNDESVIKAFYEAEKAHRGQMRASRDPYLQHCVETAMLLANIGANSTVVVAGLLHDTIDDSFMSYDYILRNFGAGVADLVEGVSKLSQLSKLARENNTACKTVEADRLHTMFLAMADARAVLIKLADRLHNMKTLYALSPVKQQRFAKETLEIFAPLANRLGISTWKVQLENLCFKHLYPNQHNEMSTMLEDSFDEAMITSAIEKLEQALKKAGISYHVLCGRHKSLYSIYSKMLKKKLTVDEIHDIHGLRLIVDNEGDCYKALGVVHSLWSEVPGKLKDYITHPKFNGYQSLHTVVMDNGTVPLEVQIRTQEMHLQAEFGFAAHWRYKEGGCKYSSFVLQMVEWARWVVTWHCEAMSKDRSSISSSDSIKPPCKFPSHSEDCPASYKPNSSQDGPVYVIVIENDKMSVQEFPASSTVSDLLSRAGPGSSRWSMYGIPAKEELRPRLNQIPVSDLKWKLKMGDVVELTPTIPDESLTEYREEIQRMYDRGLAFSRPGTMVGWGS

SEQ ID NO: 49637 - protein, 438 aa, Cryptococcus neoformans var. neoformans B-3501A
MSTRQDKSTTERHAKILRELVKQPGNKNCADCKRNDTRWASWNLGVFLCIRCSGIHRSMGTHISKVKSIDLDIWTPEQMESIQKWGNKRANMYWERHLKAGHIPSDHKIESFIRSKYETRRWAMDGPPPPDPSVLENESTGGVVSPPPHQTKSPAPIPSSTSSSAAPPVPAHLPKTHPLLSRSIASSKATPSKPTSAVQAPIIDLFADDPAPAPAAVPAASSRAPAPIATAPAPAQPAPSSASNIFDLDFRTPSAPPLSNSPPASGPISNKSQSAKADIMSLFSSPSPSAIQSQQPNLAGGFFNATPSGVQATSPYASWQGGITSAVPSDGTQLGIPVGNKWSGLQMDQNAWGAPQHAQATQKTQPTQAYAQPQQQQSVNNMVSDPWTQAKTSMASPSDPWASTSSGDAGMGGGFFGMNQAQPKKEKDERDPFANIWA

SEQ ID NO: 49638 - protein, 593 aa, Aquifex aeolicus VF5
MPWAKEGDLQELLKAFPQASVVELQNSTSVIVPKDILIDVLKYLKEKLGYKLFLDHSVVDLKDLLENEKEFNKVVKQNLIAFPEDRESRFQAFYILYNVDERKRVIVKTRTNGKLPTIEKLWFAGKWAERECYDMFGIEYEGHENLVRAFMWDTYPYFPLRKDFPLEGIPEQELPSLNEVVFGDNLEGLMNYDRMHTRVPTLEDLEVTEKKRLKKKAQIVLNWGPLHPGTHGTMWFLFDLEGERIVQTDVILGQLHRGVEKLAEHEMYNQFLVYTDRMDYLSALCSNQAWVVAIERLMGIHDKVPPKAKYIRTMMSELQRINSHLLWLGTYALDLGALTIFLYAFKEREKIMDIIEGITGARLTISYPRIGGVRMDLPEGALEVIKAFIKKFPEELKDWETILTRNRIWLRRNKEVGIISKEDAYFHGVTGPVIRGSGIPYDIRKFEPYDAYDEVEFDIPVGEIGDCYDRYLVRIEEMKQSIRIIEQCVAKLEKMSKNEPFFYEGEGKKLKLSLDGIGVKAPVGEIYSSGENPRGELGFYVVSTGGTSPYRVKIRPPSYYNLCIYPHLMKDRYVADAVTILASIDPVVGETDR

SEQ ID NO: 49639 - protein, 639 aa, Avena sativa
MSKLLVIAILLLPLISHGRDLSTIWVWEDKDFFKYCPPSQCSQHGPEIRYPFCLASSNTSSCGCGSRSVRKLVCSGQDTILVHPVLGPYNVSAIDYRHSSMKLIPLVDPCMVLQKKLISSRSSSSSQVYDDNDYDEDYDEYHEFLDPSATLVYCSREFTPSAADRIAGPVSCLSNTTHFLYFVASDEVISLLPLDCKVIPVSDGGGGRTIAMYMYAPVSMLDLYPQSFKESAESILSFAKKTVYWNGYNCRQCELSGGRCAFSAQRLEPFCMPHGSRTKVIAATSSVAAFVVLLLTVATALYLSLRTRYNEEIHLKVEMFLKTYGTSKPTRYTFSEVKKIARRFKEKVGQGGFGSVYKGELPNRVPVAVKMLENATGEGEVFINEVATIGLIHHANIVRLLGFCSEGMRRALIYEFMPNESLEKYIFSHDPNIFQNVLVPNKLLDIALGIARGMEYLHQGCNQRILHFDIKPHNILLDYNFNPKISDFGLAKLCAKDQSIVTLTAARGTMGYIAPELYSRNFGGISYKSDVYSFGMLVLEMVSGRRNSDPSTESQNDVYLPEWIYEKVINGQELALTLETTEEEKEKVRQLAIVALWCIQWNPRNRPSMTKVVNMLTGKLQNLQMPPKPFVTSENQPMP

SEQ ID NO: 49640 - protein, 323 aa, Desulfitobacterium hafniense Y51
MTNTVRKIAVLTSGGDAPGMNAAIRAVVRKGIYHGLEVLGIRKGYEGLIHGEFITMHLGAVADIIHRGGTMLMTARSQEMLTPEGQKNAAAQLRYRGIDALIVIGGDGSFRGAQTLSAQGIAIVGIPGTIDNDITGTDLTIGFDTAVNNVVQAVSKIRDTATSHDRTFLVEVMGRDCGNIALQSGVACGAESILVPEIEPDLDDIVAKLERGHQRGKHHSIIMVAEGAMSAWNLGEELRQRTGFETRVTILGHIQRGGNPSALDVVLASQMGGKAVEILCAGETDRMTACVNQEIQSLPLEVAYGERKPFNKVLYDLANQLAI

SEQ ID NO: 49641 - protein, 653 aa, Avena sativa
MGNPGAFRCSVTLQALIVFSLIAVFAADHVQGGDDGCAPFSCGHLQDISSPFRRQGDPLECGVGAYELGCTSSKATIHINTGTYYVTAINYTNSYFRVMDTNFDTNSSCPLPLWNHLPYVESILDSHGFWDLSIRSGYTACFANCSRAVTNNGAYKPVDCLSADNSHVYIWMSGYFDCRVLDLEPYCGYLAMIPFGEEYSSDMQLQLQGASYADIIQLITKGFTIQFPYEEYREPSLSKDMNICLNHSISYFKELISHASFVNWTRAFFWSDMYFYRCVDRLYTFEHTTSPVVAQLIAVPKFLFVYKYLKTRITIDAVEKFLRIQQMIGPTRYAYTDIVALTSHFRDKLGQGGYGSVYKGVLLPGGAHVAVKMLEGNSSCNGEDFISEVSTLGRIHHVNVVRLVGFCSEELRRALVYEYMPHGSLDKYIFSAEKSFSWDKLNEIALGIARGINYLHQGCDMQILHFDIKPHNILLDTNFVPKVADFGLAKLYPRGDSFVPLSAMRGTVGYIAPEMISRSFGVISSKSDVYSFGMLLLEMAGGRRNADPNAAASSQGYYPSWVYDQLTLQGESGEISPVTANMHELEKKLYESRDRPTMSEVMDMLEAGADGLQMPSRPFFCDEGHIHVEDSYHFTSELTTVSEELTVVSEDEE

SEQ ID NO: 49642 - protein, 669 aa, Magnaporthe grisea 70-15
MGSETRQVSFPLNPALESQRHLTSSCNTAQEAPDSVSIEEFMSDEKYGRQPFAKSRNPFTCGITGRSYSHPELFARADFLARALSRRSGWAPNDGLTPWDKVVAIFSINTIDYLLPAYAAHRMNGIATPVNAAYTASELEHQLRSAGAGMVFTCTALFGVTLKAADAAGIRRERIFLLPTAGDAADGAATKKSPFPNLQELIAEGQSLDSLQKLKWIKGQGARQVAFITYSSGTSGLPKAVIISHYNVICNVIAHTTFNSVSRKKNGIETEVELGLVPMSHTYGLLVVSHMATWRGDEIIVLPKFEMRSYLNAIQRFRIERLLVVPPIIIAMLNSGELCSQYDLSSVRFVASGAAPLGEETIADLAAKYPQWGLVQSYGMTETAVITSHTSEHDILPGSSGSLLPGFRAKIVDTVTGKEITSHNQAGELWIQASLLHLELSPSVVLGYMNDERATTETFVYDADGRWVRSGDKVYVTTSPHHHEHLVVVDRIKELIKVNGYQVAPAELEAHILKHPAVSDVAVTQIPDHRAGEVPKAFVVRAPEYHPELPLDEIAGRIIQHVADHKARYKWLGGGVEFVDAIPKTPSGKILRRKLREPRAPASCLELGEEADERLPDFEEDSIDSSPVSEGSPGDAAPKTPLEPHPSMDDDVFCIKNQIDQAFEWKSAV

SEQ ID NO: 49643 - protein, 486 aa, Mycobacterium sp. KMS
MINANLIINGREETSDRTIDVVSPADIRVLLGSVPDAAPGQVDEAVAAAAMAFPEWSSRPLEERQGALLAAAGTIHDMIEEYAPILSRENGKILEESHVDLEFASGICGYTAGISAEILADQQIRDTGGTTLIRRRPIGPVAAITPWNFPVVLAFMKLAPALVAGNTVVLKPAANSPLVLAEIIRALQQHFPPGVLNMVTGGDAVGEALVAHPRIRKIGFTGGIDTGRKVMAAAARDIKRVTLELGGNDPAILLDDVDLSPETMRQIVKGAFGTTGQVCFGLKRIYVPTRIHDRFVEAFSAAVDEIVVGPGDDPRVTMGPLNNAQQKNLVEKIVDDARSSGATVTTLGQRLDSAAWDHGHFMMPSVVTEADPRLAIVEEEQFGPVVPVLKYDELDDVIRLVNQSQYGLAASIWTSDEERAFLLGRRFDTGSVFINSHTFTSLDPRAPFGGAKASGLGREFSPASLDSYTELQTISRRIGPPGPPLS

SEQ ID NO: 49644 - protein, 495 aa, Avena sativa
MLVHPFLGPCRVTAIYYSRFVIELIPLLASSPCPLQKLYSKTIPVHFAYEEHPRKAHCDIADIYDEKRAILQHNSLLVFVAANQLMTDLPLNCEVVSDGLIWLPYSWDQSGSYWQPTLNTSVERILKSAKTEQGWTGSHIKVIAATSSVATLIVLFLIVATAVYLSLKTNYNKEIHLKVEMFLKTYGTSKPTRYTFSEVKKIARRFKVKVGQGGFGSVYKGELPNGVPVAVKVLENSTGEGEVFINEVATIGLIHHANIVRLVGFCSEGTRRALLYEFMPNDSLEKYIFSPDSNIFQDLLVPEKMLDIALGIARGMEYLHQGCNQRILHFDIKPHNILLDYNFNPKISDFGLAKLCARDRSIVTLTAARGTMGYIAPELYSRNFGGISYKSDVYSFGMLVLEMVSGRRNSDQGIESQNEVYLPEWIYEKVTTGQDPVLTRELTGEERVKIRQLAIVALWCIQWNPKNRPSMHKCGKYVDREVAESTDTTKAFCVI

SEQ ID NO: 49645 - protein, 443 aa, Arabidopsis thaliana
MVTLWGNYEGISQGLAAFTSSLYLAGLVSTLVASPITRNYGRRASIVCGGISFLIGSGLNAGAVNLAMLLAGRIMLGVGIGFGNQAVPLYLSEVAPTHLRGGLNMMFQLATTIGIFTANMVNYGTQQLKPWGWRLSLGLAAFPALLMTLGGYFLPETPNSLVERGLTERGRRVLVKLRGTENVNAELQDMVDASELANSIKHPFRNILQKRHRPQLVMAICMPMFQILTGINSILFYAPVLFQTMGFGGNASLYSSALTGAVLVLSTFISIGLVDRLGRRALLITGGIQMIICQVIVAVILGVKFGDNQELSKGYSVIVVIFICLFVVAFGWSWGPLGWTIPSEIFPLETRSAGQSITVAVNLLFTFIIAQAFLGLLCAFKFGIFLFFAGWVTVMTIFVYFLLPETKGVPIEEMTLLWSKHWFWKKVLPDATNLEDESKNVSV

SEQ ID NO: 49646 - protein, 275 aa, Mycobacterium sp. KMS
MREVRPFTNRRRVSAVKAGDRRVAIVTAAAAGIGKAIALRWCREGGCCVMADTDGEGLDAAVHELAESGAAVCGVAGDVCLSDVANSVVERALTEFGRLDTLFNVVGGSLARNVEEISEEQWRSQIDMNLGSVFQMSKPVIPLLRQGGGGSIVNVASTAGILAENRCSAYSASKGGVVLLTKNMALDFARDNIRVNAIAPGGTRTPRIERFLAEHPEHASMMVDLCAMQRFAGPDEIAAPAVFLASPEASYITGAVLPVDGGMTAGVTFRAFEAV

SEQ ID NO: 49647 - protein, 653 aa, Avena sativa
MGNPGAFRCSVTLQALIVFSLIAVFAADHVQGGDDGCAPFSCGHLQDISSPFRRQGDPLECGVGAYELGCTSSKATIHINTGTYYVTAINYTNSYFRVMDTNFDTNSSCPLPLWNHLPYVESILDSHGFWDLSIRSGYTACFANCSRAVTNNGAYKPVDCLSADNSHVYIWMSGYFDCRVLDLEPYCGYLAMIPFGEEYSSDMQLQLQGASYADIIQLITKGFTIQFPYEEYREPSLSKDMNICLNHSISYFKEHISHASFVTWTRAFFWGDMYFYRCVDRLYTFEHTTSPVVAQLIAVPKFLFVYKYLKTRITIDAVEKFLRIQQMIGPTRYAYTDIVALTSHFRDKLGQGGYGSVYKGVLLPGGAHVAVKMLEGNSSCNGEDFISEVSTLGRIHHVNVVRLVGFCSEELRRALVYEYMPHGSLDKYIFSAEKSFSWDKLNEIALGIARGINYLHQGCDMQILHFDIKPHNILLDTNFVPKVADFGLAKLYPRGDSFVPLSAMRGTVGYIAPEMISRSFGVISSKSDVYSFGMLLLEMAGGRRNADPNAAASSQGYYPSWVYDQLTLQGESGEISPVTANMHELEKKLYESRDRPTMSEVMDMLEAGADGLQMPSRPFFCDEGHIHVEDSYHFTSELTTVSEELTVVSEDEE

SEQ ID NO: 49648 - protein, 386 aa, Clostridium acetobutylicum ATCC 824
MSCTINPLVKKIELSPIREISDAALKYSDAINLTVGQPDFTTPEHIKLSAKKAIDNNHTSYTANSGICELRKAASNFINKKYNLNYNSDKEIIVTNGATEAIDISLRTILEKDDEVLLPAPIYVGYEPVINFCGAKPVYMDTSSNNFILNAEILEKYLTPKTKCLILCYPCNPTGSAMDKNALTEIVNLLKNKDIFVISDEIYSELTFKKRHFSIAGFEDMRNKTILLNGVSKSHSMTGWRIGFIFAPEYLTSEIFKLHQYGSTCSCSISQYAALEALTNGFNDSEYMKKEYIKRRDFIYKELVSMDFDVVKPEGAFYIFPSIKKFNMTSLNFSLKLLEKEHLAVVPGSAFSHYGEGYIRISYAASMKDLKEGMIRLRRFIQSVKL

SEQ ID NO: 49649 - protein, 641 aa, Avena sativa
MSKLLAIAILLLPLIDHGIDLATAWDDKDFFKYCPPSRCSQHGPEIRFPFCLESINTSSCGCGSRSIRKLACSGQDTILLHPVLGPYNVSAIDYRHSSMKLIPLVDPCMVLQKKLINFRSSPCPQIDDINDNLLVHFYRSTSLVCCSGEFTPSAADRIAGPISCLSNATHFLYFAAGYEDMSLLPLDCKVVPVSDGLYGRIPTYILDDPIVGRYQQSQLFKESAEIILSSAEMTVYWYDGAQNANTMGDTARSTHKGKLHSACLTLTNSTKVPLVAFLSNHIEPTTSSVAVFVVLLLTTVTMIYLSLRTRYSEEIHFKVEMFLQTYGTSQPTRYTFSEVKKIARRFKEKIGQGGYGSVYRGELQNRVPVAVKMLENSRGEGEVFINEVAPIGLIHHANIVRLVGFCSEGTRRALIYEFMPNESLEKYIFSHDPNIFQHLLVPQKLLDIALGIARGMEYLHQGCNQRILHFDIKPHNILLDYNFNPKISDFGLAKLCPRDQSIVTLTAARGTMGYIAPELYSRNFGEISYKSDVYSFGMLVLEMVSGRRNSDPSIESQNKVYLPEWIYEKVINDHELALPAETTEEEKEKVRQLAIVALWCIQWNPRNRPSMTKVVNMLTGSLQNLQMPPKPYVTSENQLMP

SEQ ID NO: 49650 - protein, 472 aa, Geobacter sulfurreducens PCA
MHRITFGTSGWRGILCEDFTFENVKVVSQAIADHVKAIGEQDKGIIVAYDTRFMGERFAKETVRVLAGAGVKAYFCRRDTPTPVISFEILRRGTAGAVNFTASHNPPEYNGIKFSPSWGGPALPETTGDIERRANEMMGEVCYREMALDEAVKAGLLEEIDPREEYLKALESKVDFDAIGRVGSVAVNALYGTGRGYLEEPLITRGLDVKAINMHRDPYFGGFPPEPSEKYIQDFIRLVKDDPAIRLGIATDGDADRFGIVDGDGTFIEPNYIIALLFDYLVRVRKMTGAVARSVATSHLVDAVAKKHGIEVIETPVGFKYIGELISQDRIIIGGEESAGLSIKGHVPEKDGILACFLVAEMVAREGLSVKALLARLYEEVGTFVTKRENITLSPAVEEGYAEKQRQAPDSFAGLKVTQKVTVDGSKFILEDDSWLLFRKSGTEPVVRLYAEASSEEKLAAVMAAGKQFILG

SEQ ID NO: 49651 - protein, 229 aa, Oryza sativa (japonica cultivar-group)
MEAKREFFFCSGGLGFTNVALVLFTTWFYSYEWCGGFSINEHVPKTNGDIPSVDEAFSDHQRLLHRLELYDLAELKVEGDGNCQHVSYTQFRALSDQFYRTTEHHRFVRQQIVKQLESYPEIYAGYVPMDYREYLKKMIKHFHFVATKSTRNGEWGDHVTLQAAADSYGVKIFILTSFRDTCYIEILPVVQKSERVICLSFWAEVHYNSIYPEGELPVMENKRKRWWHF

SEQ ID NO: 49652 - protein, 532 aa, Oryza sativa (indica cultivar-group)
MDAGAEPLLPPPASALPSVAIAGVEISERFAFGGISGNLITYLTGPLGQSTASAAAAINAWNGAALLLPLLGAAVADSWLGRYRTIICASLLYILGLGMLTLSPVLVPHQQAESGDNADNNASSSMDIHVAFFYLSLYIVAFAQGGHKPCVQAFGADQFDENDPEECASRSSFFNWWYFGIYGGNVITVSILNYIQDNIGWQLGFGIPCIAMSLSLAVFLLGTKSYRFYPLRSNTSLFDQVGKSLLAKIRWWCASWCSKSSGDLHCTQASSSQGDHNDAEKACFPDEATAVLKLFPIGATCLIYAIVFAQWITLFTKQASTLDRWIGKVQIPAAALQSLISVSIVISVPIYDRILVPLTRRYSKNPRGITTLQRIGIGLIISVILMVVAALVETRRLMVARDFGLVDNPEATIPMSFWWVVPQFILTGLADMFTMVGLQEFFYDQVPDGLCSLGLALYLSIFGIGSFISSFLVYAIDKVTSMTGDSWFSDNLNRGHLDYFYWLLAVFSVLGLAAYLHFSRVYVHKKKGISVQ

SEQ ID NO: 49653 - protein, 115 aa, Synechococcus elongatus PCC 6301
MNRLLRSLLMAFCLLICGLTIAPISTQAAPATGAALFEAQCVGCHIGGGNIIRRGKTLQLKALKKNGYDTAEAIATIVSQGKNNMSAYSDRLSPEEIAIVSAYVLEQANAGWPRS

SEQ ID NO: 49654 - protein, 158 aa, Synechococcus elongatus PCC 6301
MSHSAILKQRSGAFLAFPSRQVTINFAKLVDCEFYSGSMGAQEIIRSIEAEYTKSDLPTIYVGDTVKVGVRIQEGGKERVQPYEGVVIANSGGGINESITVRRIFQGVGVERVFLLHSPAVASVQVLRRGRVRRAKLYYLRDRVGKATRVKQRFDRSI

SEQ ID NO: 49655 - protein, 711 aa, Oryza sativa (indica cultivar-group)
MAMEAEALLPEPESPPLLAVDHLGGPASRGSSGRWPAAFVLIGTSGGRREVRILGHHGEPGDLPDRAAPAADGGGGGGGERVDGHLDAAAAARLGRRRLMARPLPHHRLRLPPLHLGLGMITVSSVLAPEESSESSNLAAHVAFFYFSLYVVAFAQGGHKPCAQALGADQFDENDPGELASRSSFFNWWFFASYGGNTVTVPILNYVQESVSWQLGFAIPCIAMAVSLAIFLIGTRSYRFYPPKSKGNPFGEVAEWIRRWIASSCSKLPDSSDELLPSSSSEGDVSNSSSEFVPNEAAELVKLFPIWASSLIYAAVMAQCITFFTKQASTLDRRVGSLVLPAASNGALFNATIMVFLPIYDRIFIPVARRYTKNPSGITTLQRIGVGLVLSIITMIVAAMVEMRRLRIARDFGLVDKPEAVVPMSFLWIVPQNILAAISDMFAVIGLQEFFYGEAPESLRSFSMALFLSIIGVGNFISSFIVYAIDRVTSSFGDSWFSNNPNRGHVDYFYLLITVLNALSLACFLYFAKMYEHRKKWDSGCEQHLPMAYKMKGVFKGLKVISQIFVVKEHQMEIGYPTDVKHVTHIGWDSPTGSAASPSWMNDMKGSPDYSSLNNFGPSTGTSWTSQVCSTDFDHPQDISPFGLYVENAGKEANPPHPDIPKPPRKSRRKKSKNNSPTASSRSSRSRSKRSFSSTADTVVDNSIQNEVRIV

SEQ ID NO: 49656 - protein, 471 aa, Mucor circinelloides f. lusitanicus
MFVVRQSKALSPIYHRASIAASFHTTRAWLATPAKESDNDASAFEKIAHGLNSFKSTVLGSPPLRNITKPVDTPFTGEAANWNQALSEAQSLVKDSDDRIIDPAKLVGDDLKEIKANISKLLGSGHPFLNTVARHYFSGEGKHVRPLLVLLIAQATSIADKKSLASNIDYKSIDTPISHGLKNITTNDVFDRKLHYTPSVTDQGCIILPTQRRLAEISEMIHTASLLHDDVIDASMTRRNLPSANASFGNKMAVLGGDFLLARASLALARLRNAECIELMATCIANLVEGEFMQLRNTKEGESGKVKKLSTFDHYMEKTYMKTGSLIAQSCKASAVLGGSTKEVANIAYDFGKNLGLAFQLVDDMLDFTVTAAELGKPAGADLKLGLATAPVLFAWEEYPELEPLIKRKFSVKGDEEKARDLVYQSDGLKKTLDLAQIHCKLATDALYKLPASDARSALVQITEKLLTRRS

SEQ ID NO: 49657 - protein, 489 aa, Escherichia coli CFT073
MHLLTLSINPTFLMRSNHFKEFKMDKKQVTDLRSELLDSRFGAKSISTIAESKRFPLHEMRDDVAFQIINDELYLDGNARQNLATFCQTWDDDNVHKLMDLSINKNWIDKEEYPQSAAIDLRCVNMVADLWHAPAPKNGQAVGTNTIGSSEACMLGGMAMKWRWRKRMEAAGKPTNKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 49658 - protein, 316 aa, Oryza sativa (indica cultivar-group)
MPWDSHSSQYEWGVDSHPPGGLLKFLRKTTPRTEQHVCNGSSSQPIDVGDDCNVGDCVRTEKCLPWTKEEDLRLVSAWLNNSNDPIQSNYKKNDQYWNGVAAVYNSTTPKNRARQVKQVKDRWKEANALWASGESEVNLMDRAVKSYEEDHKKDGPFMFKHCWDVLSKEPKWDAYLERLEDLEPDKRKFNVEEGVGHHFSLDDARDERPIGGKQAKEQQKQKRKDQAIIDLEEEFHKLVDAQNTANEGHKEMLETQRHVSSENVEARKLKEHKESTMLETYKSLMMQDTTGMPEDVRSEHMLALRCFKEKLFGKTD

SEQ ID NO: 49659 - protein, 430 aa, Prochlorococcus marinus subsp. pastoris str. CCMP1986
MKETIDFLIDTIEARQVLDSRGNPTVEAEVFLECGAIGRAIVPSGASTGAHEAHELRDGGTKYMGKGVLNAVNKIHETISPALCGLSALDQTSIDNLMIEIDGTPNKSSLGANSILAVSLANARAASNALDLPLYRYLGDPLSNLLPVPLMNVINGGAHAPNGLDCQEFMLVPHGVKTFSEALRIGTEIFHSLKSLLEKKGLSTAVGDEGGFAPELSSSEAAGDLLLEAIQKAGFIPGEQVSLALDVASTEFYKDGFYKYEGKSLTSSQMISYLSNLVSNYPIVSIEDGLAEDDWEGWSALNKEIGNKVQLVGDDLFVTNTERLRKGILEKSANSILIKVNQIGTLTETLEAMDLAKSAGFTSVISHRSGETEDTTIADLSVATRAGQIKTGSLSRSERIAKYNRLLRIEEELGDQARFAGDLGLGPKNI

SEQ ID NO: 49660 - protein, 594 aa, Pisum sativum
MASKQKQTYSVCFCCRRRFKLGISEAPSQIRELYHNYSDESAIMTASHLQRFLIEVQGDENITENEAQSIIDGHKHLSIFHRRGLNLESFFKFLFSDNNAPLLASRGVHQVMSLPLSHYYIHTGHNSYLTGNQLSSDCSDAPIIVALQRGVRVIELDIWPNGSKDDIEVLHGRTLTTPVALIKCLRSIKEYAFVASEYPVVITLEDHLTPDLQAKVAQMVTQTFGDILFCPSSESLKEFPSPDSLKRRIIISTKPPKEYLEAKEVQEKEELTKGKSSGDEEAWGKEVPSLRGGTISDYKNNDDDDEDDLNEEEDSEEAEKSRQNGSGEYRRLIAIHAGKPKGGLVEGLKVDPDKVRRLSLSESQLEKAAETYGKEIVRFTQRNILRVYPKGTRITSSNYNPLIGWMHGAQMVAFNMQGYGRSLWLMQGMFKANGGCGFVKKPDFLLKTGPNNEVFDPKASLPLKTTLKVTVYMGEGWYYDFDHTHFDQFSPPDFYARVGIAGVPFDTIMKKTKTVEDSWLPSWNEVFEFPLSVPELALLRIEVHEYDMSEKDDFGGQTCLPVWELRTGIRAVPLHSRKGDKYNNVKLLMRFEFI

SEQ ID NO: 49661 - protein, 128 aa, Clostridium symbiosum
AALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIE

SEQ ID NO: 49662 - protein, 415 aa, Triticum aestivum
  misc_feature (212)..(212): Xaa can be any naturally occurring amino acid
  misc_feature (225)..(225): Xaa can be any naturally occurring amino acid
  misc_feature (364)..(364): Xaa can be any naturally occurring amino acid
MSSSPTPAPDAGAAAMAVDDSSETDQLDSMSTEDIVRATRLLDNEVRVLKDELQRNNLELENVKDKIMENQEKIKLNKQLPYLVGNIVEILEMNPEDEAEEDGANIDLDSQRKGKCVVLKTSTRQTIFLPVIGLVDPDNLKPGDLVGVNKDSYLILDTLPSEYDSRVKAMEVDEKPTEDYNDIGGLEKEIQELVEAIVLPMTHKEQFQKLGXRPPKGVLLYGHTXGTGKTLNGSWHGLAQTNATFLKLAGPQLVQMFIGDGAKLVRDAFELAKEKAPCIISIDEMDAIGTKRLDSEVSGDREVQRTMLELLNQLDGFSSAERIKMIAATNRADILDPALLRSGRLDRKIEFPHPTEEARARILXRKMNVHPDVNFEELARSTDDFNAQGCYRGDQCNEGIIQVQAKKKSSLNYYA

SEQ ID NO: 49663 - protein, 366 aa, Clostridium perfringens str. 13
MMQPIKKIAILTGGGDCPGLNAVIRAVTRTAILKYGYEVIGYKFGYRGLYNNDFVKLDLDSVSGILHRGGTILHSSNKDNLFDYQVEDENGKIVKKDVSDVGVENLKKEGVDALVVIGGDGTLTSARDFSRKGVNVIGVPKTIDNDLLATDVTFGFNTATEIATEALDRLHTTAESHHRIMLLEVMGRNAGWIALESGIAGSADVILLPEIPYDINKIVEKVKEREEAGKQFTIIVVAEGAKPKDGEVVVSKIVDDSPDPIRLGGIANKLAIDLEGLIKNHEIRSTVLGHIQRGGNTSTYDRILSTKYGVKAVELINSNLFGNMVALKGNKVSYESLENVIGHTKNVDPEGELVNTAKSIGISFAD

SEQ ID NO: 49664 - protein, 341 aa, Mycobacterium sp. KMS
MEAIVLNGTNDVGLTSVPDPAPQDGEVIIEVAATGLCGTDLHEYVAGPTFSQPPVVLGHEVSGRIVEVGAGVDQSRIGQGAAVIPMDFCGSCHYCHRSLYHLCQRPGWIGFTRNGGLANYVAVPSRLAVRVPDVVDLEEAALTEPTAVAFHAVRRAELLLGETVMVLGAGALGLTVIQCARAAGAARIFVTEPSGVRASLARDLGATLVLDPHDPGTTACILEETRGVGVDVVFHVAGSAEAFTQGLDCLRKQGRFMEMSSWAGAASLDVNRHLLKEIQLRMVFGYDMFDDFPAVLALIADGKLALAPQITARVPLDRAVKEGLGGLLEGREGLVKVLVKP

SEQ ID NO: 49665 - protein, 360 aa, Nostoc punctiforme PCC 73102
MGEPKRIGILTSGGDCSGLNAVIRAVVNCAVDTYGWEVLGIRQATLGLMARPPQFTKLEIDQVDSLLTAGGTMLGTTNKGDPFAFPMTDGSLCDRSEEIIAGYHELGLDALIGIGGDGSLAILRRLAQQGGINLVGIPKTIDNDIGVTEHAIGFDTAVNIATEALDRLHFTAASHSRVMILEVMGRDAGHIAIAAGIAGGANVILIPEIPYTVEHICHKIKERQEKGKNYCLIIVSEAVRTHDGENVTITNRLGQSRYGGIGEYLADKIIEHIGVETRVTVLGHIQRGGTASPLDRLVATAFGVAAVNLIAEDKYDRMVTWQNRQVLSVPITEAIAQYSAVDPNGTLVKTAHGMGIYLGD

SEQ ID NO: 49666 - protein, 619 aa, Avena sativa
MSREEMKGATFSCGHLQGISYPFRRRGDPLECGVGAYELGCTSSKATIHINTGAYYVTAINYTGSYFWVMDANFDTYSSCPLPLWNHLPYSGYYGKFDSHGFRNLATQSYYRACFANCSRAVTDNSAYKPVACLSADNSHVYVWVSNYECTVDDLEPYCGYLSMIPLGDDWQIQLQDASYADITQLITKGFTVQFPVDTNAWSVSVSKTISICLNDSISYFKEQISDASMVKRIRAYFWSEMHFYQCVAYRSYNSDYTATSILVVIAIVSAIAIPKFLFAYKYWKTRITIDAVEKFLRIQQMIVPTRYSYTDIVAITSHFRDKLGQGGYGSVYKGVLLPGGVHIAVKLLEGNSSCNGEDFISEVSTIGRIHHVNVVRLVGFCAEEMRRALVYEYMPHGSLDKYIFSADKSFSWDKLNEIALGIARGINYLHQGCDMQILHFDIKPHNILLDSNFVPKVADFGLAKLYPRGESFVPLSALRGTIGYIAPEMISGSFGVISSKSDVYSFGMLLLEMAGGRRNADPNAGTSSLGYYPSWVYDQLTRRDAGEISPVSNMHELEKKLCVVGLWCIQMRSRDRPTMSDVIEMLEAGAGGCRCLRGRFSAMKGTSMWRNLTISLLS

SEQ ID NO: 49667 - protein, 999 aa, Malus x domestica
MLLFLPLLLLLLLPPLPTTLSLNQEGLYLRHFKLSLDDPDSALSSWNYADSTPCNWLGVTCDDASSSSPVVRSLDLPSANLAGPFPTVLCRLPNLTHLSLYNNSINSTLPPSLSTCQTLEDLDLAQNLLTGALPATLPDLPNLKYLDLSGNNFSGAIPDSFGRFQKLEVLSLVYNLIENTIPPFLGNISTLKMLNLSYNPFHPGRIPAELGNLTNLEVLRLTECNLVGEIPDSLGRLKNLKDLDLAINGLTGRIPPSLSELTSVVQIELYNNSLTGELPPGMSKLTRLRLLDASMNQLSGQIPDELCRLPLESLNLYENNLEGSVPASIANSPNLYEVRLFRNKLSGELPQNLGKNSPLKWFDVSSNQFTGTIPASLCEKGQMEEILMLHNEFSGEIPARLGECQSLARVRLGHNRLSGEVPVGFWGLPRVYLMELAENELSGPIAKSIARATNLSLLILAKNKFSGPIPEEIGWVENLMEFSGGDNKFSGPLPESIVRLGQLGTLDLHSNEVSGELPVGIQSWTNLNELNLASNQLSGKIPDGIGNLSVLNYLDLSGNRFSGKIPFGLQNMKLNVFNLSYNQLSGELPPLFAKEIYRNSFLGNPGLCGDLDGLCDSRAEVKSQGYIWLLRCMFILSGLVFVVGVVWFYLKYKNFKKVNRTIDKSKWTLMSFHKLGFSEYEILDCLDEDNVIGSGASGKVYKVVLNSGEVVAVKKLWRRKVKECEVEDVEKGWVQDDGFEAEVDTLGKIRHKNIVKLWCCCTARDCKLLVYEYMQNGSLGDLLHSSKGGLLDWPTRFKIALDAAEGLSYLHHDCVPAIVHRDVKSNNILLDGDFGARVADFGVAKEVDATGKGLKSMSIIAGSCGYIAPEYAYTLRVNEKSDIYSFGVVILELVTGRLPVDPEFGEKDLVKWVCTTLDQKGVDNVVDPKLESCYKEEVCKVLNIGLLCTSPLPINRPSMRRVVKLLQEVGTEKHPQAAKKEGKLTPYYYEDTSDHGSVA

SEQ ID NO: 49668 - protein, 481 aa, Haemophilus somnus 2336
MNIQHLLKTQAYINGEFISAKNHRTFPVINPANQQVICEITCCGKEETELAIKSAKQAQVHWKKYTAKERSKILKKWFELIMQHQESLAYLLSLEQGKPLSESRAEIAYGASFVEWFSEEAKRAYGEIIPQVREENRLLVIKQPVGVVAAITPWNFPNAMITRKAAPALAAGCAIIIKPAPETPLSALALAALAEQAGIPKGIFNVLPTVYAEEVGSVLTRSTDVRKLTFTGSTKIGKILMQQCADTVKKISLELGGNAPSLIFNDADLDRTVDSVIASKFRNSGQTCICTNRIYVQSEIYRAFADKLKQKVRSFIVGDFQQEAVNIGPLINESAVRKIERHIEDALSKGAILTLGGQRHSLGGTFFEPTILENVSQDMLVCHEETFSPLAALIPFDTEEQAISMANDSEFGLAAYVYTQDFSRIWRLSEELECGLVGVNEGIISNEVSPFGGVKQSGLGREGSRHGLDEFLEMKYLCMKV

SEQ ID NO: 49669 - protein, 389 aa, Burkholderia xenovorans LB400
MRALRWHGKHDIRCDTVPDPIIEEGRDAIIKVSTCAICGSDLHLFDGFMPTMESGDIMGHEFMGEVVEVGKDNKALSVGDRVVIPFTIFCGECDQCKRGNFSVCERSNRNKEKADKVFGHATAGLFGYSHLTGGYAGGQAEYVRVPMADTTHVKIPDGLTDEQVLFLGDIFPTGWQAAVNCDIQPEDTVAIWGAGPVGQMAIRSAVLLGARQVVVIDRVPERLVMARAGGAITINFDEESVLDRLKELTNGKGPEKCIDAVGMESHATRSFDAMYDRVKQAVMLETDRPHVLREMIYVCRPAGILSVPGVYGGLIDKIPFGASMNKGLTWKMGQTHVNRWTDDLLHRIQEGQIDPSFVITHTVSLEQGPDMYKTFRDKEDGCIKVVMKP

SEQ ID NO: 49670 - protein, 248 aa, Pseudomonas putida KT2440
MENVIVITGGSRGIGAATALLAARQGYRICINYHADDQAAEAILSQVRALGAEAIAVRADVSVEDEIIQLFLRVDDELGPVTALVNNAGTIGQQSRVEDMSEFRLLNVMKTNVVGPMLCAKHALLRMARRHGGQGGAIVNVSSVAARLGSPNEYVDYAASKGALDTFTIGLAKEVAGEGVRVNGVRPGYIHTGFHALSGDPDRVSKLEPGLPMGRGGRPEEVAEAILWLLSDKASYATGSLIDLGGGR

SEQ ID NO: 49671 - protein, 545 aa, Myxococcus xanthus DK 1622
MAHPLAGKPPPEDFLIDPEKLRAAYFSGRPDVDVPEQRVAFGTSGHRGSSARNSFNEGHILAVTQAICEYRQQQGIDGPLFLGMDTHALSSPAQQTALEVLAANGVQVRFTDGATPTPVISHAILTYNRGRTAGFADGIVITPSHNPPEDGGIKYNPPNGGPADTNVTSVIEKRANALLGAGNEGVQRIPHERARTAPTVKPYDFITPYVEDLGTVIDMEALRGAKLRIGADPLGGSNVAYWEPIATRYGLNLHVVNPTVDPTFRFMPLDHDGKIRMDCSSPHAMANLVRLKDAYDIAFGNDADSDRHGIVTRSLGLMNPNHYLAVAIDYLYRNRPGWKPGTAVGKTLVSSSLIDRVAKDLGRRVVEVPVGFKWFVDGLLDGSLGFGGEESAGASFLRRDGTVWTTDKDGIILDLLSVEILARTGKDPGEHYQSLAAKFGAPHYTRIDQPATAAQKAALKKLSPEAVKATTLAGEPILQRLTRAPGNNADIGGLKVVAENGWFAARPSGTEDVYKIYAESFRDEAHLQDILQEARAIVGEAFAST

SEQ ID NO: 49672 - protein, 80 aa, Zea mays
QEFGTSDPFEVLDQRGVGELVKFATERGRKARPNLKVGICGEHGGEPSSVAFFAKAGLDYVSCSPFRVPIARLAAAQVLV

SEQ ID NO: 49673 - protein, 449 aa, Aspergillus oryzae
MGEDLNNNLTGVEDEVHGTGWTLGGIPKMMVTDMASDALVDSIITERIRKLDQNPVDIQHDLPFLVADTRRIFQQHERWLQCLPNIAPFYAVKCNSNIRLLRYLARLGVGFDCASWGEMKLVLNLGVDPSRIIFAHPCKAVSALQMASRSGVPRTTFDNVDELEKIKDNAPNLRLLLRIFADDDTALVSLGNKFGAPLDTTKALLLKAKDLGLVVDGVSFHVGSGASNADTFVTAVQNAKHVFQQGKQLGFDMHVLDVGGGFQDSNFEPMALSLQRAIEKEFPPSTQVMAEPGRYYARSFYTAACKVVARRKQIGQDKLSQSDMLYLNDGIYGCFMNAVAENEIYRPILFKQETTSSTEREAGEHRYSVWGPTCDGLDCIAKEATMGCEVKVGDWVKFENMGAYTTATSTQFNGFPNRYDIIYVDDHSPPRCDREVMASTKRIRSEAVL

SEQ ID NO: 49674 - protein, 469 aa, Clostridium acetobutylicum ATCC 824
MKFPKDFFLGAASASYQVEGAWNEDGKGVSNWDVFTKIPGKTFEGTNGDVAVDHYHRYKEDVKLMAEMGLDSYRFSVSWPRIIPDGDGEINQKGIEFYNNLIDECLKYGIVPFVTLYHWDMPEVLEKAGGWTNKKTVDAFVKYAKACFEAFGDRVKRWITFNETIVFCSNGYLSGAHPPGITGDVKKYFQATHNVFTAHARSVIEYKKLKQYGEIGITHVFSPAFSVDDKEENKAAAYHANQYEITWYYDPILKGKYPEYVIKNIEKQGFLPDWTDEELNTLREAAPLNDFIGLNYYQPQRVIKNHDTGEKIERTRENSTGAPGNASFDGFYRTVKMDDKTYTKWGWEISPESLILGLEKLKEQYGDIKIYITENGLGDQDPIIEDEILDMPRIKFIEAHLRAIKEAISRGINLKGYYAWSVIDLLSWLNGYKKQYGFIYVDHKHNLDRKKKLSFYWYKKVIEERGKNI

SEQ ID NO: 49675 - protein, 397 aa, Streptococcus agalactiae 2603V/R
MTYLSERVLNMEESVTLAAGAKARELRVQGRDILSLTLGEPDFATPKNIQQAAIEAITDGRASFYTPSSGLPELKSAINAYFERFYGYSLKPNQVVVGTGAKFILYTFFMTVLNPGDEVIIPTPYWVSYADQIKMAEGKPVFVTAKEVNHFKVTVEQLEAVRTDKTKVILLNSPSNPTGMIYKAEELEAIGNWAVEHDILILADDIYGRLVYNGNIFTPISSLSESIRNQTIVINGVSKTYAMTGWRVGFAVGNHDIIAAMSKVVSQTTSNLTAVSQYATIEALNGSQESFEKMRLAFEERLNIIYPLLCQVPGFEVVKPQGAFYLFPNVTKAMEMKGYTDVTAFTDAILEEVGLALVTGAGFGAPENVRLSYATDLETLKEAVRRLHVFMGSNEIN

SEQ ID NO: 49676 - protein, 381 aa, Aspergillus oryzae
MEQYDVAVVGLGVLGSAAAYQAAQRGKKVIAFEQFEFGHVHGASHDTSRIIRTSNPLPEYVKLARSAYKDWAELEEATGQKLLTITGGLVFVPREKASPFESLINTLKVTNLPHEILNATEVKKRWPQFDIPDTVDAVYTADTGIAHASKTVAAMQYLARSKGAILKENTPVDRVVPKKEGGVTIQTPKGEFHAAKVILTTDAWTNKLLAPLGVHIPLSVMQEQVTYFKPTDTAAFQPDRFPVWIWGGDPAFYGFPCYGEPTIKAGRDWSNNLMTPEQRTYVQSPQLFEQLSSFMKSFIPDKERQPLRTVTCQYTITPDRQFIISPLDNNKDIIVGLGAAHAFKFAPAFGRALAELAIDGRTKEDVSKFGIPKSACCRSKL

SEQ ID NO: 49677 - protein, 229 aa, Triticum aestivum
QPALYSKELLEQRAAGPAMMHPSEAVAKGPRWADLFEPGVKHALFVGIGIQILQQFAGINGVLYYTPQILEQAGVGVLLSNIGLSASSASILISALTTLLMLPSIGIAMRLMDMSGRRFLLLATIPILIVALAILVVVNIVDVGTMVHAALSTISVIVYFCFFVMGFGPIPNILCAEIFPTTVRGICIAICALTFWIGDIIVTYTLPVMLNAIGLAGVFGIYAVVCILA

SEQ ID NO: 49678 - protein, 516 aa, Moorella thermoacetica ATCC 39073
MIGENKQLAEIVLVLDFGGQYNQLIARRVREAGVYSEMIPYNTPLEKILARRPRGIIFSGGPASVYSLGAPRIDRALYESGIPILGICYGMQLMAHDLGGRVEGASGREYGKTQLEITAADPLFAGLPESIQCWMSHGDYISAPPPGFQVTARSAYTPVAAMSDPARKLYGVQFHPEVKHTPMGQEILRRFLFQVCGCRGDWSVSSFIEDQVAAIRRQVGNGRVLCALSGGVDSSVAAALVHRAVGDRLTCVFVNHGLLRQGEAEQVQRAFGQAMGMNIVYVDASRRFLEKLTGVTDPEEKRKIIGHEFIRVFEEEARKLGRVDFLVQGTLYPDVIESGTETAAVIKSHHNVGGLPEDMELELIEPLRLLFKDEVRRVGEELGLPEEIVWRQPFPGPGLAIRILGEVTPEKLEILRQADAIVTEEIRRAGLYREIWQSFAVLPSMKSVGVMGDERTYAYPIVLRAVTSDDAMTADWARLPYDLLERISSRIVNEVRHINRVVYDITSKPPATIEWE

SEQ ID NO: 49679 - protein, 779 aa, Candida glabrata CBS 138
MSAPPPPPPPPMAPAASVPKSAMQGRDALLGDIRKGAKLKKAVTNDRSAPILSSGGVSSAPSSAPSGSSAPPVPVSIPGGAPQLGDILAGGIPKLRSVSGSNAPPGGAPPIPGAPPPQQAPKMPSGRPNMPSGRPTNRSHQKKSSISSIASSAPAPPSAPPPPSAPAPPSAPSMPSMRPPKHESKTQNQNSIPSAPAPPVPGAPPAPPTSAPSIPSAPAPPAPPAPPAPPMAAAPPAPPMAAAPPAPPAPPAPPMNSAPSAPPAPPAPPAPPMSSAPSIPALNSQSDNSPASNPPPSIPGGLPFLAEINARRSEKGVVDDKTVSHASNNASTSTNRAPSPPSAPPAPPVASAPSIPSAPAPPAPPISSAPSIPSAPAPPAPPAPPAPPAPPVAAAPPAPPAPPAPPMVSAPPAPPAPPAPPAPSMTSAPPAPPAPPAPALQAAKSMKSSSPPPVSSGPLPFLAEIQKKRDDRFVVGGDSNYSTKVEQTDIQGAAGSAPTTSAPPPPPAGGAGMSFMSEIESKLKHSHHEPAPSSAAPPLPPSAPQIPTSTAPPVPSVKASGDSHGAAPSNSFMSDIAASLAARNSHGADAPDVPSVPPPPSAPPAPSAPAPPSAPAPPSTSAPAAPPAPPPPPSAPMTPAAPPPPSAPSMPAAPPPPSAPAPLTHSAPPPPPASTSSQQTQSTDSAGNIKHRLFSSGTAERKVNQYTNAPEIDVGLVTINGSSSTTGTKIQSGKVTVDDSRFKWTNANQLPKPRPFQGKTKLYPSGKGTSVPLDISSYA

SEQ ID NO: 49680 - protein, 240 aa, Oryza sativa (indica cultivar-group)
MAASSSLRVITAPPKSLLFSFVTSRSLIRVGGWLTMQLILGSSSASRRQILAEMGYSFTLLVGRLARFYYLLREKHFRGTFWRFGHEKADAIMEKLRDNGMMKEILDSQETTLLITADQVVVHDGVIREKPSTPEEARKFIKGYSESHAATIGSVLVTNVKSGARKEGWDKAEVYFHKIPDEVVESLIEEGDVFYVAGGLLVEHPLTSPLVEAIVGTIDSVMGLPKSLTEKLIKESLEEP

SEQ ID NO: 49681 - protein, 167 aa, Saccharomyces cerevisiae
  misc_feature (1)..(1): Xaa can be any naturally occurring amino acid
XESCKMFIGGLNWDTTEDNLREYFGKYGTVTDLKIMKDPATGRSRGFGFLSFEKPSSVDEVVKTQHILDGKVIDPKRAIPRDEQDKTGKIFVGGIGPDVRPKEFEEFFSQWGTIIDAQLMLDKDTGQSRGFGFVTYDSADAVDRVCQNKFIDFKDRKIEIKRAEPRH

SEQ ID NO: 49682 - protein, 947 aa, Methylococcus capsulatus str. Bath
MALLKDKDFGTPPSTSDKMVTLEIDGFTATVPEGTSVMRAAASIGIDIPRLCATDSLEPFGSCRLCVVQIEGGRGLPASCTTPVFEGMKVVTQNDRLAQIRRGIMELYISDHPLDCLTCSANGNCELQDMAGVVGLREVRYGYEGANHFDAKKDLSNPYFQFEPSKCIVCSRCVRACEQTQGTFALTIDGRGFDSKISPGQNQAFMDSECVSCGACVQACPTATLIEKSVVEKGQADHSIITTCAYCGVGCSFKAEMKGSEVVRMVPDKNGQANHGHSCVKGRFAFGYATHPDRITSPMIRKSIHDPWQKVSWEEAINYAASEFKRIQAKYGKDSVGGLTSSRCTNEEAYLVQKLVRAAFGNNNVDTCARVCHSPTGYGLKQTLGESAGTQTFDSVMKSDVIMVIGANPTDGHPVFGSLMKKRVRQGARLIVVDPRDIDMVRSPHIEADYHLKLKPGTNVAVVNALAHVIVREGLVDEAFVNARCEAESFSKWKDFVAQERNSPEAMESVTGVPAQTLREAARLYATGGNAAIYYGLGVTEHSQGSTTVIAIANLAMATGNVGREGVGVNPLRGQNNVQGSCDMGSFPHELPGYRHVSDSTVRAQFEAAWNTRLDPEPGLRIPNMFAAALEGSFKGLYCEGEDIAQSDPDTQHVFAALEAMECVVVQDLFLNETAKFAHVFLPGASFLEKSGTFTNAERRISPVRRVMPPLAGYEDWQVTQMLANALGYPMNYSHASEILDEIASLVPTFSKVSFKRLDEVGSLQWPCNEEAPNGTPTMHVDHFVRGKGRFMLTEYVPTEERTSSKFPLILTTGRILSQYNVGAQTRRTANTAWHSEDRLEIHPHDAENRGIKDGDWVGIKSRQGETVLRAVVSERMQPGVVYTTFHFPESGANVITTDNSDWATNCPEYKVTAVQVTKVNAPSEWQQKFRSFTEEQLSFLEKATAG

SEQ ID NO: 49683 - protein, 464 aa, Yarrowia lipolytica CLIB122
MTSVMKRQNGGGNPFQQHRLLTQIKDKPISFVRAKNPEPVAIKPASYILIKPKQREEEDTSPGTTLSAATPTNFIPLSATLDPGSRSPSKIQKAWKKGTPSPAGLINQGVTCYMNSAVQLLMHMPAMSNYLADILLAKKYPGSVTQVFAQLYGKLFGGKKNIFPRQLIGRLDDINCMMSEWNQEDAHEYFMSLMSRLQEDSTPKGEKLNSSVIYDMFGGNLEQVVVCGGCGNESVTKQDFYDLSVNLDEKKPEGRISLKRCITRFFEEEQIQKKDGYKCDECQKTTSAKKTSRIHEFPEHLVVHVKRFKFVNDQPRKMGAPLDYPADLDLGHYSRDKQRAGVVPYKLIGVIAHCGRTTGSGHYIAHVRQPNGKWATYDDDLIEPLSEKKALKEEDAYMLMYQRLTPQASKSKSASGPKSVAMGTPKAAGKVTKPVVKTGKGQRKMADIDNIFASAKRKKNSGFV

SEQ ID NO: 49684 - protein, 372 aa, Arabidopsis thaliana
MDKIIISNLSEFDHSVVDYHKSSLLLCKSQSFELSPIEMSKNNKKKRRWDLKNGGILLEELIASFDGKTNPIRCFSSDQILKATDNFSESRIISSWGYFIWYKGVIEERQVSIKKWSSQNLSSFTEAYRDISVSSQMSGHKNALKLIGCCLEFDLPALVCEYTEHGPLNRDGGLSSGVVLPWKVRLKIAKEIASSVTYLHTAFPETIVHRNINPTNIFIDENWTAKLSDFWFCVAIPEGELYVEDDVKGVIGFVDPDYYWTMKVTEKVDIYSFGVVMLVLLSGRAAVFNGPDEAPMSLNDHVSEVMEKGEFDEIVDKEIWNDLGGDDDLVLRRSQVKAFLRLALRCVRYKKEDPVSGMLEVAKELKLIEKLS

SEQ ID NO: 49685 - protein, 352 aa, Arabidopsis thaliana
MVKKLKQNLRTGSWKKKEKSMKKERWFLENGSIFLKELIVDCNGKSIPIRSFTSSQIRKATKNFDLSCFVAEEGFYIWYKGVIEDRSYMIKRFSEYKVTDYRVSEVYKDIVLSARMSNHNNFLKLLGCCLEFPFPVLVFEFAEHGVLNYRGGITVNGEESLLPLSLRLKIGKEIANALAYLHMAFPKIIIYRDVKPLHVFLDNNWTAKLSDLSFSISLEEGKSQIEAEDVLGTYGYLDPLYFATRIVTEYTDVYSFGVFLMVVITGISVYFTGSDGYPVGILGYMKGLAENGKLNEIVYPMIMKEMTSAQRLQVEACVLLALRCCEERVEDRPKMIQVAKELKRIEHHVLRS

SEQ ID NO: 49686 - protein, 356 aa, Arabidopsis thaliana
MVKKLKQSLRSGSLEKRKEKEKDIQEEKWFLDNGSIFLKELIADCNGKSIPIRNFSSDQILKATSNFGSSCFVTAEGFYVWYKGIIEDRSYMIKRFSEYKVTQYRVAEVYNEIVLSARMSNHNNFLKLIGFCLEFSLPVLVFEYAEHGVLNHRGGVIVNGEEVILPLSLRLKIGKEIANAVTYLHMAFPKILIHRHIKPRNVFLDENWTPKLSDFSISINLPEGKSRIEVECVQGTIGYLDPVYYTTKMVTEYTDVYSFGVFLMVILTGKPALASTSSDGDYKHIASYVKGFHENGQLDGVIDPKVMEDITSAQKVHVEACVVLALRCCELRDENRPKMIQIAKELKQIETLFRRS

SEQ ID NO: 49687 - protein, 193 aa, Arabidopsis thaliana
  misc_feature (32)..(32): Xaa can be any naturally occurring amino acid
  misc_feature (37)..(37): Xaa can be any naturally occurring amino acid
  misc_feature (80)..(80): Xaa can be any naturally occurring amino acid
  misc_feature (98)..(98): Xaa can be any naturally occurring amino acid
  misc_feature (128)..(128): Xaa can be any naturally occurring amino acid
  misc_feature (136)..(136): Xaa can be any naturally occurring amino acid
  misc_feature (175)..(175): Xaa can be any naturally occurring amino acid
RLKPSGRAFPYLFHTYTSFATLQSHAFATTRXWEVQXNPPPMTLLPCSRALVDLILRPTEYHMEIWTNNFEFRLRSMLAXQPELPLTCPTRNTNSNGXTLTFTFADQTYFSATYISEEQVERWQTPDXLDNLNDTXRFTETSDAITFESKYDHIYLITPTKIAILYHENERTFIXTRELLTDARESNPCDHRS

SEQ ID NO: 49688 - protein, 711 aa, Oryza sativa (indica cultivar-group)
MSLLVVLFFFFLSPPLAAAAAYTEYSCNGTRGNFTEGSAFGLNLELLAAELPANASSSRSLFASAAVGAAAAPEDRVFGLALCRGDMRDAAACAGCLSGAFQRLRALCGRDRDATYYHDLCVVRYSGDDFLSRPDDNSPVINALDANASTYYGWDGRNATTRSFFLSLVGTLFGEMAMYGSYNSSARRYASAVMYVNPQLPTVYGLAQCTPDLSPAQCWHCFQGLQEQNRQWYDGRQGGRILGVRCNFRYESYQFYAGTPDVRIGLQDVAPSPTANNGTNHRKTLVIVLSVSITVFCFMLVGCLLLIKKLRKGDGRKSNRQLEAHSRNSSKTEEALKLWRIEESSTDFTLYDFGDLAAATDNFSEDHRLGRGGFGPVYRATVNVDENADDLGELSDGAEIAVKRLAAQSGQGLKEFKNEIQLIAKLQHTNLVRLVGCCVQEEEKMLVYEYMPNRSLDFFIFDQEQGPLLDWKKRLHIIEGVAQGLLYLHKHSRVRIIHRDLKASNILLDKDLNPKISDFGMARIFGSNMTEANTNRVVGTYGYMAPEYASEGIFSVKSDVFSFGVLLLEIVSGKRNSGHQHYGEFVNLLGYAWQLWREERGCELIDPTLGECSGSEAAAIIRCVKVALLCVQDNATDRPTMTDVAAMLGSDGVPLPDPLPPPHYQLRVSGDDYDDGGRGSPAGGGFRPSRWRFTDSCSTNDVTITTIEEGR

SEQ ID NO: 49689 - protein, 620 aa, Cryptococcus neoformans var. neoformans B-3501A
MRASRFVIPSTQPVRFRRQFRPAWIPSLGTGYDSCCVYFTTTSSSISSDSGSESGPSSGFSSRRFRRRYLYPLAFLPAGFLLVPTLSAETEPFPGAGSSSLQIASTAQLLRTWLVYSLISFPGVVDYSPKILSILINSPLRLPTEWFVRNTFFEQFVPGETVEDCISSLKALRTRGIGAMLNYSAEVDESQLQDDNTYGKEARRQRERKHRLEQVMMALEKSGEYERSLPVEQRGATGFALKVTGIVDPNVLERASYTLLRLRSLAESSSTNAPNTPLFVPYPCTPESLDCQVLARTKDLNFGDPRELFALKDKWDDIGVLETDPGLKEDDLEVLSDLWYNLRKIGEKAKENDVVLIIDAEHTWYQPALDGYTLLLSEVFNKPPKSKSEKWNGPLIYGTYQSYLRRQPTHLMHAIQHAEANGYALGLKLVRGAYHLQERKKWLDEDRLGADPIWPNKPVTDVSYDGSISTILTTLSDQLKSFHPERALSVIFGTHNPESCDIICENLLKNGLAEKGSSGLMRLKKDVRGRVRIAQLYGMKDDLTDRNAARFVNDGQPVAFKYIAYGKLEEVMPFLGRRAFENKSLMSGEQGAAGERKRVTQELWRRYLGRSSSIVPACAA

SEQ ID NO: 49690 - protein, 123 aa, Glycine max
MAGTGRSMLLSLLLFAVTLSLLEMYRGWFAASELKTIAGGFVSSLLFLLLLTFIGNYQEASGVRTGWGAVVVAQLVALIVAGTVHRVCITTCFLFSAGILYEVDKLSGMILARSESRRGGTED

SEQ ID NO: 49691 - protein, 603 aa, Cryptococcus neoformans var. neoformans B-3501A
MSAIRPIMRPFRMTTPFRQSSSFRQLRITWAPSFGAGSSRCLTIGLSPSSGSGSSFRRRLLYPLAILPVGLLLLPVLSADSEPDAIPVPTSLSTSTTSELLRTWFVYAIISMPGVVDYSPAVLNFFINSSLRGPTEWFVRHTFFGQFVAGETVEGCMPTLKAFRERNVGAMLNYSAEVDESQLTETAPSKEERNRKEREKKFETIITALEAAGEYERSLPVDQRGVTGFALKITGLIDPNILERASYTLLRLRPLAKSNSPTAPNTHLFVPYPGTPETLDRQVVARTPDLKLGDGKELLALKGKWDDMGVLEKDPGLQEGDLEELRQLWYKLQKIGHKAKENDIILYVDAEYTWYQPALDAYTLLLSQEFNRPPTSKEETWTGPLIYGTYQTYLCRQPTHLIHAIQHAEANGYALGVKLVRGAYFEQERKKWSDEGRVGAAPIWPNKSATDVAYNGSISTIMTTLASQLKSPHPELALSVAFGTHNPESCDLVCENLLRNGLAKEVGEAKMLKLREDVRGKVRIAQLLGMKDDLTDRMARKFVNDGKPVALKYMAYGKLSEVMPYLGRRAIENKSLMSGDHGAAAEMRRVAAELKRRFFGGSV

SEQ ID NO: 49692 - protein, 128 aa, Zea mays
MVHGKLEVLLVSAKGLEDTDFLNNMDPFVILTCRTQEQKSSVANGAGSEPEWNETFVFTVSDDTPQLHLKIMDSDLTNDDFVGEATIPLEAVFQEGSLPPAVHPVVKEEKYCGEVKLALTFTPAAETR

SEQ ID NO: 49693 - protein, 248 aa, Raphanus sativus
MAGVAFGSFDDSFSLASLRAYLAEFISTLLFVFAGVGSAIAYAKLTSDAALDTPGLVAIAVCHGFALFVAVAIGANISGGHVNPAVTFGLAVGGQITLITGVFYWVAQLLGSTAACFLLKYVTGGLAVPTHSVAAGVGAIEGVVMEIIITFSLVYTVYPTAADPKKGSLGTIAPLAIGLIVGANILAAGPFSGGSMNPARSFGPAVAAGDFSGHWVYWVGPLIGGGLAGVTYGNVFMTSEHVPLASEF

SEQ ID NO: 49694 - protein, 685 aa, Oryza sativa (indica cultivar-group)
MATPRGHLPACVAAAAAAAAALLTSLLPPPVAGQPLGNFCGDSGNYTANSTYQGNIRSLSATLPKNASSSRTLFATATLGAVPDIVYALALCRGDTANASACAGCVAAAFQDAQQLCPYDKDATVFYDACALRFSNQNFLASTNGDNKFLILMNTKNVSAPAKVFDAAVGVLINATADYAAANSSRRFGTGEEGFNGSKIYGLAQCTPDMATATCRSCLGGIVGMMPKYFSGKQGGRILGLRCHYRYEIYPFFNGVSLLQLPAASLGAPPAPSPAPVNVTPPATTGGGGNKTGRVLAIALPIVAAIIAAVVICFYIWKRKTERARKPSIADPTDPEDIGSIDSLILSISTLRVATDNFDDSNKLGEGGFGVVYKGVLPSDQEIAVKRLSQSSRQGIEELKNELVLVAKLQHKNLVRLLGVCLEEHEKLLVYEYMPNKSLDTILFDPDRSNVLDWWKRLKIVNGIARGLQYLHEDSQLKIIHRDLKASNVLLDSDFNPKISDFGLARLFGNDQSQDVTNRVIGTYGYMAPEYAMRGHYSIKSDVFSFGVLILEIVTGRKNNVSYDSEQSVDLLSLVWEHWLAGTAVELADSSMAGHCPGDQILKCVHIGLLCVQEDPTERPMMSMVNVMLSSSTVSLQAPSRPAFCIQKSSVNSDSYSEPFRGANHSTDRSPMSPNEVSITELEPR

SEQ ID NO: 49695 - protein, 228 aa, Arabidopsis thaliana
MNALAATNRNFRHASRILGLDSKIERSLMIPFREIKVECTIPKDDGTLVSYIGFRVQHDNARGPMKGGIRYHPEVDPDEVNALAQLMTWKTAVADIPYGGAKGGIGCSPRDLSLSELERLTRVFTQKIHDLIGIHTDVPAPDMGTNAQTMAWILDEYSKFHGHSPAVVTGKPIDLGGSLGREAATGRGVVFATEALLAEYGKSIQGLTFVIQVKPLSANLRSQALLCI

SEQ ID NO: 49696 - protein, 224 aa, Listeria monocytogenes EGD-e
MINQKKIAGEKACEWIKDGMVVGLGTGSTVYYTIEKLGEMVNNGLHITGVATSEETNKQAQNLGIPLKSLNDVTEIDITIDGADEIDTDFQGIKGGGGALLREKMVASASLKNIWVVSEEKLVRNLGKFPLPLEVIPFGWKQVERKLEKEHIQTNLRKQSSGEVYVTNNGNYILDIVNQTFTDAEMWQEKLAQIPGIVEHGLFLHYVDIIICAKANGEIELIKK

SEQ ID NO: 49697 - protein, 339 aa, Listeria monocytogenes EGD-e
MSKDIDWSNLGFSYIKTDKRYISYWKDGEWDEGALTEDNTLHISEGSTALHYGQQCFEGLKAYRCKDGSINLFRPDRNAARIQKSCERLLMPHIPTEKFIDAVMQVVRANEEFVPPYGTGATLYLRPFVIGVGDNIGVHAAPEYIFSVFCSPVGPYFKGGMAPTNFIVSDFDRAAPNGTGAAKVGGNYAASLLPGQAAKERNFGDCIYLDPATHTKIEEVGSANFFGITKDDKFVTPYSPSILPSITKYSLLYLAEHRLGLEAVEGDVYIDKLDEFKEAGACGTAAVITPIGGIQTKDDFHVFHSETEVGPVTKRLFDELCGIQFGDVEAPEGWIYKVK

SEQ ID NO: 49698 - protein, 466 aa, Mycobacterium sp. JLS
MIDSRTAPTASEVLARLHAEDIATVILGGTDTHGVMRGKRVPISQLPRMLEHGMPMCDVFWVMHVDESDLVARPDGYRGYFPTERQGYPDILAVPDLTTLRIVPWHNDTALLLCDWELPADHRPVPIAPRSVLRRVVERADAMGYRPLSALELEFYLLREKAGTTHRKRADELVPLQEAPSTYGVVMGSLQEDIGALIRRHMLDYGLPVEACNPETGPGQFEITLRYGNSLKSADDAFLFKSAVKEVAAQNDLLATFMAKPVTDWAGNSCHVHLSLRDIAGGGVFFDQDAPDQLSTALRHFAGGILHTMREFTALMAPTPNSYRRFVPYSWAGTTATWGVDNRSVGLRVIREGDHGTRVEHRQPGGDANPYLATAAALAGGLHGLLNEIEPRELSTTDIYSQPSEDLPVLPATLAEAVDLLADSAAAREWFGDDFVDHYVLMKRAEIAAQSVAVTDWEVARYLEAM

SEQ ID NO: 49699 - protein, 315 aa, Clostridium acetobutylicum ATCC 824
MSEFITIGEPLALFAAEGESEIDKRISEVDHFKKFLAGAEVNVSVGVSRLGHSAQYITKLGEDPFGEFIRRRLNEENVGTDYISSTNKKFTGFQLKSKVSEGDPSIFYFRKNSAAANFSVEDLNKVNLDGVKHVHITGIFPALSESTKEATYKLLELAKERNITTTFDTNLRPQLWNSKEDMISTINDIAFKSDILLPGINEGLVLMGSDKPEEIADFYLNKGVKLVIIKLGSKGAYVKTKDEAYTVEGFKVKHVVDTVGAGDGFAVGVISAILEGISVKEAVRRGNAVGALAVMSEGDNDGYPTHEELEKFLGR

SEQ ID NO: 49700 - protein, 295 aa, Prochlorococcus marinus subsp. pastoris str. CCMP1986
MTLKKILIVSGTHGNEINPVWAINQFNKQFKTIDKNIEYKFVIGNPLAYERGCRYIDNDLNRSFTSIQDNSIYETNRANFLVEKFGFNGSEPCDVAIDLHTTTANMGTSIVMYGRRMKDFCLAALLQHKFGLPIYLHEKDLKQTGFLVEAWPCGLVLEIGSVAQNFYDPKIINRFLIIISSLRDEINKLKNNQIRLPKDLFVHVHQGSIDYPRDKNGNINALIHPERINQDWKPIKKDAPLFMDMEGKTKTYADEDTIWPVFIGEVAYKEKNIAMSFTKKEVVSVSDQMYEEFFS

SEQ ID NO: 49701 - protein, 309 aa, Oryza sativa (japonica cultivar-group)
MATTRGQLPVEDVLRVNGSRRFAAALAAASPFASLADALLAARRIWLNEVDVNGWLEAFAAHPAIGTTSSSAPKWCKEEQSAALATATDSTAQELADWNARYREKFGFVFMICASGRTAPEVLAELKRRYENRPIVELEIAAQEELKITELRLAKLFASEPVAPPSSTVGGPTSQSDKAAGSSNRTRPPITTHVLDVARGSPASGIEVHLEMWKDASTPPSFNNKDFNGWATLGSSVTNNDGRSGQLMDIVNNVAPGFYRISFNTSKYAPSGFFPYVSIIFEIKKNQTTEHFHVPLLHSPFSFTTYRGS

SEQ ID NO: 49702 - protein, 360 aa, Oryza sativa (japonica cultivar-group)
MVGGFDKLKVEFIDQDESVQVVADTIRSSGEIPERYARPEMEADPVIIDTDGYNLPVIDMSRLINPEFSEEEIAKLGSACEDWGFFQLVNHGVDGELLQRIKDDITEFFRLPLQEKMSVAIPPNGLQGFGHHFVFSKEQKLDWVDLLFLTTRPVEDRTTEFWPTKPPTFRDSLDKYSLEIANVSAKLFKFMAINLGVDEEALLAAFKPEQPQSVRINHYPPCSQANKVLGLSPHTDGVGMTLLLQVNDVQGLQIRKDGRWFAVKNLPGALVVNVGDVLEILTNGKYKSIEHRAVINPDKERITLAAFQSVPLSSTVGPLQELLMKGEARYKTVDGAEFTKGYFAAKLEGRRYLESLKLGV

SEQ ID NO: 49703 - protein, 212 aa, Nostoc punctiforme PCC 73102
MYQGQMTNDKGQIKMNAFRVGVAGPVGSGKTALVDALCKGLREQYQIAVVTNDIYTQEDAQFLVRSQALASDRILGVETGGCPHTAIREDASMNLAAIEQLEERFIDLDLVFLESGGDNLAATFSPELVDLTIYVIDVAAGDKIPRKGGPGITKSDLLVINKTDLAPYVGADLSVMERDAKKMRGDKPFIFTNLKTQSGLADVIKFVCTNIC

SEQ ID NO: 49704 - protein, 438 aa, Moorella thermoacetica ATCC 39073
MKRGKTVSSRFIGVDEKPALPYLIMYGIQHVLAMFAGIVAVPLMVGTALKLPGEQITILVQGSLLTSGIGTLVQSLGIGRLGARLPICMGTAFVFISPFISVGSQLGIQAILGAVIVGGIVEFVFSFFVWRIQKYVPPVVTGTVVVLIGMGLMPLGFTWLAGGESSLFGQPISFAIGGLVLVILILINQFTKGFWPSISVALAIVVGYLAAGIAGVLNLGLVKEATWFAIPKVFSFGLPKFSFPAILAVLVAQFASMLETIGDTYATGLVAHKEIGRRELSGAISVDGLLSSIAVLFNGLSITSFSQNIGVISITGVASRFAVAVSGIILLLMGLVPKFAALIASMPAPVLGGAALVMFGAIAGSGILQFREAKVFGEREIFIFAISVALGMGFGLHPEGALEHLPSYLTVILGSGVAVGGITAIILNQLLPLRQKEE

SEQ ID NO: 49705 - protein, 264 aa, Prochlorococcus marinus subsp. pastoris str. CCMP1986
MRIRSLLALVISFCLTFAFVTDKTYAFSERGNAQFTDVVNTGKANDCPSLDSSLVGSISLGNGDSLKGICMHPTEVYVKVPGSKRKEAEFVATKIISPRNNTTVTEVYGDIDSGTFTEKGGIDFQLITVLTPGGLEVPFAFSAKDLTADLPSSIEPGTEVSGATFTPNYRTGDFLDPKARAKNTGVEYAQGLVALGGDDEELAKENIKVDVNGTGVVKLSIENVDSDTDEFAGTFVAIQPSDTDMGSKEPLDVKIIGELYGRKA

SEQ ID NO: 49706 - protein, 300 aa, Prochlorococcus marinus str. MIT 9303
MSWKVADIPDQKGRVALVTGANSGLGLETAKALLNKGARVIMACRSRPKGEAVRQIILESNDSTKLDLIELDLADLASVRRAAEQVERQYSRVDLLINNAGVMATPQTLSKQGLELQFAVNHLGHMALTLKLLPLLAKQHGARVVTVTSGAQYMGRIAWEDLQGIKHYDRWAAYSQSKLANVMFALELDKRVRNAASGIASLLAHPGLARTNLQPKSVAANKSWQEGLAYRLMDPMFQSAAMGSLPQLHAATAPTAQGGEQYGPRFNFRGYPKLCRIAPLALREEDRQRLWSISEKLLEI

SEQ ID NO: 49707 - protein, 682 aa, Oryza sativa (indica cultivar-group)
MAITTLLLAFLVALPGGAKAWHFCGSSGDVFAPNTTYQSNLALLSAGLAKNASSSPVLFAAGGVGDPPDTAYGLALCRGDTTNATACGACVAAAFQDGQQLCAYAREATVFYDPCYLRFSGRNFLAADGDNFAAYFSKVRNVTAPAEVFDAAVVALLNATADHAAAASSPRRFATGVEAFRGWGVRDIYALVQCTPDMSPAGCRSCLAGIISWVNDPDYFSGSPTGRVLGVRCNYWYDVHPFFPGSPLLRLDAPAFDVAPPAPSPAPVAADSTPPADRAGRKRTAVIISASVACSIVFVLIISGSVFICLKRRKASKNQKTPIIPAPNKIKRGNCAIFDLPTLQIATDNFSDSNKLGEGGFGTVYRGKLGNGQKVAVKKLSQAQYTREGLNQLHNELQLLAELQHKNFVRLLGFCSHQDEMMLVYEHIKNGSLDIFLFDTSRGKTLNWEQRHNIILGIAKGILYLHEDSSIRIIHRDLKANNILLDENMNPKIADFGLGRLLGGGHTQTKTATVVGTYGYMAPEYVLFGKVSPKIDIFSFGVLVLEIVTGRRNSSFDNTYNAVNLLTEVWNCWTKGTALQLADQSLDGYSDSKVLRCIHIGLLCVQESPVDRPSISSVILMLTRRRIKLQQPRQPAFFFGGDFSSVYQQQHRHRNYMYDKSGVIVEDKFSVNDVTNTDPYPR

SEQ ID NO: 49708 - protein, 163 aa, Triticum aestivum
  misc_feature (110)..(110): Xaa can be any naturally occurring amino acid
APPHEPPTQPERAPAEEGVAPEKNGVGSGGEKEVASEGSGAGAEVGAAVETNGVAVDVWICHQCRQRKTGLTAACRGSKKNGKCTLRYCKNCIRNRYPLIADEVLKEEAXECPKCRNDCNCSKCKKRRGEEPAGPMVHSVKRPKGDLRRIESTDALKDEIVIP

SEQ ID NO: 49709 - protein, 640 aa, Oryza sativa (indica cultivar-group)
MARHRVRCLLAAALLLVAPMAAAQPWQFCGQSGNFSANSAYQSNLRQLSATLPKNASAALFAAGSLGTVPDIVYALALCRGDIANASACESCVDNAFQGGQQLCPYNKDVFIVYDLCYLRFTNRNLLASATDNGSPMMLMNAQNASATAEVFDAAAATLLNATSSYAAANSSRRFATGEEAFDAADPTIYGLSQCTPDMSPDDCRSCLGGIIALIPQYFGRKRGARVIGTRCNYRYEVYPFFAGGSMLRLPAPAAPPSAPGPANMTPPPPTGEAEKKIKVKTAAFIYIASKCCCPLLIDSMQMGEDIESVDSLFIDLSTLRAATGNFSETNRLGEGGFGSVYKGVLPNGEEIAVKRLSMSSGQGIEELKNELVLVAKLQHKNLVRLVGVCLQQHEKLLVRRELDWGKRFRIINGIARGLQYLQEDSQLRIIHRDLKASNVLLDSDYTPKISDFGLARLFGGDQTREITRRVVGTYGYMAPEYAMRGHYSVKSDVFSFGILIIEIVTGRRSSGSLSFDQSNDLLSLVWEHWTMGTILEMMDPSLTSHAPRDQMLKCIHIGLLCVQDNPADRPMMSTVNVMLSSSTVSLQSPSKPSFFIPKSDTDSNIYSESHPLTSQSTASTGRSGGMSVNDVSITELEPR

SEQ ID NO: 49710 - protein, 673 aa, Oryza sativa (indica cultivar-group)
MATFARHRVLLLCRLAAALLLAPVAAAQPWQFCGQGGNYSANGTYQSNLAGLSATLPKNASASRTLFAKDSLGAVPDIVYALALCRGDVANATACESCVATAFQDAQQLCPYDKDAFIVYDLCYLAFSNRNILAAAADDDGSPRFLMNTQNASAPAEVFDAAVATLLNATSSYAAENSSRRFATGEEAFDAAATPTIYGLSQCTPDMSPDDCRSCLGRIIALIPRYLSRRKGGRAIGMRCNFRYEVGPFFAGGSMLRLPAPANSTPTAPTGGRKKNKSGTALAIALPLVVILLATVAICLSVQWWRRRSRSKQQPSNSIQMAEDIENTDSLFIDLSTLRAATGNFSESNRIGEGGFGSVYKGVLPSGEEIAVKRLSMSSRQGIEELKNELVLVAKLQQKNLVRLVGVCLQEHEKLLVYEYMPNRSIDTILFDLEKRKELDWGKRFRIINGIARALQYLHEDSQLRIIHRDLKASNVLLDSDYTPKISDFGLARLFGGDQTREVTSRVVGTYGYMAPEYAMRGHYSVKSDVFSFGILMIEIVTGRRSSGSYSFDQSYDLLSRVWEHWTMGTILEMMDPSLTSHAPRDQMLKCIHIGLLCVQDNPADRPMMSTVNIMLSSNTVSLQSPSKPSFFIPKSGTDSNIYSESYPQTSQPTHRSGMMSVNDVSVTELEPR

SEQ ID NO: 49711 - protein, 687 aa, Oryza sativa (indica cultivar-group)
MAHRAGCLSMLLTAAVVLLALAPRGAAYPWQVCGTTGNFTTNSTYQANLDAVAAVLPRNTSSSPDLFATAMVGAVPEQVSALALCRGDANATECSGCLATAFQDVQNMCAYDKDAAIYYDPCILYYSNVPFLSSVDNAASTNRVNLRNVTSDPGRFNGMVAALVNATADYAARNSTRRYASGEAVLDRESEFPKVYSWAQCTPDLTPAQCGDCLAAIIAKLPRLFTNRIGGRVLGVRCSYRYEVNPFLNGPVMVHLTAPPIPTASPPAAAAAAAGEGKDYNVPRLVLAILLPTIAALVLINILVWLCFWRRMERLRSGATQPYSSNFAESENISSVESMLIDISTLRAATGCFAERNKLGEGGFGAVYKGTLPDGDEIAVKRLSKSSTQGVGELKNELALVAKLQHKNLVRLVGVCLEQEERLLVYEFVPNRSLDQILFDADKRQQLDWGKRYKIINGIARGLQYLHEDSQLKVVHRDLKASNILLDMNMNPKISDFGLARLFGRDQTQGVTNLVIGTYGYMSPEYAMRGNYSLKSDVFSFGVMVLEIVTGKKNNDCYNSLQSEDLLTLVSTNHMILLVCSWKNEVWEQWTARAVSEAVDPVMGGGFSWSDVMRCIHIGLLCVQENPADRPVMSSVVMMLGSDTVSLRAPSKPAFCARRNGGGGGGAGASSGGTSSGTSTAASVQGK

SEQ ID NO: 49712 - protein, 252 aa, Synechococcus sp. RS9917
MGLIVAVVLGLLILLAQAVFIVPAGNVAVVTTLGKVTGVPRTPGPNLKAPLVQTVSLFDVRTQVRPEQFSTLTKDLQVIEATATVKYAMKPGEAGRIFQTIATDNQQIYPRVIQPSLLKALKSVFSQYELVTIATEWNTISEIVQSKVTEELAKFDYVTVQGLDLTGLKIAEEYRSAIEQKQIAEQQLLRAQTEVKIAEQEAKRYATLNSSLDDQVLYKLFLDKWDGQTSVVPALPSSGAAGGQSVIVNGRR

SEQ ID NO: 49713 - protein, 673 aa, Oryza sativa (indica cultivar-group)
MLAVVVVVVAVLLPLAAAQQTMQFSSCASGAYAANSTYEANLAVLAAALPGNASTAVAGAAAGYATATVGAVPDQVSALALCRGDANATACRACVAASFRVARRDCPRSKDATTYQDGCIVRFSDQRFLDFVGVNSPVSELYSDADSNITAVPVAWFNAAVVALMNATVDTAVAAGSGSNNTKKYFATAVEGFDPKHYPKIYGMAQCAPVMTAAQCRSCLGGFVSSIPWFLNGKPGGRVLGIWCNLRYSVKPFYQGQPMLQISAPPEPPPPAMPSLAAPPTRTARRRRVAGISAGVACFVVLMLILSAYAFIRFKRKKAAKKDNLLKKMARGKCTIFDLATLKEATENFSEKHKLGEGGFGTVYKVLFLMRKSLFQGKLPDGQEIAVKKLIESCGHGLNQLHNEVLVLAELQHKNLVRLQGFCVHKDEMLLVYEYIKNGSLDNFLFAHASRGNALSWDQQYNIIFGIAKGIMYLHEDSSIRIIHRDLKANNILLDEDMDPKIADFGLARLIGGGHTHTKTTRIVGTYGYMAPEYAIHGNVSPKIDIFSFGVLVLEIVTKRKNCSYGDGTTDTVNLLSDVWSYWTEGVISQALRCIHIGLLCVQSDPDDSPDIPSVIIMLTRDNMELQPPTEPAFFFNGNSNSASQTSDQRVYVYDRSGKIYEEDISANGITLT

SEQ ID NO: 49714 - protein, 678 aa, Oryza sativa (indica cultivar-group)
MMLAGYGILAVVLVLLPPSATPAGIADCDLGVGNTYVGNSTFEANLNHLAAELPGNVSTAHTGGFAVATVGADPDQVFALALCRGDVNATACRACVAAAFVDGKNACPGINGVTVYEDACVVRFSGQRFMDFLSPDQWQVTEMIWVPEQASESVNAPAVGWFNAAVAKILAALVDHAVATATGNNSTTKKYFATGEEDFDPNIYGFAQCVPDLTPEQCKECLNTFLFQAKQVYFGKSLSWVGMNSVWCRLMYSVRPFYGGRAMLQLSAPPPAAAEAPVLSLEPGAGKKKSAAGIAAVVASSVVVLLILSIFAVVLFRRRSKVTETDHQLRKITRAQCLIFDLPALQEATDNFSDNNKLGEGGYGIVYKGVLSDGQEVAVKKLLGTSEHGLDQLQNEVLLLAELQHKNLVKLQGFCLHQGETLLVYEYVKNGSLDNFLFDTSRGNTPNWEQLYNIIFGIAKGILYLHEDSSLRIIHRDLKSNNILLGEDMEPKIADFGLARLLEEGHTNTRTTRIVGTFGYMAPEYAIHGNVSTKIDVLSFGVLVLEIVTGRRNLNSDDHDRGNLLSDVWNCWTKGTVTQLIDQSLEEQFRRQALRCIHIGLLCVQSDPDDRPHMSSVIFMLSRENMNLQPPAQPAFFFDGDSNSCSQPFEQPVYNRPNAIYEEDISVNRMTVTDIYPR

SEQ ID NO: 49715 - protein, 503 aa, Aspergillus nidulans FGSC A4
MVPSRSTAAAQRPRMRLNRNQLPPWRYWPRQKLLPLIRYETPYLAWCQEKIRTPALDSYFAFTANLGTHTFFMVFLPIFFWSGYPSLGRGMVHLLASGVFFSGFIKDLLCLPRPLSPPLQRITMSGSAALEYGFPSTHSTNAVSVAVYALYLLNSPDSTLSDGLNFFLQGITYLYVTSIVLGRLYCGMHGFFDVVVGSALGVLLAVLHCTFETAIDHYVQVGSGKQVALVVLVILALVRIHPEPADDCPCFDDSVAFAGVMIGAQVAYWNLARANATWTNPHPATLPHSRETMKPTLLRILPPVFRGLEKLGLVLPRRYFTNASQYTTVPSQLKDHEVMPSFSDIPSIVDNIRHPRRRAISIGPQSEADAYETLAYREKRRRDSLSSPYRGSPAIDANNDDASTSGTAYPKLSRKPSKLDEYEHMMGRGTTAIDRSQSPEGTEPFPEFVDHERDEEELFAQIKRPRVRYDVEVVTKLVVYSGIAWIVIDGANVLFEWIGLMSS

SEQ ID NO: 49716 - protein, 403 aa, Arabidopsis thaliana
MNVSLPTDLIREIFARLPSKSVARFRTLSKQWASILRSTDFTKLFLSRSSNRPRLLFAVERYKCNEWQFFSSPQSQNRYEKSAHLEFHSKFSGDVSHYICSYASGLLYFPAVHIVDTETIVICNPITGMYTGLPVIMKDRRSRGFLVFDPVDKRFKAFDTHFILTLGSGELKWREKNIPCPLYERCSSNQGICINGVLYYLAKTVLVETVFGLTFLIVRFDVSSEEFKFIDAARFNDRLKDPTRLSLVNYMGKLGVTDCNCVDAGGRRTVELCLWVLEDVEKLEWVKYVYTLPENEVLASCEFSVAGVTATGDIVLCMKYTCKPYYVFYFNPEKKTLQTVEIQGFGAKLEEVENRGEVFAYVDYVEDLSLNDAKQLKSSISHVKSLCPCCQKLVQPENIGEVV

SEQ ID NO: 49717 - protein, 661 aa, Oryza sativa (indica cultivar-group)
MDRRLILSVAVAVALLVPRSAGEPWPVCGQDFGTFTPKSRFFANLQLIAATLPGNASSSPDLYATAVDVGAVPEQVTAAALCRGDVSASSCLGCLTQAFADLPNACGNSREAATYYDRCMVSYSAINFLSGGAGGEDPARIDAYTVNNENKVTSEQGRYNRLVAALVNATADYAAYNSTRRYAAGEADFDAALPKVYSLAQCTPDLSPARCRSCLAKIVAQELWSYKDDIGGRTLSVRCSFRIETKPFLNGTTMVRLPATSAPSPAPPVNATPSAATPGRETKYKVPRLVLIILLPIIAAVNLVVCFCVWRRKRPVITKAKQTNANYYAEADDVDSVDSMLMDISTLRAATGDFAESNKLGEGGFGAVYKGVLPDGNEIAVKRLSKSSTQGVQELKNELALVAKLRHKNLVSFVGVCLEQHERLLVYEFVPNRSLDLILFDTEKREKLDWEKRYRIINGVARGLQYLHEDSQLKVVHRDLKASKILLDANMNPKISDFGLARIFGQDQTQAVTNRVVDTYGYMAPEYMMRGNYSVKSDAFSFGVMVLEIVTGRKNNDFYNNSHQSEDLLNTIWERWMAGTVDEMVDPAMSRYVSASDVRKCVHVALLCVQENPADRPVMSSVVMMLDSETVSLQVPSKPAFFARNGGAKPGVASDESTASV

SEQ ID NO: 49718 - protein, 726 aa, Coprinopsis cinerea okayama7#130
MGRKEAEALVPEGFVTSKIVYMTGFWAEALLYGIYFCLFVAALNIMLRKRTLHTFSSRVFLVGIVVMFVLITLHNFFNIYSMIEGYAYQTSLESPVHFMRNTTNWARYSFPVILALVIWIGDALVIYRCFIIWQRNYYAILLPLVLLLASISFHSVNLWWFGNPTARSLEDMRPIMSTTFPLHFAQNVVTTGMIAFKLWQHHRRTRRVGVSVSGGLSMITIVRIVVESALLYTVQMAINIVLFFLNSSGQVVIQHCLIPTTGIVFALIAIRAHSARYSSTHSEHNPPSKSLIPSWLHGGENDVENQRTGHSNMPVVTTVTEEHRMDDISHTIKLPDHKLQLTNPLRIQVLLDLSRSRDQTCTYDLSLSYSPLSIDHTDPLNRFTMAPVTNGRAIFNSIPEGFPEPGKTIVYDESQKIDVDTVQLNGGFLIKVLYLSVDPYMRGRMRDPSKKSYSPAFTLGQPMNGHGVGVVVRSESSSVKVGDHVYGMLEFQNYIVRPNLEGLRIVDNKHNLPLSYYIGVCGMPGKTAYMAWKEYSQAKKGETAFVTTGAGPVGSFVIQLAKLDGLKVIGSAGSDEKVEFMKSIGADVAFNYKTTNTLEVLQKEGPIDVYWDNVGGETLDAALEAANINARFIECGMIAGYNTGGQPVKNLMYVVGKSISMHGFIVSRLEHKYEDKFYEEVPALVAKGDLKYREQVFDGLQSVGDAILAVQKGTNKAKAVIKVASD

SEQ ID NO: 49719 - protein, 251 aa, Cryptococcus neoformans var. neoformans B-3501A
MARKFFVGGNFKMNGSLESVEKIVRSINDANLDGTNEVVIAPPALYLLKVQSELNAPTQVSAQNAFTESSGAFTGEIAPQQLKDANVHWVILGHSERRSLFGDTDKLVADKTKAAINAGLSVIACIGESLEERESDKTMTVVERQLEAIAAAIDVDAWKRIVIAYEPVWAIGTGKVATVSQAQEVHAAIRSWLSRRASPEIADSTRIIYGGSVNGKNCGELSAAKDIDGFLVGGASLKPEFIDICKSGKKA

SEQ ID NO: 49720 - protein, 204 aa, Streptococcus thermophilus
MTKRTVIIGVGGPVGSGKTLLLERLTRRMSDLNLAVITNDIYTKEDALFLAKNSSLDEDRIIGVETGGCPHTAIREDASMNFEAIETLQERFNHDLDVIFLESGGDNLAATFSPDLVDFTIYIIDVAQGEKIPRKAGQGMIKSDLFLINKTDLAPYVGANLDRMREDTLHFRNEDSFIFTNLNNDDNVKEVEEWIRKNFLLEVL

SEQ ID NO: 49721 - protein, 115 aa, Streptococcus agalactiae 2603V/R
MNPLIQSLTEGQLRSDIPEFRAGDTVRVHAKVVEGTRERIQIFEGVVISRKGQGISEMYTVRKISGGIGVERTFPIHTPRVDKIEVVRYGKVRRAKLYYLRALQGKAARIKEIRR

SEQ ID NO: 49722 - protein, 234 aa, Zea mays
SRILRSSLALHGCWRCDARVTLWCWCLFQAQLGPAASAMQGHLRTYMNAGIPKRFKEDEEKEQLAKDLAKDWNAVFERSINTLFLTEMVRGLMLTLKYFFDRNVTINYPFEKGPLSPRFRGEHALRRYESGEERCIACKLCEAICPAQAITIEAEEREDGSRRTTRYDIDMTKCIYCGFCQEACPVDAIVEGPNFEFATETHEELLYDKEKLLENGDRWETEIAENLRSESLYR

SEQ ID NO: 49723 - protein, 532 aa, marine gamma proteobacterium HTCC2207
MEYRSYYAIYCAIFVSLGGFVFGFDASVVSGIIGPVTIEFGLTPIQAGFVVAAPTLSSAIGTLMIGPLSDAFGRKKILMFIAVLYLISAVSSALSTSYYMLLAARALGGFAFTSLVIAPMYIAEIAPAKRRGKLVSVNQLNIVIGLSAAYFANYYILGLSSSGADWVSAWGVDQHAWRYMLGFEIVPALIYLVALFAIPDSPRWLIQKGREQEARAVIAKLVPADQVDSEMSLITQSSATVTESLWARIGGIFGPKMRLALIVGIIVAVVQQITGINAIFFYAPTIFEQSGIGTDAAFAQAVLVGLINVVFTLVAIALIDRWGRRPLLLVGLSGIAISMALCTYGFSQATYELKSESVVQMQQMETADANFDASQLNSLVGVVYQSDVEFKTAVSEAIGIEAARKYESELIKSSAQMNALLILVGILGFVASFAMSLGPVMWALFSEIFPNQLRGVAISFVGMINSMVSFMVQLLFPLELSVLGAALTFFSYFVFAVIGLILVAWLLPETKGKSLEELETMFGTKASTGSPA

SEQ ID NO: 49724 - protein, 295 aa, Candida glabrata CBS 138
MSEKQVKYPWWYGGAAGIFAVMNTHPLDLTKVRLQAAPIPKPTIVQMLRSILKNEGIVGLYAGLSASLLRQCTYTTARFGMYDALKEHVIPRDKLTNMWYLLGASMVSGALGGLAGNFADLINIRMQNDSALPLDKRRNYKNAIDGMVKIYKAEGAKSLFLTGWKPNMVRGVLMTASQVVTYDMFKNFLVTKYNMDPKKNSTHLTSSLLAGFVATTVCSPADVIKTIVMNAHKKPGHNHDSSFKILMEAINKEGPSFMFRGWVPSFTRLAPFTMLIFFAMEQLKKYRVGMPKEEA

SEQ ID NO: 49725 - protein, 248 aa, Zea mays
MGRQFFVGGNFKMNGTIKSITEIVDNLNKAKLDENTEVVIAPPSLYLLLTREHLRKGIEVAAQNIFDKPNGAFTGEISVEQLKDSGITWTILGHSERRQILQENDDFVASKTKAAVDGGLGVILCCGESLEQREAGETVNVVTKQLKAVADKVKDWSKIVVAYEPIWAIGTGKVATTEQAQEVHAALREWLKKEVSAEASEKTRILYGGSVSEKNCKELAKRPDIDGFLVGGASLKPAFVDIINSHQA

SEQ ID NO: 49726 - protein, 685 aa, Oryza sativa (indica cultivar-group)
MAASHVALSVPVAAAVALLLLVLPRAAESYPWAKCNDTAGDFPARRSSSYLASINLIAATLPGNASASPDLFATAEGVGAAPDQVSALALCRGDANASTCLACLTQAFLDLPNACAYDKVAAIFYDSCLLAYSNATIAAGDFSSEKIPIYGFYNNANATTEQARFNRLVAALVNATADYAARNSTRRRYASGQADFNAEFPKVYSWAQCTPDLTPASCRSCLAQIIGRGIGFFENRVGGFVRAVWCSFQYSTTPFLDGPMLVRLQGTSGASPAQAPSPAAVVPAVNQTPPAATPTLEGVNSGRKYSIPGLVLIILLPTIAAINVVVGLCFWRRRRPVKEAKRTYANYSTEAEDIENLDSMLIDISILRSATGDFAESNKLGEGGFGAVYKGVLPDGYEIAVKRLSKSSTQGVEELKNELDLVAKLKHKNLVSLVGVCLEQQERLLVYEFVPNRSLDLILFDTEKSEQLDWEKRYKIINGIARGLQYLHEDSQLKVVHRDLKASNILLDANMNPKISDFGLARIFGRDQTHAVTKNVIGTYGYMAPEYLTRGNYSVKSDVYSFGVMVLEIVTGRKNNHSYNSQQSEDLLTMIWEQWVAGTVLEMVDPSMNSFFSESNVMRCIHIGLLCVQGDPAERPVMSSVVLMLGTDTVELHAPAKPTLFARKGGEESGVASGGMSIVSLEEQS

SEQ ID NO: 49727 - protein, 334 aa, Gibberella zeae PH-1
MQSILQKATGIGPQVIKPENLQGRVAIVTGGALGIGYEVSRALAHAGCKVIMVNRKEEQGTSAIEAVKNEKHDADIDWKECDMGNLSQIREVFGGFRESLDRLDFLVLSAGINTNQFGLDSDGIERHFGVNFLGHFYVCNQLWPLLRKTSKMENVSPPRVVFEASEMHRLAQLSNVQFKTKEEINDPDLDPTARYNRTKLAMILFAKYGLAGKVIAENKDKIYALSVHPGAVNTAMQQQWKDAYPGLTGKLLSWTMQAIGRDVEQGSYSALWALTSSRIEEENLNGYYFVDPDKEGEETSQASNPELASNLWDLSTSFIKEKLGEDALADWNGS

SEQ ID NO: 49728 - protein, 436 aa, Clostridium perfringens str. 13
MAQQVISKEQGSIKTLGIFSYFKNGILGLQHLVAMFGATILVPLVTGLDPSVALFTAGIGTLIFHLCTKGKVPVFLGSSFAFIPVIQVIAAKYGDLRYAQGGIFFAGLAYVLISFGIKKIGVDKIKRFLPARVVGPMIMVIGLNLIPNALEMAGVKSLIAGETGAMTSVLIACTTLGLALIISKFGKGFFSQLAIITAVCVGYTLSLILGQVDTSLIQQSTMVAVPNFTLPKFDFGAIMITLPVILAVSMEHIGDITTNGQVVGKNFIEDPGLNRTVLGDGLATLVASLLGGPANTTYGENTGVLAITKNYNPSILRLTAVFAIILSFIAKFGAVIRTIPQSVMGGISLMLFSMIALVGVKTIKNEGVKLNKTNLILMGSIIFVGLSGLFMSEPIGIEISEAVSISGLSLAALIGVILNLIITKFESAKSRKEVIA

SEQ ID NO: 49729 - protein, 581 aa, Schizosaccharomyces pombe
MSHSDYNFDIEQNAFEKEAPKVSIERKGDVVEEEVIATGEVENYAEPKSRNFLQRFFDDFKPALTTRGDGVALKRKLTSRHMQMISVGGAIGSGLYVGSGSAFADGGPASVIINYILIGIMMIFVIYALGELAIAYPVAGSFNTYATRFIDPAWGFAVSWNYFLNYFVTCPLELTTCAITFKFWTEINSAAWISIFLAVVIVINLFGVRAYGEVEFILSTIKVIATVGFIILAIIINCGGVPTDHRGYIGGSIIKQKPFRHGFKGFCSVFTTAAFSFSGTEIIGLAAAEVGNPRKSVPSAVKQVFWRIAIFYVVSLILIGLLVSPDDPRLMGNGDVSVSPFVLAIQEANIKGLPSVFNAVIIISVVSVTNSTTYTAARTLQGMATLKQAPKFFSYTDRVGRPLIAMVVVLLFGFFAYINEADKNGSDISDTVFDWLLAISGLSSFFTWGSICLSHIMFRLAFKKQGHSLKELGFVSPMGIWGSVIGLGFNILCLMAEFYVSLFLIGGSPNANDFFQGYLAACIALAFFIGYKIYDRSHIPSLDKLDIDTGLKTYDNQDEEKEEYSSKGPLNILKKAWNAVC

SEQ ID NO: 49730 - protein, 673 aa, Cryptococcus neoformans var. neoformans B-3501A
MAQSAASACGPSNMVGSVHLADVQGVSREINPYDRNGMFVGAHTICRMFPSSLVPSFTQPAIVFQRPTPPPLAVPSSVQHASSATNSLSASQASQATSVLTDDEEDLEDYRPGGYHPVNIGDEFNNGRYRIVRKLGWGHFSTVWLARDNVANRHVALKVVKSDGHYTETALDEIQLLQRVVSSAPGHAGRHHVLDLLDSFRHTGPNGSHVCMVFEVLGENLLGLIKRYQHRGVPQHIVKQIAKQVLLGLDYLHRECRIIHTDLKPENVLICIDDVESVVQAELASCPAAVPTKLVGVPPSQGRLGNQTPRKDGIFIVGSQPLPSPSSSYSSSPMLDKYGFGMSKISGASAAKAGNQPSGVGGPSYPPTQPKKSATTEAIGTDLENVKLGEGSSLKWEKTATPAPAPPKGPSLLSQQLHHPPASPPLNPSVPSGSASVSTNHTINTATDETEVSTPATTPDHVTRLSDERAPEAGDPTTLPPPFPYDPVSLERITVKIADLGNACWVDHHFTNDIQTRQYRCPEIILGTRWDESVDMWSAACLFFELLTGDYLFDPQPGVKYDKDDDHIAQIMELLGEMPRSLALSGKYSHEIFNRRGELRHINRLRFWPLTSVLKEKYLMEHEDAELLSSFLMPMLAYLPGQRAKASDLLNHPWLEGVVVQGELEMAQSLHKS

SEQ ID NO: 49731 - protein, 271 aa, Clostridium perfringens SM101
MKLFGLIGEKLGHSLSPEIHNKVFKDNNIDGLYNLFSVKKDFENNIVESLKCLGVRGANVTIPYKEKVMNQLDIISHEAKAIGAVNTILIKDGKSYGYNTDYYGFGKMLERAKVDIEGNSFFVLGAGGAARSILKYLEDSKAKKIVLVSRDKEKVFKKFKDFNINFMSYGELEEIHEEFALINTTPCGMYPNTNSVAVSEKVIKKFKVALDIVYNPLETKFLKMAKDNGLKTVDGLFMLVGQGVKAEEIWNGIKVDKSTEENIYEELKCRF

SEQ ID NO: 49732 - protein, 439 aa, Pseudomonas putida KT2440
MTLNNLEIDTLVVGAGQAGVAMSEHLSKLGVPHLVLERNRIAQAWRTGRWDSLVANGPAWHDRFPGLEFNLDADAFAGKDQVADYFEQYVRKYNLPVRTGIEVKRVVRNSDRPGFTIDTSEGVIRANRVVAATGPFQKPVIPAIAPKDSNLHQIHSAAYFNPEQLPEGAVLVVGAGSSGVQIAEELMRAGRQVYLSVGAHDRPPRAYRNRDFCWWLGVLGEWDAEIAKPGREHVTIAVSGARGGHTVDFRALAHQGMTLVGLTQSFENGVARFQDNLVENINRGDDNYLALLDAADAYIERNGLDLPEEPEARQRLADPECMRNPLQQLDLAKAGVSSIIWATGYGVDFSWLQVDTFDANGKPQHQRGVAREPGVYFLGLPWLSRRGSSFIWGVWHDAKHVAGHIATQRTYTAYRDREQRAADEQQTAKISNVSTLGAH

SEQ ID NO: 49733 - protein, 313 aa, Zea mays
  misc_feature (131)..(131): Xaa can be any naturally occurring amino acid
MADAKQQQQQQQQQPQQAAAAATGVWKTVKPFVNGGASGMLATCVIQPIDMVKVRIQLGEGSAGQVTRNMLANEGVRSFYKGLSAGLLRQATYTTARLGSFRVLTNKAVEKNEGKPLPLFQKAFIGLTAGXAIGACVGSPADLALIRMQADSTLPVAQRRNYKNAFHALYRISGDEGVLALWKGAGPTVVRAMALNMGMLASYDQSVELFRDKFGAGEISTVVGASAVSGFFASACSLPFDYVKTQIQKMQPDANGKYPYTGSLDCAVKTFKSGGPFKFYTGFPVYCVRIAPHVMMTWIFLNQIQKFEKKIGI

SEQ ID NO: 49734 - protein, 378 aa, Burkholderia xenovorans LB400
MQDGRTTLSKFLIDTLDRQPCSTETARNAGLSALLIDVAAAIKSISAMLTKGALGGNYGSAQSINTHGEEQKKLDVATNEIFVQQCEWDGLLAAMVSEEMESVYAIPPGYPRGDYLLAFDPLDGSSNIDINGVVGSIFSVLRNGEGNGNANEKNGSDPRGTVGESAFLRPGCEQVAAGYAVYGPSTMLVLSVGNGTHGFTLEREIGNFVLTHSNIRIPEDTVEFAINASNERFWEPPVRRYVQECKDGRSGCRASDFNMRWIASMVAEVHRILMRGGVFMYPRDSKTPAMEGRLRLLYEANPMSFLVEQAGGLSITGRERILDVVPRALHGRVPVILGSKHEVERIGRYHGEYDRGEDQPFTSPLFSRRSLFLPGFTA

SEQ ID NO: 49735 - protein, 680 aa, Burkholderia xenovorans LB400
MSAVAESVAIPATRLMADALRMLAIDAVEAAKSGHPGMPLGMAEIAVALWDRHLKHNPRNPAWPDRDRFVLSNGHGAMLLYGLLHLTGYDLPIDELRRFRQLYSRTPGHPEVGVTPGVETTTGPLGQGLANAVGMALAEALLAREFNRPGHSIVDHRTYVFVGDGCMMEGISHEAASLAGTLKLDKLTVLYDDNGISIDGHVSQWFSDDTPARFAAYGWHVVREVDGHDVDAVDRALSRARAAGRPTLICCRTVIGKGSPSKAGTHDVHGAPLGADEVANTRRALGWPHAPFAMPAEVRTLWDASERGAATEADWNTRFEAYRKHYPHEAAEFERRTQRTLPVQWRDTVRAMVSDADHAGESIATRKASQQAIAVLARALPELLGGSADLTGSNLTNWKTAVDVHADDSGLQGGNYLHFGVREFGMSAVMNGIALHRGHIPFGGTFLTFSDYSRSALRMAALMKTRAIFVFTHDSIGLGEDGPTHQSVEHAASLRLIPGLDVWRPCDTVETAQAWASAVERDGPSCLLLSRQNLPFAARSAEQIDAIERGGYVLRDWPAERAQTRIVLIATGSEVSLALDAVAPLAQAGIAARVVSMPSTSVFDRQPAAWRDAVLPPRVPRVAVEAGVRAFWRQYVGLEGGVVGIDTFGESAPAAALFEHFGLTARAVVDEARRVAQLAR

SEQ ID NO: 49736 - protein, 213 aa, Glycine max
MGWLSRFITAVAFLAIGVIFSPETLGSKSTTLSTYLKLAHLLCFSTAFGAALWVTFIGGIIMFKIVWFKNLPRHQFGNLQSKMFPAYFSMVGVCCAVSVASFGYLHPWKTSSTTERYQLGFLLSSFAFNLTNLFVFTPMTIEMMKQRHKVERENNIGEEVGWSKNVEVAKSNPKLAAMNKKFGMIHGLSSLANIMSFGSLAIHSWYLAGKIDL

SEQ ID NO: 49737 - protein, 784 aa, Yersinia pestis biovar Microtus str. 91001
MLWYNQLGMHDVDRVGGKNASLGEMITHLSELGVSVPNGFATTAQAFNDFLEQSGVNQRIYQLLDNTNIDDIAELSKAGAQIRQWVIETPFHPEFEQSIYDAYKQLADGEPEASFAVRSSATAEDMPDASFAGQQETFLNVQGIDAIMVAIKHVFASLFNDRAISYRVHQGYDHRGVALSAGVQRMVRSDLASSGVMFTIDTESGFDQVVFITAAHGLGEMVVQGAVNPDEFYVHKPTLRNGKPAIVRRNMGSKKIRMIYAENQEHGKQVCIEDVPEIQRNRFALSDDEVEALAHQALLIEEHYGRPMDIEWAKDGHTGQLFIVQARPETVRSNEQVMERYQLNNQSNVLVEGRAIGHRIGAGPVKVIHDISEMDRIQAGDVLVTDMTDPDWEPIMKKASAIVTNRGGRTCHAAIIARELGIPAVVGCGNATELLKEGQNVTVSCAEGDTGYVYHELLDFSVQSSQVTELPDLPLKIMMNVGNPDRAFDFARLPNEGVGLARLEFIINRMIGVHPKALLEFDQQEPALQAEIKALMHGYDDPVEFYIGRLTEGIATLGAAFWPKPVIVRLSDFKSNEYANLVGGAGYEPHEENPMLGFRGAGRYVSDHFRDCFALECEAMKRVRNVMGLTNVEVMVPFVRTVAQAEAVVAELARQGLKRGENGLKIIMMCEIPSNALLAEQFLEHFDGFSIGSNDMTQLTLGLDRDSGVVSALFDERNEAVKALLSMAIQAAKRHGKYVGICGQGPSDHEDFALWLMEQGIDSLSLNPDTVVKTWLSLAQHTKH

SEQ ID NO: 49738 - protein, 743 aa, Arabidopsis thaliana
  misc_feature (207)..(207): Xaa can be any naturally occurring amino acid
MQISLQIHLSSFTFLLLIFLLPVLSESQVASSESQTLLEIQKQLQYPQVLQSWTDTTNFCHIRPSPSLRIICLHGHVTELTVTGNRTSKLSGSFHKLFTLLTQLSSLKTLSLTSLGISGSLSPKIITKLSPSLESLNLSSNFISGKIPEEIVSLKNLKSLVLRDNMFWGFVSDDLRGLSNLQELDLGGNKLGPEVPSLPSKLTTVSXLKNNSFRSKIPEQIKKLNNLQSLDLSSNEFTGSIPEFLFSIPSLQILSLDQNLLSGSLPNSSCTSSKIITLDVSHNLLTGKLPSCYSSKSFSNQTVLFSFNCLSLIGTPNAKYQRPLSFCQNQASKAIAVEPIPKAKDKDSARIKLGLVILIIIGVIILAAILVLLVLIALKRRRSRSEDDPFEVNNSNNERHASDKVSVCSTTTASSKSLPDSRRVPQTMRSAVIGLPPYRVFSLEELEEATNDFDAASLFCEQLYRGCLREGIPVTVRVIKLKQKSLPQSLAQQMEVLSKLRHMHLVSVLGHSIASNQDHNQHAGHTIFIVQEYISSGSLRDFLTNCRKKEVLKWPQRMAIAIGVARGIQFLHMGVAPGIFGNNLKIENIMLDETLTVKISGYTIPLPSKVGEERPQAKKPRSNEDREKEDVYQFGVILLQIITGKVVAAGSSEMGSLKLQLENGLRDEPSVLSSLADPSVKGSYAYESLRTTVEFAINCLCEDQSKRPSIEDVVWNLQYTIQVQQGWRPSSGNHESSMKAIYE

SEQ ID NO: 49739 - protein, 499 aa, Arabidopsis thaliana
  misc_feature (120)..(120): Xaa can be any naturally occurring amino acid
  misc_feature (132)..(132): Xaa can be any naturally occurring amino acid
  misc_feature (189)..(189): Xaa can be any naturally occurring amino acid
EGLHSPRQLSRNGSMLLSLTLFFHFFFIIFNRWEKFDDTEWTILGVEGESERERVMEALKTATFSPMSVLSEKRSEPRKPFSLPNLFPPKSQRPISQESFLKRFNGGLALLTSVLSQCNXAPAKSLTYEEAXLQQSMTTSSSFDSDGLIEGISNFVTDNPLVIAGGVAALAVPFVLSQVLNKKPKSWGXVESAKNAYTKLGTDDNAQLLDIRATADFRQVGSPNIKGLGKKAVSTVYNGEDKPGFLKKLSLKFKDPENTTLYILDKFDGNSELVAELVALNGFKSAYAIKDGAEGPRGWLNSSLPWIEPKKTLSLDLSSLTDSISGVFGESSDGVSVALGVAAAAGLSKLLFAEDRKQTLKQVDEFLNTKVAPKELVDELKEIGKALLPQSTSNKALPAPATVTAEAESATATTTTVDKPVPEPETVAATTTTVDKPVPEPEPVPEPVPVPAIEAAVAAQVITEPTETEAKPKPHSRPLSPYASYPDLKPPSSPMPSQP

SEQ ID NO: 49740 - protein, 705 aa, Oryza sativa (indica cultivar-group)
MANFCILHPKGCIMLYRLLEYNISASLKLSLKFLLYWTKALNDDVWQEAQLALCSAMCRGSVLLLRVHAALLLLAALPALIAGQPWEICGENGNYTANSTYQANLKQLAAALHKNVSSGTGGGRLFASGAVGAVPDAVYALALCRGDINASACADCVGTIFQDAQQLCPYRKEVSIVYDSCYLRFSNLDFLSSADNSGVVDLYNTGTVSGDVGRYDRAVTGLLNATARYAAGNINASSRLFATGVMVGFDAQFPKIYAMAQCSPDLSPAQCGLCLGAMVARWWQTFEPNTQGARSVGARCNMRVELYSFYNVPSMLQLQAEAVAPSPSPAPAPAGKPPAVPGTTGAASRSEDFESIESLFLDLSTLRIATDNFSENNKLGEGGFGVVYKGSLPHGEEIAVKRLSQSSVQGMGELKNELVLVAKLQHKNLVRLVGVCLEEHERMLVYEYMPNRSLDTILFDAEKSSLLDWGRRLKIINGVARGMQYLHEDSQLKIVHRDLKASNVLLDSDYNPKISDFGLARLFGGDQTQDVTNRVVGTYGYMAPEYAMRGHYSVKSDVFSFGVLVLEIVTGRRNSGSYYSEQSGDLLSIIWEHWTMGTIMEMVDRSMGERAAGGEIARCIHVGLLCVQENPASRPAMSAVNVMLSSGTVSLKAPSRPAFYIRKGSGDDGGGTGSYSGSFVGTLPSSGRSAPMSPNEVSITELEPR

SEQ ID NO: 49741 - protein, 377 aa, Cryptococcus neoformans var. neoformans B-3501A
MNGYYDPQQHQSTNIEIPQGPTNQPRLLLRNLNETDATFHLSGVELAYANSLRRVMMADVPTIAIDQVLFMQNTTPLADEMIAHRLGLIPLISRNVSKGLRYTRDCDCDEGCYYCMVTLRLKVTFSGNDGEQFMRVTSDMLEVVPSPGGPPPPNPYGPPPELSEEDRIIINNRDPEMGQPIGKGNPTVPPILIAKMGKGQEIDVLCKAYKGIAKHHAKWSPLSTVAFEYDPYNKLRHTTHWFETDERAEWPLSSNAAFETPPNPAEPFDYNAVPSTFYFSAESVGSIPVRSVVEQGLDLLIEGLANVVLGVQKEIGGEEEEGEDGAAADGVVGDGMGVGMGGGLVEPNIPAGIGQDQMAMAGGYGGYGSQQGYGGSW

SEQ ID NO: 49742 - protein, 545 aa, Pseudomonas putida KT2440
MTLSPLAGKPAPASVLVDIPRLLTAYYTGRPDATVAAQRVAFGTSGHRGSSLELSFNEYHVLAISQAICLYRQEKGIDGPLFIGADTHALSAPATASALEVLAANGVQVMLSKDDEYTPTPAVSHAILCHNRGRTQGLADGIVITPSHNPPQSGGFKYNPPNGGPADSDVTKWIEGKANELLAANLAGVKRMDHAQALQAPTTHRHDYVSNYVADLENVIDFDVIRGAGLRLGVDPLGGAGVRYWSAIAKHYQLDLEVVNTEVDPTFRFMTVDWDGQIRMDPSSPYAMQGLIGLRERFDVAFACDPDHDRHGIVTPDGLLQPNNYLAVAIDYLFRHRPQWRSDAAVGKTVVSSGLIDRVTQRLGRDLYEVPVGFKFFAQGLFDGSLGFGGEESAGASFLRRDGSVWATDKDGLIPALLAAEMTARTGRNPSQAYADLTEALGKPFATRVEAKADARQKALLSKLAPEQVKSTELAGEPIVQILSHAPGNGQAIGGLKVMTANGWFAARPSGTEDIYKIYAESFIDEAHLQRLVEEAQVLVDEAIA

SEQ ID NO: 49743 - protein, 161 aa, Brassica napus
  misc_feature (11)..(11): Xaa can be any naturally occurring amino acid
  misc_feature (19)..(19): Xaa can be any naturally occurring amino acid
  misc_feature (21)..(21): Xaa can be any naturally occurring amino acid
  misc_feature (31)..(31): Xaa can be any naturally occurring amino acid
  misc_feature (36)..(36): Xaa can be any naturally occurring amino acid
  misc_feature (39)..(40): Xaa can be any naturally occurring amino acid
  misc_feature (42)..(42): Xaa can be any naturally occurring amino acid
  misc_feature (45)..(45): Xaa can be any naturally occurring amino acid
  misc_feature (48)..(48): Xaa can be any naturally occurring amino acid
  misc_feature (51)..(51): Xaa can be any naturally occurring amino acid
  misc_feature (55)..(55): Xaa can be any naturally occurring amino acid
  misc_feature (60)..(60): Xaa can be any naturally occurring amino acid
  misc_feature (63)..(63): Xaa can be any naturally occurring amino acid
  misc_feature (67)..(69): Xaa can be any naturally occurring amino acid
  misc_feature (75)..(76): Xaa can be any naturally occurring amino acid
  misc_feature (88)..(89): Xaa can be any naturally occurring amino acid
  misc_feature (91)..(93): Xaa can be any naturally occurring amino acid
  misc_feature (95)..(96): Xaa can be any naturally occurring amino acid
  misc_feature (100)..(102): Xaa can be any naturally occurring amino acid
  misc_feature (105)..(107): Xaa can be any naturally occurring amino acid
  misc_feature (115)..(115): Xaa can be any naturally occurring amino acid
  misc_feature (119)..(120): Xaa can be any naturally occurring amino acid
  misc_feature (139)..(139): Xaa can be any naturally occurring amino acid
  misc_feature (147)..(148): Xaa can be any naturally occurring amino acid
  misc_feature (151)..(151): Xaa can be any naturally occurring amino acid
  misc_feature (153)..(153): Xaa can be any naturally occurring amino acid
  misc_feature (155)..(156): Xaa can be any naturally occurring amino acid
SEKKKKKKSVXASSMLSSXAXVTSPAHATMXAPFTXLKXXAXFPXTRXANXDITXIASNXGRXSCMXXXPPVGKXXVETLSYLPDLTXXEXXXEXXYLLXXXWIXXXEVELEHGXVYRXXGSTPVYYDGRYWTMWKLPXFGCTDSAXXLKXAXNXXGERDI

SEQ ID NO: 49744 - protein, 387 aa, Oryza sativa (japonica cultivar-group)
MSSCFNGGAGWPEPVVRVQAVSDSCGATIPERYVKAPSERPSSLDGGGGLNNIPVVDMSMPDGEETARAVAAACREWGFFQAVNHGVRPELLRRARAAWRGFFARPAEAREAYANSPATYEGYGSRLGTAKGGPLDWGDYYFLHLLPAALKSHDKWPTSSVPAGGGGLREATEEYAEEVVRLCRRVMRLLSRGLGLDDGRLQAAFGGVGGEGACLRVNFYPRCPQPELTLGVASHSDPGGMTMLLVDDHVRGLQVKNAGHWITVDPVPDAFIVNIGDQIQVLSNAVYKSVEHRVTVSAAEERLSLAFFYNPRSDLPLAPMPELVAPPARPALYPPMTFDEYREHIRRCGLSGKAQLQSQQMATAICGAPPAATAFSSSSSSASSLAR

SEQ ID NO: 49745 - protein, 607 aa, Oryza sativa (indica cultivar-group)
MYATGAAGDVPDKVYGYALCRGDVADAHACERCVAAALRDAPRVCPLAKDALVFHDLCQLRYSNRNFLLDDDYYVATYSLQRSSRLVSAPAPAAVAAFDAAVAMLANATAEYAAAANTSRRYGTAEEEGVDGDGDSGRPRMYALAQCTPDKAADVCRACLTTLTTVQLPKLYSGGRTGGGVFGVWCNLRYEVFPFFSGRPLLHLPAFVEAPPPATSAAATRRGEKKRNKTGIVLAIVMPTIAAMLLIVVAYFCCWRRRRPEEQTFLPYDIQSIDSLLLDLSTLRAATDDFAETKMIGRGGFGMVYKGVLPEGQEVAVKRLCQCSGQGIEELKSELVLVAKLYHKNLVRLIGVCLEQQEKILVYEYMSNKSLDTILFDIDKNIELDWGKRFKIINGIAQGLQYLHEDSRLKIVHRDLKASNILLDFDYNPKISDFGLAKIFDGDQSKDITHRIAGTYGYMAPEYAMHGHYSVKLDVFSFGVLVLEIVTGRRNSGSYDSGQDLDLLNHVWGHWTRGNVVELIDPSLGNHPPIEQMLKCIHIGLLCVQKRPASRPTISSVNIMLSSNTVRLPSLSRPAFCIQDVSASDSSNPHSTAVSSNDMSITDLVPR

SEQ ID NO: 49746 - protein, 466 aa, Clostridium perfringens SM101
MLFGKNELGSQFETPIFGTVESNEPIPKYKLAKKSIAPQVAYRLIKDDLLDEGNARQNLATFCQTYMDDEAVKLMSETLEKNAIDKSEYPQTTDMENRCVNILADLWHAPKELNYMGTSTVGSSEACMLGGMAMKFRWRNRAKALGMDVTSKKPNLVISSGYQVCWEKFCVYWDIEMRLVPMDEQHMSINVDKVLDYVDDYTIGVVGILGITYTGKYDDIKALDKKLEEYNKTAKITVPIHVDGASGAMFAPFIEPDLKWDFQLKNVVSISTSGHKYGLVYPGIGWVLWKDKEYLPQELVFEVSYLGGKMPTMAINFSRSASQILGQYYNFLRYGFEGYRQIHQRTKDVAMYLSSELEKTGLFEIYNNGENLPIVCYKLKDDVKVNWTLYDLADRLLMKGWQVPAYPLPEDLQNVIIQRFVCRADLSRNLADLLMRDLKAAIEDLNNARILSKTQVDNKGVQGFTH

SEQ ID NO: 49747 - protein, 711 aa, Oryza sativa (indica cultivar-group)
MATTVATAMRRRRNLTPCDSRLATAVPLLVAFLLLLHAPPLAEAQPLPWQMCDTAGGNYTEGSTYQANVRALASALPVNASSSRALFAKGAAGAAPDVVYAIALCRGDTNASSCAACVATAFQDAQQLCAFNRRATMFDDPCILRYSDQDILANATDGQGNFIAWNYNNVSAARAAAFDAASGRLVNATAGYAAADPVRRFGTGEVGFDDATYPRIFSLAQCTPDLSEADCRSCLGRIIRWVPQYFAGKPGGRVFGVRCNFRFESYSFFSGRPLLQLPGPPPAPAPSPANMAPPSPPGTMGGRTRHRTGRVLAITLPIAGAILALIVLTCFCFWRRRTPARKASPVPYSTNPDDIQSIDSLLLDLSTLRAATDNFAERNKLGEGGFGIVYKGVLPEGREIAVKRLSQSSRQGIEELKTELVLVAKLRHKNLVSLVGVCLEEGEKLLVYEYMPNKSLDTILFDYEKSKDLDWGKRLNIVSGVARGLQYLHEDSQLRVVHRDLKASNVLLDFDHNPKISDFGLAKLFEWDQTQDVTSHIAGTYGYMAPEYAMRGQYSVKSDAFSFGVMILEIVTGRRNSSFSNSEQSIDLLSLVWEHWTTGTIEELLDPAIGSRAVNVLLKLINIGLLCVQDNPADRPAMSAVNVMLSSDTVSLQAPSRPTFSIQEMDGADTDLYESGAYSRSAFQPTGDGNTRAAAASSSPNELSLSELEPR

SEQ ID NO: 49748 - protein, 630 aa, Oryza sativa (indica cultivar-group)
MATAVATAIRHRRHLALSLSLRYNLAAVALLVAFLLLHAPPRAGAQPLPWQLCNATAGNYTEGSAYQANVRALASALPANASSSRALFAEGAAGTAPDVVYAVALCRGDTNASSCAACLAAAFDTAQQLCAFNRRATLFNDPCILRYSDQDILANCTPDMSEADCRSCLGDIIRRMTPKYFVGKPGGRVFGVRCNFRFEAYSFFSGRPLLQLSGPSPPPANMTPPVTSEGRTRHRTGRILAITLPIAGAALVFIVLTCFCFRRKRTPANKASPLPFSTNPDDIQSIDSLLLDLSTLRAATDNFADRNKLGEGGFGAVYKGVLSEGQEIAVKRLSQSSRQGIEELKTELVLVAKLRHKNLVSLVGVCLEGDEKLLVYEYMPNKSLDTILFDYEKSKDLDWGKRLKIVSGVARGLQYLHEDSQLRVVHRDLKASNVLLDFDHNPKISDFGLAKLFEWDQTQDVTSHIAGTYGYMAPEYAMRGQYSVKSDAFSFGVMILEIVTGRRNSSFSNQQSIDLLSLVWEHWTTGTIEELLDPAMRGRSADDLLKLINIGLLCVQDNPADRPTMSAVSVMLSSETFSIQAPSRPTFCIQETDSAADTDLYSSALRSTGDSKTRAVASPNEVSLTELEPR

SEQ ID NO: 49749 - protein, 572 aa, Listeria monocytogenes EGD-e
MAKELKGIAASDGIAIAKAYLLVEPDLSYEKTEVTDVESEVKRFESALEVSRTELSMIREKAAKDLGEDKAQIFDAHLLVLNDPELTGPIEESIKNSKTNAETALQETTDMFIGMFESMDNEYMRERAADIKDVRKRVLSHLLGVTIPNPALIDEEVVVVAADLTPSDTAQLNRNFVKGFVTDIGGRTSHSAIMARSLEIPAVVGTKEVTASVAKNDIVIIDGLEGNVIIHPTEEQIAHYEKIKSDFALQQAEWDKLKNEKTVSKDGVHVELAANIGTPNDLEGVISNGGEAVGLYRTEFLYMGRDNFPTEEEQFEAYKAVVSGMDGKSVVVRTLDIGGDKTLPYLELPEEMNPFLGFRAIRLCFANEELFRTQLRALLRASVYGNLKIMFPMIATVNEFRQARDILLDEKAKLKAAGTEVSDSIELGIMIEIPAAAVLADQFAKEVDFFSIGTNDLIQYTMAADRMNERVSYLYQPYNPSILRLVKMVIDASHKEGKWTGMCGEMAGDQTAVPLLLGLGLDEFSMSASSILKSRSLIKRLDQSEMVKLAEEALNKSTAEEVVELVEKYTAE

SEQ ID NO: 49750 - protein, 205 aa, Vitis vinifera
QVVGTVVAVIVYVITAWWLMATIPNHCDTTMLPADSPWRCPMDNVFFDASVIWGLIGTRRIFGNLGAYSNVNWFFLLGAIAPLLVWLMHKAFPKKKWIPLIHMPVLLGSTAMMPPASAVNFTSWIIVGFLSGFVIFRLKPKLWERYNYVVSGGLDAGTAFMTILIFLTLGSGNVSIDWRGNNPEGCPLASCPTARGIVVDGCPVF

SEQ ID NO: 49751 - protein, 301 aa, Triticum aestivum
  misc_feature (200)..(200): Xaa can be any naturally occurring amino acid
  misc_feature (245)..(245): Xaa can be any naturally occurring amino acid
  misc_feature (263)..(263): Xaa can be any naturally occurring amino acid
  misc_feature (281)..(281): Xaa can be any naturally occurring amino acid
GRHGKSRVRVSRVWRRPAEAGGHLFVEWSVAVSVVSDCLPSYTSDDNSAIVATDSIKNTVYVKAKECTEVVSMEEFAVILGRHFTSLYSQVSEATVTIVERPWERVAVDGKPHSHGFKLGSEKHTTEVNVKKSGSLLINSGIQGYSLLKTTQSGFEGFVRDRYTLLPETRERIVATEVTAWWRYPFEHISQLPSKPFCFXTQRYQDVKKVLADTFFGPPDVGVYSPSVHNTLYLMVMEVLTGFPXDIASVQLKMPNLHFTPVXNLGGKENPGLVKFADDVXMPTDEPHGTSKHVEPRQLKA

SEQ ID NO: 49752 - protein, 332 aa, Bacillus anthracis str. Ames
MNPLIFKENRPFDLIAVGRLCVDLNANETQRPMEETRTFTKYVGGSPANIAIGAARLGLQTGFIGKVSDDQMGRFITGYLKDNKINTDQIPIDCTGAVTGLAFTEIKSPEDCSILMYRDNVADLNLDPTEVSEDYIKQSKALLISGTALAKSPSREAVFLALEYARKHDVVVFFDVDYRPYTWQSEAETAVYYNLAAEKSDVIIGTREEFDMMEKLLNYEKSNDQVTAERWFSHHAKIVVIKHGGDGSIAYTRDGQSHRGGIFKTKVLKTFGAGDSYASAFIYGLMQGLEIPQAMRLGGASASIVISKHSCSDAMPTRAEISAFMETAEELV

SEQ ID NO: 49753 - protein, 310 aa, Ralstonia solanacearum
INGFGRIGRMVFRAAVANFKDIEVVAINDLLEPDYLVYMLKYDSVHGRFDGEVAVDGNTLIVNGKKIRLTAVKDPAELKWGEVGADVVVESTGIFLTKEGAQKHIDAGAKKVIMSAPSKDDTPMFVYGVNHGTYKGEAIISNASCTTNCLAPVAKVLNDKWGIKRGLMTTVHAATATQKTVDGPSNKDWRGGRGILENIIPSSTGAAKAVGVVIPELNKKLTGMSFRVPTSDVSVVDLTVELEKAATYDEICAEMKAQSEGALKGVLGYTEDKVVATDFRGDARTSIFDAEAGIALDGTFIKVVSWYDNE

SEQ ID NO: 49754 - protein, 514 aa, Salmonella typhimurium LT2
MSVSKKPMVLVILDGYGYREEQQDNAILNAKTPVMDALWAKRPHTLIDASGLEVGLPDRQMGNSEVGHVNLGAGRIVYQDLTRLDVEIKERTFFANPVLTNAVDQAKNAGKAVHIMGLLSAGGVHSHEDHIMAMVELAAERGAEKIYLHAFLDGRDTPPRSAEASLKKFEDKFAALGKGRVASIVGRYYAMDRDNRWDRVEKAYDLMTLAQGEFQADTAVAGLQAAYARDENDEFVKATVIRAEGQADAAMEDGDTLIFMNFRADRAREITRAFVNADFDGFARKKVVNLNFVMLTEYAADIKTAVAYPPASLANTFGEWMAKNDKTQLRISETEKYAHVTFFFNGGVEEPFAGEERILINSPKVATYDLQPEMSSAELTEKLVAAIESGKYDTIICNYPNGDMVGHTGVMEAAIKAVEALDNCIEQVTKAVESVGGQLLITADHGNAEQMRDPATGQAHTAHTNLPVPLIYVGEKNVKAVEGGKLSDIAPTMLSLMGMEIPQEMTGKPLFIVE

SEQ ID NO: 49755 - protein, 442 aa, Cicer arietinum
MAEPSKVIHVRNVGHEISENDLLQLFQTFGVITKLVMLRTKNQALLQMEDIPSAISALQFYANAQPSIRGRNVYVQFSSHKELTTMDQSQGRDDEPNRILLVTVHQMQYPITVDVLQQVFSPHGYVEKIVTFQKSAGFQALIQYESRQSAVTARSSLQGRNIYDGCCQLDIQFSNLDELQVNYNNDRSRDYTNPNLPTEQKGRPSHSGYGDTGMHGVQGSGARPGGFSQMTNAAAIEAAFGGDLPPGITGTNDRCTVLVANLNPDRIDEDKLFNLFSIYGNIVRIKLLRNKPDHALVQMGDGFQAELAVYFLKGAMLFGKRLEVNFSKHPNIIQGADTHEYMNSNLNRFNRNAAKNYRYCCSPTKIIHLSTLPQDIIEEEIASLLEEHGLVVNCKVFEMNGKKQALVQFETEEEATEALVCKHASPLSGSIVRISFSQLQNI

SEQ ID NO: 49756 - protein, 319 aa, Geobacter sulfurreducens PCA
MKKIGILTSGGDCSGMNAAIRAAVRTAIRMNIEVVGFRKGYLGLMKGDAIPLDTKAVSGILHRGGTFLQSARSPEFKTPEGQRTALNNLKALGVEGMVVMGGDGSLTGALALNRLGLPVVGIPASIDNDIPFTDMALGVDTALNNIIYAVDCIKDTASSHARAFVIEVMGRHSGYLASISAIATGAEYALVPEREYDLAEICQQLRARYEEGRDNAIIILAEGAGHGHEIANSIKDAIGFETRVTVLGHYQRGGAPTVFDRLLASRLGKKSVELLVTGTWGVMVGLSCNAILATPLEDVIKGEKRPQDEVLRLAEVLGV

SEQ ID NO: 49757 - protein, 406 aa, Glycine max
  misc_feature (223)..(223): Xaa can be any naturally occurring amino acid
MSRFRRFELIEQPPFFPSCYSSPFLVQDSLSLDLDLLPLPSPFDAFADLLHAPSLAYRRLERQLDNELRLQSLSDRVAELESRFHRVLGGDRKYTWTAEIKGAEKNGFDRKYKWVAEIAEEEEKKKKKMKKQVKVPKDRNVTWDAEEEEENKKRLLKGVAKNVKWTAEITGKGEKSGSSRKYTFQVQSGDAEKKKEKEKEKEKKKGNGSRIVEIHEPSGHRDXGFETGWVAFTSLAFAKRFGAVQNERGKKKDLSPQDAALLIQISFRAYLIRRSKALRALRELAIAKSKLKEIRAQFNNFSYRRHVACNAEERQRFSEKIIVLLLTVDAIEGADIMVRSAKRSMVDELEAMLDVVDPQPGGRSASLSSFKRRTFDMPDGVIRKEIEEGVAQVVQMLEEAENSSEA

SEQ ID NO: 49758 - protein, 384 aa, Nicotiana tabacum
MCVQESEEVSEEMENLDISKSDENIKIGSLQVEDELGNTQKENCEKNTSSSFSVIRNSFPMESISEDTTIADRKQILSNKFLPTLRSGEWSDIGGRLDMEDTHICIADLAKNFGQSILGEEEAVSFYGVFDGHGGKGAALFVRDFLPRIIVEDADFPLKLEKVVSKSFLETDAAFAKSCSADSDLSSGTTALTAMIFGRSLLVANAGDCRAVLSRGGLAIEMSKDHRPCCVSERTRVESLGGFVDDGYLNGQLGVTRALGDWHIKGLKEVEKGGPLSAEPELKLLTLTKEDEFLIIGSDGIWDVFRSQNAVDFARRRLQEHNNAKLCCKEVVDEAKKRGAIDNLTVVMVCFHSEPPPTIVFQRSRIRKCISAEGLQNLRSLLDG

SEQ ID NO: 49759 - protein, 369 aa, Arabidopsis thaliana
MEMMKIDPLFDRASELKAFDETKTGVKGLVDSGVSQVPRIFHHPTVKLSTPKPLPSDLLHLKTIPTIDLGGRDFQDAIKRNNAIEEIKEAAAKWGFFQVINHGVSLELLEKMKKGVRDFHEQSQEVRKEFYSRDFSRRFLYLSNFDLFSSPAANWRDTFSCTMAPDTPKPQDLPEICRDIMMEYSKQVMNLGKFLFELLSEALGLEPNHLNDMDCSKGLLMLSHYYPPCPEPDLTLGTSQHSDNSFLTVLLPDQIEGLQVRREGHWFDVPHVSGALIINIGDLLQLITNDKFISLEHRVLANRATRARVSVACFFTTGVRPNPRMYGPIRELVSEENPPKYRETTIKDYATYFNAKGLDGTSALLHFKI

SEQ ID NO: 49760 - protein, 698 aa, Oryza sativa (indica cultivar-group)
MRRHRSYLAGVAAAAAATATFLVAVLLHAPLAAGDDEPPPWVLCAPYPPSGNYSRNGTYQANLDLLSTTLPKNTSSSPAMYATGTVGDVPDKVYGLALCRGDANASACERCVAAALRDAPRRCPLVKDVLVFYDLCQLRYSNRDFFLDDDYFVTTYTLQRSRRVGAAAAAAFDAAVAVLVNATADYAAADSSRRYGTGEEEGVDGDSDRPKIYALAQCTPDKTPEVCRTCLSTVIGQLPKEFSGRTGGGMFGVWCNFRYEVFPFFSGRPLLQLPAFVETPPPPPSPSATSGEKTKNRIGAVLAIVMPAIAAVLLMVVACVCCWKRIKKRRPEEQTFLSYSVSSDDIQSIDSLILDLPTIRVATDDFADTKMIGQGGFGMVYKGVLPDGQEIAVKRLCQSSRQGIEELKSELILVAKLYHKNLVRLIGVCLEQQEKILVYEYMPNRSLDIILFDTDKNRDLDWGKRFKIINGIARGLQYLHEDSQLKIVHRDLKASNILLDFDYSPKISDFGLAKIFGGDQSEDVTNRIAGTYGYMAPEYAMRGNYSIKSDVFSFGVLVLEIITGRRNTGSYDSAQDVDLLNLVWEHWTRGNVVELIDPSMGDHPPIEQMLKCIHIGLLCVQKKPASRPTISSVNIMLSSNTVRLPSLSRPAFCIQEVSASDSSNPYSERYPRPRHSGYSDNSTVVSSNDLSITELVPR

SEQ ID NO: 49761 - protein, 798 aa, Oryza sativa (indica cultivar-group)
MLRRSLVAHAVLLFAAVALPLAAAQPWPVCGTSGGNYTAGSTYETNLLRLALTLRANASSSLTLFASGALGSAPDTVYGLLQCRGDMNPSDCFDCGTNVWRDAGPTCNRTKDAILVYNQCYAQFSDRGDFLAATNNSGAYSLLISGTNITSTNVTGYDGAVTSAKRTTLCGTGGTYTAGSTYESNLLNLTRTLRENASSSPTLFAAGALGSAPNPVYGLLLCRGDVSPSDCAYCGLNVVQDVGRSVCNRSKDSVLVYDQCYARFSNKADFLVSSNNSGEVSLLLTNGTSITSAGVAGYNHAVSELLNATVRYAVENSTRLFATGQRVGNENDTGFRNIYSMAQCSPDLSPALCRRCLDDLVGKWWKTFPPKGEGAKVAGAKCYLRSELGQGPFYNGAPMVMLRADVLTKATDVVPATSGKSNSATKVLVIVVLIMAGAIIAAISLCMWNMRNKRSVGKAEVFSGPDTGEQFESVKSSLLSLASLRVATNNFDESMKLGEGGFGPVYKGLLLGQEVAVKRLAKGSNQGLGELKNELVLVAKLHHNNLVRLIGFCLEEGEMLLVYEYMPNKSLDTFLFDTEQSRRLDWKTRLRIIEGIAQGLQYLHQDSEKRIIHRDMKASNVLLDADLSPKIGDFGLARLVKQDKSRDITKRVAGTFGYMSPEYVMRGEYSTKSDVFSFGILVIEIVTGKKRSNGTYFTEQYEDIISTVKRHWVEGNIVDMIDQSLGKNYPEAEVLKCIKIGLLCVQQNPIVRPTMTDVIVLLNGGVTRSLPASAAHRPTSLGDGSSGYSQTITQLSAR

SEQ ID NO: 49762 - protein, 118 aa, Zea mays
LALAVSSTRNAQEDSMADNTGTLAGGIKDVPGNENDLHLQELARFAVDEHNKKANALLGFEKLVKAKTQVVAGTMYYLTIEVKDGEVKKLYEAKVWEKPWENFKELQEFKPVEEGASA

SEQ ID NO: 49763 - protein, 648 aa, Oryza sativa (indica cultivar-group)
MLRRSSSVVHVVLLFAAVALPLTAAQPWTICPGRSGTYIANSTYETNLENLPLTLRASASASPTLFASDSHGSGPDTVYGLLLCRGDVSSSDCFDCGTRVGNDVGQVCNRTKDAILVYNQCYAQFSDKRDFLNAANNSNEYSLLKSGTNITSTDIAGYDRAVTELLNATVRYALENSTRLFATGQRVGNDTGFSNIYSMAQCSPDLSQAQCRSCLDGFLGQWWKLFPLNGEGARVAGPRCHLRSELATFYTGNPMVQLPDAVPAITGGQKNSGSKILVIILPTVSVAIIAVISLCIWNVCKRSRSAKAGHYSRRPDTSEDFESVKSTVLSLASLQVATDNFHESKKIGEGGFGEVYMGILSGQEVAVKRMTKGSNQGLEELKNELVLVAKLHHRNLVRLVGFCLEEGERLLVYEYMPNKSLDTFLFDAKQRRQLDWATRFKIIEGIARGLQYLHQDSQKKIVHRDMKASNILLDADMNPKIGDFGLARLFGQDQTRDITSRIAGTFGYMSPEYVMRGQYSTKSDVFSFGILVIEIVTGRRRNSRPYFCEQNDEDILSIVWRLWEEGTTTEMIDYSLGRNYPEAEVLKCVNIGLLCVQQNPVDRPTMTDVLVLLNSDTTCTLPTLAPRPTYLIDGTSSYSQTVTQWSGR

SEQ ID NO: 49764 - protein, 48 aa, Glycine max
VVHVPLPDEKEIERRVLENKKKDLLSRYASEGLVKEQTEAKDMLNIQR

SEQ ID NO: 49765 - protein, 663 aa, Oryza sativa (indica cultivar-group)
MRRRSSVLHAVLLLLLVAAVALPLAAAQPWPVCGTSGGNYTAGSTYESNLLRLASTLRANASASPTLFASGVRGAGPDAVYGLLLCRGDMNPSDCFDCGTRVGDDVAQACNRTKDAILVYNQCYAQFSDTGDFLAATNNSGAYSLLISGTNISSADVAGYDRAVTELLNATVRYAVENSTRLFATGQRVGADPGFRNIYSMAQCSPDLSPAQCRSCLDGLVGQWWTGFLFPRNGEGARVAGPRCYLRSELGSGFYTGAPMVLLRADGLSPASAPAPDVVPATTLVKKNSASKILVIALPIVAVAIVAATSLCMWTVRKKSRSAKAEHLSELDASEDLESVKSTLLTLGSLQVATDNFDESKKLGEGGFGAVYKGHLFGQEVAVKRMAKGSNQGLEELKNELVLVAKLHHKNLVRLVGFCLEDGERLLVYEYMPNKSLDTLLFDVEQRRQLDWATRSRIIEGVARGLQYLHQDSQKKIVHRDMKASNVLLDADLNPKIGDFGLARLFGQDQTRDVTNRIVGTFGYMAPEYMIRGQYSTKSDVFSFGILVLEIVTGQRNSGPYFAEQNEDLVSLVWRHWTEGNIVEMIDYSLDRKYPEAEVLKCVNIGLLCVQQNPVDRPTMADVMVLLNSDATSSLPVPLAHRPISLSDGSSGYSQTVTQLSPR

SEQ ID NO: 49766 - protein, 661 aa, Oryza sativa (indica cultivar-group)
MLRRSLVAHAVLLFAAVALPLAAAQPWPVCGTSGGTYTAGSTYETNLLRLASTLSANASSSPTLFASGALGSAPDTVYGLLQCRGDMNPSDCADCGTNVWRDAGPTCNRTKDAILVYNQCYAQFSDRGDFLAATNNSGGVSLLISGTNITSTDVAGYDRAVTELLNATVRYAVENSTKLFATGQRVGNDTGFSNIYSMAQCSPDLSPAQCRSCLDGLVGQWWKTFPLNGKGARVAGPRCYLRSELGPFYTGNPMVRLPVKADGLTPASAPAPDVVPAITGGKNNSGSKILVIILPIVSVAIIIAVISLCIWNARKKRRLAKAERHPGTDTNEDFESVKSTLLSLASLQVATDNFHESNKIGEGGFGAVYKGILHGQEVAVKRMAKGSNQGLEELKNELVLVAKLHHRNLVRLVGFCLDEGERLLIYEYMSNKSLDTFLFDAEQKRKLDWAVRFKIIEGIARGLQYLHQDSQKKIVHRDMKASNILLDADMNPKIGDFGLARLFRQDQTREVTSRIAGTFGYMPPEYVLRGQYSTKSDVFSFGILVIEIVTGRRRNSGPYLSEQNDEDILSIVWRHREKGAIAEMIDHSLGRNYSETEVLKCVNIGLLCVQQNPVDRPTMADVMILLNSDTTCTMPALAPRPAYLIDGTSGYSQTVTQWSGR

SEQ ID NO: 49767 - protein, 266 aa, Magnetospirillum magnetotacticum MS-1
MKYVLDAWGFDKYLAAVEEKLGRKLERVAPEHVAPRKPTDRFSHVGVHKQVQDGLNWIGVVLPVGKMTTDEMRELAKISAECGDGQIRLTVWQNFIFSGVPDAKVAEVEARVEALGLTTKAAGIRSGLVACTGARGCKFAASDTKGHAMVIADHVERAVPSLDVPVNVHLTGCHHSCAQHYIGDIGLIGAKVVVSEEGDTVEGYDIVVGGGFAENPKIGTEIWKAVKAEDAPTRVEALLNAYLARRLGPEESFQAFTARTGPEALR

SEQ ID NO: 49768 - protein, 311 aa, Exiguobacterium sibiricum 255-15
MKIYSLGEALIDLIPLDADNVTFQKNPGGAPANVAVGLARLGADSYFLGSVGDDSMGHFLKDTLHHYGVKTDHLVFDPEHKTGLVLVTNAADGERSFEFINSYRADMSFHEKDIPDSLAEADLLHIGSISLISGDAVEATRRAIEVAKSNNVPISYDPNLRESLWSDLDAARSTIRSVLPDAQIVKLAEEELTFLTGQTNLDEGAAELLAEYPIRLLAVTRGAEGSLLYTDRSMAEIQAISVDAIDTTGAGDAFMSGLLHQCAIRSFSFDWDETELQDIGRFAAISGGLAASVKGAMAALPTLDEVSRRLT

SEQ ID NO: 49769 - protein, 498 aa, Oryza sativa
LISPIVAARRARVPSFPQPASAAAATRPIPGSYGPPLLGPLRDRLDYFWFQGPDDFFRRRAADHKSTVFRANIPPTFPFFLGVDPRVVAVVDAAAFTALFDPALVDKRDVLIGPYVPSLAFTRGTRVGVYLDTQDPDHARTKAFSIDLLRRAARNWAAELRAAVDDMLAAVEEDLNRAPDPAAASASYLIPLQKCIFRFLCKALVGADPAADGLVDRFGVYILDVWLALQLVPTQKVGVIPQPLEELLLHSFPLPSFVVKPGYDLLYRFVEKHGAAAVSIAEKEHGISKEEAINNILFVLGFNAFGGFSVFLPFLVMEVGKPGRDDLRRRLREEVRRVLGGGDGGEAGFAAVREMALVRSTVYEVLRMQPPVPLQFGRARRDFVLRSHGGAAYEVGKGELLCGYQPLAMRDPAVFDRPEEFVPERFLGDDGEALLQYVYWSNGPETGEPSPGNKQCAAKEVVVATACMLVAELFRRYDDFECDGTSFTKLDKRELTPS

SEQ ID NO: 49770 - protein, 341 aa, Salmonella typhimurium LT2
MKALSKLKAEEGIWMTDVPEPEVGHNDLLIKIRKTAICGTDVHIYNWDDWSQKTIPVPMVVGHEYVGEVVGIGQEVKGFKIGDRVSGEGHITCGHCRNCRGGRTHLCRNTTGVGVNRPGCFAEYLVIPAFNAFKIPDNISDDLASIFDPFGNAVHTALSFDLVGEDVLVSGAGPIGVMAAAVAKHVGARHVVITDVNEYRLELARKMGVTRAVNVAKESLNDVMAELGMTEGFDVGLEMSGAPPAFRTMLDTMNHGGRIAMLGIPPSDMSIDWTKVIFKGLFIKGIYGREMFETWYKMAALIQSGLDLSPIITHRFSIDDFQKGFDAMRSGQSGKVILSWD

SEQ ID NO: 49771 - protein, 426 aa, Bdellovibrio bacteriovorus HD100
MHKVTSEELFQRALKVAPGGVHSPVRSFKGLDRAPVFFKKAEGAYLTSVEDKKYIDFCQSFGPLILGHLDAEVKEEVHRMVDTAWTFGATEIYSLELAEWITSTLPFMEKLRFVSSGTEAVMSALRVARAATGRTKILKFEGCYHGHVDNLLVKAGSGLAGTAASSSAGIPAEVAAHTVVAPLDDEAKLAEVFAAQGKDIAAVIIEPLPANYGLLVQRPEFLKKVAELCEKNGSLLIFDEVISGFRVGLGGMVEKTGIRPDLVTYGKIIGGGFPVGCYGGKAELMNMVAPSGDVYQAGTLSANPIGMRAGLTTLKKMQRVDGWNVLEQRTKKFTDAIKAGFVKKGVNLEISQVASLFWIHGPTASPIRSIDHIPANQGGNFKNLFLKALDKGVYLAPNAYEVGFVSLAHSDELLEQAAQIIVDAAE

SEQ ID NO: 49772 - protein, 428 aa, Staphylococcus aureus subsp. aureus MRSA252
MRYTKSEEAMKVAETLMPGGVNSPVRAFKSVDTPAIFMDHGKGSKIYDIDGNEYIDYVLSWGPLILGHRDPQVISHLHEAIDKGTSFGASTLLENKLAQLVIDRVPSIEKVRMVSSGTEATLDTLRLARGYTGRNKIVKFEGCYHGHSDSLLIKAGSGVATLGLPDSPGVPEGIAKNTITVPYNDLDALKIAFEKFGDDIAGVIVEPVAGNMGVVPPIEGFLQGLRDITTEYGALLIFDEVMTGFRVGYHCAQGHFGVTPDLTCLGKVIGGGLPVGAFGGKKEIMDHIAPLGNIYQAGTLSGNPLAMTSGYETLSQLTPETYEYFNMLGDILEDGLKRVFAKHNVPITVNRAGSMIGYFLNEGPVTNFEQANKSDLKLFAEMYREMAKEGVFLPPSQFEGTFLSTAHTKEDIEKTIQAFDTALSRIVK

SEQ ID NO: 49773 - protein, 212 aa, Zea mays
  misc_feature (183)..(183): Xaa can be any naturally occurring amino acid
MASLSLSSPPSLSSAHHNASTRLILRTPNSLKLRTPPHSLPAIRAITLTQDDLKRLAADKAVESVKSGMVLGLGTGSTAAFVVAKLGALLASGQLSDIVGVPTSKRTEEQARSLGIPLSVLDDNPRLDLAIDGADEVDPDLNLVKGRGGALLREKMVEAASDKFVVVVDDTKLVDGLGGSGLXMAVEGVQFCWKYNLDRLQELFREEVWKQN

SEQ ID NO: 49774 - protein, 196 aa, Staphylococcus aureus subsp. aureus MRSA252
MKVNPNNIELIISAVKEDQYPETELSEVALSGRSNVGKSTFINSMIGRKNMARTSQQPGKTQTLNFYNIDEQLIFVDVPGYGYAKVSKTQREKFGKMIEEYITKRENLQLVIQLVDLRHDPTQDDILMYNYLKHFDIPTLVICTKEDKIPKGKVQKHIKNIKTQLDMDPDDTIVSYSSIQNNKQQQIWNLIEPYIS

SEQ ID NO: 49775 - protein, 287 aa, Brassica napus
MNLDTQQHSVNVMLRQLSFIRSSLIPFSSYSPRTSPTPLTSIRSQTRATMSTTPIQNESTQQTQRPVQVAQRLEKFKTTIFTQMSILGNKHGAINLGQGFPNFDGPDFIKEAAIQAIKDGKNQYARAFGAPELNSAVASRFHQDTGLVIDPEREVTVTCGCTEAIAAAMLGLINPGDEVILFAPFYDSYEATLSMAGAKVKCITLRPPGFDIPLDELKAAVSSETRAILMNTPHNPTGKMFTREELEAIASLCIENDVIVFSDEVYDKLDFEMDHICIASLPGLYER

SEQ ID NO: 49776 - protein, 327 aa, Gloeobacter violaceus PCC 7421
MKAFVLAAGKGTRLRPFTDALPKPLMPVVNKPVMTHILALCRKHGFDQIVANLHYRGEKIAERFADGHRHGVELRYSWEEQLLGTAGGVRRQADFLAGDAFLVISGDVMTDLDLGALVRFHKQSGAVATMAVKEVGDPSRFGVVLTDPDGRVESFQEKPAKGSERSRLANTGIYVLEPEVFEHIPEAAFFDFGNDLFPLLVSKGAPVYAMRTGAYWSDVGTLSQYLYTHWELLTHPELKQRVGANTVVESGAVVSEQALIGSGCTIEKGARVLGYSCVSDGCTIRAGSVVVDSVVWTSARWGHKLKGDLVRSIWGDGMQVSLGLPNL

SEQ ID NO: 49777 - protein, 350 aa, Oryza sativa (indica cultivar-group)
MGAVLGTGRVGTLTRVALTVLVFLLLLPSHALAAAVAKDTSATLVETLPLPTTLVGPESVAFDKFGDGPYSGVSDGRILRWDGADKGWTTYSHAPGYNVAKCMAPKLHPAELTESKCGRPLGLRFHNTSGNLYIADAYKGLMRVGPSGGEATVLATEADGVPFKFTNGVDVNQVTGEVYFTDSSTRFQRSQHERVTATGDSTGRLMKYDPTTGYLDVLQSGMTYPNGLALSADRSHLVVALTGPCKLVRHWIEGPKAGTSEPFAELPGYPDNVRPDGKGGYWVALHREKTESPYGSDTHLLAVRIGRKGKILQELRGPKNVRPTEVIERGGGKLYLGSVELGHVAVVKAT

SEQ ID NO: 49778 - protein, 359 aa, Nocardia farcinica IFM 10152
MAGQQGTDAVILVGGQGTRLRPLTLSAPKPMLPTAGLPFLTHLLARIAEAGITHVVLGTAFKAEVFEEHFGDGSDLGLEIEYVTESEPLGTGGGIRNVLPKLRHDTVMVFNGDVLGGTDLGAVLDTHHSTGADVTLHLVRVSDPRAFGCVPTDEEGRVTAFLEKTQDPPTDQINAGCYVFRREYIEKIPAGRPVSVEREVFPALLAEGARVQGHVDTSYWRDMGTPEDFVRGSADLVRGIAPSPALPGQRGESLVHPGAGVAPGALLIGGTVVGRGAEIGAGARLDGAVIFDGACVEAGATVERSIIGFGARIGPRALVRDAVIGDGANVGARCELLRGARIWPGVEIPDGGIRFSTDV

SEQ ID NO: 49779 - protein, 511 aa, Cryptococcus neoformans var. neoformans JEC21
MFARQPLSQNLLRPLSRPSSSFSRTSTIPKLAFLQSARGFASASEPYDVVIIGGGPGGYVAAIKAAQLGFKTACIEKRGALGGTCLNVGCIPSKAMLNNSHIFHQTQHDLKNRGIDVSGIQLNLPKMLAAKEASVKALTGGIETYLFKKNGIDYIKGEASFETANKLNVKLLEGGETQVEAKNVIIATGSEVTPFPGLEIDEERIVSSTGALELKEVPKKMVVIGGGVIGLELGSVWSRLGAEVTVVEYLGAIGAGMDGEIGKQFQKILTKQGFKFKLNTKVISGHREGDIVKLKVDSAKGGKEETIEADVVLVAIGRRPVTTGLNLEAIGVETDKRGRIIIDDEFNTSAKGVKCIGDVTFGPMLAHKAEEEGIAAVEILKTGHGHVNYDAIPSVVYTHPEVAWVGKNEEELKGAGVQYKIGKFPFAANSRAKTNQDSEGFVKFIVEKETDQVLGCHIIGPNAGEMIASATLALEYKASAEDIARTCHAHPTLSEAFKEAALASYDKTINF

SEQ ID NO: 49780 - protein, 379 aa, Marah macrocarpus
MAITCMMATESSPAEEVKREHQVAFGGAGESSVPENFIWPDEFKATADAPELHVPHIDLKKVLSGDEKDVEEATRLVDEACRKHGFFVVVNHGVDKELMNKVHECMNEFFTLPLDVKQKAHRKVGENFGYANSFIGRFSTKLPWKETFSLRYLAHENSSTARDYVSQVLGPEFSHHGEVYQECGKALSDLSLRIVELLGLSLGISRETFRKFYEDNDSIMRMNYYPRCEKPELTLGTGPHCDPTSITILHQDDVSGLQVYVDDQWHSIPPTEDSFVVNVGDTFMSLTNGVYKSCFHRAVVNCKEARKSMAFFLCPAVEKVVRAPEELVEKYPPRKFPDYTWPMLLEMTQKYYRADSNTFNAFTTWIQQQNLDSTASPAV

SEQ ID NO: 49781 - protein, 497 aa, Staphylococcus aureus subsp. aureus MRSA252
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVVTVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGGNDVATSPFTLVFKNAGFAFAASFMNAVILTSVLSAGNSGMYASTRMLYSMSKDKLAFETFGKTNKNGVPYMSLLVTAIIVVIIFVVQSVTEGAYQYIVAASGLTGFIAWVGIAVSHYRFRRAFDKQNYDKSKLKYTAKWFPFGPIFAAILCIVVIIGQDVDFIKTGDFNFSRFLITYMGIPVFLAFFIYHKLRYKTKKIPLEQVDLRQDVSMDEIKG

SEQ ID NO: 49782 - protein, 557 aa, Burkholderia sp. 383
MDKIWLKSYPPGVPAEIDASPYPSVPDLLDESFRQYRDRTAFVCMGKGITYGELDKLSRQFGAWLQSRGLARGARVAIMMPNVLQYPVAIAAVLRAGYTVVNVNPLYTPRELEHQLKDSGAEAIVILENFASTLQAVIANTGVKHVVVASMGDLLGIKGWLVNYVVRNVKKMVPAWQLPSFTRFKTALSEGARQAFKAQKIGPDDVAFLQYTGGTTGVAKGATLLHRNIVSNVLQAGAWHHPAHEKFPDVKQFVTVVALPLYHVFALTVCGFLTMRTGGMGILIPNPRDIAGMIKELKGYQISTIPAVNTLYNALLNHPEFNQLDLSKLVIANGGGMAIQEGVAKRWYEKTHTAIIEGYGLSETSPVATCNPVTATEYSGTIGLPLPSTEVAIRDDAGNDVALGEPGEICIRGPQVMAGYWNRPDETAKVMFADGFFKTGDVGVMDARGYVKIVDRKKDMILVSGFNVYPNEVEDVVASHPGVFEVAAVGVPDEHSGEAVKLFVVKKDPALTDKDILAYCKERLTGYKRPKLVEFRTELPKTNVGKILRRELRDGRA

SEQ ID NO: 49783 - protein, 530 aa, Moorella thermoacetica ATCC 39073
MYLVTAAEMGQLDRLASSEYMIPSIVLMENAGLRVVESIERHFQGQVANRRILIFCGKGNNGGDGLVVARHLLNRGAEVKVFLLARPEDIRGDARTNLEIYQKMGGKLLLLLGESHLQRADIALLYADLVVDAIFGTGFKGAAMGLPAAVINMINKAHRETVAVDLPSGLEADTGRCFGPCIQATWTVTFALPKLGLVVEPGASLTGRLEVADIGIPQKLVATQHFNRRLLTAAWCRSQLPRREASGHKGLYGRVLAVGGSPGLTGAITLAATAALKAGAGLVTAAVPRGVQGILAMKTTEIMTMSLPETPAGALSRDALDPLLERLAEVDVLAIGPGLSRDPATVDLVKELLPRVQVPAVVDADALNALATDTRVLTGDHGPLVLTPHPGEMARLLGTTAAKIQEDRLEIAAKYAREWQAVLLLKGARTVIAWPDGQVYINPTGNPGMATAGSGDVLTGIIAGLAGQGLKPGVAAALGAYLHGAAGDEAARQRGQRAMMAGDLLDFLPYVLRNLEEEVETIVAAGLGRD

SEQ ID NO: 49784 - protein, 384 aa, Debaryomyces hansenii CBS767
MVASKISNVAKTASLAAQALKTSGSANGRTLAQAGQYHALRMSGQRPASSSSGPQTMTVRDALNSAMAEELDRDDDVFLMGEEVAQYNGAYKISRGLLDRFGERRVIDTPITEMGFTGLAVGSALAGLKPICEFMTFNFAMQSIDQIINSAAKTYYMSGGKQPCNITFRGPNGAAAGVGAQHSQCYAAWYGSIPGLKVLSPYSAEDYKGLFKAAIRDPNPVVFLENEMSYGESFEMSEEALSSDFVLPIGKAKIEREGTDITLVSHTRNVMHCLQAAEKLESEYGVKAEVINLRSIKPLDTDSIIQSVKKTNHLVTCEAGFPAFGVGSEICAQIMESEAFDYLDAPVERVTGCEVPTPYAKELEDFAFPDVEIVMRASRKVLGL

SEQ ID NO: 49785 - protein, 341 aa, Staphylococcus aureus subsp. aureus MRSA252
MSTNIAINGMGRIGRMVLRIALQNKNLNVVAINASYPPETIAHLINYDTTHGKYNLKVEPIENGLQVGDHKIKLVADRNPENLPWKELDIDIAIDATGKFNHGDKAIAHIKAGAKKVLLTGPSKGGHVQMVVKGVNDDQLDIEAFDIFSNASCTTNCIGPVAKVLNNQFGIVNGLMTTVHAITNDQKNIDNPHKDLRRARSCNESIIPTSTGAAKALKEVLPELEGKLHGMALRVPTKNVSLVDLVVDLEKEVTAEEVNQAFENAGLEGIIEVEHQPLVSVDFNTNPHSAIIDAKSTMVMSGNKVKVIAWYDNEWGYSNRVVDVAEQIGALLTSKETVSAS

SEQ ID NO: 49786 - protein, 446 aa, Coprinopsis cinerea okayama7#130
MATVQNPDTSYNDPQHQSQQLQAQPSSLSNDDTSTPKQHLDVGNHTATSISQPRIVLDDPPASASVNQQPLSQPIAAHGGGMGHVGDSYAVGAPTTSEKLADNLVLSVTLVLAVLFWIMTLITQSIVTARRGNLTVGAAWFGLFLQLLLILLLSSLLFNPHTFLPPHHIQLSTLAALVLVFAAYAVERNIHDPPDPSQRALAAAWLLTIFVDLVWVMYFTAPPGSLIARVVENGRGPAVHPAALGAYTPGAGVGVGGGQSVVKGGLEGGANTGMTHTPMELAPLGPTPRHSAIRTASITQRSSGPGVADTSTEVSNLGVPTNGTGIGGGGSVVGSETGGRKSPWSFGGRDKEREREQAARAQQQQQALQQPVSPGGAQSDWAREMQSLPKAEALFGYTAAKEDPGELSFKKGEILYILDRSGKWWEARKADGTTGIAPSNYLRLVE

SEQ ID NO: 49787 - protein, 547 aa, Emericella nidulans
MGVESSSYHGESITPAPAPQPQQYSSQESIGSTKPEPGVDTPIPRITLRATIMGLFVSMGGLLFGYDTGQISGFQEMSDFLERYGELQSDGSYSFSHVRSGLIVSLLSIGTLIGALCGAPLADKLGRKWSITVWCIILMVGIIVQISAPSGNWVQIVMGRWTTGLGVGGCSLVVPMYQGESAPKHVRGAMISSYQLFVTLGIFLAYCINLGTESLDGSAQWRITLGLTFLFALILGLGMAMFPESPRFNYRHGKIDTARTTMARLYGVPENHVVIVRELAEIQSQLDAEKEQSQKWNEFITAPRMLYRILLGIVLQALQQLTGANYFFYYGTTIFQGAGISNSFITQVILGAINFGTTFGGLYVVENFGRRKSLIAGASLMFICFMIFASIGHFMLDVEHPENTPGPGKGMVVVASFFVLFYATTWGPIVWSIVAELFPSKYRAKGMALATASNWLWNFLIGFFTPFITGAIDFAYGYVFAGCLLVAVFVVYFFVIEGKDRTLEELDWMYVNHVKPWESSKYEIPRITYHDDARGARKENTEHAEVA

SEQ ID NO: 49788 - protein, 345 aa, Oryza sativa (japonica cultivar-group)
MEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 49789 - protein, 779 aa, Saccharomyces cerevisiae
MPTTYVPINQPIGDGEDVIDTNRFTNIPETQNFDQFVTIDKIAEENRPLSVDSDREFLNSKYRHYREVIWDRAKTFITLSSTAIVIGCIAGFLQVFTETLVNWKTGHCQRNWLLNKSFCCNGVVNEVTSTSNLLLKRQEFECEAQGLWIAWKGHVSPFIIFMLLSVLFALISTLLVKYVAPMATGSGISEIKVWVSGFEYNKEFLGFLTLVIKSVALPLAISSGLSVGKEGPSVHYATCCGYLLTKWLLRDTLTYSSQYEYITAASGAGVAVAFGAPIGGVLFGLEEIASANRFNSSTLWKSYYVALVAITTLKYIDPFRNGRVILFNVTYDRDWKVQEIPIFIALGIFGGLYGKYISKWNINFIHFRKMYLSSWPVQEVLFLATLTALISYFNEFLKLDMTESMGILFHECVKNDNTSTFSHRLCQLDENTHAFEFLKIFTSLCFATVIRALLVVVSYGARVPAGIFVPSMAVGATFGRAVSLLVERFISGPSVITPGAYAFLGAAATLSGITNLTLTVVVIMFELTGAFMYIIPLMIVVAITRIILSTSGISGGIADQMIMVNGFPYLEDEQDEEEEETLEKYTAEQLMSSKLITINETIYLSELESLLYDSASEYSVHGFPITKDEDKFEKEKRCIGYVLKRHLASKIMMQSVNSTKAQTTLVYFNKSNEELGHRENCIGFKDIMNESPISVKKAVPVTLLFRMFKELGCKTIIVEESGILKGLVTAKDILRFKRIKYREVHGAKFTYNEALDRRCWSVIHFIIKRFTTNRNGNVI

SEQ ID NO: 49790 - protein, 219 aa, Escherichia coli
  misc_feature (1)..(1): Xaa can be any naturally occurring amino acid
  misc_feature (42)..(42): Xaa can be any naturally occurring amino acid
  misc_feature (90)..(90): Xaa can be any naturally occurring amino acid
  misc_feature (92)..(92): Xaa can be any naturally occurring amino acid
  misc_feature (138)..(138): Xaa can be any naturally occurring amino acid
  misc_feature (174)..(174): Xaa can be any naturally occurring amino acid
  misc_feature (182)..(182): Xaa can be any naturally occurring amino acid
XTQDELKKAVGWAALQYVQPGTIVGVGTGSTAAHFIDALGTXKGQIEGAVSSSDASTEKLKSLGIHVFDLNEVDSLGIYVDGADEINGHXQXIKGGGAALTREKIIASVAEKFICIADASKQVDILGKFPLPVEVIPXARSAVARQLVKLGGRPEYRQGVVTDNGNVILDVHGXEILDPIAXENAINAIPGVVTVGLFANRGADVALIGTPDGVKTIVK

SEQ ID NO: 49791 - protein, 373 aa, Staphylococcus aureus subsp. aureus MRSA252
MAELQRGLEGVIAAETKISSIIESQLTYAGYDIDDLAENAQFEEVIFLLWNYRLPNEEELAHLKGKLNQYMTLNPRVYTHFEEYVTDHVHPMTALRTSLSYIAHFDPDAENESDENRYERAMRIQAKVASLVTAFARVRQDKEPIKPNPDLSYAANFLYMLRGELPTDIEVEAFNKALILHADHELNASAFTARCAVSSLSDMYSGIVAAVGSLKGPLHGGANEQVMTMLSEIGSIENVDAYLDEKFANKDKVMGFGHRVYKDGDPRAKYLREMSRQITKDAGREELFEMSVKMEKRMAEEKGLIPNVDFYSASVYHCMEIPHDLFTPIFAVSRSAGWIAHILEQYKDNRIMRPRAKYIGETNRKYIPLEERK

SEQ ID NO: 49792 - protein, 300 aa, Aspergillus oryzae
MSAVKAARYGKDNVRVYKVHKDEKTGIQTVYEMTVCVLLGGEIETSYVTSGLNRSLESLANNRGLQLHQGRQQRHCRNRLHYQNTIYITAKQNPVTPPELFGSILGTHFIEKYNHIHAAHVNIICHRWTRMDIDGKPHPHSFIRDSEEKRNVQVDVVEGKGIDIKSSLSGLTVLKSTNSQFWGFLRDEYTTLKETWDRILSTDVDATWQWKNFSGLQEVRSHVPKFDATWATAREVTLKTFAEDNSASVQATMYKMAEQILARQQLVETVEYSLPNKHYFEIGRFSAFPGIPCLKLSLMR

SEQ ID NO: 49793 - protein, 204 aa, Citrus unshiu
KLGDDEFGHMLVNILKQNNVKTEGVCFDNHARTALAFVTLKKNGEREFMFYRNPSADMLLKDSELNMGLIKQAKIFHYGSISLISEPCRSAHMAALKAAKDAGVLLSYDPNVRLPLWPSQDAARDGIKSIWNHADLIKVSDDEVNFLTKGGDAEKDDVVMSLWHDNLKLLLVTYGAKGCGYFTKKFKGRVPGFSVKTVDTTGAG

SEQ ID NO: 49794 - protein, 180 aa, Calycanthus floridus var. glaucus
MFPMVTGFMNYGQQTVRAARYIGQSFMITLSHANRLPVTIQYPYEKSITSERFRGRIHFEFDKCIACEVCVRVCPIDLPVVHWRLETDIRKKRLLNYSIDFGICIFCGNCVEYCPTNCLSMTEEYELSAYNRHELNYNQIALGRLPMSVIEDYTIRTTRNSTQIKIAMDKPLNARTVTNF

SEQ ID NO: 49795 - protein, 122 aa, Brassica napus
MWKQIISRLPKKSSKNHSSSNATASTSKSSSSSDNGTGKSHAKNAAPAAKPATAPPPDPGPKDGNFKQGNGIYEALPSFKDVPNAEKQTLFLKKLSLCCVLFDFSDPSKNVKEKEIKRQTLP

SEQ ID NO: 49796 - protein, 588 aa, Brassica napus
MSLPETKSQTLLDAWDFQGRPADRSKTGGWASAAMILCIEAVERLTTLGIGVNLVTYLTGTMHLGNATAANTVTNFLGTSFMLCLLGGFIAHTFLGRYLTIAIFAAIQATGVSILTLSTIIPGFQPPRCPTTSSHCVQPSGIQLTVLYLALYLTALGTGGVKASVSGFGSDQFDETEPKEQSQMTYFFNRFFFCINVGSLLAVTVLVYMQDDVGRKWGYGLCALAIVLSLSIFLAGTNRYRFKKLIGSPMTQVAAVIVAAWWNRRLELPSDPSFLYDLDDVIAAEGSMKSKQKLPHTNQFRSLDKAAIKDQEMAMTQNVYNKWTLSTVTDIEEVKQIVRMLPIWATCILFWTVHAQLTTLSVAQSETMDRHIGSFEIPPAAMAVFYIGGLLLTTAVYDRLAIPLCKKLFNYPHGLRPLQRIGLGLLLAAMGMAVAALVEIKRLRTAHAHGPTVKTLPLGFSLLIPQYLIVGIGEALIYTGQLDFFLRECPKGMKTMSTGLLLSTLALGFFFSSVLVTIVEKVTDKAHPWIADDLNKGRLYNFYWLVAVIVALNFLVFLVFSKWYVYKEKRLADLGIELEDEPDIPMGH

SEQ ID NO: 49797 - protein, 479 aa, Glycine max
  misc_feature (206)..(206): Xaa can be any naturally occurring amino acid
MSMSYVSVRQPFSWYDMLNSFQFIGNQLLYLWNTFLKFHRENKTKILEFLRNSWANDRRTEWSIWMVYSKVDMPHQYMSNGVEGTSLYRSLRGRSSSTRRSNDDPVQTATMRAELHRRGIAQMRINNRSLQDMYIFGDPLRVPIIIVERLENMYRSASVKSYFLPLEDKARHILENGSRAIIQLPGNSPPQNEHVLRVVVFVHGFXRAPPRGNHLDLRLVRNQWLLIDPKIQFLMSQANEDKTSGDFREMGFRLAQEVILFLKKKMDKASRNGNLKDIKLSFVGHSIGNLIIRTALTESVMEPYLRYLHTYVSISGPHLGYMYSSNSLFNSGLWILKKLKGTQCIHQLTFTDDPDLENTFIYNLSKEKTLANFQNVLLLSSPQDGYVPYHSARIEPCPAASLDFSKRGKIFLEMLNNCLDQIQAHTNDRVVMRCDINFNTSSYGRNLNTLIGRTAHIDFLESDIFAKFIMWSFPDLFRQ

SEQ ID NO: 49798 - protein, 602 aa, Rhodococcus sp. RHA1
MSTVVDALIGKVFAATRENRSGELADYIPELAAVAPDSFGICIATVDGYVYEVGDTRLPFTIQSISKPFTYALALADRGSDAVAEKIDVEPSGEPFNEISLDPRTERPRNPMINAGAITAASLVAGPDVDTRFERIRAEYSRYAGRDLTFNRSVYESESRTGHRNRAIGHMLRSFGIITGDPDETVDLYFRQCSIDVTCRDLSLMAATMANNGVNPVTRDTVLEPALVERVLSVMSTCGMYDAAGKWVYEVGLPAKSGVGGGIVAVLPGQIGIAVYSPRLDAHGNSVRGVEACRALSNDLELHFLHVTRAARSAIRATYSVVDSPSRMRRTPAERAALDDVGKRSRIYELHGDLLFAGAESAVREIGGVENELEVVVIDVRRVDDVGGIARRMLESLRDELTRRGCAVALVDPAALLGYTHSDLTGASGRVFADLEAALQWSEDTLLDRHCAALRQPATIDVAHHPVLAGLRPEQLRLLTRELDIRTFARDEQIIQRGDRACGLFLILSGRVSMRVTDSGGAVYRIMTLSTGMTFGEMTMLLDLRFLNDVCADSEVTVAVLPADRYADMAVTEPGLKLALLERLAAGAYEQLDVMLRSLLRP

SEQ ID NO: 49799 - protein, 465 aa, Rhodococcus sp. RHA1
MTQMSERHTAKVIGVTVAAAVGGFLFGFDSSVINGAVDSIQGHFELGSFFTGFAVAIALLGCAVGAWFAGRLADRWGRKKVMLLGSVLFVVSSLGAGLAFSVPDLMLWRVLGGLGIGIASVIAPTYISEIAPARYRGALASLQQLAITLGIFAALLSDAVLQNAAGGASNELWLNLEAWRWMFIVGVVPAVVYGILALLIPESPRYLVGKHLDQEAADILANITGELDPHERVSEIRLTLRHESTASFDDIRGPKFGLQPIVWVGIFMAIFQQFVGINAIFYYSTTLWKSVGFTENESFTTSVITAIINVGMTFVAILFVDRIGRRILLMVGSLGMFASLLMAAIAFSQASGSGDDVVLPSPWGAVALIGANLFVIFFASTWGPVMWVMLGEMFPNNMRAYALGISTAANWIANFTVTLAFPPLTRSVGLWFLYGLFAFFALLSFFFVRSKVRETKGMELEEMHT

SEQ ID NO: 49800 - protein, 67 aa, Arabidopsis thaliana
QTHERTGDAIGKASTFTVSGIAGGSSCNRGSPMSGSSIGGSFGNQPLTLKVMKQMCAGVVSITSDST

SEQ ID NO: 49801 - protein, 357 aa, Mortierella alpina
FVPDHPGGSVILTHVGKDGRDVFDTFHPEAAWETLANFYVGDIDESDRAIKNDDFAAEVRKLRTLFQSLGYYDSSNAYYAFKIYFNLCIWGLSSFIVAKWGQTSTLANVLSAALLGLFWQQCGWLAHDFLHHQVFQDRFWGDLFGAFLGGVCQGFSSSWWKDKHNTHHAAPNVHGEDPDIDTHPLLTWSEHALEMFSDVPDEELTRMWSRFMVLNQSWFYFPILSFARLSWCLQSILLVLPNGQAHKPSGARVSISLVEQLSLAMHWSWYLATIFLFIKDPVNMMVYFLVSQAVCGNLLAIVFSLNHNGMPVMSKEEAVDMDFFTKLIITGRDVHPGLFANWFSGGLNYQIEHHLFP

SEQ ID NO: 49802 - protein, 137 aa, Solanum lycopersicum
TPSGGAQVRATYHIYNPQNVGWDLNAVSAYCSTWDANKPYSWRSKYGWTAFCGPVGPRGRDSCGKCLRVTNTRTGAQTTVRIVDQCSNGGLDLDINVFRQIDTDGVGNQQGHLIVNYQFVNCGDNVNVPLLSVVDSE

SEQ ID NO: 49803 - protein, 322 aa, Staphylococcus aureus subsp. aureus MRSA252
MKKIAVLTSGGDSPGMNAAVRAVVRTAIYNEIEVYGVYHGYQGLLNDDIHKLELGSVGDTIQRGGTFLYSARCPEFKEQEVRKVAIENLRKRGIEGLVVIGGDGSYRGAQRISEECKEIQTIGIPGTIDNDINGTDFTIGFDTALNTIIGLVDKIRDTASSHARTFIIEAMGRDCGDLALWAGLSVGAETIVVPEVKTDIKEIADKIEQGIKRGKKHSIVLVAEGCMTAQDCQKELSQFINVDNRVSVLGHVQRGGSPTGADRVLASRLGGYAVDLLMQGETAKGVGIKNNKIVATSFDEIFDGKDHKFDYSLYELANKLSI

SEQ ID NO: 49804 - protein, 311 aa, Oryza sativa (japonica cultivar-group)
MARNEEKAQSMLNRFITMKQEEKRKPRERRPYLASECRDLADAERWRSEILREIGAKVAEIQNEGLGEHRLRDLNDEINKLLRERGHWERRIVELGGRDHSRSSNAPLMTDLDGNIVAIPNPSGRGPGYRYFGAAKKLPGVRELFDKPPEVRKRRTRYEIHKRINAGYYGYYDDEDGMLERLEAVAEKRMRNEVITEWHRVERVRREAMKGVVSGEVASAGGRGGEAAREVLFEEVEEEVEEERRLEEEKREREKGEEAGKEFIAHVPLPDEKEIERMVLERKKKELLSKYTSDALQVEQEEAKEMLNVRR

SEQ ID NO: 49805 - protein, 593 aa, Ustilago maydis 521
MLSPAIRAGSLRAAVLPSLALQASRLAVPSTSASAAAAAAAAAAVAPSSLFASQQQTRTIFWTRSRKNDKTVSVLQAAQNDAQEQLPPPNSTGQNKRGFFRTARRTFYVIALGSLGTYAYFVYQGRHPPDQLPQDPSKKTIVVLGSGWGATSLLKNIDTEEYNVVVISPHNYFLFTPLLPSVTVGTLDGRSIVQPTRHTTRFKTREVKVYEADCEYVDPINKTVTFEDRSEVKGSVSKVTIPYDYLVYSVGTENQTFGIEGVKKHACFLKELSDAEKIRARLIDCVESAAIKGQSEEEIDRLLHMVVVGGGPTGIEYAAELRDFVESDLIRWYPEVANKLRVTLVEALPNILPMFSQTLIKYTESTFKENSIDILTKHMVKDVDDRDVLVKTPSGEEKKIPYGLLVWAAGNTARPLTRQLMAALPESQKNRRGLDVDDHMRLKGAEDSIFALGDATATQFAPTAQAASQQGAYLARVFNQLARLHILEDKLEAAKKANADASELSGLERQIEKAAKIRPFKYSHQGSLAYIGSERAIADIPLLGNNQIASGGVVTFMFWRSAYMSMLFSLRNRSLVAADWFKVFLFGRDVSRE

SEQ ID NO: 49806 - protein, 235 aa, Saccharomyces cerevisiae
MSRNVDKANSVLVRFQEQQAESAGGYKDYSRYQRPRNVSKVKSIKEANEWKRQVSKEIKQKSTRIYDPSLNEMQIAELNDELNNLFKEWKRWQWHIDHTLMEKKTKRKRLEDSHVLMNSGKLINGKRYFGRALELPEVKEWLKQSQRQNDGGSINTKCIPKDRNDFYYHGKVTAALTEFEANWTSILKAHYNVPVNEDEEEMSRQTQEIHVPTLADMEHWLVQRRKKKLMDELNL

SEQ ID NO: 49807 - protein, 221 aa, Triticum aestivum
ARGAVLTDRVLLVDPSNEMGELFCEPFPGTTWLLPPDFPLTSYTNFSIQTAESHANMVKNKVISTVDVAQGLPAFAYIHLDHDATGEDKQFYCDEDQRVLRDIQWLVMRTDSYIVPGLFLVMAFQEELDMLFPEPDTVFHHLGRYLFHPSNHVWGLVTRYHDAYLAAAHQRVGIQVRVFGSAPNSPELLEQITTCAQKEGLLPELLTAGAPAATTSPPFPE

SEQ ID NO: 49808 - protein, 219 aa, Desulfovibrio desulfuricans G20
MPQAVIFDMDGVLLDSEPMHMQVQDNMAAELGFKMTRAEHLAFVGISPLATWEQLCARHGLPQNPQELAEEQGRRYLAQALEKAVPRAGLLPLLDYLQARDKPLAVASSNQRETVDAVLGKLGVRDFFRAVVTGSDAERSKPWPDIFLKAARLLRALPADCLVIEDAATGVAAARSAGMRCIGLCVPDAPFQDLSSADITVSSLDEIIPLLENKSCRCG

SEQ ID NO: 49809 - protein, 321 aa, Mannheimia succiniciproducens MBEL55E
MIKKIAVLTSGGDAPGMNAAIRGVVRSALFEGLEVFGVYDGYYGLYHNKIKQLNRYSVSDVITRGGTFLGSARFPEFKNPEVRAKCAEILRSHGIDALVVIGGDGSYTGAKLLTEEHGIQCIGLPGTIDNDAPGTDYTIGYQTALETAVDAIDRLRDTSSSHQRISIVEIMGRHCSDLTINAALAGGCEYIVASEVEFDQEELIQQIERSIANGKRHAIIAITELITDVHELAKRIEERVHHETRATVLGHVQRGGSPCAFDRILASRMGVYAVDLLLQGKGGYCVGIQNEQLVHHDIIDAINNMRRSFKAELLDMNERLF

SEQ ID NO: 49810 - protein, 311 aa, Gloeobacter violaceus PCC 7421
MVVLVTGAAVVDILVSAPQELPAPGASRLTDTIALAAGGCGVNTAIGLARLGVPVEFAAHLGADGAGEWIKAELSRAGVGLAHFRQSAEVATKSAVVLLSAAGERSFLRTRGGGNAIARADLEHLDWSGIGHLHIGGCYSLRRLLGEDLAAVLRSARRAGVVTCLDTVWSSDGNWEALLPALGQIDHLLPSLAEARAITGESTPQAMARWLIAHGSTRVIIKLGERGAYACGPDIDAVVPALPVPGGRVIDTTGAGDAFCAGYLAALAEGLTAPRAVRWANAWGAVAVSGLGATAALRDRSQLEALVVPTE

SEQ ID NO: 49811 - protein, 320 aa, Gloeobacter violaceus PCC 7421
MSTHVLCLGEMLLDCLADQPDRPEAQVASWTSYPGGAPANVACALAAIGGKSCFVGCLGADPEGERLLAVLERSGVNTAGVQRAPWPTRKVYVTRTAAGERTFASFGGHPPDAFADTHLQAEKITPDLFDGAAFLTLGTLMMAFPDSARAVEGALDLADERFVKICLDVNWRPVFWEQPEQAPAVVRGLIERCDVLKVSEEEAEWLGMPSIEAITAAFDHLEGILLTRGENGCLWQVGERRGEHLGYRVPTVDTTGAGDAFVAALLHRLSRAPLRAWESEAAAVVDYACAAGALSTMIPGGIGSTPDEAAVQAFLRAQAL

SEQ ID NO: 49812 - protein, 254 aa, Brassica napus
MAKFGEGDKRWIVEDRPDGTNVHNWHWAETNCLEWSRSFFTNQFSNAVILSGEGNLFIKIKKLEKLEGEAYVNVRKGKIIPGYELSVSLSWEGEAKDSEGKTISKAEGSVDMPYISDENADEDPEVRVSVKDEGAVGKALKEAMVKKGKGVALEKVRVFVEAMAKGGPCRDELENKKVAPKWVAAAAAAVEKTSVLPAVVVKEKKKVKTKEGFKTISMTEKFSCRAKDLYEILMDENRVKGFTQSNAKISKDVN

SEQ ID NO: 49813 - protein, 325 aa, Listeria monocytogenes EGD-e
MAQKTMIQAITDALAVELEKDENVLVFGEDVGKNGGVFRATEGLQEKFGEDRVFDTPLAESGIGGLAIGLALEGFRPVPEIQFFGFVFEVMDSVAGQMARMRYRTGGTRNAPITIRAPFGGGVHTPEMHADNLEGLMAQSPGLKVVIPSTPYDAKGLLISAIRDNDPVIFLEHMKLYRSFREEVPEGEYTVEIGKAAVRREGTDVSIITYGAMVQESMKAAEALEKDGVSVEVIDLRTISPIDVETIIASVKKTNRAVVVQEAQKQAGIAANIVAEINDHAILSLEAPVMRVAAPDSVFPFSQAETVWLPNHNDIIERVKEVIAF

SEQ ID NO: 49814 - protein, 419 aa, Nitrosomonas europaea ATCC 19718
MRLTPERLDLLIAAVRKILPLQAPADVLLRQFFQDHHKLGQNDRGTIAEAVFGILRRRFFLEKLAGKATARELVLAYLTRFQGMNLRELAPLIRETEIKWIQQIKAVKLEEQPLSIRAEFPEWLVEKLQKYHSDEEILRLGQTLQQPAPLDIRVNSLLAKREEVLAALEQQEIEAQPTPFSPVGIRITGKPAINRNALFLSGKIEVQDEGSQLLGFLLAPKRGEMVVDFCAGAGGKTLLLGALMHSRGRLYAFDVSEKRLNNLKPRLKRSGLSNIHPQRIDSERDAKLKRLAGKIDRVMVDAPCSGLGTLRRNPDLKWRQSPESIDELQKKQMAILTAAANLLKPGGRLVYATCSLLPEENQQIVEHFLANHPQFSILHCDELLAQQKIHLPDTGKFLQLSPLYHNTDSFFAAVLERSV

SEQ ID NO: 49815 - protein, 544 aa, Listeria monocytogenes EGD-e
MAYSFKLPDIGEGIHEGEIVKWFVQPGDKIEEDESLFEVQNDKSVEEITSPVSGTIKEIKVAEGTVATVGQVLVTFDGVEGHEDDAEEESAAPKAESTESTPAPAQASGKGIFEFKLPDIGEGIHEGEIVKWFIQPGDKVEEDQSIFEVQNDKSVEEITSPVDGTVKDILVSEGTVATVGQVLVTFEGDFEGEASHESTPESPAEDAALANNDATSAPATGGNGTPSSKKDPNGLVIAMPSVRKYAREKGVNIAEVAGSGKNNRVVKADIDAFLNGEQPAAATTTAQTEEKAAAPKAEKAAGKQPVASSDAYPETREKLTPTRRAIAKAMVNSKHTAPHVTLMDEIEVTALMAHRKRFKEVAAEKGIKLTFLPYMVKALVATLRDFPVLNTTLDDATEELVYKHYFNVGIAADTDHGLYVPVIKNADKKSVFQISDEINELAGKARDGKLTADEMRHGSATISNIGSAGGQWFTPVINYPEVAILGVGRIAQKPIVKDGEIVAAPVLALSLSFDHRVIDGATAQKAMNNIKRLLNDPELLLMEV

SEQ ID NO: 49816 - protein, 467 aa, Listeria monocytogenes EGD-e
MVVGDFPEERDTIVIGAGPGGYVAAIRAAQLGQKVTIIEKEYYGGVCLNVGCIPSKALITIGHRFKEAGHSDNMGITADNVNLDFTKAQEWKGGVVNKLTSGVKGLLKKNKVEMLEGEAFFVDDHSLRVIHPDSAQTYTFNNVIIATGSRPIEIPGFKYGKRVLSSTGALALTEVPKKLVVIGGGYIGTELGGAFANLGTELTILEGGPEILPTYEKDMVSLVKRNLKSKNVEMVTKALAKSAEETENGVKVTYEANGETKTIEADYVLVTVGRRPNTDEIGLEQAGVKVTERGLVEVDKQGRSNVSNIFAIGDIVPGVPLAHKASYEAKIAAEAIAGEKSENDYTALPAVVFSDPELATVGLTEKEAKEKGFDVKAAKFPFGGNGRALSLDAPEGFVRLVTRKEDGLVIGAQVAGMNASDIISEIGLAIESGITAEDIALTIHAHPSLGELTMEAAELALGRPIHM

SEQ ID NO: 49817 - protein, 146 aa, Pseudomonas fluorescens Pf-5
MKSVAELLKLKAKHNQQVHTIAPHQMVLEALMVMAEKNVGALPVLENGVVVGVISERDYARKLVLHGRSSVGTPVSAIMSSPVITVDSHQSVDTCMNIMTDSHLRHLPVVENGQLLGLLSIGDLVKEAIAEQADLIRQLEQYIRGE

SEQ ID NO: 49818 - protein, 645 aa, Brassica napus
  misc_feature (57)..(57): Xaa can be any naturally occurring amino acid
MSSSSSSSFRSPAGAAATLFSSDQKIRLGRLDVLRSSHSAFLGRRNPRGVVSVHPSXSPSPIQAVSSPSKPEAATKRSKVEIIKEKSNFIRYPLNEELLTEAPNVNESAVQLIKFHGSYQQYNREERGGRSYSFMLRTKNPSGKVPNQLYLTMDDLADEFGIGTLRLTTRQTFQLHGVLKQNLKTVMSSIIRNMGSTLGACGDLNRNVLAPAAPYVKKDYLFAQETADNIAALLSPQSGFYYDMWVDGEQFMTAEPPEVVKARNDNSHGTNFVDSPEPIYGTQFLPRKFKVAVTVPTDNSVDLLTNDIGVVVVSDENGEPQGFNLYVGGGMGRTHRMESTFARLAEPLGYVPKEDILYAVKAIVVTQREHGRRDDRKYSRMKYLVSSWGIEKFKDVVEQYYGKKFEPSRELPEWEFKSYLGWHEQGDGAWFCGLHVDSGRVGGIMKKTLREVIEKYKIDVRITPNQNIVLCDIKTEWKRPITTVLAQAGLLQPEFVDPLNQTAMACPAFPLCPLAITEAERGIPSILKRVRAMFEKVGLEYEESVVIRVTGCPNGCARPYMAELGLVGDGPNSYQVWLGGTPNQTQIARSFMDKVKVHDLEKVFEPLFYHWKVDRETKESFGEFTTRMGFEKLKELIDTYKGGPQ

SEQ ID NO: 49819 - protein, 389 aa, Pseudomonas fluorescens Pf-5
MHTPDFDVVVVGLGAMGAATLYQLAKRGVRVAGIDRFAPPHDLGSSHGDTRITRQAVGEGAAYVPLAIRSQQIWRELEAELDVQLFEQCGVLVMTASTDPQRPAGARDFTDNSIELARRYGIEHQELDAAEIRRRFPQFAPLDDSARGYFEPGGGFVRPERCIDAQLTRARQLGATLITGQTVLELDAQDDGVHIISDGSRLFARQVIVSAGMWSAQLLGAPFDSLLQVCRQQLYWFRLDEPERYPARSPSFILHSADDVDACYGFPPISGEGSVKIATEQYSASSQPDSLDRQPSSADAQRLFHKLIAPHIAGLAPELVKASVCAYTVTPDSGFIIDRHPRLANVTVVSACSGHGFKHSAAIGEALAQQHVDGCSEIDLESFSLHRFN

SEQ ID NO: 49820 - protein, 519 aa, Corynebacterium efficiens YS-314
MSGLEQPAELSRVWRWLLLVSVAICAASGLVYELALVSLSASLNGGGIVETSLIVAGYVAALGVGAILVKPFLRWPAQTFLAVETLLGLIGGLSALVLYMTFAVVGQNLWMLVLATALIGILVGAELPLLMTMIQRGRLADARTTGSLVATLNAADYLGALLGGLAWPFILLPWLGMMRGAAAAGMINLLAALFVGCVLLRHLLPRAQFIRAVVALLVAIAVLGTVLVRSDGIVATARQQLYRDPVIYAHQSDYQDIVVTQRGADRRLYLNGGLQYSTRDEHRYTESLVYPGLSDSARTALIIGGGDGLAARELLRFPDMRITQVELDPEVIEVANTILLPDNGGAMQDPRVTVITDDAFTWLRAGGDGGQRYDAIFVDLPDPNNDTMARLYSQEFYTLALARLNDGGRMVVQSSSAYTTPDVFWRIASTMSAAGCGAVIPYHVHVPTFGDWGFQLCGPEGTELGLRGDTPSLRFLTDEVLAAAGVFGADNQPRELEPSTLDHPRVVEDLRRGYRQAGE

SEQ ID NO: 49821 - protein, 696 aa, Oryza sativa (japonica cultivar-group)
MGISAAAAAAPFLLLVALLLLLPSPAAAFSFTYNFTSADTAPSGIAFQGDAFFNKFIRLTRDERIGPITSSAGRAFFSRPVPLCDPVSRRRASFSTAFSFSIAAPDPSAASGDGLAFFLSPFPSVLPNSSAGGLLGLFNSFSRGGAAAAHPRPLVAVEFDTYKNEWDPSDDHVGVDLGGIVSAATVDWPTSMKDGRRAHARVAYDGQAKNLTVALSYGDAAAAAALTDPVLWYAVDLMEYLPDAVAVGFSAATGEAAELHQVLYWEFTSSIDTKEETVILWVVLGLCGLLLVLVAAGVLWFVSQWRKAGELADGDIDEEMGYDELADEEFFVESGPRRFRYSDLAAATKNFSDERKLGQGGFGAVYRGFLKELGLAVAIKRVSKGSTQGRKEYAAEVRIISQLRHRHLVRLVGWCHEHRGDFLLVYELMPNGSVDRHLYGGGGGSKKAGGAAPPLSWPTRYNVALGLASALLYLHEECPQCVVHRDIKPSNVMLDATFSAKLGDFGLAKLVEHGSQPHTTVLAGTLGYLAPECVITGRASRESDVYSFGVVALEIACGRRPAELDEEDPSKARLVPWVWELYGKRAILEAADQRLNGKFDLEQMERLMVVGLWCAHPDHAHRPSIRQALNVLKFEAPLPSLPPKMPVPSYFPPPDLVAPVSVEGTSSTDGPGVSECGSSGSNAGGGSGINDRLLDP

SEQ ID NO: 49822 - protein, 416 aa, Rhodococcus sp. RHA1
MTRGFVLRQAVGAALAANALRPLPGAPTSVVAFFSGWLTTELAPHLLAVTAADAAQHAARHGTRTRSDRVGLALAAASAAGLAAVIATGRGAGAEAESALVETLGENYTDRDSAIEHPGRPVWRQLLNPFWMRNKAVTRVRNLAYGPGGRRARLDIYHRQDLPSKSPVLLQIHGGGWVIGNKDQQGLPLMLEMASRGWVCAAVNYPLSPKAKWPEHLIAIKQALAWLREHVEEYGGNPDFIAVTGGSAGGHLAAMVGLTANDSHLQPGFEDVDTSVQACVPYYGVYDIAGDTGIKAVLQRVHSGLMPMVLGKHATFPDDYRAASPLAHLRADAPPFFVIHGTSDSLIPVAEARIFVDELRQVSDNPVVYAELKGAQHAFDVFPSIRSISVTQAVGRFLEWSRSATTDVPAAGTESA

SEQ ID NO: 49823 - protein, 282 aa, Triticum aestivum
SFPPSRSNFIVFKHPVIGLVDPDNLKPGDLVGVNKDSYLILDTLPSEYDSRVKAMEVDEKPTEDYNDIGGLEKEIQELVEAIVLPMTHKEQFQKLGIRPPKGVLLYGSPGTGKTLMARACAAQTNATFLKLAGPQLVQMFIGDGAKLVRDAFELAKEKAPCIIFIDERIKVIAATNRADILDPALLRSGRLDRKIEFPHPTEEARARILQIHSRKMNVHPDVNFEELARSTDDFNGAQLKAVCVEAGMLALRRDATEVIHEDFNEGIIQVQAKKKSSLNYYA

SEQ ID NO: 49824 - protein, 484 aa, Bordetella bronchiseptica RB50
MENLGYPARLELYVAGQWRGVEGRRTQVVVNPSTQQPLGELPLASVEDIDDALAAADQAFGDWARTTAWERADILQRAAALIEARRDRLAVVLTLENGKPLADSHGELDRVVETILWCAEEGKRTYGRVLPARAQRLSQSSLKRPVGPVAAFVPWNFPAVLAARKLAAAMAAGCTVVLKPAEETPAICIELVRAFVDAGTPAGVVNLLYGVPAQVSERLIASPIIRKVSFTGSVAVGRLLASMAAGHLKPATMELGGHAPVVVFDDVDADRVAKMCVGFKYRNAGQVCLSPSRFYVHERIADRFAESFVRHAGLLRVGDGMEEGVQMGPLNNVRRLQAAERLVEQAVGAGASLALGGRRIGQRGYFYPPTVLEGVPDAADILAEEPFCPVAPIMRFGSMDEVIGRANHPSLGLAAYAFTNRMATSAEFAERIEAGWIGINNFVPALADAPIGGMKDSGLGYEGGPEGLDAYLHARFVSQLNVEV

SEQ ID NO: 49825 - protein, 234 aa, Triticum aestivum
  misc_feature (150)..(150): Xaa can be any naturally occurring amino acid
  misc_feature (154)..(156): Xaa can be any naturally occurring amino acid
  misc_feature (176)..(176): Xaa can be any naturally occurring amino acid
LNKFVQKSRLVPVRNSRDIVDPRVRAQAPARPAEEETPPGAGVKVSFRPSVAIVVGIFTMIFSLTFLLLMYAKFCHPANTPLLPATTASPSRPPATTAEAAAALEEAGAGVGKAVIESLPFFRFAALRGARQGLECAVCLARFDDADLLXLLPXXXHAFPLDCVDRWLHSSASCPXWRARGPPRTTPTSGLKYPAAKPRIVFGATRGKPLLFGRNCPSFKRGPARNPLPRGFFF

SEQ ID NO: 49826 - protein, 865 aa, Debaryomyces hansenii CBS767
MNFLKKFLGSAPTDEVALIPSGRLFLARSPQSPKGELECLYNDAFASIRQTTTPFYYQLCITRVYQEGELDAHGSSGFDDSDDSDEDDHDTPHSISDSNAGGHSKDEWSFPILEELKIHTYDKADGSKTLAWKDLNGDLGDRFEFTVDSDIKLTEFDSFMFALYKCLFELKYHKSSLSITNMSQLQEFIYNPKSELLTFDDLRGDFLNYEDDEASEDVDTGDDYRSVSSTDEFHDAESRTTPSATIKSSGKAERSPVKSNVAGVPSIFSSDKEALNTGNVLYECSNFDLHLFDSDAGVFNLQVKKPELNLKIIELENWTYSLRLLSSHKSKPINFECILSADMNPTFNFEYLSFIFNHFIQKSETQTLAYSWLLKFSHFNELQEFQVSFMKAMWESLNKIKWNKSRPSEQDYVLDAFSNLAIDDEDLTENDKKEINEMSDDDMLIDNDYSDDEDAISKLVNRSIRGETTKPRHKYVDDDDDEYGDYDEEKQLDAFKREQDKNSNLSVGYANDRSYVVRGDKLGVFNNNNNNLNYQTTISNLKTLDGKRFTPEQVMLHMQDQHMVMSNKDMDDKRLYKMDLSRGKIVDEWEVDDIIPIESYGPNSKFSQLTNEQTLTGMSRNKLFKVDPRLPTTKLVQGDDNLRTPNYNFLALSTTEQGFLAVGSAKGDIRLFDRLGTNAKSLLPSLGEAIIGIDVSNDGRWILATCKTYLLLVDAKVGANQRNEGSLGYVKSFDKDKKPKPRRLTIKPEHVAYMSMKTEGKPLQFTKAYFNTGIDSKETTIVTSTGPYIISWSLKKVLSNNSSKEDQPYLIKRYDQNVIADNFKFGSNSDVIIALQDDVSMANKKNFRKANKSSLFSRDNVVNNY

SEQ ID NO: 49827 - protein, 402 aa, Brassica napus
  misc_feature (112)..(112): Xaa can be any naturally occurring amino acid
MATKRSVGTLKEADLKGKSVFVRVDLNVPLDDNSNITDDTRIRAAVPTIKYLMGNGSRVVLCSHLGRPKGVTPKFSLKPLVPRLSELLGVEVVMANDSIGEEVQKLVAGLPXEGGVLLLENVRFYKEEEKNDPEFAKKLAALADVYVNDAFGTAHRAHASTEGVAKYLKPSVAGFLMQKELDYLVGAVANPKKPFAAIVGGSKVSTKIGVIESLLSTVDILLLGGGMIFTFYKAQGHSVGSSLVEEDKLDLAKSLMEKAEAKGVSLLLPTDVVIADKFAPDANSKIVPATAIPDGWMGLDVGPDSIKTFSEALDTTQTIIWNGPMGVFEFEKFAAGTEAVAKQLAELSGKGVTTIIGGGDSVASVEKVGLADKMSHISTGGGASLELLEGKPLPGVLALDDA

SEQ ID NO: 49828 - protein, 387 aa, Triticum aestivum
  misc_feature (221)..(221): Xaa can be any naturally occurring amino acid
  misc_feature (238)..(238): Xaa can be any naturally occurring amino acid
MIPAVKLSPAAFSVTNQRSKSAFVPSVSILNMKKFASCSLRPLYLTRLDDPHTSELKPRRQLLDFRCAASAADDKESKAEVVPASSEAAQKLKISIYFATWWALNVIFNIYNKKVLNAFPYPWLTSTLSLACGSAMMLFSWVTCLVEAPKTDLDFWKALFPVAVAHTIGHVAATVSMSKVAVSFTHIIKSAEPAFSVLVSRFILGESFPMPVYLSLLPIIXGGCGLTAATELNFNMIXGFMGAMISNLAFVFRNIFSKRGMKGKSVSGMNYYACLSIMSLVILTPFAIAMEGPQMWAAGWQKALADVGPNVLWWIGAQSVFYHLYNQVSYMSLDQISPLTFSIGNTMKRISVIVSSIIIFRTPVRPVNALGAAIAIFGTFLYSQAKQ

SEQ ID NO: 49829 - protein, 757 aa, Mannheimia succiniciproducens MBEL55E
MDEQLRQAALDFHEFPVPGKIEVTPTKSLATQRDLALAYSPGVAMPCLEIQEDPAKAYNYTAKGNLVAVISNGTAVLGLGNIGALAGKPVMEGKGVLFKKFAGVDVFDIEINEKDPEKLVEIIAALEPTFGGINLEDIKAPECFYIEQKLRERMNIPVFHDDQHGTAIISSAAVLNGLRIINKKIEDVRLVASGAGAASIACLNLLVSLGMKRENITVCDSKGVIYKGRDENMDATKKLYAIDDNGTRSLADAIPNADIFLGCSAAGALTQEMVKTMGPNPLILALANPNPEITPPEAKAVRPDAIVCTGRSDFPNQVNNVLCFPFIFRGALDVGATTINEEMKMAAVRAIADLALAEQSDVVSSAYTDESEVTFGPEYVIPKPFDPRLIIRIAPAVAKAAMDSGVATRPIQNFDAYIEKLTQFVYKTNLFMKPVFNQAKADKKRVLLTDGEETRILHAVQEISTLGIAYPVLVGRLDVIEAQIKRLGLKIQAGVDFEVLNTDNEEIYQQCWSLYHNKLKRHGVTEAMAKRRMLTNSTAIGSALLELGYADAMLCGLVGTYSSSLSLLKEVIGIKENVDIPATVNGLVLPSGNLFIADTFVNLAPTAEELAEITLMAAEEVRRFGIEPQVALISHSNFGTSEDQSAVKMREVLQLVKTQAPDLIIDGEMHANVALNENLRREVMPDSPLKGAANLLIMPDMESARISLNLLQGTATPITIGPILMGMKKPAHILTSVSSVRRIINMVAIAAVKAQQN

SEQ ID NO: 49830 - protein, 694 aa, Nitrosomonas europaea ATCC 19718
MKNPLEGSVIRRVMVGTDRSETADQTVQWAAGLADRYDAELFIVQVIVPKYPSATEFGESEQTSAVAANNDLAHFARQIAGERGHALVVINADPALAIVHAAEQEAIDVLVVGNLGMAGRKEFLLGNIPNRISHNAHCTVIIVNAAHSADERAPHSVRASLSNDEIPSFKPRLVARATHIAAVMAKHGLTELFSQSDPDISIRRQQARRLRGALEELGPIFSKLGQVLSTRPDLLPIEYIEELVLLQSRVPPMTESEVVRVSEQELGVPWEDVFKSFDPNPLAAGTIAQVHRATLETGDRVVVKVQRPTARADIEQDLALFEMFAEKVGKRPALNQVINMEDVFKHLSTSLHRELDFRQEANNIERMRTVLADYDRLAVPSIHWDLSTSRLLVMEEIQGIPIKQAPAGPERIQAARQLLESYYKQIIVDGFFHADPHPGNLMWWKDCIYFLDFGMVGAVGADLREHLLLMLMALWQEDAGFLTDVTLMMTNAVNSNDFDVAQFQSEIGEVMAKYRAASLAEMQIGPLLQEMSTVSLRHGVPLPASLTLATKALAQVQLATAELDPTLDPYDVAGKYLMRLMVKRIGAALNPKTFVYQSQKLKVRTLRVIEALENLVGVRPGGPKLVVNFKANSLENIVRHTGRRLALGLTAAASILTSGLTTMSTAVAEWVPVTFGAVAGLLTLGLVIDLLRGR

SEQ ID NO: 49831 - protein, 444 aa, Lyngbya majuscula
MMKFPDGPKTPALLQSINLIVNPLNYLEDCAKRYGDIFTIRFLNYPPTVLVSHPQAMKEIFTASSQTFNTGEAMKELPTAFTGENALPLLDGDLHKHRKRMLMPAFHGERLRAYSELIYDLTKQEIEQWTKGEPFHVQASMQDISLKFIIRAIFGVNDEDRFQQFKKTLISLLNLLSDPWTSIVLYFRALQQDWGSWSLWGRFVRLRQQVDDIIYAEIKRRRDDPALLGEDILSLMMSARNEQGELINDVELRDDLMILLLGGHETTSMSMTWALYWIHHFPQVYETLMAELDTLDDYQDSSAIMKLPYLDAVCHETLRIYPPTILGAYRIAQKPVEIMSHKFEAGTFILPCIYLTHRQEDLYPEPNHFRPERFLERQFSAYEFVAFGGGSRRCIGYALSLFEMKLILATILTNLKLALPDNRVIKPVRSAFTVAPSPMYMIRA

SEQ ID NO: 49832 - protein, 285 aa, Mycobacterium sp. MCS
MAAARVCVVGSVNADLRFAVPSLPRPGQTVLASSMTTSPGGKGGNQAIAAARAGGDVSLVAALGDDPAAGQLRAHLRANGVGLDGVVTVPGPSGSAVVIVDAAAENAIVVAPGANAHLSVASSAVREAIAGADVVLLQLEIPLHTANDAARVARDAGAVVMVNASPAGAPPHELLRLSEVADVVVVNQAEAGEWHWPVPHLVITRGARGASYLGDGERFDVPAPAVEAVDTTGAGDVFAGVLAVHWRSGHENALRRACVAGALATLVPGAGDCAPTAEAIDDTLR

SEQ ID NO: 49833 - protein, 109 aa, Brassica napus
RDEVMIRPSSKVIIKFLMVKQNHGYRGEFDYVEVHRSCKIVVEVNGSLNKCGVISPRFDVGVKEIEPWAARLLPSRQFGYIVLNTSAGIMDHEEARRKNVGGKVLGFFY

SEQ ID NO: 49834 - protein, 477 aa, Lactococcus lactis
MLFLKGLTLMTKTLPKDFIFGGATAAYQAEGATHTDGKGPVAWDKYLEDNYWYTAEPASDFYHKYPVDLELAEEYGVNGIRISIAWSRIFPTGYGEVNEKGVEFYHKLFAECHKRHVEPFVTLHHFDTPEALHSNGDFLNRENIEHFIDYAAFCFEEFPEVNYWTTFNEIGPIGDGQYLVGKFPPGIKYDLAKVFQSHHNMMVSHARAVKLYKDKGYKGEIGVVHALPTKYPYDPENPADVRAAELEDIIHNKFILDATYLGHYSDKTMEGVNHILAENGGELDLRDEDFQALDAAKDLNDFLGINYYMSDWMQAFDGETEIIHNGKGEKGSSKYQIKGVGRRVAPDYVPRTDWDWIIYPEGLYDQIMRVKNDYPNYKKIYITENGLGYKDEFVDNTVYDDGRIDYVKQHLEVLSDAIADGANVKGYFIWSLMDVFSWSNGYEKRYGLFYVDFDTQERYPKKSAHWYKKLAETQVIE

SEQ ID NO: 49835 - protein, 519 aa, Nitrosomonas europaea ATCC 19718
MHSAILILDFGSQYTRLIARRIRETNVYCELHPFDVSPQFIREFAPIGIILSGGPASTFTEDAPRVPQIVFELGVPVLGICYGMQAMAAQLGGEVEDAQTREFGYAELLTAPCKLFHGIQDRINSDGKPALDVWMSHGDRVNKLPPGFTAIASNAATPFAAMADETRNFYGVQFHPEVTHTRQGKAILDHFVHDICSAGYDWNMPDYVEEAIGRIRARVGNDKVVLGLSGGVDSSVAAALIHRAIGDQLVCVFVDNGLLRLNEAKQIMETFSRNLAVNVIYIDAGRQFLEQLKGITDPEQKRRTIGREFVEIFQQEAEKIENAKWLAQGTIYPDVIESAGSHTKKAGVIKSHHNVGGLPETLHLKLLEPLRELFKDEVRELGLALGLPHDLVFRHPFPGPGLGVRILGEVKYEYTELLRQADAIFIEELRNAGWYEKTSQAFAVFLPIKSVGVMGDNRSYEYVVALRAVQTEDFMTAHWAELPYTLLSRISNRIINEIRGINRVVYDISGKPPATIEWE

SEQ ID NO: 49836 - protein, 680 aa, Mycobacterium sp. MCS
MDFYSAYRHGFARIAACTHHTSIADPKGNAESVLRMARDCHDDNAALAVFPELTLTGYSIEDIVMQDGLLEAVEAALLQVVTASAELLPVLVVGAPLRYRHRVYNTAVVIHRGQVLGVVPKSYIPNYREFYENRQIAAGDEERGEIRVGGQEVPFGPDLLFEATDVPGFVLHVEICEDMWVPVPPSAEAALAGATVLANLSGSPITIGRSEDRCLLARSASSRCLAAYVYAAAGEGESTTDLAWDGQTMIWENGSCLAQSERFPKGERRSIADVDLQLLRNERLRMGTFDDNRRHHLIDEDSFRRIEFTLDPPTGDIGLYREVERFPFVPADPARLEQDCYEAYNIQVAGLEQRLRALHYPKIVLGLSGGLDSTHALIVAARAMDREERPRSDILAFTLPGFATGEHTRNNATRLAEALGVTFETIDITSTAKLMLTEMDHPFSRGEKVYDVTFENVQAGLRTDYLFRLANQRGGIVLGTGDLSELALGWSTYGVGDQMSHYNVNGGVPKTLIQHLIRWVILSKQFDDTVNEVLQSVLDTEITPELVPSGEDEEIQSSEAKVGPYVLQDFSLFQVLRYGFRPSKVAFLAWHAWRDADSGNWPTGFPDSKRPSYTLDEIRHWLQVFAQRFYSFSQFKRSALPNGPKVSAGGSLSPRGDWRAPSDMSARVWLDEIENAIPKG

SEQ ID NO: 49837 - protein, 258 aa, Daucus carota
MASDDSVPQHSVEKTTEYESSDRGLFDFMKKEEKDETKVIATEFEEKVQVSEPEPKYEDCKVVEEEEEKAAKPSLLEKLHRSGSSSSSSSSDEEVEEGGEKKKKKEKKGLKEKIEEKIHHKEEDTSVPVEVVTEPEKKKGFMEKIKEKLPGGGKKVEEETVAPPPPPAAAPVDCAVEGDPAKKGILEKIKEKIPGYHPKTSTEEEKKDNDCASAKLIIRCLDRMFDYYYYASFSCGVGLILCFDPLLWGPLISFGTSG

SEQ ID NO: 49838 - protein, 98 aa, Brassica napus
MGKKGNGGWFSTVKKKVFKSSPKDSKRENNISNSDANRWQQQNDTQEVVSFEKFPEESSPEISHDVESIASTPATAIGERKHAMAMATADAAKAAVAA

SEQ ID NO: 49839 - protein, 496 aa, Pseudomonas fluorescens Pf-5
MTKSRSDWEQHFQSLSLEGRAFIDGQYCAAASGATFECLSPVDGRFLANVASTDQADADRAVAVARQAFNSGVWSGKAPAERKRILTRFAELILEHQEELALLETLDMGKPIGDSMAIDIPATANAIRWNAEAIDKLYDEVAATPHDQLGLVTREPAGVVAAIVPWNFPLIMASWKFAPALAAGNSFILKPSEKSPLTAIRIAQLALDAGIPKGVFNVLPGYGHTVGKALALHMDVDVLAFTGSTAVGKQLLVYSGESNMKRVWLEAGGKSPNVVFADAPDLRAAAEAAAAAIAFNQGEVCTAGSRLLVQRSIREQFIPLLVEALKGWKPGHALDPETRVGAVVDQRQLENVLRYIEIGKEQGGQLLAGGVRTLESTGGLYVEPTIFDGVTNAMTIAREEIFGPVLSVISFDTEEEALQIANDSIFGLAAGVWTANLSRAHRFARGLRAGSVWVNQYDGGDMTAPFGGFKQSGNGRDKSLHAFDKYTELKATWIKL

SEQ ID NO: 49840 - protein, 437 aa, Brassica napus
  misc_feature (164)..(164): Xaa can be any naturally occurring amino acid
IKNKQVKRRVGKYEVGRTIGEGAFAKVKFARNSETGEPVALKILDKEKVLKHKMSEQIRREIATMKLIKHPNVVQLYEVMASKTKIFIILEYVTGGELFDKIVNDGRMKEDEARRYFQQLVHAVDYCHSRGVYHRDLKPENLLLDAYGNLKISDFGLSALSTHXPGLLHTSCGTPNYVAPEVLNDGGYDGATADMWSCGVILYVLLAGYLPFDDSNLMNLYKKISSGEFNCPPWLSLGAMKLITRILDPNPMTRVTPQEVFEDEWFKKDYKPPVFEEKDDSNMDDVDAVFKDSEEHHVTEKKEEQPAAINAFEIISMSRGLNLENLFDPEQEFKRETRITLRGGANEIIDKIEEAAKPLGFDVQKKNYKMRLENVKAGRKGNLNVATEIFQVAPSLHMVQVSKSKGDTLEFHKFYKKLSNSLENVVWTNNEVKKAGK

SEQ ID NO: 49841 - protein, 719 aa, Exiguobacterium sibiricum 255-15
MINNELETQQVRLYSVEFVTFQTILMETETPFGQGEFSLVCDGEPMDYSIENREDMDGTIKLTLLLDRAVELERCYEIILPDQERVRVLPNRIVQTAGFDRKYSYEGPLGAVYETDMISLYVWSPLAERLECIRYDQDGVERDSRDFERQERGAYRLVVPRSWENSLYRYRVTTYQGTEEVVDPYAKAVSVNGQFAVLLDVEQEINRQFPHRQKRPLLIKPTDAILYEAHIRDFTIDPSSGSHYPGQYLGMTETGTVSPEGRSTGIDYLLDLGVTHLQLLPVHLFTTTEEVSRLPYNWGYDPVQWFSLTGCYASDPIDPKVRILEYVGMIERLHAAGIRVTFDVVMNHVYIRERSALEYLVPGYYFRYEMDGTLANGTGVGNDTASERFMMRRMIVDCLTYFADIFHVDAFRFDLMGIHDVETMNHVRSALDHIDPTILVYGEGWDLATPLPQRQKAISSVASQMPRIGHFNDVFRDALKGSTFNETDCGFVSGNGWWEGEVHNGMAGSITLNGQTTGRFPEPTYSINYVEAHDNHTLYDKLTLARPDLDETTRLQMSRLAQTIIFLSAGIPFLHAGQEFGRTKQGVENSYNAPDAINRVDWTLRDRQAQMVEYLKNILQIRRMHGGFRLHRANQVQELMHFLPMQPGVIAYEVGAVHSYDAWQRTLVVHNVTSEKIDIVLDHPRWNVHVYGNEASITPIEKGVSQITVLPLSTTIATC

SEQ ID NO: 49842 - protein, 305 aa, Vibrio fischeri ES114
MNKLVVLGSVNADHVLQVASFPRPGETLHGHSYSVIPGGKGANQAVAAARLGADIAFIASVGDDSFGHQMIEAFQFDGINTEAVMIEENTPTGIAMIQVAATGENSICISAEANARLTADRIAPHHGLIEAADTLLMQLETPIETIEKAAQIAKAAGTKVVLNPAPAHQLSDDLLQLVDIITPNETEAELLTGIQVTDMASAQQAADALHAKGIETVMITLGSKGVWISQNGSGRQVEGFKVQATDTTGAGDTFNGAFLTGLQSGRKLDDAIKFAHAAAAISVTRMGAQTSIPSITEVERFLLEH

SEQ ID NO: 49843 - protein, 720 aa, Shewanella sp. MR-4
MSSLESSSESIAVNAQGQTSRRAARAQAQAFIDTLKPLQHPNSQKLYLQGSREDLRVGMRQILQTDTRIGGTATAPIVEKNPPIPVYDCAGPYSDPAAQINVRQGLAKLRLPWIIERQDTEVLDCATSDFTQQRLKDDGLDHLRFEAGSSAIVRPRRALPGKRVSQLHYARQGIITPEMEYVAIRENMALAEVQDEILNRRGQGESFGAVIGKPITPEFVRDEIARGRAIIPLNINHPEAEPMIIGRNFLVKVNANIGNSAVTSSIEEEVEKLVWSTRWGADTVMDLSTGRYIHETREWIIRNSPVPIGTVPIYQALEKVNGVAEHLTWEVFRDTLIEQAEQGVDYFTIHAGVLLRYVPMTAKRVTGIVSRGGSIMAKWCLSHHQENFLYTHFREICELCVAYDVSLSLGDGMRPGSIADANDEAQFAELETLGELVKIAWEYDVQTIIEGPGHIPMQLIKENMDKQLIHCAEAPFYTLGPQITDIAPGYDHFTSGIGAAMIAWYGCAMLCYVTPKEHLGLPNKQDVKQGLIAYKIAAHAADIAKGHPGAQIRDNALSKARFEFRWEDQYNLGLDPDTARAYHDESLPQESAKVAHFCSMCGPKFCSMKITQDVRDYAASLAAGTLSVASSSQNVESAEALASINPAQQGQSNTEALQQIRVKTQDELAAAMAQKSAEFAASGAKLYLPLGDANTANTANESAKQQDGTELRPTAQVAEV

SEQ ID NO: 49844 - protein, 331 aa, Burkholderia sp. 383
MSSSTASPTLSAAHLLAPITSDMEQVNRVIRQSLASDVLLINQIAEYIIGAGGKRLRPALLLLVAGALGETSHQRHVLAAVVEFIHTATLLHDDVVDESELRRGRQTANALFGNAASVLVGDYLYSRSFEMMVGVGKMRVMEILSEATTIISEGEVLQLLNMHDADVDETRYMQVIRYKTAKLFEASARLGAVLAGADAPTEAAAAEYGRRIGTAFQIMDDWLDYAGTVEAMGKNAGDDLREGKPTLPLIYLIERGTPEQSALAREAIEQGGTDRFDTIFEAITRSGALDHTLECARQEAQAAAAAIAAFPDSVYKESLLALCSYSTSRQS

SEQ ID NO: 49845 - protein, 1050 aa, Oryza sativa
MLVPHQELPAAAAVVADAVQPMEVVAQTEPANAAESQPPEDPQTSRFTWTIENFTRINGKKHYSEPFVVGGFKWRVLIFPKGNNVDHFSMYLDVADSVNLPYGWNRYAQFSLAVVNQIHPKYTIRKDTQHQFNARESDWGFTSFMPLSDLYDPSRGYLVNDTVVVEAEVAVRRMVDYWTYDSKKETGYVGLKNQGATCYMNSLLQTLYHIPYFRKAVYHMPTTENDMPSGSIPLALQSLFYKLQYSDNSVATKELTKSFGWDTYDSFMQHDVQELNRVLCEKLEDKMKETVVEGTIEQLFEGHHINYIECINVDYKSNRKESFYDLQLDVKGCSDVYASFDKYVEVERLEGDNKYHAEQYGLQDAKKGVLFLDFPPVLQLQLKRFEYDYMRDTMVKINDRYEFPLQLDLDRDDGKYLAPDADRSIRNLYTLHRYKFDDERVTKEDTKKALEEQYGGEEELPQINPGFNNTPFKFTKYSNAYMLVYIRESDKDKIMCNVDEKDIAEHLRIRLKKEQEEKEHKKKEKAEAHLYTIIKVARDEDLKEQIGKNIYFDLVDHEKVRSFRIQKQLPFTSFKEEVAKECGIPVQFQRFWLWAKRQNHTYRPNRPLGPHEESQSVGQLREVSNKAHNAELKLFLEVETGVDLRPIRPPEKSKEDILLFFKLYNPEKEELCFVGRLFVKATGKPSEILTKLNEMAGFAPNEEIELYEEIKFEPNVMCEHIDKKLTFRSSQLEDGDIICFQKSPVSDGETQVRYPDVPSFLEYVHNRQVVHFRSLEKPKEDDFCLELSKLHTYDDVVERVARQLGLDDPSKIRLTSHNCYSQQPKPQPIRYRGVEHLLDMLVHYNQTSDILYYEVLDIPLPELQCLKTLKVAFHHATKDEVVIHSIRLPKNSTISDVITDLKTKVELSNPDAELRLLEVFYHKIYKIFPPHEKIENINDQYWTLRAEEIPEEEKNLGPHDRLIHVYHFMKDPNQNQQIQNFGDPFLLVIREGETAAEILERIQKKLRVPDEEFSKRRDVYGAWEQYLGLEHTDTTPKRSYTANQCCMCLD

SEQ ID NO: 49846 - protein, 217 aa, Magnaporthe grisea 70-15
MASRGAPRGRGGGGFGRGGGRGGFQQRDFGPPTSVVEMGKFVHACEGEMFCESINPKIPHFSAPIYLENKTAVGKVDEILGPLNQVFFTIKPSEGIQAGAFKAGDRFYIAQEKLLPLERFLPKPKPPPGSVPKVKKPAGGRGGRGGPGGRGRGAPRGGGGFGGRGGGGGFSRGGGGGFSRGGGRGGGGFTRGAGSGGFSRGGGRGRGGGGFSRGGRV

SEQ ID NO: 49847 - protein, 331 aa, Oryza sativa (japonica cultivar-group)
MAFADPHLQIPDRYISAPPPPASATARASSLPVVDMARLLDPEHREAEVALLGSACRSWGFFQLINHGVDEAVIQKMKDNTVQFFELPLEDKNTVAVRPGGIEGFGHHFRSSAGKLDWAENLIVETQPFQQRNLEFWPSKPPTFRDSIDKYAMEMWNLTTRLLRFMASDLGVEQETLLAAFRGKRQTFGLHRYPPCRHPEKVIGISPHSDGFGLTLLLQVNDTLGLQVSKDGRWHPVRPLPGAFIVNVGEILEVLTNGRYKSVFHRVAVDAERGRVTVVVFQDACINGLVKPLPELGETPRYHAIGKSEYFKGHTAEVLGQGERFIDTLKK

SEQ ID NO: 49848 - protein, 122 aa, Triticum aestivum
SKILSKVIEYCKKHVQASPKPADSGAVTDANSSTSTAAAAPVEDLKSFDAEFVKVDRATLFDLILAANYLNIKGLLDLTCQTVADMIKDKTPEEIRKIFNIKNDFTPEEEAEVRKENQWAFE

SEQ ID NO: 49849 - protein, 553 aa, uncultured bacterium
MLRLKERPAWKALEAHAFEMREARIADLFTNDPARAQEFSVAACGLLLDYSKNPLSRQTRRLLMTLAEEASLPAQIVAMFEGKRINVTEKRAVLHTALRNRSGRPLLLDGKDVMPEVRAVLSRVRDFSERVRGGIARGYSGLPFTDVVNIGIGGSDLGPLMVCSALRPYGSHDLLVHFVSNIDGAHLAATLSGLNPETTLFVVSSKTFTTQETLTNARSAREWLLTLLRPSGATEVAVQQHFAAVSSNLEATSKFGIAPDRVFGFWDWVGGRYSLWSAIGLPIALGIGFNRFDELLAGAYDMDEHFRTAPLESSMPVIAALTGIWNINFLGHRSQAVLPYAQDLAHFPAFLQQLDMESNGKRVDRSGAEVEYATGPVIWGAPGTNGQHAFFQHLHQGTQVTPADFIVAANGADRLPEHQEILLANCIAQSEALLRGKNADEVRAELKARGIVGDEAERLIPHRTFPGNRPSNTIVMRHLDPRSLGALIALYEHKVFVQGAIWSINSFDQWGVELGKQLASGVLEDLKAGKARSGHDASTARLIEYVLGNKEDK

SEQ ID NO: 49850 - protein, 175 aa, Oryza sativa
  misc_feature (71)..(71): Xaa can be any naturally occurring amino acid
VDPRAAGIDTRIVSTVGSATMPLQDIHNEENALVNDMEQRSKEEPLSTESLKSSKRRSSFSTIFWILCLGXRMKTEYPENGSKNSPAVPSYMAATQSAKAKLRGQNSPRLSSDSAEKNGFTRRHSLPSSNGKLNSHSPRTQRPTHAGGKEGVKADKSMLSSRDASERPAKAEWKR

SEQ ID NO: 49851 - protein, 106 aa, Brassica napus
RGDMSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGG

SEQ ID NO: 49852 - protein, 149 aa, Mannheimia succiniciproducens MBEL55E
MWIYSFGLRDKLLFKLISDKKCGRFFPKIRKHKMAEETIFSKIIRKEIPADIIYQDDLVTAFRDIAPQAKTHILIIPNKLIPTVNDVTAEDEAVLGRLFITAAKIAKLEGIAEDGYRLIVNCNKHGGQEVFHIHMHLLGGEKLGPLNAK

SEQ ID NO: 49853 - protein, 294 aa, Clostridium perfringens SM101
MKEIFDVLPDKINSCLKDKNNLNKLQEIRVKIGKPLNIVLDNTEIIFNYVIRKEDVKAIIQKISNYSLYAFEEDIRQGYITIQGGHRVGLAGQCVIEDNSIKTIRNITSLNIRVCREIVGCSNSLMNSLVENNRVNNTLIISPPKCGKTTLLRDITRNISNGISQIGFKGKRTVVIDERSEIAACYNGIPQMNVGMRTDVYDNCIKSEGMMMAVRGLSPEVIICDEIGTYKDMEGLMMAYNSGVSIIATLHGRNVEELYRRPVFREIVENNIINRVVVLSGKKGIGTIEGIYNV

SEQ ID NO: 49854 - protein, 505 aa, Triticum aestivum
  misc_feature (349)..(349): Xaa can be any naturally occurring amino acid
MPPPPKNRSHAPAKAGQSRPPPRQPGRRMASRDAGERAAFFARREAATVLRRVLRGDASKRSGGSIKSLVFSPSVRNKRATFALVCQTLKYLPILKEVLASSGVFSSKWKKQEELVYVTAYDILFGQEIAVSGSVEEYIMLHKDTFRTALQKICVKRKVSNVEDLLSEKTTVKPKPRFVRVNTLKTTTGSVIEVLSKMHKVDKDDMVPDMLVLPPGTDMHKHPLVTDGKVFLQGKASCMVAAAVSPKPGWKVIDACAAPGNKTVHLAALMNGEGSIIACELNKERAKTLQHTVRRSGANNIETVIGDFLNIDSNDPSYAEVRAILLDPSCSGSGISTERLDHLLPSHSXDQDDAGSSARIRKLSAFQRKALSHALSFPSVERLVYSTCSIHQAENEDVVSSVLPLASSLGFELATPFPQWRRRGLPVFYGAEHLLRTDPEDDLEGFFIALFVRKAAAADALEPSEDGGALGRKRKRACTTRSGGLRAFSSLRLSRMDVLCSIWGI

SEQ ID NO: 49855 - protein, 150 aa, Arabidopsis thaliana
MKNILKTQVHVVVIYLLIKIAFSQVKTDFDVNWSTSKMVRITNRLGDGLTLNLHCKSADDDLGLKILAPNGSWSFKFRTSIVGTTLFYCHFTWPGQSKRFDIYDDDRDGVRSHISCINCIWDISIQGPCMFSESDHAFNICYDWNGNLRT

SEQ ID NO: 49856 - protein, 847 aa, Oryza sativa (indica cultivar-group)
MPSSSAAALLLQLQLLLVISLSTAQPGFISLDCGGDGDFTDDIGIQWTSDDKFVYGGKTANLSVQNDLPKQLKTVRYFPVDDRKYCYTMNVSERTRYLVRATFLYGNFENSNIFPKFDLSLGAAPWTTVVVYDDTTPAVVEAIILASAPTLSVCLSNASTGQAPFISTLELRQLNGSLYETDYENQFFLKLSARINFGAESNASVRYPDDPFDRIWRSDLVRRANYLVDVAPGMERISTKRHISIRTDGEEPPEEVMRTAVVGQNGSLTYRLNLDETPGNSWAYAYFAEIEDLAPNETRKFKLAIPEMPEYSTPTVNVEENAPGKYRAYEAANNMAILVSRYPQESWAQEGGDPCLPASWSWIQCSTEKAPRVLSICSSQCLEFWKDKNYFLFRRTLSGKNITGSIPVELTKLPGLVEFHLEDNQLTGALPSSLGDLPNLKQFFSGNSNLHVAHNTITHPVIIIVCVVIGAFVLLVAAVGCYLFAYNRKKKPSDAPAKQLSSPLSEVTTESVHRFALSEIEDATDRFGRRIGYGGFGIVYYGKLADGREIAVKLLINDSYQGTREFLNEVTLLSKIHHRNLVSFLGYSQQDGKNILVYEFMHEGTLKEHIRGGPAYVKVTSWVKRLEIAEDAAKGIEYLHTGCSPTIIHRDLKSSNILLDKNMRAKVADFGISKPVVSGSHVSTMVRGTFGYLDPEYYGSQQLTEKSDIYSFGVILLELISGQEPISDDHFGPHCRSIVAWATSHIESGNIHAIIDQSLDTGYDLQSVWKVAEVAIMCLKPTGRQRPSMSEVLKEIQDAIALERGGRELVPSIQHPVSKCSPSVNMDSVVLEQNSRFDELLELPGLR

SEQ ID NO: 49857 - protein, 175 aa, Oryza sativa (indica cultivar-group)
MAPSVMASSATTVAPFQGLKSTAGMPVARRSGNSSFGNVSNGGRIRCMQVWPIEGIKKFETLSYLPPLTVEDLLKQIEYLLRSKWVPCLEFSKVGFVYRENHKSPGYYDGRYWTMWKLPMFGCTDATQVLKELEEAKKAYPDAFVRIIGFDNVRQVQLISFIAYKPPGCEESGGN

SEQ ID NO: 49858 - protein, 149 aa, Mycobacterium sp. MCS
MTVPETGAGTLSAVTERTLVLIKPDGVQRRLVGEILGRIERKGLTLAALELKTVDDELARRHYAEHEGKPFFGSLLEFITSGPVVAAIVEGPRAIAAFRQIAGGTDPVEKATPGTIRADLALVTQDNLVHGSDSPESAAREIDLWFPGR

SEQ ID NO: 49859 - protein, 534 aa, Oryza sativa
MADAATTPLLTSHEAKPAKALSIDDAIETYIGATGARQLLTAMLLAFAWAFEAQQVFMSVFTDAEPTWHCTGVAAGDPGSFCSLAAASASASACALPPGTWEWDRPAETSVVSEWALKCGGGGPALVSLPASSFFAGNLAGGFMLTTLADTLLGRRKMLVLSLVTMSVAGVLTVFSPNVWVYAALRFVCGFCRSTAGTSAMVLSTELVGKWWRNTVSVAAFVFFSVGFMSLPALAYTLREASWRNMYVWTSLPSLCYAVLLYFLVQESPRWLLVRGRKQEAIAALRQIASLNGGEGITTSSFTKLETCAGEVGDGVAGGEGMFSTLRSICERRWALRRLAAITTATFGVGVVYYGMPLSVGSLSSDLYLSVAYNAAAELPSSVLSWLLMGRFNRRSSLVALTAASGLCSLACVVIPDPEAGAGGSHLRLAAELASFFASCAAYDVLLMYSIELFPTSVRNSAVGLVRQAGVLGGVVAPMLVALGRERSYWSFGVFGLTVGCLGLFVTFLPETKGRRLSDTMEDEEEAAAVLSGG

SEQ ID NO: 49860 - protein, 582 aa, Glycine max
MCGILAVLGCSDDSRAKRVRVLELSRRLKHRGPDWSGLHQHGDCFLAHQRLAIVDPASGDQPLFNEDKSVIVTVNGEIYNHEELRKQLPNHKFRTGCDCDVIAHLYEEHGEDFVDMLDGIFSFVLLDTRDNSFIVARDAIGVTSLYIGWGLDGSVWISSEMKGLNDDCEHFECFPPGHLYSSKERGFRRWYNPPWFSEATPSTPYDPLVLRHTFEQAVIKRLMTDVPFGVLLSGGLDSSLVASVTSRYLANTKAAEQWGSKLHSFCVGLEGSPDLKAAKEVADYLGTVHHEFTFTVQDGIDAIEDVIYHVETYDVTTIRASTPMFLMSRKIKSLGVKWVISGEGSDEIFGGYLYFHKAPNKEEFHRETCRKIKALHQYDCLRANKSTFAWGLEARVPFLDKAFINTAMSIDPESKMIKRDEGRIEKWILRRAFDDEEHPYLPKHILYRQKEQFSDGVGYSWIDGLKAHAAKHVTDKMMLNAGNIYPHNTPTTKEAYYYRMIFERFFPQNSARLTVPGGASVACSTAKAVEWDAAWSNNLDPSGRAALGVHISAYENQNNNKGVEIEKIIPMDAAPLGVAIQG

SEQ ID NO: 49861 - protein, 338 aa, Gloeobacter violaceus PCC 7421
MTIKVAINGFGRIGRNFLRCWLGRKQSDFEVVAINDTSDPNTNAHLLKYDSMLGQFSGEVSADENSLTANGHTIKCFSDRNPLNLPWKDWGVDLVIESTGVFTSRDGASKHLAAGAKKVLITAPGKNDDGTFVMGVNDHNYDPEKHTIISNASCTTNCLAPVAKVLHENFKIVKGTMTTIHSYTGDQRLLDASHRDWRRARAAALSIVPTSTGAAKAIGLVLPELKGKLDGLAFRVPTPNVSVVDLVVEVEKPTLVEQVNHVLKEASENELKGILAFSEIPLVSIDYRITDVSSIVDAQLTMVLKDNLVKVISWYDNEWGYSQRVVDLAELVARKWAA

SEQ ID NO: 49862 - protein, 525 aa, Shewanella oneidensis MR-1
MSDIHEHKILILDFGSQYTQLIARRIREIGVYCELWAWDVTEAQIREFAPNGIILAGGPESVTADNSPRAPEYVFNAGVPVLGICYGMQTMSEQLGGKVIQGVGEGEFGYAQIEMLAESALFKGIEDAVSSDGKSLLDVWMSHGDKVSAIPAGFVAVAKTDTCPFAAMSCEEKRFYGVQFHPEVTHTRQGMRMLSHFALDICGCAANWKPSSIIEDAIERLKKQVGDDEVILGLSGGVDSSVVAMLLHRAIGKKLTCVFVDNGLLRLNEAKQVMEMFGDHFGLNIVHVDAENRFLDALKGEADPEAKRKIIGRVFVEIFDEEAKKCVNAKWLAQGTIYPDVIESAGSATGKAHVIKSHHNVGGLPDDMELGLVEPLRELFKDEVRKIGLELGLPYNMLYRHPFPGPGLGVRVLGEVKKEYCDLLRRADAIFIEELHKADLYNKVSQAFTVFLPVRSVGVMGDGRKYDWVVSLRAVETIDFMTAHWAHLPYDFLGRVSNRIINEVDGISRVVYDISGKPPATIEWE

SEQ ID NO: 49863 - protein, 184 aa, Zea mays
MKGLLKGLRYISQIFDAKEPEMQIGKPTDVKHVAHIGWDNASVTAPSWMNEFKASPGVARGGDPEPSQPGGSGGCGDEQTGGEDAGGKAERPRRTRGNKVSGGNELAKRRDCAAEGSRRDRRVAKAADVAEGAEGDAAAAPRQRRRKPRAASGGRSKSSSGGAAASDAEAARPEAEAEDDRDGC

SEQ ID NO: 49864 - protein, 506 aa, Yersinia pseudotuberculosis
MRYAHPGTPEALVSFKAIYGNYIGGEFIEPLGGQYFMNTSPVNGSDIAQFPRSDARDIDAALDAAHQAADAWGKTSVQHRSNLLLQMADRIEANLEYLAVAESWDNGKPIRETLNADLPLAVDHFRYFAGCLRAQEGGVAEIDEKTVAYHFHEPLGVVGQIIPWNFPLLMAAWKLAPALAAGNCVVLKPAEQTPLGITLLLELVGDIFPAGVINVVQGYGREAGEALARSKRIAKIAFTGSTPVGRHIMACAAENIIPCTVELGGKSPNIYFADVMEAEPEFIDKAVEGLVLGFFNQGEVCTCPSRALIHESIYAPFMARVMTKVANIRRGDPLDTETMIGAQASRQQFDKILSYIDIARKEGGEILTGGARATITPALDSGFYIQPTLIKGDNLMRCFQEEIFGPVIGVTTFKDEAEALAIANQTQFGLGAGIWTRDAHLAYRMGRGIKAGRVWTNCYHVYPAHAAFGGYKQSGVGRETHKMALNQYQQTKNLLVSYDTAPLGLF

SEQ ID NO: 49865 - protein, 300 aa, Rhodococcus sp. RHA1
MSTPDTTPTTGTARVKRGMAEMLKGGVIMDVVTPDQAKIAEDAGAVAVMALERVPADIRAQGGVSRMSDPDMIDGIISAVSIPVMAKARIGHFVEAQILQSLGVDYVDESEVLTPADYANHIDKWQFTVPFVCGATNLGEALRRITEGAAMIRSKGEAGTGDVSNATTHMRTIGGEIRRLTSLSEDELYVAAKELQAPYDLVVEVAKAGKLPVTMFTAGGIATPADAAMMMQLGAEGVFVGSGIFKSGNPAERAAAIVKATTFFDDPDVLAKVSRGLGEAMVGINVDDIPVPHRLAERGW

SEQ ID NO: 49866 - protein, 125 aa, Vibrio fischeri ES114
MKYIQTKNSLKAAGHYSQAIVHNGLIYVSGQLPINPNTGEKINGDISQQTRRVLDNLNTILEEVGSDLQQVLKLVIYISDIDMWDTVNDICKEYFIDHKPVRTIVPTRELHFGLKIEVDCIAICE

SEQ ID NO: 49867 - protein, 397 aa, Bacteroides thetaiotaomicron VPI-5482
MNQLSDRLNSLSPSATLAMSQKSNELKAQGIDVINLSVGEPDFNTPDHIKEAAKKAIDDNFSRYSPVPGYPALRNAIVEKLKKENGLEYTAAQISCANGAKQSVCNAILVLVNPGDEVIVPAPYWVSYPEMVKMAEGTPVIVSAGIEQDFKITPKQLEAAITPKTKALILCSPSNPTGSVYSKEELAGLAAVLAKYPQVVVIADEIYEHINYIGAHQSIAQFPEMKERTVIVNGVSKAYAMTGWRIGFIAGPEWIVKACNKLQGQYTSGPCSVSQKAAEAAYVGTQEPVKEMQKAFERRRDLIVKLAKEVPGFEVNVPQGAFYLFPKCSYFFGKSNGERKIENSDDLAMYLLEDAHVACVGGTSFGAPECIRMSYATSDENIVEAIRRIKEALAKLK

SEQ ID NO: 49868 - protein, 397 aa, Arabidopsis thaliana
MPATEYQRSFGRSFLNLRRDTAVNSVESTTVTPELTQMEAELVSFQRKVAERFIDLNASSCEDLLSLEWVGKLLDSFLSCQEEFRSIVINHRSMITKPPMDRLVSDYFERSVKALDVCNAIRDGVEQIRQWQKLIEIVICAFNNNAGGSSGKRPLGEGQFRRARKTLIELAIGMLDEKDSSSSSVSSQHRNRSFGRNKEQLHHRTIGHFRSLSWSVSRSWSASKQLQAIGNNLATPRASDITATNGLIVPVYTMTSVLLFVMWALVAAIPCQDRGLQVHFNVPRNYQWGGSLMSLHDRIIEESKKRERKNTCGLLKEIHQFEKTSRLMNELVDSVQFPLSEEKEMEVRERVEELGKLQEALKNGLDPFERKVREVFHRIVRSRTEGLDTVGKHHGSE

SEQ ID NO: 49869 - protein, 142 aa, Solanum nigrum
MVPQRPAKVALSQAEKPAPIIIPALSEDDEEIIQSVVQGKTPSYSLESKLGDCLRAASIRKEALQRITGKSLEGLPLEGFDYESILGQCCEMPVGYVQIPVGIAGPLLLDGREYSVPMATTEGCLVASTNRGCKAIFVSGGA

SEQ ID NO: 49870 - protein, 269 aa, Oryza sativa (japonica cultivar-group)
MAICKVFYSHCIQHGIALKEQNFTLSYDTNIPRQAGLSGSSAIICAALSCLLDFYNVRHLIKVEIRPNIILDAEKELGIVAGLQDRVAQVYGGLVYMDFGKEHMDTLGHGVYTPLDINLLPPLHLIYADNPSDSGKVHSTVRQRWLDGEEFIISSMEEVARLALDGRKALLDKNYRELARLMNRNFDLRRQMFGDDVIGTVNIKMVEAARSVGAAAKFTGSGGAVVALCPDGEAQVLLLEKACRDAGFLVQRIQVAPSPLPLTEGNPPF

SEQ ID NO: 49871 - protein, 435 aa, Bacteroides thetaiotaomicron VPI-5482
MKQDMIVILDLGSHENTVLARAIRALGVYSEIYPHDITVEELKALPNVKGIIINGGLNNVIDGVAIDVNPSIYTMGIPVMAAGHDKATCAVKLPAFTDDIEAIKAAIKSFVFDTCQAEANWNMANFVNDQIELIRRQVGDKKVLLALSGGVDSSVVAALLLKAIGENLVCVHVNHGLMRKGESEDVVEVFSNQLKANLVYVDVTDRFLDKLAGVEDPEQKRKIIGGEFIRVFEEEARKLDGIDFLGQGTIYPDIVESGTKTAKMVKSHHNVGGLPEDLKFQLVEPLRQLFKDEVRACGLELGLPYEMVYRQPFPGPGLGVRCLGAITRDRLEAVRESDAILREEFQIAGLDKKVWQYFTVVPDFKSVGVRDNARSFDWPVIIRAVNTVDAMTATIEPVDWPILMKITDRILKEVKNVNRVCYDMSPKPNATIEWE

SEQ ID NO: 49872 - protein, 532 aa, Oryza sativa (japonica cultivar-group)
MADEATTTPLLASYKAKPAKAPSIDDAIETYIGATGAGQLFKAILLAFAWAFDAQQVFISVFTDAEPRWHCTAGADPSCSPGAASPCALPPGAWAWDRPAETSVVSEWALKCAGPALVSLPASSFFAGCLAGGFLLTTLADSLLGRRKMLLVSLASMSVAGVLTAFSPNVWAYAALRFVCGFGRSMVGTCALVLSTELVGKRWRDTVSVAGFVCFTVGFLSLPALAYTFREASWRSMYLWTSLPSLGYAILLYFLVQESPRWLLVRGRKHDAIETVRQIAALNGGGGITCSFSMLHACATEREDDSAGGAGGGGGGVFATLRSMWERRWALRRLAAIMTASFGVGMVYYGMPLNVGNLGSNLYLSVTYNALAEFPSSVLSWLLMGRINRRSSVVALTAAAGVCSLACVAIPEGTGGRMAAEVLSFFATCTAFNIILMYSIELFPTSVRNSAVGMVRQALVLGGVAAPMLVALGRERSFWSFGVFGLAVGCLGLFAVCLPETRGRSMSDTMEEEEHKEAAAAIGDMDSNADLV

SEQ ID NO: 49873 - protein, 181 aa, Zea mays
MASSMLSSATVVSSPAQAAMVAPFTGLKSSAAFPVTRKTDTDITSMASNGGRVNCMKVWPPVGKKKFETLSYLPDLTDVELSKEVDYLLRNKWIPCVEFELEHGFVYREHGNTPGYYDGRYWTMWKLPLFGCTDSAQVLKEVQECKKEYPNAFIRIIGFDNNRQVQCISFIAYKPPSFTGA

SEQ ID NO: 49874 - protein, 265 aa, Clostridium perfringens SM101
MNELGKIAVITGATSGIGKEYAFQLAKKGYDLILVGRRVEKIKAVAEEIENNFKVKTHVEILDLTDDNKLDDFIKRLEKKDNIEFLVNNAGYGADDSFTRNEYSKQYDMAKVHMLVTMKLCHSLSKKMKENNKGYIINVSSMAGFNVFPSSAMYCSTKAFLISFTQCLAMELLENNIKVQCLCPGFTRTDFHSKLNMEESKLQNKGFVRWMSTREVVEISLKNINKKLNVIVIPGFCNKFLYFVSKFTPRWLYYKVAIKGWELMD

SEQ ID NO: 49875 - protein, 294 aa, Idiomarina baltica OS145
MSDDNPHSASGSSQKSWAAKLLQVFAGEPKSREELVDLIQDAEERDLIDNDTKEMIEGVLDVAELKVRDIMIPRSQMVTIDIHQSVEEFLPIVIESQHSRYPVVTDNKDHVEGILLAKDLLSYGFNFTEDSFSLSEVMRPAVIVPESKRVDVLLKEFRSNRYHMAIVVDEYGGVSGLVTIEDILEEIVGEIEDETDHNDDDKADIKRLSASRYSVKALTTIEDFNDHFNSQFADDEIDTVGGLVAHGFGHLPQPGEQITLSGFTFKVTSADKRRIQQLQVTPPTSDTYTEESQG

SEQ ID NO: 49876 - protein, 419 aa, Mycobacterium sp. MCS
MSPAQQREFDIVVYGATGFVGKLTAEYLADHGAGARIALAGRSQDKLLEVRESLGPKATDWELITADASQPSTLNAMAARARVVITTVGPYTKYGLPLVAACAAAGTDYADLTGETMFVRDSIDHYHKQAVDTGARIVHACGFDSIPSDLTVYALHRKVAADGEGELGDTSMVVRTLAGGASGGTIASILEVLNTASTDPEARREMTDPYTLSPDRSAEPELGAQPDMRWRRGAEIAPELSGYWTAAFAMAGPNTRIVRRSNALLGYAYGRRLEYSEVMSTGRTPVAPALAALTTAGSAAVMGLGSRYFNRLPRKLVDRVLPAPGTGPSEQTRERGHYTVETYTTTTTGARYLARMSQRGDPGYKATSVLLGECGLALALDRDKLSDLRGVLTPAAAMGDALLARFPGAGVSLETSRLA

SEQ ID NO: 49877 - protein, 375 aa, Pinus banksiana
QVIKCKAAVAWGAGEPLKIEEVEVDPPQSMEVRIKVHYTALCHSDLIFWEAKGQTPLFPRIFGHEAAGIIESVGEGVTDLKEGDTVLPVFTGECKECRHCKSEESNMCDLLRVDIETGVMKSDGKSRFSINGKPIYHFAGTSTFSEYTVVHSGCVAKINPKAPLNKVCILSCGVSTGMGAALNVAKPKQGSTVAIFGLGTVGLAAAEGSRMAGASRIIGIDLNSDKFERAKLFGVTESLNPLDYEKSIQQVIAEKTDGGVDYSIECTGNVKAMIQAFESCHIGGGVTVLVGFPPSDAVFATNPLNFLCERTLKGTFFGNYKPLSHLPGLVELYLNKKLELEKFITHEVSFADINKAFDYMIKGESLRCVINVIGN

SEQ ID NO: 49878 - protein, 250 aa, Solanum tuberosum
MVRIAFGSIGDSLSVGSLKAYLAEFIATLLFVFAGVGSAIAYNKLTSDAALDPAGLVAIAVAHAFALFVGVSMAANISGGHLNPAVTLGLAVGGNITTLTGLFYWVAQLLGSTVACLLLKYVTNGLAVPTHGVAAGMNGAEGVVMEIVITFALVYTVYATAADPKKGSLGTIAPIAIGFIVGANILAAGPFSGGSMNPARSFGPAVVAGDFSQNWIYWVGPLIGGGLAGFIYGDVFIGSHTPLPTSEDYA

SEQ ID NO: 49879 - protein, 210 aa, Arabidopsis thaliana
MLTAAGDDELDPVVGPESATEAATPRVLTIISHVMEKLVARNEWLAKQTKGFGKSLEAFHGVRAPSISIAKYLERIYKYTKCSPACFVVGYVYIDRLAHKHPGSLVVSLNVHRLLVTCVMIAAKILDDVHYNNEFYARVGGVSNADLNKMELELLFLLDFRVTVSFRVFESYCFHLEKEMQLNDAVSSLKDIQPMQESLSPASTLSSLYV

SEQ ID NO: 49880 - protein, 375 aa, Pinus banksiana
QVIKCKAAVAWAAGEPLKIEEVEVAPPQAMEVRIKIHYTALCHTDVYFWEAKGQTPLFPRILGHEAAGVVESVGEGVTDLKEGDTVLPVFTGECGECRHCKSEESNMCDLLRINTERGVMISDGKTRFSKDGKPIYHFLGTSTFSEYTVAHAGCVAKINPEAPLDKVCVLSCGASTGMGAALNVAKPKKGSTVAVFGLGAVGLGAAEGARIAGASRIIGIDLISERFEKAKLFGVTEFINPLDHAKPVQEVIAEKTDGGVDYSIECTGNVKAMIQAFESCHDGWGVAVLVGVPHSDAVFQTSPLNFLTERTLKGTFYGNYKPRSDLPGLVEMYLAKKIELEKFITHEVSFADINKAFDYMLKGESLRCIINLIGN

SEQ ID NO: 49881 - protein, 375 aa, Pinus banksiana
QVIKCKAAVAWAAGEPLKIEEVEVAPPQAMEVRIKIHYTALCHTDLYFWEAKGQTPLFPRILGHEAAGVVESVGEGVTDLKEGDTVLPVFTGECGECRHCKSEESNVCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARMAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYMDKKLQLERFITHEVSFADINKAFDYMIKGESLRCVTNVIGN

SEQ ID NO: 49882 - protein, 338 aa, Triticum aestivum
  misc_feature (195)..(195): Xaa can be any naturally occurring amino acid
MAPLGDAVAPAAAAAAPGLVVSFGEMLIDFVPDVAGVSLAESGGFVKAPGGAPANVACAISKLGGSSAFIGKFGDDEFGHMLVEILKQNGVNAEGCLFDQHARTALAFVTLKSNGEREFMFYRNPSADMLLTEAELNLDLIRRARIFHYGSISLITEPCRSAHVAATRAAKSAGILCSYDPNVRLPLWPSAQAAXRDGIMSIWKEADFIKVSDEEVAFLTQGDATDEKNVLSLWFEGLKLLIVTDGEKGCRYFTKDFKGSVPGYSVNTVDTTGAGDAFVGSLLVSVSKDDSIFYNEAKLREVLQFSNACGAICTTKKGAIPALPTTATALELISKGSN

SEQ ID NO: 49883 - protein, 527 aa, Oryza sativa (japonica cultivar-group)
MGVSADGLVLKAACERCGSSSDLHGTGCRHATLCVSCGSAMARSGDCCPVCAAPIASLIREYNVLVDTTGEKQYTIGKFTTGVPPFSDRENAGSRSWSLHPEGQQGRQPTGNIWENCSNRKSCILEDDTGDYQYQGQIQGLQSAASTYYLLMMHGKDVHAVPADSWYNFSKISQYKQLTLEEAEEKMSRRRSTATGYGRWMMKAATNGAAAFSSDVTQLDDANEGETDQVHLKKGNKNGDENKSDKGSGEERAHVPMTKGREEEGSKDRDFDLDDEIEKGDDWEHEEIFTDDDEAVDVDPEEGGDLADPEIPAPPEIKQDDNEKHGGVGLSKSGKELKKLLRRAAGQNESDDDDEDTDEDESPSPVLAPKQQDQLKSEPQEDNHSKPTVLGHPYSTPHVSKSNQKRRQRGDDSKTCATPKKPKIEPDTKKIVVKEETSCSLEPTSEPFASARSDTNVSPITVEEIRVVLRLYAPIAMRDFSKDFMPRFSPRLRSPEDREVFLANLRKISHLQKINGQKYIILLEEYK

SEQ ID NO: 49884 - protein, 363 aa, Exiguobacterium sibiricum 255-15
MMTKLVTAVEDTTKVKTMRALVKEERGFGAVLKEVAVPSPKRGEVLIRVEATSICGTDVHIYEWDAWAASRVNPPYVFGHEFSGEVVELGEGTKRLKLGDRVSAETHIVCHQCKQCLRGQYHICKNTKIIGVDTQGCFAEYVVMPEENLWVNPEDMPAAIASIQEPMGNAVHTVLASDVSAKTVAIVGCGPIGLMAVSVAKAAGAAEVIAIDVNPYRLELAKTMGADVVIDSRHEDVLERVRMMTDGDGIDVVCEMSGHPVAIRQAFEMVTAGGDVNILSLPVKPVEIDLTNHVVFKGVRVQGITGRKMYETWSQVSAFLSSGKVDVKPLITHTLPLERFEEGFELMRQGKCGKVVLQPRGTN

SEQ ID NO: 49885 - protein, 515 aa, Oryza sativa (japonica cultivar-group)
MADAATTPLLTSHEAKPAKALSIDDAIETYIGATGARQLLTAMLLAFAWAFEAQQVFMSVFTDAEPTWHCTGVAAGDPGSFCSLAAASASASACALPPGTWEWDRPAETSVVSEWALKCGGGGPALVSLPASSFFAGNLAGGFLLTTLADTLLGRRKMLVLSLVTMSVAGVLTVFSPNVWVYAALRFLVGKWWRNTVSVAAFVFFSVGFMSLPALAYTLREASWRNMYVWTSLPSLCYAVLLYFLVQESPRWLLVRGRKQEAIAALRQIASLNGGEGITTSSFTKLETCAGEVGDGVAGGEGMFSTLRSICERRWALRRLAAITTATFGVGVVYYGMPLSVGSLSSDLYLSVAYNAAAELPSSVLSWLLMGRFNRRSSLVALTAASGLCSLACVVIPDPEAGAGGSHLRLAAELASFFASCAAYDVLLMYSIELFPTSVRNSAVGLVRQAGVLGGVVAPMLVALGRERSYWSFGVFGLTVGCLGLFVTFLPETKGRRLSDTMEDEEEAAAVLSGG

SEQ ID NO: 49886 - protein, 311 aa, Triticum aestivum
MAMDQCTDDVKYEEEFIVNSRDTKLFTCSWMPHNSEPKALIFICHGIAAECSVSMRDTASRLVRAGYAVYGIDHEGHGRSSGQRCYVPNFSDVVADCSSHFMSVCDKPENRGKKRFLYGISMGGSIALLLHRKEPAYWDGAVLLAPMCKISDDMRPHPVVVSALKMVCAVAPGWRIIPIPDIIDKVCKDPEMRKQVRSNPYIYRGKLPLKTCHELLMVSLDIEKNLHEVSLPFLVLHGGDDIVTDPSVSKLLFEEASSGDKDLKLYPGMWHALMAEFPQDAERVYSDIISWLDQRANCAANVSANTGTASA

SEQ ID NO: 49887 - protein, 267 aa, Oryza sativa (japonica cultivar-group)
MAAAAEPTDGPTLSVVSKWLHALRKKHNKIIQMEEPLADGRKLNKEQGEDLLALIYFGSLFDVKPQTEFIATMLVRPKEWDCCITFDYVRPCRLTRCRSLEPRDDTILMWRTKKHNKILQMEESLTDGRKLNKEQEELKRMCAPLATALAEELSSRPARSPSTVASSSSSSVDLSIEDLLALIYFGSLFDVKPQTEFVATMLVRAKERDCCSTFDYVCPCRLTPCHSPVSPPLAARQCGKKTGERRKKGKKEEMDGKHDGDGTVPIL

SEQ ID NO: 49888 - protein, 568 aa, Magnaporthe grisea 70-15
MASITTRQAAEAPGAKAKEKTYPLMSRREIEGLIADGRTVFILDGFVLKADAWKKYHPGGDKAMLHMIGRDATDEVTVLHSAEARQMMNRYRIGRIEGHWKNFVPPIQGGHFRPLASPESPPDSPLLECTTATSSDSESRPPSPVFDSAGIKYRGQNSAPSVTSVSSVDEPEDLPDGIAFLDSLTKKEIDLDKATYPSLDETTQRDIVQKYRDLNARIKAEGLYDCNYGAYFYEVRRYCVLFGLMALTLHWGWYITSAVFMGMFWHQLLFTAHDAGHVGITHNFHVDTLIGIFIGDFMGGLSLGWWKHMHNVHHIVTNSPEHDPDIEHLPFMAISHRLFGSLRSTYYERVLEYDAVAKILVPIQHYSFYILLMFGRFNLYRLSLEFILLRKGPRKGPAWWHPYVELSGLAFFWYWYAYRVVYCSIPDNLNRLAFILISHMVTMPLHAQLTLSHFAMSTANLGPTESFAQKMLRTTMDVDCPEWLDFFHGGLQFQAIHHLYPRIPRHNLRRTQVLVREFCAEVGIPYALLGFVDGNKVVVGKLAEVARQAAFLAKCEQHTIENGGLHGH

SEQ ID NO: 49889 - protein, 356 aa, Oryza sativa (japonica cultivar-group)
MGVLCFGASNILLCAEDSSSVLGLGGFGGGGGEVAAELGCGGGGGFDFFGFGGGAVFPIDSDEFVALLVEKEMDHQPQRGYLEKLELGGLECSWRKDAIDWICKVHSYYNFGPLSLYLAVNYLDRFLSSFNLPHDESWMQQLLSVSCLSLATKMEETVVPLPMDLQVFDAEYVFEARHIKRMELIVMKTLKWRLQAVTPFSFIGYFLDKFNEGKPPSYTLASWCSDLTVGTLKDSRFLSFRPSEIAAAVVLAVLAENQFLVFNSALGESEIPVNKEMVMRCYELMVEKALVKKIRNSNASSSVPHSPITVLDAACFSFRSDDTTLGSSQSNSNNKDYNSQDSAPASKRRRLNTTPI

SEQ ID NO: 49890 - protein, 246 aa, Thermotoga maritima
MKMKEFLDLLNESRLTVTLTGAGISTPSGIPDFRGPNGIYKKYSQNVFDIDFFYSHPEEFYRFAKEGIFPMLQAKPNLAHVLLAKLEEKGLIEAVITQNIDRLHQRAGSKKVIELAGNVEEYYCVRCEKKYTVEDVIKKLESSDVPLCDDCNSLIRPNIVFFGENLPQDALREAIGLSSRASLMIVLGSSLVVYPAAELPLITVRSGGKLVIVNLGETPFDDIATLKYNMDVVEFARRVMEEGGIS

SEQ ID NO: 49891 - protein, 377 aa, Oryza sativa (japonica cultivar-group)
MESEEAAAAWGDAMRDRLASLGRPKRLFIIVNPYGGKRGGRKIFQTEVLPLIEAAGILYTMQETKHRLHAQEIAHSLDLRKYDGIVCVSGDGVLVEVVNGLLQREDWNTAIKIPLGIIPAGHKRPLDVTSVVQGKTRFFSVLMLTWGLVADIDIESEKYRWMGSARLDFYSLLRVVSLRRYNGRVLFVPAPGYEGLGDLVEQISSCKSNGASTGVQEDRSNDFNDETCAYAGPSIDETDHEWRSLDGPFVSVWVSGVPFASENVMTAPEAKFGDGYLDVAIIKDCPRSALAGLMFQMKDGSYVKSPYVEYFKVKALRIEPGMRVGSTTKGGIIDSDGEVIARGDGSHTGDEIEHLMAYGPPIQLTVDQGLATIFSPR

SEQ ID NO: 49892 - protein, 431 aa, Geobacter metallireducens GS-15
MPTDITMPKLSDTMTEGRLVSWKKSVGERVERGEIIAEVETDKATMELEAFASGTLAEQRVKPGELVAVGTVIGVIGAGGEIPPVAPEKPTPSPEEPKPSPEESKPSPQKAEPQPTPEATPAAPAGDVPERVMELPEEKASAPAPPEAERGEGERAAPVVRRMARERGIDLSLVTGSGPEGRILQEDLERYLTEKPAPESAVATGEGAEGEPLSRMRGAIARVTSQAWQTIPHFYETVEIAMEEGVEIVRELKGSGNEVTFNDLVVKAAAMALAKYPRLNASFAGDRIVTHCEVNIGIAVAVDDGLLVPVVKGCQGLALKEIALETVRLADRARSGRISQEEISGGTFSISNLGMFGIDEFAAVIFPPQAAILAVGNVADRPVVRDGRVVAAKTMRVTLSCDHRIVDGAYAARFLGEFRRIVEKPVLMLLQ

SEQ ID NO: 49893 - protein, 569 aa, Xylella fastidiosa Dixon
MSQTRPWLQHYPSGISTEIDTDAFRTIADVFNTSVIKYRHCPAYTNFGKTLTYGEVDLLTKQFASYLLNVLKLKKSDRIALMMLNCLQYPVATFGALCAGLAVVNVNPLYTARELKHQLVDAGSTVLVVMDNFCTTVQHIIADTPIKQVITTELGDLLDFPKRSLINFAVKHIKKLVPEYQLPRSIRFREALALGSKHSMPPIHIASDDLAFLQYTGGTTGTPKGAMLTHRNMVANMQQVSQWLQTSNSLKEGCETVLTALPLYHIFALTANNLVFMKIGGCNHLISNPRNMRAFVKELQRVRFTVITGVNTLFNKLLNTPGFDKLDFSSLKIALGGGMVIQRSVAEQWKQVTHVPLIEAYGLTEASPAACINPLNLQEHNGSIGMPIPSTDVCIKDDTNTVLPIGEIGELCIKGPQVMKGYWQRPEETSEVLDADGWLHTGDIVKMDKQGFLYIIDRKKEIILVSGFNVYPKEIEEVIAMIPGVAEVAAVGVPDEQSGEVVKVVIVKKDPMLTAEEVKAHAATNLTRYKLPRIIEFRATLPKTDVGKILRRELRDAAPASTTFTAQPK

SEQ ID NO: 49894 - protein, 328 aa, Geobacter metallireducens GS-15
MHEMTYRDALNKALKEEMRRDPSVVAWGEDVALYEGSFKVTRGLLAEFGEERVKDTPISENTIIGVSIGAAMGGLRPVAELMTVNFALLAMDQIVNHMAKISSMFGGQTHLPMVVRAPGGGGSQLGAQHSQSLETYFMHCPGIHVAVPATPADARGLLKASIRDNNPVMFLEHELLYNSKGEVPDDPEFLVPLGKAEVKREGKDVTIVAYSRMTILALQAAAELEKEGSSCEVVDLRTLAPLDTETFVASVQKTGRAVVVEECWRAAGLGGHLASIIAEECFDRLLAPVRRVSGLDVPMPYSRKIEKLCIPQVETIAAAVRDVMSQKY

SEQ ID NO: 49895 - protein, 209 aa, Brassica napus
  misc_feature (176)..(176): Xaa can be any naturally occurring amino acid
RVSIHLLNNGILLGCRGHMAQCLQNLSAASESLREEIVSEGGVPSLLAYIDGPLPQEPAVTALRNLIPSVNTETWVALNLLPRLAHVLMSGSLGAQQAAASAICRFGSSPEAKRLVGESGCVPAMVKLLESKSNGCREAAAQAIAGLVTEGRVRRELRKGGKSVTNLVMLLDSNPXNTAKKYAVAGLLGLEGSEKSKKVMVSLRRPSGI

SEQ ID NO: 49896 - protein, 412 aa, Glycine max
MNALAATNRNFQRAARILGLDSKLEKSLLIPFREVKVECTIPKDDGTLVSYVGFRIQHDNARGPMKGGIRYHPEVDPDEVNALAQLMTWKTAVADIPYGGAKGGIGCNPRDLSISELERLTRVFTQKIHDLIGIQKDVPAPDMGTNAQTMAWILDEYSKFHGHSPAVVTGKPIDLGGSLGREAATGLGVVFATEALFAEYGKSISDHTFVIQGFGNVGTWAAKSIFERGGKVIAVSDISGAIKNLNGIDILALLKHKDGNGGVLKDFPGAEAMDPDELLVHECDVLVPCALGGVLNKENAADVKAKFIIEAANHPTDPDADGILSKKGVIILPDIYANAGGVTVSYFEWVQNIQGFMWDEEKVNRELKKYMTKAFQDIKAMCKIHNCDLRMGAFTLGVNRVARATLLRGWEA

SEQ ID NO: 49897 - protein, 375 aa, Pinus banksiana
RVIKCKAAVAWAAGEPLKIEEVEVAPPQAMEVRVKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARIAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYLDKKLELEKFITHEVSFADINKAFDYMIKGESLRCVINVIGN

SEQ ID NO: 49898 - protein, 278 aa, Nocardia farcinica IFM 10152
MTVSNDAYFKDKVCVITGAGSGIGRALAENLARRGARLALSDIDTEGLAETVRRCEQLGAQVKSDRVNVAEREAVLLYADAVKAHFGVVHQIYNNAGIAHHGDVIKSEFKDIERIMDVDFWGVVNGTKAFLPMLIESGDGHVVNVSSLFGLIAVPGQAAYNSAKFAVRGFTEALRQEMLVGKLPVKVTCVHPGGIKTAVARNATYAEGIDEKSAASMFDKKLAIHTPEMAAQTIVNGVRKGHGRVLIGWEAKLLDLFVRVTASGYQRIAAAVSGPYLP

SEQ ID NO: 49899 - protein, 395 aa, Novosphingobium aromaticivorans DSM 12444
MTPSARVQAAIDLLDAVIAAAKAQGASADRIAADWFRSRRFVGSKDRRAIRELVWSAIRVCGEVPESGRAAMLRVAVADPGIAALFDGSTYGPAPIRAGEVAAEGGNAPAWLSERLRQSGLGEDEQAALLGRAPLDIRANTLRITRDELRLRLPVELEVTAAPDALRLPSGTAAESWPEFQEGLFEVQDSGSQIACMALDVKPGEAVVDLCAGGGGKTLSLGAAMANTGELLACDIDRARLSRLPDRAARAGVLAQTRLLNPGKEAEMLADWAGRADAVMVDAPCSGTGTWRRNPEARWRLDPRSIERYCTMQANVLEIGAGLVRPGGRLTYVVCSLIDAEGRDRIEAFLAAHPDWSVAMPPLPAGRPHGKGWRLTPLGDGTDGFFFATIVRRVN

SEQ ID NO: 49900 - protein, 375 aa, Pinus banksiana
QAIKCKAAVAWAAGEPLKIEEVEVASPQAMEVRIKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARIAGASRIIGIDLNSDRFEKAKLFGVTEFINPLDYKKPIQEVIAEKTDGGVDCSIECTGNVKAMIQAFESCHDGWGVAVLVGVPHSDAVFATSPVNFLNERTLKGTFFGNYKPRTDLPGLVELYMDKKLELEKFITHEVSFADINKAFDYMIKGESLRCVINVIGN

SEQ ID NO: 49901 - protein, 177 aa, Rhodococcus sp. RHA1
MIDHSSARDAVTRLTRWADDFPQPGVRFADLTPVFSDADGFRVVVDALAACAPEADVIAAVDARGFLLGGGVARELGSGVVAVRKSGKLPPPVLSQSYTLEYGTATLEIPAGSIGLDGRSVLVVDDVLATGGTLDATARLVESAGARVIGVAVVLEIAALGGRERLGKYPLTSLVTV

SEQ ID NO: 49902 - protein, 375 aa, Pinus banksiana
KVITCKAAVAWGPSQPLKIEEVQVAPPKAMEVRIKVHYTSLCHTDLVFWQAEGHTPIFPRIFGHEAAGVIESVGEGVTDLKVGDCVLPVFTGECKECKHCKSEESNMCDLLRIDTERGVMMSDGNSRFSINGKPIHHFLGTSTFSEYTVAHAGCVAKINPKAPLDKVCVLSCGVPTGMGATLNAGKPKKGSIVAVFGLGAVGLAACEGARIAGAARIIGIDFNNERSERAKQFGVTEFINPKEYDKPIQQVIAEKTDGGVDCSVECTGSIEAMVQALECCHDGWGVAVLAGVPRADAVFKTNPVNFLSEKTLKGTFFGNYKPRTDLPGLVEMYLNGELELDKFVTDKVSFSDINKAFDHMLKGEGLRTVIKVIQD

SEQ ID NO: 49903 - protein, 318 aa, Novosphingobium aromaticivorans DSM 12444
MSDQTTHYVRPDVKAFLDFLNGTDAPPMSQLGLEAARASYIAMGQLAEEPPRDLAVIRDLTCPGPAGDIPLRLYDPRETREPGPAVVFFHGGGFVIGDLESHHSLCTEIAAELDMPVIAVDYRLAPEHPFPAAPDDCEAAARWIAANSATALGRKVTGLIPMGDSAGGNLTIVVTQALVDEPAAVPVIIQVPIYPLSDDKPDHKSFLDFADGFLLTADSMQWFANAYQAVTGHKRAYPIYGEHSTTPPTVLVTASLDPIRDSGRVYGAELIRAGAEVVFLEMKGTIHGFTQVRKAIPSAQADMQSIFAAIRLLLERLK

SEQ ID NO: 49904 - protein, 374 aa, Pinus banksiana
QVITCKAAVAWGPGQPLKIEEVEVAPPQAMEVRIKVYYTALCRTDLVFWEAKGQTPLFPRIFGHEAAGIVESVGEGVTDLKPGDSVLPVFTGECKECRHCKSEESNMCALLRINTDRGVMISDGKSRFSVNGKPIYHFLGTSTFSEYTVVHVGCVAKINPKAPLSKVCILSCGVSTGMGATLNVGKPKKGSTVAIFGLGSVGLGAAEGARIAGASRIIGVDLNSDRYEQAKLFGVTEFINPQDYEKPVQEVIAEKTDGGVDCSIECTGNVKAMIQAFESCHDGWGVSVLVGVPHSDAVFATHPINFLNERTLKGTFFGNYKPRSDLPGLVEMYLDKKLELDKFITHEVSFADINKSFDYMIKGESLRTVIKVSD

SEQ ID NO: 49905 - protein, 288 aa, Burkholderia sp. 383
MTAAASTSGADRYVVFGNPVAHSKSPFIHAQFAAQTGEPVEYTHRLAPVDGFDAAVRAFVAEGGRGANVTVPFKLEAHALADTLSPRAAAAGAVNTLRIDVDGRIHGDNTDGVGLVRDIEANLGVSLAGARILLLGAGGAARGVVLPLLDRAPLSITIVNRTASKAEALVGQFMQAAHDAGCTLAGGGPDVVRAERYDVVINATAGSLDAALPECDAAAFGAGTLAYDMMYGAQPTVFMQHAASLGARTADGLGMLVEQAAESFFIWRGVRPDGAPVLAALRQALAAS

SEQ ID NO: 49906 - protein, 826 aa, Bacteroides thetaiotaomicron VPI-5482
MKIIIIGGVAGGATTAARIRRTNEAAEIILLEKGKYISYANCGLPYYIGGVIKEREKLFVQTPEAFSTRFRVDVRTENEVIFIDRKRKTVTVRQSSGDTYEESYDKLLISTGASPVRPPLPGIDLNGIFTLRNVADTDRIKEYINSHAPRKAVVIGAGFIGLEMAENLHAQGAKVSIVEMGNQVMAPIDFSMASLVHQHLMDKGVNLYLEQAVASFERDGKGLKVIFKNGQSISADIVILSIGVRPETTLARAAELKIGEAGGIAVNDYLQTSDESIYAIGDAIEFRHPITGKPWLNYLAGPANRQGRIVADNIQGAHIPYEGAIGTSIAKVFDMTVASTGLPGKRLRQAEINYMSSTIHPSSHAGYYPDAMPMSIKITFDPKTGKLYGGQIVGYDGVDKRIDEIALVIKHEGTIYDLMKVEQAYAPPFSSAKDPVAVAGYVAENIITGKVQPVYWRQLRDIEMENNFLLDVRTPDEFSLNTLPGAVNIPLDELRDRLDELPKDKMIYTFCAVGLRGYLAYRILVQHGFEKVRNLSGGLKTYHAAAAPIILREESENEVPAQPNANIQQPADAQPQKTVSPVEAVKTIRVDACGLQCPGPILKMKKTMDSLVSGDRVEITSTDPGFPRDAAAWCNSTGNQLISKETAGGKSVVVIEKGEPKSCNIVTSCEGKGKTFIMFSDDLDKALATFVLANGAAATGQKVTIFFTFWGLNVIKKLHKPNVEKDIFGKMFGMMLPSSSRKLKLSKMSMGGIGGKMMRYIMNRKGIDSLESLRQQALENGVEFIACQMSMDVMGVKQEELLDEVTIGGVATYMERADNANINLFI

SEQ ID NO: 49907 - protein, 1280 aa, Magnaporthe grisea 70-15
MPPRGGRVSKGPSLPLNLLREIGADGASSKGRGRSNRSGGRAFDRRPNRGGDRPKGSSHASHRAVEVTKKPNLKRSKRGHETDSEDSEDGSSEEQDDSGLEDEDDYDDDDEDVSDVEESTDEKSLPKAVRDKIAEDDKEIAELERRLGIKGRKGLPKSFKEDGLGDLLEGIDDAIGVESNEKKKRKAEADEWLAQKRQKANQTTRQVERDDDDEGSDSEDDDIDEDDFDMGDESSQDGGSDGEFEGFESDPETASAPKPQRENPYVAPTSGVTVTKYIPPSMRAKTGSDDELMLRIRRQTQGLVNRLTDANLISILGEIEKLYREYPRQHVTSTLVDLLLIQVCDPSSLPDTLLILTAGFATAAYKVIGMDFGAYLVQTTAEKFKEHYAKTVGRTQEQQEVTKETSNIITFLAQMYNFQMIGCNLVFDHIRFLLGELSELNAELLLRIIRMAGKPLRQDDPMALKDIVALIRPAMAKFGENNVSVRTKFMIETINDLKNNKMKAGATASAINTEHTTRMKKLLGTLSSRKLKATEPLRMGLKDIEEADKKGKWWLVGSSWAGKDKTDKKKTSDKPEADDVSDVNDLEIYDDDDLDVDLEALARRLMLNTDIRRSIFFAVMSALDFEDAYRNLLKLRLNKERQREVSHVLLQCCGSEEQYNPYYALVARKISGDDRRTKWNFQDTLWKFFRRLGESLFDEEADEVDDEDDKATELRRIVNIGKFYGNLISEGVLNLDVLRCLNFVYLKPKTKMLVEVILVTALLDFPCKNRAGADEVIRKMFTLPGKPEFARSLKYFMEKVMPRTDFLILLLLPEQKDLVIIGGGVAGYVAAIKAGQQGMKVTCIEKRGTLGGTCLNVGCIPSKSLLNNSHLYHQILHDTKNRGIEVGDVKLNLQQLMKAKDTSVGGLTKGVEFLLKKNGVEYLKGTGSFVNEHEIKIALNDGGETSRTAKNILIATGSEATPFPGLEIDEKRVVTSTGALALEKVPETMTVIGGGIIGLEMASVWSRLGAKVTVVEYLGQIGGPGMDTEIAKSAQKILKKQGIEFKLNTKVNGGDTTGDKIKLDIDAAKGGKAESIESDVVLVAIGRRPYTGGLGLENVGLETDDRGRVVIDSEYRTSHPHIRCVGDVTFGPMLAHKAEEEAVAVVEYMSKGYGHVNYAAIPSVMYTHPEVAWVGQSEQDLQKAGIQYRVGTFPFSANSRAKTNLDTEGMVKMLADPETDRILGVHIIGPNAGEMIAEGTLALEYGASSEDIARTCHAHPTLAEAFKEAAMATHAKAIHF

SEQ ID NO: 49908 - protein, 858 aa, Vicia faba
MSFIFGGGDKIKGTLVLMQKNVLDINSLTDPAKILDGALGGFGSILDTLTSFLGNSVLLQLISSTKPLTSGEGKLGKETYLKQAITNLPTLGDKQTAFSIEFEYDSSFGIPGAFKIKNYMSNEFYLVSLTLDDIPNLGTIHFVCNSWIYNAKNYQTDRIFFANNTFVTSETPPPLVYYRQLELKTLRGNGTGERQEWDRIYDYDVYNDLGEPDKGESYARPILGRSSDHPYPRRGRTGRKPTATDPNSESRGNSVYIPRDEAFGHLKSSDFLVYGLKSVSQDVIPLLQSVFDINFTPTEFDSFDDVFDLYEGGIKLPTDIISKISPLPVISEIFRTDGEEVLKFPPPKVIQVSKSAWMTDEEFGREILAGVNPGLIRSLQEFPPKSKLDSAIYGDHTSTITKEQIELNLEGFSTLDEAIQNKKLFLLEHHDTIIPYLRLINSTSTKAYASRTILFLKSDGTLKPLAIELSLPHPQGDQFGVVSNVYLPAIEGVEATIWLLAKAYVIVNDSCFHQLVSHWLHTHAVVEPFVIATNRQLSVLHPIYKLLHPHYRDTMNINALARQSLVNADGIIEKTFLWGGYAMEISSKVYKDWVFTDQALPADLIKRGIAVEDSTSPHGLRLVIEDYPYAVDGLDIWDAIKTWVQDYVSIYYITDDKIQQDSELQSWWKEVVEVGHGDKKGEPWWPKLQTRQDLIHVSSIIIWSASALHAAVNFGQYPYGGFILNRPTLSRRLMPEKGTTEYDELATNPQKAYLKTITPKLQTLIDLSVIEILSRHASDEYYLGQRDSAEYWTSDTNALAAFKKFGKTLAEIEGQLILRNNNESLRNRVGPVSMPYTLLYPSSEEGLTFRGIPNSISI

SEQ ID NO: 49909 - protein, 148 aa, Triticum aestivum
  misc_feature (17)..(17): Xaa can be any naturally occurring amino acid
  misc_feature (55)..(55): Xaa can be any naturally occurring amino acid
PFMPEGSRLHLMMVAYXDGSEDPVIASILNETLKALDYPHSQVHIHRDVKVISLXNPSVVKLGDFGVSACIFDRGDRQRARSTFVGTPCWMAPEVLQPGTGYDFKADLWSFVITALKLAHGHAPFSMYPAMKVLLMTLQNAPPSVNAF

SEQ ID NO: 49910 - protein, 413 aa, Burkholderia mallei ATCC 23344
MSTADPYLIAGGGHAARRAAETLRERDPAARIVMIGAEPELPYDRPVLSKEALVGGDAGERRAFVRDAAWYRERDIELRLGVRVEAIERGARRVRLSDGARLGYARLLIATGSRVRRFAGPVDAGVHVHYVRTLADTRALRAALAPGKRVAVLGGGFIGLEVAASAVRLGCRATVVDPAPRLLQRRMPEAVGAFALALHARHGVDVRLGALPERIRRAANGAAVVETSAGGIVADVVVAGIGVVPNVELAQAAGLDVDDGVCVDEMCRTADPAIFAAGEVTRHFNPLVGRALRIESWQIAENQPAVAAANMLGAAETYAQWPWLWSDQYDSNLQTLGLFGGEQTLVLRGSPERDRAFCVFALNARRELAAVAAVNAGREIAVCRRLMTAGVALDPARLADPSDALRAMLPRGV

SEQ ID NO: 49911 - protein, 473 aa, Staphylococcus aureus subsp. aureus MW2
MSEKQYDLVVLGGGTAGYVAAIRASQLGKKVAIVERQLLGGTCLHKGCIPTKSLLKSAEVFQTVKQAAMFGVDVKDANVNFENMLARKEDIINQMYQGVKHLMQHNHIDIYNGTGRILGTSIFSPQSGTISVEYEDGESDLLPNQFVLIATGSSPAELPFLSFDHDKILSSDDILSLKTLPSSIGIIGGGVIGMEFASLMIDLGVDVTVIEAGERILPTESKQASQLLKKSLSARGVKFYEGIKLSENDINVNEDGVTFEISSDIIKVDKVLLSIGRKPNTSDIGLNNTKIKLSTSGHILTNEFQQTEDKHIYAAGDCIGKLQLAHVGSKEGVVAVDHMFEGNPIPVNYNMMPKCIYSQPEIASIGLNIEQAKAEGMKVKSFKVPFKAIGKAVIDSHDTNEGYSEMVIDQSTEEIVGINMIGPHVTELINEASLLQFMNGSALELGLTTHAHPSISEVLMELGLKAESRAIHV

SEQ ID NO: 49912 - protein, 325 aa, Geobacter metallireducens GS-15
MESKLRALLPDAELIRMYEQMVLSREFEESCAEQYTKGHITGFLHLYSGQEAVAVGATAGLHRDDYILSAYREHAQAIVRGAEPRRVMAELFGKRTGICKGKGGSMHLFDPNLSFMGGYAIVGGQFPIAVGLAFAAKFRKEGRIVACFFGDGAANQGTFHESLNWARLWELPVLFICENNSYGIGTSVERASALPDIHRRTCGYDIPSERVHGMDVIAVYEAVKWAAEWVREQNRPFLIEAITYRFRGHSMSDPGKYRSLAEVELWKSRDPIPAFANRLVEEEIATEAQLEGIKQQALVTVADAVKFAEDSPWPEDSEVWEDVYA

SEQ ID NO: 49913 - protein, 441 aa, Xylella fastidiosa Dixon
MMPRSLTHPSDVPAMSSPYKSSSHMAKETLLYAQSGGVTAVINATAAAVITEARSHRVKVLAARNGILGALREDLIDTSKESITAIRALTHTPGGAFGSCRFKLKSLEADHDKYERLLEVFKAHNVRWFLYNGGNDSADTALKVSQLAKTFDYPLHCIGVPKTIDNDLAITDASPGFGSAAKYTAVSICEAARDVAAMAETSTKVFIYEAMGRHAGWLAAAAGLAGQGQEEAPHIILLPERTYDETAFLAKVQQVVDRVGWCVVVASEGIRSNDGRFVADAGGTTDAFGHTQLGGVAAYLASRVKQALGLKVHWTLPDYLQRSARHIASKTDWEQAQAVGKAAVRYALEGMNAVMPVIVRTSDTPYRWKIEPAALTKIANHEKTLPASFLRRDGFGISERARTYFEPLIRGEAPMPYERNGLPRHVHLKNQSVQKRLPAWE

SEQ ID NO: 49914 - protein, 1486 aa, Aspergillus nidulans FGSC A4
MGQDSAVGEASSQSTRGDGPLSAVEQEDKLHNEVSKVAKRLSTSSASENGQPQVLNPMPGSNLDPSSPAFDARTWVKEFNRLLESDPESAPPRALGVAFKQLGVFAYGTAAEFQKTTGNVLIEAAVYLARWFRGNRHGRRVDILRNFEGVVEKGEMLLVLGPPGSGCSTLLKSLAGETADLNIAPESYINFRGLDLASVRSSFRGDVLYNDELDTHLAHLTVGETLTFASRARSVRHVPGAFSRRQLDTARRDVMMATFGLNHTIDTRVGDDFVRGVSGGERKRVSIAEASLAGAKFQCWDNSTRGLDSANAINFCSSLRLQADLLDVTSVVTLYQAPQAAYDLFDRVTLIYEGRQIFFGHITEAKGYFEKLGFFAPSRQTIPDFLTSMTSAEERRVRPGFEESAPRSPDEFAERWRLSDERRKLLDELASYEQKHPPEVRMAEYDRSRRAEQAQQQRAKSAYTISYPQQVSLTLWRAYRRLLADPGFTIASLLFNVVMALILGSMFYNLKPDTSSFYYRGGIIYFSLLFNAFASQLEVIPSKLNFSVLTIYAERPVVEKQNRYAFYHQSAQAIASYLMDLPYKIINMFVFNILIYFMANLRREAGAFFFFCLTTLLSTLVQSAVFRTLACITRTSEQAMIPSAILSLGLMIYTGFTTPPGYMPGWSRWMAYINPLWYGFEALMANEFHERDFPCASMVPTGQGYANLPSASQICSVVGSEVGSALVNGDSYISKSFDYWNVHKWRLVNSKNTIDTEGQCTNGSRSNRNIGILCGFLAIFFPTYVLAAELAKPPKTRGEILVFGRGKGFHRREQPLDAESQEKDRPVVADKTHGSLQSDTIIAGKDVFHWEDLCYDIKVKGGTRRLLDHIDGWVKPGVSTILMGVSGAGKTTLLDVLATRVTTGVVTGQAMVNGKPTDPSFQHKVGYVQQQDLHLSTMTVREALQFSAVLRQSAEIPKSEKLAYVEQVIDTLEMREFADAVIGVPGEGLNVEQRKRLTIGVELAAKPQLLVFFDEPTSGLDSQTSWVISELIKKLTNSGQAVLCTIHQPSAILFNQFDRLLLIAPGGKTVYFGDLGSGASTLIQYFEKYGTPPCPAGANPAEWMLRVIEPPADGSKGLNWHQIWLDSPEYQAVKAELGHLRNLRTLGSTRGEGLEVENSSQHQEFVASFWTQFSQVLQRTWKHFWRSPTYIWSKIILVVLSSLYLGFSFNVNNSIQGLQNQLWAIFMLLILFINITEQIMPMFLPQRALYEARERPSKIYRWTTYLLSNILIELVWQTLMAVLLYFCWYYPVGFVQNTTSDDQAIRGFAVFLFLWVYLLFTSTMAHFAIFWINLPETAGVLTSLLWMLVGVSMADLPKFWTFMYRVSPATYLVGGIMSNAVANSDVICADREILRMAPIGNLTCNEFLTPYINVAGGLVLNPTSQSTCEYCPLATTNEFLDRFQISYSTRWRDLGLVWVYILVNIVAGMGLYWAFKVPKRRGSKHA

SEQ ID NO: 49915 - protein, 1118 aa, Saccharomyces cerevisiae [sequence omitted]

SEQ ID NO: 49916 - protein, 950 aa, Arabidopsis thaliana
MINLEKEAKEKQILIRDGKRKIVHHVNTTLLVKIYEASAIDDRHLFLKPYYGPPNYYFIKAWLDDTKEYGTYVVKDSFKVNQPPLKIPLNFPAQYLYVELLKGMSYRDPGTSNRTVVMGRAKIRLSPLMTSYKERPISGGIDLVGLNSDQCVVKKVTAAYHPTDVFLFNCGDTSNNVDNSGRNWTVESRQILSSNLVNASFTSEASYQKAGVSRIPYMKARIFRSEFTYSFPVTPGSIFLRLYFYPTQYKSGFDAVNSFFSVKVNGFTLLRNFNADSTVQASIPLSNSLIKEFIIPVHQTLNLTFTPSKNLLAFVNGIEIVSMPDRFYSKGGFDNVLRNVSSDVDFQIDNSTAFESVHRLNVGGQIVNEVDDSGMFRRWLSDDSFGNSGSIVNVPGVKINYTEKTPAYVAPYDVYATSRLMGNSSNLMFNLTGMFLTVDAGYNYLVRLHFCETLPQVTKAGQRVFSIFVEDKMAKKETDVIRLSGGPRIPMYLDFSVYVGFESGMIQPELRLDLVPLKDTNQTYYDAILSGVEILKLNDSDGNLARPNPELLVSTDSTPDDSNVTPPIKGKPHVLVIILIVVGSVIGLATFIVIIMLLIRQMKRKKNKKENSVIMFKLLLKQYIYAELKKITKSFSHTVGKGGFGTVYRGNLSNGRTVAVKVLKDLKGNGDDFINEVTSMSQTSHVNIVSLLGFCYEGSKRAIISEFLEHGSLDQFISRNKSLTPNVTTLYGIALGIARGLEYLHYGCKTRIVHFDIKPQNILLDDNFCPKVADFGLAKLCEKRESILSLIDTRGTIGYIAPEVVSRMYGGISHKSDVYSYGMLVLDMIGARNKVETTTCNGSTAYFPDWIYKDLENGDQTWIIGDEINEEDNKIVKKMILVSLWCIRPCPSDRPPMNKVVEMIEGSLDALELPPKPSRHISTELVLESSSLSDGQEAEKQTQTLDSTII

SEQ ID NO: 49917 - protein, 325 aa, Idiomarina baltica OS145
MKQITHDFCTLAREVIEIERDAIEGLKTFLDDNFNRACQAMFDCKGRIIVTGMGKSGHIGGKIAATLASTGSPAFFVHPGEASHGDLGMVTDSDIVIAISNSGETGEILNIIPVMKRLGVTIIAMTGNPESTLATLADVHVCIRVEQEACPLGLAPTASTTASLVMGDALAVALLNARGFTADDFALSHPGGSLGKRLLLRLSDVMHTGDRVPQVEQDALIRDALLEISRKGLGMTSIVDEHGRLAGIFTDGDLRRILDSRVDVHTSKIADFMTRTCVTADENMLAAQALKLMQDRKINGLIIVDHDGKPHGAMNMHDLLQAGVV

SEQ ID NO: 49918 - protein, 516 aa, Gluconobacter oxydans 621H
MKRVDMTRRFIITTPIFYVNGAPHIGHAYTSIAADVLARFHRLNGEEVLFVSGTDEHGQKVEQTAVAKGMDPQAYADEVSASFRQMQKDMAISTDEFIRTTEERHKGAAKALWEKVAANGHIYLGAYEGWYSTRDEAFIGEDELVKKPDGTFVAPSGAPVERVKEPSYFFRLSDFQDRLLKLYEDNPDFIGPVGPRREIESFVRQGLRDLSVSRTSFKWGVPVPNDPDHVMYVWFDALANYLTAVGYPDLNDPRAKFWPADVHIVGKEIARFHCVYWPAFLMAAGIDLPKSVFAHGWWTVEGEKMSKSLGNVLDPKALADEFGLDALRFFLMREVPFGGDSNFSRRSMITRTNVELANDLGNLCQRTLSQVARNLGGVLPERGTLTEDDQAMLAMVTLLPTIMSEQIERKAITDALEEVWKVIRAANSYIDRQAPWALKKTDPERMADVLRVLVDMIRGIATMLQPYMPNTMDRMLTQLGVQDDERTFAALETPLPAGRTLPKPEGLFPRFVEEEA

SEQ ID NO: 49919 - protein, 656 aa, Streptococcus pneumoniae
MSNLSVNAIRFLGIDAINKANSGHPGVVMGAAPMAYSSLQNNFISIQLNQTGLTATALFFQQVMVQCSFMLFFTFLVLKMSAWMRLRVSVNGVKNTRSPRICHTAGIDATTGPLGKDFNCYWFCPSRRFLAAKYNREGYNIFDHYTYVICGDGDLMEGVSSEAASYAGLQNLISWLFFMIQMISTWMVRQRIPLQKVFVTVTMLRLHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPSRCAWNEAAWYLAVTSEKTPTALVLTRQNLTVEDGTDFDKVAKGAYVVYEMQRPTLIPSLIATGSEVNLAVSAAKELASQGEKSRVVSMPSTDVFDKQDAAYKEEILPNAVRRRVAVEMGASQNWYKYVGLDGAVLGIDTFGASAPAPKVLAEYGFTVENLVKIVRNLK

SEQ ID NO: 49920 - protein, 398 aa, Nocardia farcinica IFM 10152
MSPVTDAPNATASLSEITHDEIFAGHLGGKLSVELSAPLETQRDLSIAYTPGVAQVSRAIAQDEALAKRYTWTDRLVVVVSDGTAVLGLGDIGPRASLPVMEGKAALFKKFAGLDSIPIVLDTKDVDEIVETLIRLRPSFGAVNLEDISAPRCFEIEKRVIEALDCPVMHDDQHGTAIVVLAALNGAAKVQGRSIEGLKVVVSGAGAAGVACTNILLAAGVADVTVLDSKGILSRERSDLNAVKAELAARTNPRGLVGGAAEALAGADVFLGLSAGLIAEELIASMAPESIVFAMSNPDPEIHPEVARKYAAIVATGRSDFPNQINNVLAFPGVFKGALDAGARRITEGMKIAAAEAILGVVADELGPDKIVPSPLDPRVAPAVAEAVAAAARAEGVA

SEQ ID NO: 49921 - protein, 76 aa, Brassica napus
DIRIVDKKKQKTIVVHKEGQVDAVVWNPWEKKVEDLGTEDYRRFVTVESAAVEKPITVNPGQEWKGILQMSVVPSS

SEQ ID NO: 49922 - protein, 375 aa, Pinus banksiana
QVIKCKAAVAWAAGEPLKIEEVEVAPPQAMEVRIKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARMAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYMDKKLQLEKFITHEVSFADINKAFDYMIKGESLRCVTNVIGN

SEQ ID NO: 49923 - protein, 375 aa, Pinus banksiana
QVIKCKAAVAWAAGEPLKIEEVEVAPPQAMEVRIKIHYTALCHTDLYFWEAKGQTPLFPRILGHEAAGVVESVGEGVTDLKEGDTVLPVFTGECGECRHCKSEESNMCDLLRINTDRGVMISDGKSRFSINGKPIYHFVGTSTFSEYTVTHVGSLAKINPEAPLDKVCILSCGVSTGMGATLNVAKPKKGSSVAIFGLGGVGLAAAEGARIAGASRIIGIDLNSDRFEKAKLFGVTEFINPLDYKKPIQEVIAEKTDGGVDYSIECTGNVKAMIQAFESCHDGWGVAVLVGVPHSDAVFATSPVNFLNERTLKGTFFGNYKPRTDLPGLVELYMDKKLELEKFITHEVSFADINKAFDYMIKGESLRCVINVIGN

SEQ ID NO: 49924 - protein, 375 aa, Pinus banksiana
KVITCKAAVAWGPSQPLKIEEVQVAPPKAMEVRIKVHYTSLCHTDLVFWQAEGHTPIFPRIFGHEAAGVIESVGEGVTDLKVGDCVLPVFTGECKECKHCKSEESNMCDLLRIDTERGVMMSDGNSRFSINGKPIHHFLGTSTFSEYTVAHAGCVAKINPKAPLDKVCVLSCGVPTGMGATLNAGKPKKGSIVAVFGLGAVGLAACEGARIAGAARIIGIDFNNERSERAKQFGVTEFINPKEYEKPIQQVIAEKTDGGVDCSVECTGSIEAMVQALECCHDGWGVAVLAGVPRADAVFKTNPVNFLSEKTLKGTFFGNYKPRTDLPGLVEMYLNGELELDKFVTDKVSFSDINKAFDHMLKGEGLRTVIKVIQD

SEQ ID NO: 49925 - protein, 224 aa, Shewanella sp. MR-4
MSLAEVKGVLFDLDGTLADTAPDLVQALNLSLSDVGIAAKPLADMRSAASHGSFALVDAAIPGADDALRTQVQQGLLAHYQRINGDHCQLFDGIAPLLDWLELCRVPFGVITNKPARFTRPLLHKLKLSSRMPVMISGDSTRFPKPHTAPMLLGAQQLQCHPQQILYLGDAERDLLAAQAAGMLGGVALWGYLSEADTPDAWPAYAQFNSPSSLHSALSQALAK

SEQ ID NO: 49926 - protein, 308 aa, Geobacillus kaustophilus HTA426
MLVYNQEELVRFVEEAKQYARYGKVADYIPALGKANPNELSIAIYTPDDEVVSAGDVTVKVTLQSISKIIALALVLIDRGEDEVFHKVGMEPTDYPFHSIAKLEEKPAKPLNPMINAGALVVTSMIQGGSVSERLERLLAFVRRLAGNERISYSDEVARSEFETAFLNRSLCYFLKQHRIIDEDVEELMELYTKQCAIEMTCIDLARIGLVLALDGRDPHSSEPLMPLDVARICKTFMVTCGMYNSSGEFAIKVGIPAKSGVSGGILAAVPGRCGIGVFGPALDDKGNSLTGVKLLERLSKTYSLSIF

SEQ ID NO: 49927 - protein, 405 aa, Zea mays
MEAARHAPPTTSAQHRPPRSRRRANCRWRRCHWATARRPADFVLPNELLAALPRDPYEQLDLARRITTLVVSGQVSGLEQEAGRMRAEAAGKDRENAELRERVVLLDTALQETNARLRSPMLTMPDLLQAMETFTQEHERQGKSSCSAMVHKKNKKSSFIHRMNKLSHKTDSYMQGFKEHLTMGPKISETIKGKLSFGAKVLQAGGIDKVFREYFAVEKDEKLRKAFQCYLSTTAGPIAGMLFISTKKIAFHSDRPLSFTSPKGSSTRVPYKVLIPTERMKSASVRENLYNPDEKYIDVVTVDGFDFWFMGFVSYEKSFKYLQQIELIYHIDYEAKFFNYVLEYSVLSNALTDHTELGCCIRFSGAFEDAKITHVDDTVDPVRDMETISEELRLKFSLVFVDLQV

SEQ ID NO: 49928 - protein, 539 aa, Novosphingobium aromaticivorans DSM 12444
MTQQLGAMQDWKLRVTHLIDHAAREHGQREIVSRWADGSESRTTWAGIRHDALRMTQALRRLGVKPGDRIATLAMNHHRHLVSWYGSVGVGGILHTLNPRLFDDQLEYIVNHAEDRVMLFDKQWTPIIERMKSRWPTVEHYICFDSSEPALHFEEWIASEDGQTEWADGDERDPCMLCYTSGTTGNPKGVLYEHRSTVLHAMSAISPPIFGLDCRSVMLPIVPMFHAASWGLPWAGAAAGAKFVYSAVNDGAVLCDLMNREKVTCSAGVPTVWLALLQHVDAHNGGEIPPTLQTIVCGGSAMPRAMIERFMRAGRRVAHAWGMTETSPIGTTGAETWNWDDLSFDEKVTVKAMQGRPPFGVEIRCVDLGDPGKVLPRDGVTAGALQVRGPWIVKRYFKAEQDAVAAGQWFDTGDVGVIHPDGTLQLTDRTKDVIKSGGEWISSVELENAAIGHPAVAEAAAIGVYHPKWDERPLLVVIRKPGMDVNQEELRSYLQQHVAKWWVPDAVAFVDQIPHTGTGKISKKDLRDQFRDYRWDEVA

SEQ ID NO: 49929 - protein, 229 aa, Plantago major
ARGPLGPHDVRIRMKAVGICGSDVQYLKEMRLADFVVKEPMVMGHECAGIIEEVGTEVKSLVPGDRVAVEPGISCWRCNLCKNGRYNLCPDLKFFATPPFHGSLANQIVHPADLCFKLPDNVSLEEGAMCEPLSVAVHACRRANVGPETNVLVMGAGAIGLVTMLAARAFGAPKVVIVDVDDHRLAVAKELGADGVVKVSMSVKDVDEEVEQIKKCMAGEIDITFDCAG

SEQ ID NO: 49930 - protein, 1096 aa, Tuber borchii
MDSRPSIANEDGPIVPNGNGTDPPMPQRKRIVVVGLGMVAIAFIEKILKLDAENKQYEIVVIGEESHVAYNRVGLTSFFEHRKVEDLYLNPKEWYESKPDVLNHKINTKVTSIDPVSKSITTSGGYDVSYDVLVLATGSDAVVPSNTPGHDSKGVFVYRNIEDLEKLISFSATVKGSTGCVVGGGLLGLEAAKAMMDLEQFGSVKLIDKNPWVLSRQLDQDAGKLVLEKITELGLDALSCRKIKTINSNENNQTESVTFEDGETMDTTCICFAIGIKPRDELADSAGIKTASRGGFIINKDVETTVPGIYAIGECASWENQTFGLIAPGVEMAEVLAFNLCKSALHGHSETPKAFRRPDLSTKLKLLGVNVASFGDFFADRDGPRELPGRSPSQERRGREVKALSYRDPFQAVYKKYIFTSDGKYLLGGMIIGDTADYIKLVGMVKSKKALEIPPSQLILGAKTEGEENPDDLDDDTQICSCHNVTKGDISKVVKDGSCKSLGDVKSCTKAGTGCAGCIPLVQSIFNAEMKAMGAEVSNHLCPHFAYSRVDLFNIIKVKEIKTFPEVMRECGKDPESLGCEVCKPTMASIFASLFNQHVMDKPMHMLQETNDKFLANIQRNGTFSVVPRVAGGEITPEKLIAIGTVAKKYNLYCKITGGQRIDMFGARKQDLVAIWTDLVEAGMESGHAYAKSLRTIKSCVGTTWCRFGVGDSVGMAIRLEERYKSIRAPHKIKSGVSGCIRECAEAQNKDFGLIATETGYNIFVGGNGGSKPRHSELLIKDCPVERVIPVLDRYLMFYIRTADRLQRTARWMENLPGGIKYLKEVILDDKLGICDQLEKEMQDLVKTYFCEWTEVVKDEERRKQFQQFANTSEASETIEIINERSQSRPTYWPKASVKYDFKNHRWSNLAWQPIIEASYFNNANSSTPVSAAVKRGDTQLAIFKVRGKYYATQQMCPHKRAFVLSDGLIGEDPDDGTEEGKKKKNMWVSCPYHKRNYTLEGKTPGGCANDEEVSIATFDVEERSDGWVYLKLPSVAELDSLLGTERWKVKKEESEDPFKEMDKKISNKGRKAAKPTEALNGNGSPIEKKINGLEW

SEQ ID NO: 49931 - protein, 541 aa, Candidatus Kuenenia stuttgartiensis
MAHHFKNAEECWRSILSDVKGNANLLSEIKRFAEENTAPAKIVFGTSGWRGEMGTDYTFHTVRIVTTAIIEMFKNASAELLSALGAENFGDIKKRGIIVGHDNRFLGPEFANAVMGLLSKEGIKVYYTGEATTPELSASIEMVNAAGSINLTPSHNPSNYAGFKFNPADGGPAGTEITSVIERNANQLMANNKTIPAILPGDVEKIDTIKLYKDFLLRRGTLDIEKIRRFIQNEDCFICIDHVHGASRKRPASILGESNKISYLRTEDDYLFGGISPEPSARNIQPAMDMLKGRGNRFKLGVVIDPDGDRIRFTDGNRDITINHFGATALHFLHTYKNIFGVLVKSVATSNFGNAIAQKLSIPVKETAVGFKNFRPYMLQKASERAIVAYEESDGITGYNNTLEKDALFGLLIAIEMMAVTGKNISEYLCMLEEEFGAYYPERAGIEVARSLAGEPLAKKLSKLLERFKTGEEFLIGEKKKKIASVITTDGIKIVLDDNSWFLIRPSGTEPKVRFYTETRSQCEAAAMIDAVKSITKEALE

SEQ ID NO: 49932 - protein, 477 aa, Geobacter metallireducens GS-15
MSEELYDLIVIGAGPGGYVAAIRAAQLGMSVAVVEKRSALGGVCLNEGCIPSKALLDSSELFALARDRFAGHGIAIDPPRLDLARMMARKDDVVKKLTDGVAFLFKKNKIARVQGTARLTGERDGAHGVDVEGGDQGPGTGDREKQTLRGKRVLLATGSEAAVIPFMPFDGELVVSAREALSFDRVPEHLLVVGAGYVGLELGSVWRRLGSQVTVVEMLPKMLPNTDGQVADTLMGSLKKQGIVFRMETKVTGFAKRDGKAAVTVEAGGATEEIVCDRVLVAAGRRPLTAGLGLEELGVRLEAGRIAVDDNYQTSLRGIYAIGDLIHGPMLAHKAMAEGEVFAERLTGQASVVDYAYIPGIVYTWPEAAGVGRTEEELKTEGVEYRVGKFPFMANGRAKCMDETEGFVKILATPDTGRVLGIHVIGPRASDVIAEAVTVMTYGGSAADIAMTFHAHPTLAEAMKEAALDVEKRAIHA

SEQ ID NO: 49933 - protein, 412 aa, Geobacter metallireducens GS-15
MYVTGNLAGNTIAMVLAGGKGERLAPLTLRRPKPGVAFGGKYKIIDFVLSNMFNSGIKKVYILTQYRAYSLMKHIRESWGKWAGLGEFFVAISPETSSESEEWFKGTADAINHYLRFIESSDADYVAIFGGDHIYRMDVSQMIGYHRRNRADITIAALEVPVEEARRFGVFCVDDDNRVTAFEEKPANPVTIPGRETCFASMGNYIFSTRRLIEVLQEGKKLHADLDFGKHVIPMMLAKKDRVFAYNFNDNLIPGMKPEERGYWKDVGTIDSYYEANMELIHVSPQLNLYNYKWPILTNQGNYPPAKTVFDEDGRRGMNIDSYVCAGCITSGSVVRRSIVGPLTKVNSYSLVEDSILFENVNVGRNVKIRRAIIDKNITIPDGTTIGYDHGEDRRRGYTVTESGIVVVSPAE

SEQ ID NO: 49934 - protein, 849 aa, Oryza sativa (indica cultivar-group)
MGASRKLQGEIDRVLKKVYDTENANQKEKFEADLKKEIKKLQRYRDQIKTWIQSSEIKDKKVSASYEQALMDARKQIEREMERFKVCEKETKTKAFSKEGLGQQPKTDPKEKAKAETRDWLNNVVSDLENQIDNFEAEVEGLSIKKGKQRPPRLVHLEKSITRHKAHIKKLESILRLLDNDELSPEQVNDVKDFLDDYVERNQEDFDEFSDVEELYSTLPMEKVEALEDMVSLAPSSLVKGVASVSTTAVLSTKSSVATSPTQATVSAAPSLSVSQDQAEETASQESNPESAPQTPPSKVGSQPSVPVVPTTISTSTAAVSVSAETISSPVRPIVPTTTAAVLPASVTARSAPENIPAVTSAPANSSSTLKDDDNMSFPSRRSSPAVTEIGLGRGITRGLTSQGLGSAPISIGPVSGNGSVSALTDLSKRNMLNTDERINSGGISQQLISPLGNKAQPQQVLRTTDTISSDSSNTNESTVLGGRIFSPPVVSGVQWRPQNTAGLQNQSEAGQFCGRPEISADQREKYLQRLQQVQQQGSLLNVSHITGISQKQFPSQQPNPLLQQFNSQSSSISSQAGIGLGQVQVPESGHTKSEEQQQSFAEDVSVESVATAGANKHMSEDDTKIPFSNPSASITEGTQLSRDPDLPAGQPLQPGMSSSGVGVIGRRSVSDLGAIGDNLSVASASTSHDLLYNLQMLEAAFHRLPQPKDSERVKNYIPKHPAVTPASFPQIQAPVVSNPAFWERMGGDSLSTDLLFFAFYYQQNTYQQFLSARELKKQSWRFHRKYNTWFQRHVEPQVTTDEYERGSYVYFDFHVIDDGTGSGWCQRIKNDFTFEYNFLEDELSVQTN

SEQ ID NO: 49935 - protein, 371 aa, Glycine max
GFMIRNSRAGNLSSYGNLVGDSFGKFGKALVQICVIINNIGMLIIYMIIIGDVISGTSSSSEFHHSGVLEGWFGVHWWTGRTFVLLFTTFAVFAPLSCFKRIDSLRYTSALSFGLAVAFLVIAVGISIFKISIGGIGMPRLFPIITDVASVFELFTVTPVVVTAYLCHFNVHSIDNELEDSSQINGIVRTSLALCASVYLLTSFFGFLLFGEGTLDDVLANFDIDLGIPFGSVLNDAVRFSYAAHLVLVFPVVFYAVRINLDGLIFPSSRPLVLDNFRFASITMVLIVASFLGANFIPSIWDIFQFTGATAAACLSFIFPSAITLRDRYNIATKKDKILSVFMIVLAVLANVVAVYSDAFALIKNSITKRE

SEQ ID NO: 49936 - protein, 479 aa, Mesorhizobium sp. BNC1
MTTLHQNLIDGAWVGGEGKENINPSNIKDVVGIYAQASAEETKQAIAAAKAAFPAWSRSGILERHAILRKTADEILARKDELGELLSREEGKTLPEGIGEVTRAGQIFDFFAGAVLRLAGEVLPSVRPGIGVEITREPIGVIGIITPWNFPIAIPSWKIAPALAYGNTVVVKPADLVPGSTWAIVDILVRAGLPKGVLNLVMGKGSVVGQTMLESRDVTAITFTGSVGTGKRVAAASVELGRKFQLEMGGKNPTVVLDDADLKVAVESVTQSAFFSTGQRCTASSRVIVTEGIHDRFVEALAERIRGLKVGNALEPGIDIGPVVDANQLKQDTDYIEIGKQEGAKLVAGGERVQKETEGYFLQPALFTEATNSMRISREEIFGPVASVIRVKDYEEALATSNDTEFGLSAGIVTTSLKYATHFKRNAEAGMVMVNVPTAGVDFHVPFGGRKGSSYGPREQGTYAAEFFTVVKTAYTAAG

SEQ ID NO: 49937 - protein, 258 aa, Oryza sativa (indica cultivar-group)
MGWATRFLAAVCFFAAGVVFAPDVLLGARSGSGSGGGAAAAAKVAHLLCFATSWGAALWATFIGGIIMFKNLPRHQFGNLQGKLFPAYFMLISACAAVSVAAFAYLHPWKTASTVERYQLGFLLAALGFDLSNLLVFTPMTIEMMKKRHKIERDLSIGEEVGWSKNVQVAKNNPTLAAINKKFGMIHGLSSLANIMSFGSLAMHSCKYTDADDRLTKYLDYKEGLRERLKRSVEEDEKLICFINASIPQRLPEMVRCN

SEQ ID NO: 49938 - protein, 576 aa, Glycine max
  misc_feature (45)..(45): Xaa can be any naturally occurring amino acid
MAKSKNNAKKLSYISVPSQIINSISSSSLQSLLDSPKKSSRNTTXNRFFIFFTNTSSIIFRKPRIWFFTLFLFGFLGMLKFGLTLHTPFPPYPCATTALLPRNMISTTPHSKPSLGAVVRENNDQKKDEVLLAHVELRAQGLEKVEGDEGVEKSEFWEQPDGLGYKPCLSFSRDYRGASERVLRDRRKYLMVVVSGGLNQQRNQIVDAVVIARILGAALVVPILQVNVIWGDESEFGDIFDLKHFKRVLANDVRVVSALPSTHLMTKPVEGSPPLHVTPSWIRSRYLRRFNREGVLLLRSLDSRLSKDLPSDLQKLRCKVAFNALRFAQPIQELGDGIAERMQSKGPYLALHLRMEKDVWVRTGCLPGLSPEFDEIVNNERIQRPELLTARSSMTYHERKMAGLCPLNAVEVTRLLKGLGAPKNARIYWAGGQPLGGKKALLPLIQEFPHFYSKEDLALPGELQPFANKASIMAAIDYIVSEKSDVFMPSHGGNMGHAIQGHRAFAGHKKYITPNKRHMLPYFHNSSLPEEEFNRIMKELHQDSLGQPELRTIKAGRDVTKFPIPECMCNDSNAQS

SEQ ID NO: 49939 - protein, 364 aa, Glycine max
MGKGGMSIDEHGEGKEENMAAWLVGMNTLKIQPFKLPTLGPHDVRVRMKAVGICGSDVHYLKTLRCAHFIVKEPMVIGHECAGIIEEVGSQVKSLVPGDRVAIEPGISCWHCNHCKHGRYNLCDDMKFFATPPVHGSLANQIVHPADLCFKLPDNVSLEEGAMCEPLSVGVHACRRANIGPETYVLIMGAGPIGLVTMLAARAFGAPRTVIVDVDDYRLSVAKSLGADDIVKVSTNIQDVAEEVVQIQKVMGADIDVTFDCAGFDKTMSTALSATQPGGKVCLVGMGHSEMTVPLTPAAAREVDVVGVFRYMNTWPLCLEFLRSGKIDVKPLITHRFGFSQKEVEEAFETSARGGNAIKVMFNL

SEQ ID NO: 49940 - protein, 513 aa, Gluconobacter oxydans 621H
MPASIQSPPDLPGPGRRKTLEQVLFENDTNGLKRSLTATQLIILGVGSTIGAGIYVMTGTAAAEYAGPSVLISFVIAALACLFTAFSYGELSSTLPVSGSAYSYAYISMGEKAAWMVGWLLLLEYGISCSAVAAGLSGYASSLLGVTGFHMPSALTHATLQPVPGTAGAQISADWRFDLIGFTATLLVTALLVRGVEESARINTMIVALKVGVLFVFVALGIGAVNPANWHPFIPASEGGFHYGVRGIFRAASVIFFAYVGFEAVSTASAEARNPTRDVPIGIIGSLLICTIVYMIVATVLLGIVPYRELDVPDPLAIAVKIMHTPWLSLLVNVGATIGLCSVLMGLMYAQSRVLLTISRDGLIPQIFSVIHPKFRTPWIGTIVLGFVVALITATLPIDIISDLVSIGTAAAFGIVCFTVIWQRNTRPDIVRPFSVPLGGIRIRGIWIGTTPALGILFCLVMTIPLVSDMVHAVTSGNPVPLILLVTYLALGIATYAFYGRRHSKMRPEPPLV

SEQ ID NO: 49941 - protein, 141 aa, Nitrosomonas europaea ATCC 19718
MAVERTLSIIKPDAVAKNVIGQIYARFEAAGLKVVAARMAHLSRVEAENFYAIHRERPFFKDLVEFMISGPVMIQVLEGENAIARNRELMGATDPRKAEKGTIRADFAESIDANAVHGSDAPETAVVEIACFFPSLEIHSR

SEQ ID NO: 49942 - protein, 249 aa, Vitis vinifera
MPKIAFGRFDDSFSLASFKAYLAEFHPTILFVFAGVGSVMAYNKLTSDAALDPAGLVAVAVAHGFALFVAVAISANISGGHVNPAVTFGLVVGGQITILTGILYWIAQLVGSILACFLLKLVTGGLTTPVHSLGAGVGVIDAIVFEIVITFALVYTVYATAVDPKKGSLGIIAPIAIGLVVGANILAAGPFSGGSMNPARSFGPAVVSGDFKDNWIYWVGPLIGGGMGGSVYAIMYMGSDHQPLASSEF

SEQ ID NO: 49943 - protein, 361 aa, Nitrosomonas europaea ATCC 19718
MGEKPYRARQLLRWVHQSGKTDFMEMSDLAKGFRHKLMECAVVQLPEIVSDHTAGDGTRKWLLSTGAGNAVEMVFIPEPSRGTLCVSSQVGCALACSFCSTGRQGFNRNLSVAEIIGQLWWANRLLEAGSHDPFPLDTTRVQTDKPETRRPVTNVVMMGMGEPLANFENLVTALDLMLSDDAYGLSRRRVTVSTSGLVPALDRLRERCPVALAVSLHAPNDALRDQLVPINKKYPIRDLLAACERYLPAAPRDFITFEYVMLKGVNDSVALARELVQLVRNVPCKLNLIPFNAFSGSGYERSGAEAIGNFRDVLMQAGIVTTVRKTRGDDIAAACGQLAGQVRDKTRRTSGCGTGQPAVAR

SEQ ID NO: 49944 - protein, 116 aa, Mannheimia succiniciproducens MBEL55E
MSNIIKQLEQEQLKQNIPSFRPGDTLEVKVWVVEGAKKRLQAFEGVVIAIRNRGLHSAFTLRKVSNGTGVERVFQTHSPAIDSISVKRKGAVRKAKLYYLRERSGKSARIKERLGA

SEQ ID NO: 49945 - protein, 690 aa, Burkholderia sp. 383
MPPCPRFLDSFSGLDMTTSSPASTTLMANAIRALAMDAVQQANSGHPGMPMGMAEIGVALWSRHLKHNPTNPHWADRDRFVLSNGHGSMLLYSLLHLTGYDLPMEELKNFRQLHSKTPGHPEYGITPGVETTTGPLGQGLANAVGMALGEALMADEFNRDGAKIVDHHTYVFLGDGCLMEGISHEACSLAGTLKLNKLIALYDDNGISIDGDVVNWFHDDTPKRFEAYGWNVIPHVNGHDVDAVDAAIAKAKLSDKPTLICCKTVIGQGAATKAGGHDVHGAALGAEEIAKTREALGWTWAPFVIPQEVYAAWDAKEAGKRAETEWDATFAAYRAKFPAEAAEFERRMANQLPADWAEKAAAIIAGANERGETVATRKASQQAIEGLAAALPELLGGSADLTGSNLTNWKASKAVRANPEGPGVQLGNHINYGVREFGMSAAINGLALHGGHKPFGGTFLTFSDYSRNALRVAALMKVPSIFVFTHDSIGLGEDGPTHQSIEHVSSLRLIPNHDVWRPADTVETAVAWTHAIAADRPSSLIFSRQNLAFNPRTDAQIANIEKGGYVLKDWDEEIVARKIILIATGSEVELAMKAIEPLAQQGIAARVVSMPSTNVFDRQDAEYRERVLPHGVRRVAIEAGVTAFWHKYVGLEGGVVGIDTFGESAPAGVLFKYFGFTVEHVVETAKAVLA

SEQ ID NO: 49946 - protein, 336 aa, Burkholderia sp. 383
MTIRVAINGYGRIGRNTLRAFYENGKKHDIEIVAINDLGDAKTNAHLTQYDTAHGKFPGEVSVDGDYLIVNGDRIRVLANRNPAELPWGELGVDIVMECTGFFTTKEKASAHLKGGAKKVIISAPGGKDVDATIVYGVNHDVLKAEHTVISNASCTTNCLAPLVKPLHDKIGLETGLMTTIHAYTNDQVLTDVYHEDLRRARSATHSQIPAKTGAASAVGLVLPELNGKLDGYAIRVPTINVSIVDLSFIAKRDTTVEEVNAIMKEASEGALKGILGYNTAPLVSIDFNHNPASSTFDSTLTKVSGRLVKVSSWYDNEWGFSNRMLDTAVAFANAK

SEQ ID NO: 49947 - protein, 606 aa, Zea mays
  misc_feature (101)..(101): Xaa can be any naturally occurring amino acid
  misc_feature (477)..(477): Xaa can be any naturally occurring amino acid
KASKAGTLFSRPLAAAGGASSGSGVAALPDLRRCKSFSCGRGGDALTAAGKPQRRSCDVRGRSTLWALFHQDDRQPVRDGTAFGAFPASSSAAAAALAAKXPLAPQPPPLPPPACVPEMFSEEEIAVAEDSDEIVPVMEPVSVVGTSGEMETEVSAARDVRAMKDHIDLEASQSQQPRKLPPKDLKEMAGSFWLAASMFSKKWQKWRGKQKLKKQEAAGSKAAAAAMPPPEKPSKPSFLRRSRFRRGEAGSEFAGGRRSCDTDPRFSLDAGRMSVGDMGFSWDEPRASWDGYLFGAGTGIGLGRAPPLSRLPPILSAMEDSPAGILERSDGQIPVEDDSQPEPDHDANVPGGSAQTRDYYMDTSSRRRRSLDRSSSVRRSFEVTDPKPVPVPVPVPIPVPVTAPAAIVNGKESPAMGSSEFYHFHHAEDLFDHRFSTNSLVEDFSASLDAAFHGPAKKPPRWRKAWSLWGLIHRRAXGRRDGASDAADRAFSEPWPDLRVRGYNGRMQRCNSNASARSSFSSNSGGLGSSRRSYLDAHGKRRREECAALERNRSARHSPGNADNGLLRFYLTPIRSASGRRTGVLPVKGGRQLRSQSFARTMLGLY

SEQ ID NO: 49948 - protein, 317 aa, Mycobacterium sp. MCS
MIATIDLSRWYAGGAEADAVAAEVDEGLQQAGFILVTGHGVDPVLAADVRAAARAFFAQPHAVKSRYSVPVGGHGWIGPGAEANGYAEGTETPPDLKESFSLGADTPTGDPDIDRIWFAANVWPDEVPGLRPLVTAYTAQMRRVADDLLALFAHALRLSHNPFERLADRPTWTMNINHYPPVSVVGEPEPGQFRIGPHTDFGTVTILDREPGAGGLQVYSEADGWADAPYRSDALTVNIGDLLEYWSGRRWPSGRHRVLPPQPDAPEEDLVSLIYFYEANHDAVVTPLGPPIGRVAGLDPVTSSDFIKERLDAITVG

SEQ ID NO: 49949 - protein, 316 aa, Zea mays
  misc_feature (27)..(27): Xaa can be any naturally occurring amino acid
  misc_feature (39)..(39): Xaa can be any naturally occurring amino acid
  misc_feature (59)..(59): Xaa can be any naturally occurring amino acid
  misc_feature (104)..(104): Xaa can be any naturally occurring amino acid
MADAKQQQQQQQQQPQQAAAAATGVWXKTVKPFVNGGAXSGMLATCVIQPIDMVKVRIXQLGEGSAGQVTRNMLANEGVRSFYKGLSAGLLRQATYTTARLGSXFRVLTNKAVEKNEGKPLPLFQKAFIGLTAGAIGACVGSPADLALIRMQADSTLPVAQRRNYKNAFHALYRISGDEGVLALWKGAGPTVVRAMALNMGMLASYDQSVELFRDKFGAGEISTVVGASAVSGFFASACSLPFDYVKTQIQKMQPDANGKYPYTGSLDCAVKTFKSGGPFKFYTGFPVYCVRIAPHVMMTWIFLNQIQKFEKKIGI

SEQ ID NO: 49950 - protein, 295 aa, Zea mays
  misc_feature (232)..(232): Xaa can be any naturally occurring amino acid
MASHIILPPDDADENHNHQAAAAAEEEEEERDELGRDDDDDEHGISEADFGYVLDDVPHFTDYLPDIPTYPNPLQDHPAYSTVKQYFVNEDDTVPQKVVVQKNSRRGVHFRRAGPRQRVYFGTDEVKACIVTCGGLCPGLNTVIRELNGYKGFYSSNYLPLTPKSVNDIHKRGGTVLGTSRGGHDTKKIVDNIQDRGINQKLTDILERLIQVYIIGGDGTQKGAYEIFKEIXKRGLKVSVAGVPKTIDNDIAIIDKSFGFDTAVEEAQRAIDSAHVEACSAENGIGLVKLMGRYS

SEQ ID NO: 49951 - protein, 292 aa, Burkholderia mallei ATCC 23344
MLAGMMLIGSAVTFGVWAGRNPLVVLNAAARRPTFVGRFGLTYGAGPRRALDVYLPAAREPRPAGGGAPLVVFFYGGSWQRGRRGDYRFVGEALASRGCVVAIPDYRLYPDAVFPGFVEDAAAAVRWARDHAAALGADPRRIHVAGHSAGAQIATLLATDSRFLRAHGLDKRDLAGVVGLAGPYDFLPLEDATLKRIFPEPGRDASQPIRFVDGREPPMLLASGLRDATVKPGNTVRFASRVAAAGGAVQVRLYPGIGHALLVGALGLPMRRFLPVLDDVAAFVRAAPRAPA

SEQ ID NO: 49952 - protein, 278 aa, Triticum aestivum
GTSLSLSLSLSLSCQAHTPPALTLPSLLSPHSILLHHTKHTLSLSSPMAVAIAEAPFHVLAVDDSVLDRKLIERLLKTSSFQVTTVDSGTKALEFLGLHGEDASISSVHADQLDVEVNVNLIITDYCMPGMTGYDLLKKIKESSSFRDIPVVIMSSENIPSRINRCLEEGANEFFLKPVRLSDMSKLKPHIMKSRCKEHCHQDEDLLSNSETNPTNNSSSSSDTITISSSNPTDNSSGDTISSSNPTDNSSGESSNIHKRKAADDEILTKTSRPNHSC

SEQ ID NO: 49953 - protein, 520 aa, Burkholderia mallei ATCC 23344
MSPHPNSDNSTAQSNPPQLRRSLKARHLTMIAIGGSIGTGLFVASGASISQAGPGGAMLAYLLIGLMVYCLMMSLGEMAAFMPVSGSFATYGAKYVEEGFGFALGWNYWYNWAVTIAVELVAAQLVMHYWFPDVPGVWWSAAFLGVMFLLNVLTVRGFGEAEYWFALIKVVTVIAFIGVGLLMIFGILKGGPSNGWSNFTIGDAPFAGGLPAMMGVAMIAGFSFQGTELIGVAAGESENPRTTIPRAVRQVFWRILLFYVLAIFVIGVLIPYTDPNLLKSDVTDVGVSPFTLVFRHAGLAFAAGVMNAVILTAVLSAGNSGMYASTRMLHNLATEGRAPKLFAKLSAGGVPRNALYATTAVGALCFLSSLYGDKTVYLWLLNTSGMTGFIAWLGIALSHYRFRKGYVRQGFSVDQLPYQSSLYPYGPIFAFALCIVIALGQDYQAFLANRIDWIGVLATYVGIPLFLVVWLGYRLVHKTRVVRYEDMDIASWVAEHERAAAHEAREAAAVRVPSSPEAAS

SEQ ID NO: 49954 - protein, 202 aa, Zea mays
MAGSGSGSPPCASCKLLRRRCTQECVFAPYFPPDDPHKFAIVHKVFGASNVSKMLQELPAQQRADAVSSLVYEANARMRDPVYGCVGAISYLQQQVSQLQVQLALAKAEILCVQMQHDESAAASAAPAPAKQQQLYHHHQQQQTMECEAYGSLLVQNGLMMNTLGSAGAAHQQQQMLGGFGSAGNTAMALQEACLKKETLWA

SEQ ID NO: 49955 - protein, 237 aa, Picrophilus torridus DSM 9790
MEMYDVIKKSDLVYFDIYTSISPDKTFEDLIKINANTLKATRDVLENEGPIIERAVTENITIVVTGDALSATTHNQIRRSAIEKGIDVNIYENASIITAFPSRTGLFIYRFGSIVSMPFTSDKFFPLSVYDKIYKNYINNMHTLILLDLKDGRTMPINDALNNLLAMEDKKHKGLIKEDTLLFAGIKIGSCYEKIYFSNISKMLELDIEDSPASIIIPAELNEIELEFARSFCINVF

SEQ ID NO: 49956 - protein, 404 aa, Rickettsia sp. California 2
KIRGKIFRLPILKASIGEDVIDISRVSSEADCFTYDPGFMSTASCQSTITYIDGDKGILRHRGYDIKDLAEKSDFLEVAYLLIYGELPSIEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYKVNPIIKNALNKIFILHADHEQNASTSTVRIAGSSGANPFACVSTGIASLWGPAHGGANEAVINMLKEIGSSENIPKYIAKAKDKNDPFRLMGFGHRVYKNYDPRAAVLKETCKEVLKELGQLENNPLLQIAIELEAIALKDEYFIERKLYPNVDFYSGIIYKAMGIPSQMFTVLFAIARTVGWMAQWKEMHEDPEQKISRPR

SEQ ID NO: 49957 - protein, 140 aa, Mesorhizobium sp. BNC1
MAIERTFSMIKPDATKRNLTGAITKMLEDAGLKVVASKRVWMSRRQAEGFYAVHKDRPFFDELCEFMSSGPTVIQVLEGENAIAKNREVMGATNPANAAEGTIRKVFALSIGENSVHGSDAPETAEQEIRYWFSETEIVG

SEQ ID NO: 49958 - protein, 461 aa, Streptomyces coelicolor A3(2)
MPAVPERAPVTTRSETQSTLDHLLTEIELRNPAQPEFHQAAHEVLETLAPVVAARPEYAEPGLIERLVEPERQVMFRVPWQDDQGRVRVNRGFRVEFNSALGPYKGGLRFHPSVNLGVIKFLGFEQIFKNALTGLGIGGGKGGSDFDPHGRSDAEVMRFCQSFMTELYRHIGEHTDVPAGDIGVGGREIGYLFGQYRRITNRWESGVLTGKGQGWGGSLIRPEATGYGNVLFAAAMLRERGEDLEGQTAVVSGSGNVAIYTIEKLTALGANAVTCSDSSGYVVDEKGIDLDLLKQIKEVERGRVDAYAERRGASARFVPGGSVWDVPADLALPSATQNELDENAAATLVRNGVKAVSEGANMPTTPEAVHLLQKAGVAFGPGKAANAGGVAVSALEMAQNHARTSWTAARVEEELADIMTSIHTTCHETAERYDAPGDYVTGANIAGFERVADAMLAQGVI

SEQ ID NO: 49959 - protein, 483 aa, Oryza sativa
MSLGYAEKLSYREDVGNVGMPEIFDSPELLHKKIEELAVMVRESKHLVVFTGAGISTSSGIPDFRGPKGVWTLQRSGKGVPGASLPFHRAVPTLTHMALVELEKTGRLKFVISQNVDSLHLRSGLPREKLAELHGNSFKEICPSCKKEYLRDFEIETIGLKDTPRRCSDKNCGARLKDTVLDWEDALPPEEMDAAKEQCQTADLVLCLGTSLQITPACNMPLLSLKNGGRVAIVNLQATPKDKKASLVIHGLVDKVIAGVMYMMNLRIPPYIRTDFVQISLRNSVKKKCVRWTLRVTSIHGLRAPLPFLRSVEVSFPERPDMKPVVLKEQPFSLQRETSMNRPFVMLLTFNFSDGCGCSSSSIEWPVDFLKQKDSFVRDRSLVLQELQHAAEHRSRAGQHAILEREGVPRAETSIHALVTNIVRYDTEDSKAAVPMATWMNSNGSLSKRHMDAIGCNPASSKKQKLVATRHRRKGLNPATQKV

SEQ ID NO: 49960 - protein, 265 aa, Oryza sativa (indica cultivar-group)
MRAVLIDWLVEVTEEYRLVPETLYLTVNYIDRKYEEICPPQVEELCYISDNTYTKDEVLKMEASVLKYLKFEMTAPTTKCFLRRFLRAAQVCHEAPVLHLEFLANYIAELSLLEYSLICYVPSLIAASSIFLAKFILKPTENPWNSTLSFYTQYKPSDLCNCAKGLHRLFLVGPGGNLRAVREKYSQHKAQLPRANLMAKAHGSSSTFQFEKWRLRNLSLRKMENERRCARFCHQDDTRQLTPWDVLKAHDNEKLRASRKIVKIE

SEQ ID NO: 49961 - protein, 376 aa, Nostoc sp. PCC 7120
MARDYYEILGVARDADKEEIKQAYRRLARKYHPDVNKEPGAEERFKEINRAYEVLSEPETRARYDRFGPEGVSGAGVGFQDMSDMGGFADIFESIFSGFAGGGMGGPTQQRRRGGPARGDDLRLDLKLDFREAVFGGEKEIRISHLETCETCSGSGAKPGTRPRTCSTCSGSGQVRRVTRTPFGSFTQVSTCPTCNGTGMVIEDKCDTCDGKGTNQVTKKLKITIPAGVDNGTRLRIKDEGDAGQRGGPPGDLYVYLFVNEDEEFQRDGINVISEIKVSYLQAILGCRLEVNTVDGPVELIIPAGTQPNTVMKLENRGVPRLGNPVSRGDHLLTVLIDIPTKVIPEERELLEKLAKIKGDRTGKGGLEGFLGNLFK

SEQ ID NO: 49962 - protein, 535 aa, Picrophilus torridus DSM 9790
MKNISEIINIPEDYYDLYGRYIAKVSLNVLDYLKNKRYGKLILVTAMTPTPAGEGKTTTAIGLGNALKLLGKNAGIAIREPSLGPCFGVKGGATGGGKSTVEPSNKINLMFTGDFPAVSAAHNLLSAVINNHMYHGNELKLDPKNIVFPRTIDMDDRSLRSIIVGSGDRSTGVMMNDKYVITAASEVMAILALSRNYNELKQRLGNIMIGYNLNKAPIFARDLKVHGAMASLLVDALRPNIAQTSEHVPAIIHTGPFGNIAHGTSSILGDIIGLKMFDYLVTEAGFGSDLGFEKFIDIVLRLSDFKLSAVVLVATVRAMRYHGGGRINEPDVNAVLRGSENLMWHVQNIKKFGFNPVVAINRHSNDTDAEINAISNILTKNGVEFSISDAYSDGGHGALDLAGKVLKSISDYNPRYIYGINDDPEEKISKIAMNVYNANSVEFSHDAVKTMKLIKDDFSDLYVCMAKTQSSISDNAKLINVPEGFTVKINGININSGSGFIIPLLGNIMTMPGLPRRPASENIDIDDYGNITGLQ

SEQ ID NO: 49963 - protein, 606 aa, Oryza sativa
MPVITVAKTELFRVLGEEFTDDEFSDLCFKFGIELDDIHAEDGSKDITNVPAHKIMYKIEIPANRYDLLCIEGLSRALRIFRGRESLPNYHVSQPAQMQRMVIKESVSAVRGVVVCAVLRGMQFTQAAYDSFIDLQEKLHENICRKRTLVSIGTHDLDTIQGPFSYEALPPKEIVFAPLNKTTAVNGEQLMLDLANDNHLKKYLHIIQHLPTYPVIFDAQRRVLSLPPIINGNHSKITLDTRNVLIEITATDLTKALTVLDTMVAMFAQYCAVPFQVEPVEIVHEKTNQLQVYPQWGRWPTVTADAAKICKQVGIEQQPVADLIAMLRRMSLPARASATSATELIVDVPPTRSDVIAACDVMEDVAIGYGFERLIARKTIPHTLTSGRQQPLNKLTDQLRHVLACASYDEVLTFGLVSRKENFGSLNKPDDASAAVIANPKTQDFQIARTTLLPGLLKTLQSNKSLPLPLRVFEISDVVLKDTSVDVGAVNKRMLCAVFSDTSSGFENIHGLLDTIMIALEVPWKHRDDSKKSRVKTHESHQGPALSYEVLPSEDNTYFPGKRGDVYLNDKKIGVFGILHPEVLKNFGLTVPCSALHIEIEHFVDY

SEQ ID NO: 49964 - protein, 481 aa, Marchantia polymorpha
MASSTTTAVKQSSGGLWSKWGTGSNLSFVSRKEQQQQQQQSSPEASTPAAQQEKSISRESIPEGFLTVEEVSKHDNPSDCWIVINDKVYDVSAFGKTHPGGPVIFTQAGRDATDSFKVFHSAKAWQFLQDLYIGDLYNAEPVSELVKDYRDLRTAFMRSQLFKSSKMYYVTKCVTNFAILAASLAVIAWSQTYLAVLCSSFLLALFWQQCGWLSHDFLHHQVTENRSLNTYFGGLFWGNFAQGYSVGWWKTKHNVHHAATNECDDKYQPIDPDIDTVPLLAWSKEILATVDDQFFRSIISVQHLLFFPLLFLARFSWLHSSWAHASNFEMPRYMRWAEKASLLGHYGASIGAAFYILPIPQAICWLFLSQLFCGALLSIVFVISHNGMDVYNDPRDFVTAQVTSTRNIEGNFFNDWFTGGLNRQIEHHLFPSLPRHNLAKVAPHVKALCAKHGLHYEELSLGTGVCRVFNRLVEVAYAAKV

SEQ ID NO: 49965 - protein, 484 aa, Marchantia polymorpha
MPPHAPDSTGLGPEVFRLPDDAIPAQDRRSTQKKYSLSDVSKHNTPNDCWLVIWGKVYDVTSWVKVHPGGSLIFVKAGQDSTQLFDSYHPLYVRKLLAQFCIGELQTSAGDEKFKSSTLEYAGEEHEVFYHTLKQRVETYFRKQKINPRYHPQMLVKSAVIIGTLLLCYYFGFFWSQNVLLSMFLASIMGFCTAEVGMSIMHDGNHGSYTQSTLLGYVMGATLDLVGASSFMWRQQHVAGHHSFTNIDHYDPDIRVKDPDLRRVTSQQPRRWFHEYQHIYLGVLYGVLALKSVLIDDFSAFFSGAIGPVKIAQMTPLEMGVFWGGKVVYALYMFLLPMMYGQYNILTFIGLYILSQLVAGWTLALFFQVAHVVDDAVFPVAETDGGKAKIPSGWAEMQVRTTTNFSSRSMFWTHISGGLNHQIEHHLFPGVCHVHYPSIQPIVKATCDEFNVPYTSYPTFWAALRAHFQHLKNVGLQDGLRLDG

SEQ ID NO: 49966 - protein, 464 aa, Marchantia polymorpha
MAPNGQAVSYEGNGESKKPSFMSINSEELRKHDKVGDLWISIEGKVYDVTDWLTKHPGGENALKSLAGQDVTDAFLAFHPGTAWSLLPQFQIGVLTDYEVSPIQADYRKLLTDLKRAGLYKNPLHVYGQYLAVMIPMFVLCVLGVVYSPGFWIHIGCGVLMGFFWIQAGFMGHDIAHSGMFKTGIDKYLKLSIGCFTGIGMQWWRNNHNAHHYSCNCVDYDPDIQYMPLFAITPKFFASLYSNFYERKMDFDAAARFLVSYQHYTFYIVMALARINLYAQTLIVAFTRKMPFSTRAWELGALAFYWSWFSLLLSCLPNNYHRLAFVLSAFATTGIQHVQFVLNHFSSPVYEGRPESKTWFESQVRGSLNISSSPWTDWFHGGLNFQIDHHVFPTLPRHNLRKVAPFVKPLCDKYDLPYESVSWWEANLRVLRTLKAAAMEARDISKPAPSLSKSLIWEAANARG

SEQ ID NO: 49967 - protein, 406 aa, Arabidopsis thaliana
MSAILQGAGAATALSPFNSIDSNKLVAPSRSSLSVRSKRYIVAGSDSKSFGSSLVARRSEPLIPNAVTTKADTAASSTSSKPGHELLLFEALQEGLEEEMDRDPHVCVMGEDVGHYGGSYKVTKGLADKFGDLRVLDTPICENAFTGMGIGAAMTGLRPVIEGMNMGFLLLAFNQISNNCGMLHYTSGGQFTIPVVIRGPGGVGRQLGAEHSQRLESYFQSIPGIQMVACSTPYNAKGLMKAAIRSENPVILFEHVLLYNLKESIPDEEYICNLEEAEMVRPGEHITILTYSRMRYHVMQAAKTLVNKGYDPEVIDIRSLKPFDLYTIGNSVKKTHRVLIVEECMRTGGIGASLTAAINENFHDYLDAPVMCLSSQDVPTPYAGTLEEWTVVQPAQIVTAVEQLCQ

SEQ ID NO: 49968 - protein, 115 aa, Oryza sativa (indica cultivar-group)
MKLLAQQRDLQAKIPDIEKCLDIVATLQAKKALGEALTADFELSEGIYSRAKIEDTDSVCLWLGANVMLEYSCDEANALLKKNLENAKASLEVLVADLQFLRDQQTITQIRLSED

SEQ ID NO: 49969 - protein, 162 aa, Medicago truncatula
MAFNAAKNVRLMLAQLGGAGKRSFATSTTPKLKPMSTTIDATHDAHSTSRLSTLKAELAPVYIVCGMVGVALTIATHTAYQQLARSPNVHVSKKRRESFPEAYDPDRTINSADKFINGSFLRKMAHVQDTKPTVHDPVHPNPFTRPRTAETLKSVGVHPGRN

SEQ ID NO: 49970 - protein, 527 aa, Clostridium difficile 630
MINLEEKYLTRKDTYMIKILEYNGHIRNWKVLCEELGIDSSLCRDERERAILVEAYKTWGYDMANHMHGMFAFALWDTVEKKLFCLRDQFGVKPFYYYETENGKLLYGSSIRKIMEQPGFVKELNEDMLQIYMSFTYVAGENTFFRGVKKLMPGHYLVYQNKTVCIGRYWKPEFHPDNSKSIEEWTDEIHTTLQKIMPEVKSENETAELFLSGGVDSSYILAMSDIEKTGSCGYEEERFDESKLAQQTANILGCKNSRYIITPEEYFASVPYVMYHMEQPTGDASAIVFAIGCKAAAENTNICYSGEGADEFFGGYNIYHKAECYGENLKTFYIGNTNIMNEGEKRKILKKYNPDVLPIEVVKGIYEETEELDTLTNMSNVDIQIWLEGDIYFNIDKMSTAVGLEVRMPLTDTRIFDIASRIPSEYKVKGKENKIAFRTAASKTLPEEIAFRNKLGFIVPIRIWMADDQYNKDIRDKFNSEIADKFFNIDEINEIFNDYISGNSDNWRKIWMIYTFLVWYEIYFVKC

SEQ ID NO: 49971 - protein, 247 aa, Triticum aestivum
MSSSSKLFQSACKAARSFLASSSAPAAAPRAASSVLADGRNAALATLANLGRNSTLPAAYAHHLHTNAASSQGYAWIAAIPAAVYMLQDQEVHAAEMERTFIAIKPDGVQRGLISEIVSRFERKGYKLVAIKLVVPSKQFAEKHYHDLKERPFFNGLCDFLSSGPVLAMVWEGEGVIKYGRKLIGATDPSKSEPGTIRGDLAVVVGRNIIHGSDGPETAKDEIALWFQPKELVSYTSNEEKWIYGVN

SEQ ID NO: 49972 - protein, 172 aa, Oryza sativa (japonica cultivar-group)
MQDPEEEDDDQQQQHPAARRCAACRYLRRRCADDCVLAPFFPASRPHRYACVHRVFGASNVARLLQSLPMAERGNAANTMAMEAYWRVQDPVYGCTGIINRLQEEIRAVQCELARTQAHLAIAVASSQQPPPPPPPPPLPSPPPPPPPQQQEEQSPPPLLDPADEFLNLDGL

SEQ ID NO: 49973 - protein, 469 aa, Oryza sativa (japonica cultivar-group)
MPPTMLASVPTRPRSHPFRRRRGAAAAAPPLLPDQIAAAAAAAAKRPAESSTSASSCFHSEVISATSTTCPTSLAAAQRPEKRPRYQDVDEEQPAASECSEIIGGARPRAAEVEVSESSCLASVLESYLACPEQLANDAETTAYSSAREDLTLSETEEEEEEEEVRSGPCICTDCSFSPLHESSSSSDDDNAVPSPTFSLFLALAEQFVPFTHPKTPTATDVALQAGEGKRFEDLDNEVSYERFRRRERRGVVARDYIEVYSSMLGSYGRAVVEQRVVMVNWIMEHSQAMKLQPETVFMGIGLMDRFLTRGYVKGSRNLQLLGIACTTLATRIEENQPYNCILQKAFKVGINTYSRSEVVAMEWLVQEVLDFQCFVTTTHHFLWFYLKAANADDRVEDLAKYLALLSLLDHKHLSFWPSTVAAAVVALACLATNNESSCHLVMETHMRTKNDDLPECLMSLEWLTNYAS

SEQ ID NO: 49974 - protein, 304 aa, Shewanella oneidensis MR-1
MPETALLEEVVDRVRPLLGQGKVANYIPALANIDPGKLGIAVTTIDGETIGAGDYLEPFSIQSISKVFSLTLALTLYEETEIWSRVGKEPSGHSFNSLVQVELERGKPRNPFINAGALVIADLLQSRLGAPKHRMLELVRALSQNDKVCFDKQVADSEYQHSARNAAIAYLMKSFGNFQGDVDTVLRTYFHYCALKMNCADLSKAMLYLANRGKTLDGTELISQVQTRQLNALLATSGLYDGAGEFAYRVGMPGKSGVGGGIIAVIPGELSVCVWSPELDTQGNSLAGTAMLEQLSQRLGRSIF

SEQ ID NO: 49975 - protein, 270 aa, Triticum aestivum
MAAADDIGASAGRWSLHGRRALVTGGTRGIGRAVVEELAALGAAVHTCSRKEAELGERLKEWEAKGFRVTGSVCDVSVRDQRELLLQDVAGRFAGKLDILINNVGTNHRKPTTEYSADEYSFIMATNLESAYHLCQLAHPLLKASGVASIVFISSVSGVVAISSGSIYGMTKGAMNQLAKNLACEWAKDNIRINSVAPWYIKTSLVEEDLAKEDFVDSIARRTPMRRVGEPEEVSSLVAFLCMPGSSYITGQTISVDGGMTINGMYPTEN

SEQ ID NO: 49976 - protein, 540 aa, Parvularcula bermudensis HTCC2503
MHGLMMETPLLVTEILRHAVRSSPNQEVVTRLVEGGMHRYTFKEAGERIAQLAHALVALGVGEGDRVGVMGWNTHRQLELYYATAGIGAVCHTINPRLGPENAGYVMNHARDKVVFYDETFLPLVKGLAPHLATVESYIALSATGALPEIGDKPVHNYESLIEKHPTTYDWPEFDERTACGLCYTSGTTGRPKGVLYTHRSTVLHALVLAQPNVGAFDRGDALLPVVPMFHVNAWGVPYAALMMGVKLVMPGPGLDGESLYEIFESEQVAYALGVPTVWLNLLNYVDQNNLSFSSLKHTMVGGAALSERIIKGFERHGVRVRQGWGMTEMSPIGTTNVEEDDWSELPEEERVQIQLRQGKAVPFMQMRIVDDEGNCLPHDGESDGHLQVKSPWVLSAYYEYDGQTLTDDGWFDTGDVVVIHPDGRMQITDRAKDVIKSGGEWLSTIDIENAALSHPAVANAAVIGMPHPKWQERPLLIVEMAKGANAEPAEILEFTRQQLPKISWPDDVQTVETIPLGATGKVLKTELRKQFADFTLPTV

SEQ ID NO: 49977 - protein, 359 aa, Hordeum vulgare subsp. vulgare
MIEGAGSIVDAHTVEVTQPDGSKQRHTTKHILIATGSRATLVNIPGKELAITSDEALSLEELPKRAVILGGGYIAVEFASIWKGLGAQVDLFYRKELPLRGFDDEMRTVVASNLEGRGIRLHPGTNLTELSKTADGIKVVTDKGDEFIADVVLFATGRAPNSNRLNLEAVGVEVDQIGAIKVDEYSRTSVPNIWAVGDVTNRINLTPVALMEATCFAKTVFGGQTVKPDYKDVPCAVFCIPPLSVVGLSEQEALAEAKNDLLVYTSSFNPMKNSISKRQEKSIMKLVVDAETDKVLGAAMCGPDAAEIMQGIAVALKAGATKATFDSTVGIHPSAAEEFVTMRTLTRRVSPASKPKTNL

SEQ ID NO: 49978 - protein, 731 aa, Burkholderia mallei ATCC 23344
MNARRRFLQGTATTGIAAATLAAFPLSIRRALAIPANNRTGTIRDVEHIVILMQENRSFDNYFGTLRGVRGFGDRFGIPLPNALTVWQQRNATGALVLPYHLDGSKGNAQRVSGTPHSWDDGQNAWDGGRMYQWPRYKNTASMGYFRESELPFQFALANAFTICDAYHCSMHAGTNSNRMFMWTGTNGPTGAGVASVVNEWDDIGPSTFGYEWKTYPERLQEAGVSWKVYQNMPDNFTDNALAGFRQYRRANEASGKPVSNSDKVVSPAYDPASDDVRNPLYKGIANTMPDGGFLGAFKEDIRAGKLPQVSWVVAPAAYSEHPGPSSPVQGAWYIQEVLDALTATPDVWSKTVLLVNFDENDGYFDHVPSPSAPSLNPDGSPAGKTTLPEADIAFERFTHPKPPGTKSQPQPDARVYGPGVRVPMYVISPWSRGGWVNSQVFDHTSTLRFIEARFGVREPNISAFRRAVCGDLTSAFNFVRPNNEPLPTLAGRKTRAQADALRAAQQQMPQIVPPANGLLPRQETGTRPSRALPYELHVNAVARTLDGTLRLVFANTGQAAAVFHVYDKLNLGRLPRRYMVEAGKQLDDVWAAMTDNGGKYDLWVLGPNGLHRHFTGDMNRLRAGGAPVPEVRVEYDRQHGNVQLLLRNEGARECVFTVRAKAYRDDGPWTFKVKGGAERKHHWKLDGSGNWYDFVVTCDADTGYSRRFAGRVETGEHSVSDPAMGFGDRF

SEQ ID NO: 49979 - protein, 254 aa, Hordeum vulgare subsp. vulgare
MRTVVASNLEGRGIRLHPGTNLTELSKTADGIKVVTDKGDEFIADVVLFATGRAPNSNRLNLEAVGVEVDQIGAIKVDEYSRTSVPNIWAVGDVTNRINLTPVALMEATCFAKTVFGGQTVKPDYKDVPCAVFCIPPLSVVGLSEQEALAEAKNDLLVYTSSFNPMKNSISKRQEKSIMKLVVDAETDKVLGAAMCGPDAAEIMQGIAVALKAGATKATFDSTVGIHPSAAEEFVTMRTLTRRVSPASKPKTNL

SEQ ID NO: 49980 - protein, 367 aa, Vibrio sp. Ex25
PADYNGIKVFIESGRDADEIITEKIETQISTLTAQDVKSVDFDQAVEDKLIEIINPMNEFVDSIIDFIDIEAIKKANLRVLIDPMFGVAKNALQTVLINGRCEVDVINDGKNPDFGGLMPSPSAATLYRLMHLVEQEGYDIGIGTDGDADRLGIIDEKGNFIHPNEVLILLYYYLLKYKGWKGSVVRNIATTHLLDKIAEDHGEKCFEVPVGFKHISSQMEADDSLIGGESSGGLTIRGHIKGKDGVFASSLLVEMISVTGKKLSELLDEIYGKYGYAYMAEGDCKFKPAQKEVLFNKIYVEKQLPEFEFDIEKVSYEDGAKVYFKNGGWIIARFSGTEPLLRIFAEMQDKDTAERVLQQFKEFLSL

SEQ ID NO: 49981 - protein, 117 aa, Bacteroides thetaiotaomicron VPI-5482
MDLIKIAEEAFATGKQHPSFKAGDTVTVAYRIIEGNKERVQLYRGVVIKIAGHGDKKRFTVRKMSGTVGVERIFPIESPAIDSIEVNKVGKVRRAKLYYLRALTGKKARIKEKRVNN

SEQ ID NO: 49982 - protein, 245 aa, Xylella fastidiosa Dixon
MEIATVTRVNSTQPANACAPSHIPIIIDNPMSEAKRRAAEKAIEYVENDMIIGVGTGSTVAYFIDALGRTPKRIKGAVSSSEQSTAHLKQHGIEVLELNHTGTLPLYVDGADECDPYKRLIKGGGASLTREKIIAEASKQFICIIDPNKQVATLGKFPLPIEVIPMARSLVARQIMARTDGQPVWREGVITDNGNVILDVHHLCITDPVKLEQELNQIPGVVCVGLFARRCADLVIIGSEPPHIL

SEQ ID NO: 49983 - protein, 303 aa, Gluconobacter oxydans 621H
MTEGETMADTSMYQGSLTALVTPMHTDGRIDFDVSAKLIERQIEAGTTALIPAGTTGESPTLSHEEHGRVVAHCVETANGRVRVMAGAGSNSTSEAVLMAKHAHSVGADSVLVVVPYYNKPTQEGLYRHFMTIADATPLPMFLYCIPGRSVVDISVATMARLAEHPNIVGTKDATANMARPIAVRRAVDKPFNQLSGDDNSVLSFLAAGGDGCIGVTSNVVPHLCADMHLAWQEGRIEDAIAIQDHLTPLHDAMFMESNPGPVKYALSRLGLCNATLRLPLVEPQEETRRAIDAALRSLELLD

SEQ ID NO: 49984 - protein, 419 aa, Candidatus Kuenenia stuttgartiensis
MPEKMEENSPWQTALTQFNNVSKRMNLPEDIHQILKHFSRILTVSVPVRMDNGSTASFEGFRVQHCSAKGPYKGGIRYHPDLTLDDLKALAMEMTWKCSLVDIPFGGAKGGVVCDPKKLSRGELERITRRYTYAIQPIIGPDIDIPAPDVNTNEQIMAWIMDTYSMNKGFCSPGIVTGKPLNIGGSLGRADATGLGVAYIAASAVRQNKKTLKGLNVVIQGYGNVGSAAGKFLEEMGCKIVAVSSSTGGIYNPGGLSHNAIIEHYRKTGGFRYFPLAENITNAELLELPCDVLIPAAMGGQITKKNAGKIKAKLIVEGANGPTTPEADEILSGRKIKIVPDILANAGGVIVSYFEWVQDAQCYFWCKNEVNAKLKILLERSFNDVYAFAQKNKYSLRTSAMMLAIKKVADVFTVRGLYP

SEQ ID NO: 49985 - protein, 341 aa, Arabidopsis thaliana
MAAKLISTGFRHTTLPENYVRPISDRPRLSEVSQLEDFPLIDLSSTDRSFLIQQIHQACARFGFFQVINHGVNKQIIDEMVSVAREFFSMSMEEKMKLYSDDPTKTTRLSTSFNVKKEEVNNWRDYLRLHCYPIHKYVNEWPSNPPSFKEIVSKYSREVREVGFKIEELISESLGLEKDYMKKVLGEQGQHMAVNYYPPCPEPELTYGLPAHTDPNALTILLQDTTVCGLQILIDGQWFAVNPHPDAFVINIGDQLQALSNGVYKSVWHRAVTNTENPRLSVASFLCPADCAVMSPAKPLWEAEDDETKPVYKDFTYAEYYKKFWSRNLDQEHCLENFLNN

SEQ ID NO: 49986 - protein, 349 aa, Mycobacterium sp. MCS
MTQLIERPTGADDHDRFFTDVPTVTELTMVQAINRALHDAMAADDRVLVFGEDVATLGGVFRVTDGLSETFGEQRCFDTPLAESAIVGIAIGMAIRGFVPVPEIQFDGFAAPAFDQVVSHLAKYRMRTRGDVDMPVTIRIPSFGGIGAVEHHSESTETYWLHTAGLKVVTPSSPTDAYWLLRHAIAARDPVIYLEPKRRYWARGAVDTTEPGLPIGRAAVRREGTDVTVLTYGPLVATALSAAEHAAAESDWSLEVVDLRSLNPLDFDTVAASVGKTGRAVVMHEGPRTLGFGAELAARISEELFYDLEAPVLRATGFDTPYPPARLEKLWLPGVDRLLDCVQRTLEMP

SEQ ID NO: 49987 - protein, 453 aa, Coccidioides immitis RS
MATVTVANSAPCLRGLATLARSLNSAGRIIPQWQPLACVVSSGRRLGDNRLFQSSSQASSRPRMSYRIAVSSSGKGRRFSPDRNVCSFDPETQDAIGLQQGRNYLERKLSRPDSGEDAFFVSKIDHHPNAFAFGVADGVGGWTQSGVDPADFSHSFCSYLAECALKWDASAHELRARALMQMGYERTLADRTIFAGSSTACIGVACEDGTVQLANLGDSGSVLFRLAAVHHYSTPQTHDFNTPYQLSVMPPLIRMQSAIFGGRQYEDLPQDANVTNYRLQHGDVLLLATDGVYDNLNNQDILTLVTGRMMATGAWNGTADMGIGVSDGLNALTQPAGLSSAFSSLKSRPHSHRSRHHPHHHHHHHHHQQHANPEQPSSAKAIDAHTRNHTLQALLAVTIAGEAKIASMDFRRDGPFAKESQRYRPWDHWRGGKPDDICVIVVIAVEEGRDVVD

SEQ ID NO: 49988 - protein, 360 aa, Arabidopsis thaliana
  misc_feature (324)..(324): Xaa can be any naturally occurring amino acid
MEGDVGIGLVCQNTMDGKASNGNGLEKTVPSCCLKAMACVPEDDAKCHSTVVSGWFSEPHPRSGKKGGKAVYFNNPMWPGEAHSLKVEKVLFKDKSDFQEVLVFESATYGKVLVLDGIVQLTEKDECAYQEMIAHLPLCSISSPKNVLVVGGGDGGVLREISRHSSVEVIDICEIDKMVIDVSKKFFPELAVGFDDPRVQLHIGDAAEFLRKSPEGKYDAIIVDSSDPVGPALALVEKPFFETLARALKPGGVLCNMAESMWLHTHLIEDMISICRQTFKSVHYAWSSVPTYPSGVIGFVLCSTEGPAVDFKNPINPIEKLDGXAMTHKRELKFYNSDMHRAAFALPTFLRREVASLLAS

SEQ ID NO: 49989 - protein, 500 aa, Atriplex prostrata
MAFPIPVRQLFIDGEWREPLLKNRIPIINPSTEEIIGDIPAATAEDVEVAVVAARKAFKRNKGRDWAATSGAHRAKYLRAIAAKITERKDHFVKLETLDSGKPFDEAVLDIDDVASCFEYFAGQAEALDAKQKAPVTLPMDRFKSHVLRQPIGVVGLISPWNYPLLMATWKIAPALAAGCTAVLKPSELASVTCLEFGEVCNEVGLPPGVLNILTGLGPDAGAPIVSHPDIDKIAFTGSSATGSKIMASAAQLVKPVTLELGGKSPVIMFEDIDIETAVEWTLFGVFWTNGQICSATSRLLLHESIAAEFVDRMVKWTKNIKISDPFEEGCRLGPVISKGQYDKIMKFISTAKSEGATILCGGSRPEHLKKGYYIEPTIITDITTSMQIWKEEVFGPVICVKTFKTEDEAIELANDTEYGLAGAVFSKDLERCERVTKALEVGAVWVNCSQPCFVHAPWGGVKRSGFGRELGEWGIENYLNIKQVTSDISDEPWGWYKSP

SEQ ID NO: 49990 - protein, 270 aa, Mycobacterium sp. MCS
MTFAQKYGPWAVVAGASDGLGAAFAERIAENGVNVVLLARRQSVLDDVAAGIRDRTGVETRTLAIDLTDPAATGAVADATDDLEVGFLVYCAGADPAFEPFLAQPIEAAEAMVQRNCVAPMRLCHHFAPAMAARGRGGLVIFGSGAGLAGGPNMVAYAATKAFDMVFAEALWAELHDTGVDVLGLILGKTDTPALRTLEHRRGQIASTEQTPPGAVPVAGVVSEAFDNLANGPTWIVGEDLRAATQMMGSISRSDAVRFIVEASRDAMGP

SEQ ID NO: 49991 - protein, 549 aa, Triticum aestivum
  misc_feature (217)..(217): Xaa can be any naturally occurring amino acid
  misc_feature (257)..(257): Xaa can be any naturally occurring amino acid
MSGPRQGSSQPQFMTSVGQNNNLSNGPGTPLIDSIDVDQIVIPEKNSWKNLFSYIGPGFLVSIAYIDPGNFETDLQAGAQYKYELLWIILIASCAALVIQSLAASLGVVTGKHLAEHCRAEYPKVTNFILWILAELAVVACDIPEVIGTAFALNMLFKIPIWCGVLITGLSTLMLLFLQQYGVRKLEFLIAFLVFLIATCFLVELGYSKPNSSEVVXEGLFVPEIKGDGATGLAISLLGAMVMPHNLFLHSALVLSXKVPRSVHGIKEACRFYMIESAFALTVAFLINISIISVSGAVCSADNLNPEDRMNCNDLDLNKASFLLKNVLGNWSSKVFAIALLASGQSSTITGTYAGQYVMQGFLDLRMTPWLRNLLTRSLAIVPSLIVSLIGGSSAAGKLIIIASMILSFELPFALVPLLKFTSSKTKMGPHTNSRFIAVLTWAIGSFIMVINIYFLITSFVRLLLHSGLSTVSQVFSGIFGFLGMLIYIAAILYLVFRKNRKCTLPLLESDAKLGDAGHTEGEGSLGHLPREDISSMQLPHQRAASDLD

SEQ ID NO: 49992 - protein, 81 aa, Brassica napus
IVGVVFNYFVFKNYKKWWQRYNYVLSAALDAGLAFMGVLLYFSLTMNGISIGHWWGAEGENCPLASCPTAPGVHVEGCPVF

SEQ ID NO: 49993 - protein, 720 aa, Phytophthora cinnamomi
MSQVLQHPRVFTFVKGESKGNGSMKPLLGGKGANLCQMARNGVNVPPGLTITTEVCQEFYAVGGRLPDGLMDEVRKGVHLMEKTLGVTFADATNPLLVSVRSGAAISMPGMMDTVLNLGLNDEIVKGVAKRGGERFAFDCYRRLLQMFGDVVLEIPHDDFEAELSAMKQARHVTFDVELTASDLKELVHKYKKVYEKHGRSFPSDPWEQMRMGIEAVFRSWNIPRAVKYREINKITGLKGTAVNVQAMVYGNINDQSCTGVLFTRNPANGENKLYGEFLLNAQGEDVVAGIRTPQPISELAQKMPTVYKQLDETVHTLETHFKDVQDTEFTVQDGVLFMLQTRNGKRTGPAALKIAVDMWREKLITEEEAVMLVEPRHLDQLLHPSFANEKGYQKDVLCRGLPASPGAAVGKIVFTAADAEAWFARGENVMLVREETSPEDVGGMHAAEGILTSRGGMTSHAAVVARGWGKPCVCGCSALSIDANSKTMRVHTASGAEVVLREGDYISVNGTTGEVIKGEQELQKAAMSGDLAQFMKWVDAHRRMEVFTNADTPEDAREARAHGAQGIGLTRTEHMFFSSAQRIAAVRRMIGAVELDSPAQQEALDALCTFQQGDFEGIFRAMDGLPVTIRMLDPPLHEFLPHEGSALEELCETLAKEMKVSKATVQSRLAGLKEANPMMGLRGCRLGIVHPGITEMQAKAIAEAAVKVAGEGISVHPHI

SEQ ID NO: 49994 - protein, 503 aa, Yersinia pestis KIM
MFVPQPSNKPLSLMLAGLSVKKTAADSFMKCVVYSHQCVISATEGRMEQQLQNSSLKRGLKNRHIQLIALGGAIGTGLFLGIAQTINMAGPSVILGYAIGGFIAFLIMRQLGEMVVEEPVAGSFSHFAYKYWGDFAGFLSGWNYWAMFILVGMAELTAVGIYIQYWWPEIPTWVSAAVFFIIINAINLVNVRLYGETEFWFAIIKVAAIIGMIVFGAYLLASGSGGPAASVTNLWAQGGFMPHGFRGLIMAMAVIMFSFGGLEMVGITAAEAEDPRNSIPKATNQVVYRILIFYIGSLTVLLSLFPWNNVVEGGSPFVMIFDALDSPWVATALNVVVLTAALSVYNSGVYCNSRMLFGLASQGNAPKLLTKLNKRGVPIRSIALSALATSAGVVINYIMPGKAFELLMALVVSTLVINWVMICLAHLKFRKAKVKEGVVPRFKALWYPYGNYLCLVFLALILVIMYLTEGIRISVLMMPVWIALLWCGFVLTRRKCPKTVTSL

SEQ ID NO: 49995 - protein, 900 aa, Phytophthora cinnamomi
MSQVLQHPRVFTFVKGESKGNGSMKPLLGGKGANLCQMARNGVNVPPGLTITTEVCQEFYAVGGRLPDGLMDEVRKGVHLMEKTLGVTFADATNPLLVSVRSGAAISMPGMMDTVLNLGLNDEIVKGVAKRGGERFAFDCYRRLLQMFGDVVLEIPHDDFEAELSAMKQARHVTFDVELTASDLKELVHKYKKVYEKHGRSFPSDPWEQMRMGIEAVFRSWNIPRAVKYREINKITGLKGTAVNVQAMVYGNINDQSCTGVLFTRNPANGENKLYGEFLLNAQGEDVVAGIRTPQPISELAQKMPTVYKQLDETVHTLETHFKDVQDTEFTVQDGVLFMLQTRNGKRTGPAALKIAVDMWREKLITEEEAVMLVEPRHLDQLLHPSFANEKGYQKDVLCRGLPASPGAAVGKIVFTAADAEAWFARGENVMLVREETSPEDVGGMHAAEGILTSRGGMTSHAAVVARGWGKPCVCGCSALSIDANSKTMRVHTASGAEVVLREGDYISVNGTTGEVIKGEQELQKAAMSGDLAQFMKWVDAHRRMEVFTNADTPEDAREARAHGAQGIGLTRTEHMFFSSAQRIAAVRRMIGAVELDSPAQQEALDALCTFQQGDFEGIFRAMDGLPVTIRMLDPPLHEFLPHEGSALEELCETLAKEMKVSKATVQSRLAGLKEANPMMGLRGCRLGIVHPGITEMQAKAIAEAAVKVAGEGISVHPHIMIPLVGSFEELEQQVKLVKSVVQDVIGKRGKSFDYKVGTMIEVPRGALQAGKLAEVAEFFSFGTNDLTQMTFGISRDDAQAKFLSYYVKHGVLEKDPFETLDQEGVGELVRLAVERGRATRPKIELGICGEHGGDPQSIEFFEKVGLKYVSCSPMRVMIARLAAAQAALKLKKSSPVPGA

SEQ ID NO: 49996 - protein, 284 aa, Haloarcula marismortui ATCC 43049
MQTGFVELFVDLVGTDPLINGLVGGVIIATMNLFGASLVLVWRDPSERALDTALGFAAGVMLAAAFTSLIIPGIEEYSGGNPIPTLVGVALGALFLDRADGLVPHAHYLLTGSRRSDAANPSQDLSVDESKLAGVVLFILAITLHNIPEGLAVGVGFGAAAGDPLQIGSALSLMLAIGIQNIPEGLAVSVAAINAGLDRRLYAVFSGIRSGVVEIPLAVLGAVAVVTIEPLLPYAMGFAAGAMLFVISDEIIPETHQRGYERVATLGLMAGVIVMLYLDIALAA

SEQ ID NO: 49997 - protein, 515 aa, Picrophilus torridus DSM 9790
MFYNENTYIKMKASGKEDEFDKKYEEALESVKGYFGKEYPNIIINDVNEEKKIKDISPIDESELAEFQLASKESIERAIDILSSGYKKWFQVPYDARVNIIEKALRMLQERKFEFAALLTYENGKNRYEAMGDVDEAIDFMKYYSMSMIENHGFIKFTGKAYENEESMSFMKPYGLFAVISPFNFFSIGVGMTTGPLITGNAVLLKPSSDIPLSLYLFVRLLIEAGVNKDAIAFVSGTGSLIGDIITENKKVSGVVFTGSRDVGLRIFKNATKYGPKPVITEMGGKDAVIISDKADLKKAVEGCVRSSFGFAGQKCSASSLIYVHEKIYDEFIEKFVERTKSIKVGDPREKSTFMNPVVNKDAYEKYKKMCDTYFKEGKILTGARIMDRKGYYVEPTVITDLKPDSYIVRNEIFLPAVAIIKVKSIDDAINDINSMDYGLTGGIFTEDPEEYQHYFESVDVGVVYANRAAGASTGAMVGSQPFVGWKLSGSTGKGTGSFYYLTQFLREQSITIAH

SEQ ID NO: 49998 - protein, 360 aa, Candidatus Kuenenia stuttgartiensis
MGVLTGGGDCPGLNAAIRAIVKSAVQKHNISVIGIEDGYDGLILPNKTRKLTPFNSRGILHVGGTILGTSNRANPFKYRITVNGKTEVRDVSSEVIQKTKLLELDALIVIGGDGSMNIASHLYDMGCPVVGVPKTIDNDVLFTDASFGFSTAVQIATEMLDRLHTTAESHHRVMVMEVMGRYAGWIAVASGIAGGADVILIPEIPYDREEVCQKILRRQKKGCRSSIVVVSEGAKEIGGALCILQSAEEGGSAERLGGAGEKAGLYIKKNTGIDVRVTTLGHVQRGGTPDAPDRILSTRFGAAAVNLIINNQFGRMVCLKGQDIESVPLSSVAGGQKKVPTETGLVITAEEIGVNFGRKA

SEQ ID NO: 49999 - protein, 159 aa, Vibrio sp. Ex25
MNQVWVTGDAVVDLIPESETSLLKCPGGAPANVAVAIARLSGKSAFFGRVGDDPFGRFMKSTLDQEGVCTEFLVKDPEQRTSTVVVDLDDQGERSFTFMVKPSADQFMSVEDIPNFKQGDWLHVCSISLANEPSRSSTFEAIKRAKAAGGFISFDPTCV

SEQ ID NO: 50000 - protein, 337 aa, Anabaena variabilis ATCC 29413
MIRVAINGFGRIGRNFARCWLGRENSNIELVAVNDTSDPRTNAHLLKYDSMLGKLKNVDITADDNSITVNGKTIKCVSDRNPENLPWKEWEIDLIIESTGVFTSKEGALKHVNAGAKKVLITAPGKNEDGTFVIGVNHHDYDHNVHHIISNASCTTNCLAPIAKVLNDKFGIIKGSMTTTHSYTGDQRLLDASHRDLRRARAAAINIVPTSTGAAKAVALVIPELKGKLNGVALRVPTPNVSMVDFVVQVEKRTITEEVNQALKDASEGPLKGILDYSELQLVSSDYQGTDASSIVDASLTLVMGNDLVKVMAWYDNEWGYSQRVLDLAELVAEKWV

SEQ ID NO: 50001 - protein, 446 aa, Oryza sativa (japonica cultivar-group)
MACSFHFVPLLLLLTLLLLISSASRTAALPSMRSSSEDTASNATAAARLRPGKELLKYKRIRALLKKLNKPSLKTIQSPDGDLIDCVPSHLQPAFDHPKLKGQKLLDPPERPKNYNLTIAVSSSSSSRVGEVVVQAWHAAGEECPEGTVAIRRTTEKDLLRASSLRRYGRKPARRNIRRDSTSNGHEHAVGYVNNDNYYGAKASVNVWSPRIGDPSEFSLSQIWVISGSFGNDLNTIEAGWQVSPELYGDSNPRFFTYWTVEFEVICTYNFQTDAYQETGCYNHNCRGFVQTTNKIAIGAAITPESVYNGRQFDITLMLWKDPKHGHWWLELGPGMVVGYWPSYLFTHLAHHGNMVQFGGEVVNTRPSGSHTATQMGSGHFPGEGFDRAAYFRNLQVVDWDNSLIPAANLKLLADHPACYDIQGGSNSYWGSYFYYGGPGRNVKCP

SEQ ID NO: 50002 - protein, 346 aa, Magnaporthe grisea 70-15
MGLAAPKNKRKLGNDPNNTRWSRNTENFGHRMLRSQGWEPGQYLGPQDASHAVYHTAASASHIKVALKEDNLGLGAKMNRGDECTGLNAFKEMLARLNGKSEAAIEKDKKAREAHAMNVYVERKFGTMRFVSGGFLVGDVIQEKKEDAEAESTDGTPEPAEATVKKEKKRKAGRDDDDEAQSKEERRRAKKQKKSMKETGSGGDDVTSEEDSAKSKSKKSHKSKKEKKRRKEEPASDEQESEDEESREKRRKKEKKERKERRREKREKKLKKKQQREEDSSSSEANSDDETTGVDTGASTPVASGTSTPVSQVSVRHLARRRFIAQKRMAMKDQQALNQIFMIKSS

SEQ ID NO: 50003 - protein, 176 aa, Triticum aestivum
  misc_feature (22)..(22): Xaa can be any naturally occurring amino acid
MAPTVMALWATSVAPFQGVKSXTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 50004 - protein, 864 aa, Arabidopsis thaliana
MAPKKIGAGKGDSSILAKISNYDIVSQGRRAACDAVYVSKKLLKSTGKAAWIAGTTFLILAVPLILELEQDHRLGEIDFEQASLLGTPPVERYIDQKYALHKQIYHQFFTTFSSLRKVENPLCYCRNLLKMAPNLRIKKACDAMKLLGISETKTRAFLRKLLKTYENNWDFIEEDAYKVLLDAIFDEADAQSTEKNKKEEEKKKKEEEKKSRSVATSRGRRKAPEPLVQDEEDDMDEDEFPLKRRLRSRRGRASSSSSSSSSYNNEDLKTQPEEEDEDDGVTELPPLKRYVRRNGERGLAMTVYNNASPSSSSRLSMEPEEVPPMVLLPAHPMETKVSEASALVILNDEPNIDHKPVISDTGNCSAPMLEMGKSNIHVQEWDWETKDILNDTTAMDVSPSSAIGESSEHKVAAASVELASSTSGEAKICLSFAPATGETTNLHLPSMEDLRRAMEEKCLKSYKIVHPEFSVLGFMKDMCSCYIDLAKNSTSQLLETETVCDMSKAGDESGAVGISMPLVVVPECEISGDGWKAISNMKDITAGEENVEIPWVNEINEKVPSRFRYMPHSFVFQDAPVIFSLSSFSDEQSCSTSCIEDCLASEMSCNCAIGVDNGFAYTLDGLLKEEFLEARISEARDQRKQVLRFCEECPLERAKKVEILEPCKGHLKRGAIKECWFKCGCTKRCGNRVVQRGMHNKLQVFFTPNGKGWGLRTLEKLPKGAFICEYIGEILTIPELYQRSFEDKPTLPVILDAHWGSEERLEGDKALCLDGMFYGNISRFLNHRCLDANLIEIPVQVETPDQHYYHLAFFTTRDIEAMEELAWDYGIDFNDNDSLMKPFDCLCGSRFCRNKKRSTKTMQILNKA

SEQ ID NO: 50005 - protein, 526 aa, Arabidopsis thaliana
MTGGGFATSANGVEFEAKITPIVIISCIMAATGGLMFGYDVGVSGGVTSMPDFLEKFFPVVYRKVVAGADKDSNYCKYDNQGLQLFTSSLYLAGLTATFFASYTTRTLGRRLTMLIAGVFFIIGVALNAGAQDLAMLIAGRILLGCGVGFANQAVPLFLSEIAPTRIRGGLNILFQLNVTIGILFANLVNYGTAKIKGGWGWRLSLGLAGIPALLLTVGALLVTETPNSLVERGRLDEGKAVLRRIRGTDNVEPEFADLLEASRLAKEVKHPFRNLLQRRNRPQLVIAVALQIFQQCTGINAIMFYAPVLFSTLGYGSDASLYSAVVTGAVNVLSTLVSIYSVDKVGRRVLLLEAGVQMFFSQVVIAIILGVKVTDTSTNLSKGFAILVVVMICTYVAAFAWSWGPLGWLIPSETFPLETRSAGQSVTVCVNLLFTFIIAQAFLSMLCHFKFGIFIFFSAWVLIMSVFVMFLLPETKNIPIEEMTERVWKKHWFWARFMDDHNDHEFVNGEKSNGKSNGFDPSTRL

SEQ ID NO: 50006 - protein, 900 aa, Phytophthora cinnamomi
MSQVLQHPRVFTFVKGESKGNGSMKPLLGGKGANLCQMARNGVNVPPGLTITTEVCQEFYAVGGRLPDGLMDEVRKGVHLMEKTLGVTFADATNPLLVSVRSGAAISMPGMMDTVLNLGLNDEIVKGVAKRGGERFAFDCYRRLLQMFGDVVLEIPHDDFEAELSAMKQARHVTFDVELTASDLKELVHKYKKVYEKHGRSFPSDPWEQMRMGIEAVFRSWNIPRAVKYREINKITGLKGTAVNVQAMVYGNINDQSCTGVLFTRNPANGENKLYGEFLLNAQGEDVVAGIRTPQPISELAQKMPTVYKQLDETVHTLETHFKDVQDTEFTVQDGVLFMLQTRNGKRTGPAALKIAVDMWREKLITEEEAVMLVEPRHLDQLLHPSFANEKGYQKDVLCRGLPASPGAAVGKIVFTAADAEAWFARGENVMLVREETSPEDVGGMHAAEGILTSRGGMTSHAAVVARGWGKPCVCGCSALSIDANSKTMRVHTASGAEVVLREGDYISVNGTTGEVIKGEQELQKAAMSGDLAQFMKWVDAHRRMEVFTNADTPEDAREARAHGAQGIGLTRTEHMFFSSAQRIAAVRRMIGAVELDSPAQQEALDALCTFQQGDFEGIFRAMDGLPVTIRMLDPPLHEFLPHEGSALEELCETLAKEMKVSKATVQSRLAGLKEANPMMGLRGCRLGIVHPGITEMQAKAIAEAAVKVAGEGISVHPHIMIPLVGSFEELEQQVKLVKSVVQDVIGKRGKSFDYKVGTMIEVPRGALQAGKLAEVAEFFSFGTNDLTQMTFGISRDDAQAKFLSYYVKHGVLEKDPFETLDQEGVGELVRLAVERGRATRPKIELGICGEHGGDPQSIEFFEKVGLKYVSCSPMRVMIARLAAAQAALKLKKSSPVSGS

SEQ ID NO: 50007 - protein, 440 aa, Arabidopsis thaliana
MLSGFRLGRFVELEFVYTWTIFFFSLYLVAIGQSGHKPCVQAFGADQFDEKNPQENSDRSSFFNWWYLSMCAGIGLAILVVVYIQENVSWALGFGIPCVFMVISLVLFVLGRKSYRFSKTRQEEETNPFTRIGRVFFVAFKNQRLNSSDLCKVELIEANRSQESPEELSFLNKALLVPNDSDEGEVACKSRDVEDATALVRLIPVWLTTLAYAIPFAQYMTFFTKQGVTMERTIFPGVEIPPASLQVLISISIVLFVPIYDRVLVPIGRSITKDPCGITTLKRIGTGMVLATLTMVVAALVESKRLETAKEYGLIDQPKTTLPMSIWWLFPQYMLLGLADVHTLVGMQEFFYSQVPTELRSLGLAIYLSAMGVGSLLSSLLIYLIDLATGGDAGNSWFNSNLNRAHLDYFYWLLAVVSAVGFFTFLFISKSYIYRRVDVV

SEQ ID NO: 50008 - protein, 634 aa, Parvularcula bermudensis HTCC2503
MCGIAGIVDLVGEREIPESPLDRMVKALAHRGPDGGGVYRVPGLAFGHRRLAIVDPDQAAQPYIGSEGSVLTYNGEIYNHGELRGDLDRARRPIKTRSDTEILCELMELRGEDALPSLDGMFAFAHWTPRTETLLLVRDRIGEKPLYLAQTPDNFLIFASEIDAILESGLISAEINPTAVADYLLYGYVPDPKTIYRGIGKLPPGHLLKIARGQPIAPAKPWWTLTFKPDDGCLYEAVVEELPLLLDRCVSAQMMSDVPIGAFLSGGLDSGAVTASMQKAATAPVTTCAMGFADPDFDERAAARETATHLCTNHFDWEAPLSPVEDVPRLAAIYGEPFADSSALPTAHLCAGARRHATVALSGDGGDEVFAGYDRYGGILNEARLRQAIPGVVRRSIVTKAGNAFPAFTDRVPKPLRLRTVLQSVGEDHAAAYARAVSAVLPDLSRTLLSEELRDYRPEHHVEEAVYKADTDDPILSAQAADFATWLPGRMLVKIDRASMAVGLEVRPPLLDHRLVEWAARLPRRIKYSEGKGKVILREAIGDRLPKGVSTRAKKGFGSPVDHWFRDQDGSLSRHLLDRTAWRECGFFDQSAVEDLVARHCAGRRNAGQALWSILMFDAFLIRKPSDRTSIASY

SEQ ID NO: 50009 - protein, 368 aa, Oryza sativa (japonica cultivar-group)
MGYLPSLGGKAAHLVSDLATVILNPVSERESQRHPSHLPEATEVQENIYEDDDDDNSVKNSEIPNGPDTSSFRAFLMSFMSSSNSSSDSIEIIPEHNMNMEYPTLTPVGKGSNGRKGLFSRGKHSIGKIINKAGRIGGFRQKPSYSIDGETVQTEYDAPGLELKGSKESASHDKLPAMSEPSMLLSETMRTVLYTSLPVLVQGRNWMLVYSTWRHGISLSTLYRRSMLCAGYSLLIVGDRKGAVFGGLVEAPLQPLIKKKYQGTNNCFVFTNIAGRPVIYRPTGANNYFTFCSTDYLAMGGGGHFALYLDGDLLNGSSSTSETFNNPCLSRSREFEVKDVELWGFVNASKYDEMLTICRTEKQGIWNL

SEQ ID NO: 50010 - protein, 145 aa, Glycine max
QSLVFSSSNSTMASRLTVTALVLIALATVSLQTSASSVGKFIDETITSHKIVIFSKTYCPYCRRAKAVFKELNQVPHVVELDEREDGSKIQDIMINIVGRRTVPQVFINGKHLGGSDDTVEAYESGHLHKLLGIETKDHDDHDDL

SEQ ID NO: 50011 - protein, 204 aa, Oryza sativa
MTSVWKTKVLTGLNKLFDKDGKKAAAAEFLKSFNKEEIGKEIDDKKTELEPKVVEVVESSPPEIKALLKDKKTASKIKKNGPAVTKFLEELAKIDFPGAKPVSDAVAKSGTTPLSPAIAFILEKVAPFVPKEEPKPEPEAEAAAETTSREVAVEEEKKKEEAAPAEPDDGAAEAAAPSTEVVEEKKEEEKPAEAAAPAAEPEKQ

SEQ ID NO: 50012 - protein, 287 aa, Zea mays
MICFCSLVPSILNQDDPQGPSTAPPPPDSPSNDNDDMKSVLSLDDGRWSVSADEHTSFTSANLEEELLQLNIKQPSPPPVLAEVQRPISPSRVADPTPGLPTSGTARFQNLHVPIKLMDCFLRVAESNTKRSLETCGVLAGTLKNRTFYVTTLIIPKQKSTSVTCEATNEEELFEVQDMGSLFTLGWIHTHPTQSCFLSSVDLHNHYSYQVMLPEAIAIVMAPTDTTRKHGIFHLTDPGGMGVIHDCQERGFHPHKAPLDGSPIYKQCSHVYMDTDIKFDMIDLRER

SEQ ID NO: 50013 - protein, 618 aa, Xylella fastidiosa Dixon
MPRRRFVPSLSGRTIVNITTALPLPTHLLSEKVTAPLLGARKIYVTGSRQDIRVPMREIALTPSSARYGGNENLSLVLYDTSGIYTDPQATIDLACGLPRLRTAWIDERADTVEAKLHFKVPESVSVTAPPFPTPPRPLRARDNVAVTQLEYARRGLVTPEMEFVAIREQQRREQTVENLRGQRHAGDAWGALIGKPITPEFVRDEIARGRAILPNNINHPESEPMIIGRNFLTKINANIGTSALSSSIAEEVEKLVWAIRWGADTIMDLSTGRDIHTTREWILRNSPVPVGTVPIYQALEKVGGHVEALSWAVFRDTLIEQAEQGVDYVTVHAGVLRDFIPLTASRLTGIVSRGGSIMARWCQAHRSENFLYTHFEELCEIMRAYDVAFSLGDGLRPGCIADANDAAQFAELEILGKLTHIAWNHQVQVMVEGPGHVPMQLIKANMDKQLAACGEAPFYTLGPLTTDIAPGYDHITSAIGAAMIGWYGTAMLCYVTPKEHLGLPNLQDVHDGIIAYKIAAHAADLAKGHPAAQVRDDALSKARFEFRWQDQFHLSLDPEKAMALHDESLPKEAHKRAAFCSMCGPQFCSMKISQEVRDASSTELSDANKDTNTSDGI

SEQ ID NO: 50014 - protein, 268 aa, Staphylococcus aureus subsp. aureus MW2
MKFAVIGNPISHSLSPVMHRANFNSLGLDDTYEALNIPIEDFHLIKEIISKKELDGFNITIPHKERIIPYLDHVDEQAINAGAVNTVLIKDDKWIGYNTDGIGYVKGLHSVYPDLENAYILILGAGGASKGIAYELAKFVKPKLTVANRTMARFESWNLNINQISLADAEKYLAEFDIVINTTPAGMAGNNESIINLKHLSPNTLMSDIVYIPYKTPILEEAERKGNHIYNGLDMFVYQGAESFKIWTNKDADINSMKTAVLQQLKGE

SEQ ID NO: 50015 - protein, 117 aa, Ralstonia metallidurans CH34
MPAWRRAQPERISIMSDVQQKIDQIVKGSPVVLFMKGTAQFPMCGFSGRAIQILKACGVDAPTTVNVLEDEGIRQGIKEYANWPTIPQLYVNGEFIGGSDIMMEMYQNGELQSLLKA

SEQ ID NO: 50016 - protein, 498 aa, Gluconobacter oxydans 621H
MPSPEISSPVSRHPFALLLPEESDRMDHAAAAILPSTRLMENAGWAVARVIRNRFSPRRVTVACGPGNNGGDGYVVARNLARWGWSVRVAALAAPKPGTPAAEMAACWTGLMVPFTAEELAGADLVVDAVFGSGLKRPVADDVAAVLAAAREVVAIDMPSGVAGASGEILGKARDCTLTVTFVRPRPGHVLQPGSDLCGEVICADIGMPDAAWDGITPVVQHNKPGLWSLPVSGDGDYKYRRGVVSLCGGAEMPGATRLSARGARRSGAGLVRISAGEGAPAYRLGDPGLIVDDAPLSELLEDARRKVWICGPGLTEDEVAATLPQLLKADRIVLADAGALAWGAQDLSRLKGVAAVTPHIGEFRKLFGPVEGSRLDAALAAAKRINAVVVMKGPDTIIAAPDGRLAINTHASSALATAGSGDTLTGVIAALLAAGMDVWEGCCAGVWLHGEAGIEAGKAHGGWPLAEDLDLPLGPARATATRLAREAGDKKATGSLL

SEQ ID NO: 50017 - protein, 659 aa, Oryza sativa (japonica cultivar-group)
MVGVLLLLSIMPLAAGELLAQLCGNGGNYTANGTYQSNLARLAAALPSNASSSPDHFATATAGQAPDAAYALALCRGDVANATACGDCVAASFQDARRTCPSDKSATIYYDDCLLRFAGDDFLAAPNITENATLFQAWNQQNITGDAAVAAANVRELLTVTARTAAAAARRFATGFMDGSSESKQTLYSLAQCTPDLAAGDCLACLQRLIAMVNSTTSVRLGGRVLLLRCNLRFEAFVFYAGEPTRRVSPPGSTPAPDSIAPTKNRKKSKSWVIAAIAAPVAAVVLCLIVCYYCRWSRRFRKDRVRLREKRSRRFRGDELICEMEGEISEFSVFEFREVIKATDNFSEENKLGEGGFGPVYKGLFSEGLEIAVKRLASHSGQGFLEFKNEVQLIAKLQHRNLVRLLGCCSQGEEKILVYEYLPNKSLDFYIFDERKKDLLDWNKRLVIIEGIAQGLLYLHKHSRLRVIHRDLKPSNILLDSEMNPKISDFGLAKIFGSNSNEGTTRRVVGTYGYMAPEYSSEGLFSPKSDVFSFGVIILEIISGKRNASLDQCEDFINLLGYAWKLWSEERWLELLDASLVTNWQSSCMLRCINIALLCVQENAVDRPTMSNVVAMLSSESMVLDEPKHPAYFHVRVTKNDESSTVGTCSTINDVTINY

SEQ ID NO: 50018 - protein, 507 aa, Ralstonia metallidurans CH34
MKAQEIAACWQAMDLPPPWTPAEGAAPGVLAVRSPIDGEVFGQLAMCDAALANARIARAHAAQTTWALTPAPARGEVVRRFGEALRANKDALGRLVSLESGKILQEGLGEVQEMIDICDFAVGLSRQLHGLTIASERPAHAMRETWHPYGLCGVISAFNFPVAVWAWNAALALVCGNGVVWKPSEKTPLCALAAQGLLDRVFERHAPQFDGLSCVLTGGRQLGEHLVQHPAVRLMSATGSTRMGREVGMACAAHFKRAILELGGNNAAIVTPSAELEMTIRAMTFAAAGTAGQRCTTLRRAFVHADLIETVTNRLRQVFARLPVGDPLEDGTLVGPLIDHAAGDTMANALASCRAQGNVVHGGERLLGDRYPHACYVRPALVLTDAQHDTMLTETFAPILYLMPYTSLDEAIALNNAASHGLSSCIFTESLREAERFLSSAGSDCGIANVNIGTSGAEIGGAFGGEKATGGGRESGSDAWKGYMRRATNTINYGDALPLAQGIRFDV

SEQ ID NO: 50019 - protein, 461 aa, Ustilago maydis 521
MEQGDVAVSRLRRRFEVPSRKVGRRVSYRCVLKGRAGEWEEIANSEKVSCKEQQQQQQQQAKARFVIHDYGRQDPVKLTLLEISSKQTQTATLNPSEFPFDLRFTISNHKLFKSIAFTSSEICHQGISQRHNGAVIPTAVNFDNKSLPISCVQLGMMLNPLATCEQLALTPSMSEGLSFDLEMELRALGCQIIQQAGILLQLPQRTLAAAQVFYQRFWYSSSMCDFSADEIAIGCLLLSTKLEETPCSLRHLIGAFHYVNFHLNKSRRHSEYEPPSRDSSALMALRDAAVVSEMQILKRLGFQVHVTLPYALLVNYLQVLSLTDPKLKTRVRRHHGWHPHVAPMEPVGNQQEETVSLAQCAWSFLNDALQTPVLCIVGPHIVACAAIALATEMCEPLVRLPHQPAPWWLLFDASEAEVMIAASHLLWRYHHHSLQTDLAKLLDRHELKRYLAAHSANLNSC

SEQ ID NO: 50020 - protein, 96 aa, Triticum aestivum
  misc_feature (26)..(26): Xaa can be any naturally occurring amino acid
  misc_feature (47)..(47): Xaa can be any naturally occurring amino acid
  misc_feature (66)..(66): Xaa can be any naturally occurring amino acid
  misc_feature (76)..(76): Xaa can be any naturally occurring amino acid
FLWITKNGMEDNHLVRTMGNINIIWXFQKVKETKYYGSRNKESQRSXYSNKIRIKKKSIVKRRFIXKEYIMIKIPXATMVWTPPMKVSSLRFQNKR

SEQ ID NO: 50021 - protein, 134 aa, Glycine max
  misc_feature (24)..(24): Xaa can be any naturally occurring amino acid
  misc_feature (36)..(36): Xaa can be any naturally occurring amino acid
FVTLFTCLLSANSHTDHIVPTGFXPPLTNDSVEVAXANRTQTLNYKPVIGILTHPDDGASGRLSNATGVSYIAASYVKFVESGGARVIPLIYNESPENLNKVVLENTVLFLFFVFLRTLELHFQIRFFFNTLCS

SEQ ID NO: 50022 - protein, 114 aa, Glycine max
MPEKKNKKVSFTEEDAVTLMQRYDATTVFTLLQEVAHYPHPKIDWCELVKKSATGISNAREYQMLWRHLAYRHSLPEIFEDGDEPLDDDKDDDSDLECELEALPPVGWGCAWGA

SEQ ID NO: 50023 - protein, 531 aa, Zea mays
  misc_feature (221)..(221): Xaa can be any naturally occurring amino acid
MRRAWTPADERAATTTSEHRRRRRMGKYEMGRTLGEGHFGKVRLARDAGTGRSFAIKILDRQRILAMKIDEQIKREIATLKLLKHPNVVRLYEVSASKTKIYMVLEYVNGGELFDKIALKGKLTEKGGRKLFQQLIDAVGYCHEKGVCHRDLKPENVLVDAKGNIKVSDFGLSALPQNQRKDGLLHTTCGSPNYIAPEVLLNKGYDGSVSDVWSCGVILYXMLTGSLPFDDQNMVVLYQKILKGNAHIPKWLSQGAQDLLRKILDPNPITRVDVDGIRAHDWFKQGYAPSAPFNDDEEDINVDEEDSLNMTENGIQDKIAINQINAFQLIGMSSCLDLSGFFEKEDASERKIRFASNYPPAYLFEKIESIVRKMGFQVHKSNGKGAESHCHVLQLKVIQDCKGLANLRGKESLLISAEVFEINESLYVVELKKSSGDCSLYRKLCETLSEDLGTCKSQQFLKQDSIRQEIDLLGPWVRSIARIELLPGINHLDALPPKRPPHFCNTFRLCILLWKKLLQCKLQAARVAGRR

SEQ ID NO: 50024 - protein, 112 aa, Urtica dioica
MMMRFLSAVVIMSSAMAVGLVSAQRCGSQGGGGTCPGLRCCSIWGWCGDSEPYCGRTCENKCWSGERSDHRCGAAVGNPPCGQDRCCSVHGWCGGGNDYCSGGNCQYRCSSS

SEQ ID NO: 50025 - protein, 510 aa, Lactococcus lactis subsp. lactis
MDDKEHQRHRLIYHTNGKSLEEINGTVEVPKNVGFFKMLLTYSGPGALVAVGYMDPGNWSTSITGGQNFQYLLISVILMSSLIAMLLQYMSAKLGIVSQMDLAQAIRARTSKSLGIVLWILTELAIMATDIAEVIGAAIALYLLFNIPLILAVFITVLDVFLLLLLTRVGFRKIEALVICLILVILVIFAYQVALSNPDWKGIIEGFIPNSRTFASSPTVAGMSPLTGALGIIGATVMPHNLYLHSSISQSRKINHQDKSDVARAVRFSTWDSNIQLTVAFVVNSLLLIMGVAVFKTGVIDDPSFFGLYDALSNPTVLSNGLLADVAKTGALSTLFAVALLASGQNSTITGTLTGQVIMEGFIHMRMPMWARRLVTRLLSVVPVLICVSMTRGQTLKAQHEAINNLMNNSQVFLAFALPFSIIPLLMLTNSKKEMGDFKNNFIIKCLGWFSVIALTYLNLIGLPDQIANFIPHNLGLSHLISGFLILGVLFLLIWTIVELYRGNKKMMAC

SEQ ID NO: 50026 - protein, 533 aa, Enterococcus faecalis
MGKNSEEHEPKQRHHLIEYANGPSLEEINGTIDVPKNMSFWKTLFAYSGPGALVAVGYMDPGNWSTSITGGQNFQYLLMSIILISSLIAMLLQYMAAKLGIVSQMDLAQAIRARTSKTLGIVLWILTELAIMATDIAEVIGGAIALYLLFHIPLGLAVFITVFDVLLLLLLTKIGFRKIEAIVVALIVVIFVIFAYQVALSNPVWGDVIKGLVPSAEAFSTSHAVNGQTPLTGALGIIGATVMPHNLYLHSSVVQSRKIDRKDKTDIQRALRFSTWDSNIQLTMAFFVNSLLLIMGVAVFKSGSVKDPSFFGLFDALSNPAVMSNSILAHIAGSGILSILFAVALLASGQNSTITGTLTGQIIMEGFIHMRVPIWLRRMVTRLLSVIPVLICVLMTSGKSTVEEHIAINNLMNNSQVFLAFALPFSMLPLLMFTDSRVEMGEHFKNSWLIKLLGWVSVIGLIYLNMKGLPDQIEGFFGDNPTASQITLADNIAYVIIALVILLLVWTVVELYKGDKRYAQQLAAMEQQVEEVK

SEQ ID NO: 50027 - protein, 281 aa, Glycine max
MAVSYVHMLQCNRGFHKGNLSYPNCSYKARRSHRLVFASMHTPEPKVDSLLDSVKWDTKGLVVAIAQNVDTGAILMQGFANREAIATTISSRKATFYSRSRSTLWTKGETSNNFINVHDVFIDCDRDSIIYLGKPDGPTCHTGAETCYYTSVFDLLKQQEAEENKLALTSLYALESTISQRKTELIGENEKPSWTKRLLLNDKLLCSKIREEANELCQTLENNEDEKRTASEMADVLYHAMVLLAKKGVKIEDVLQVLRLRFSQSGIEEKKSRVSQKSVDD

SEQ ID NO: 50028 - protein, 416 aa, Triticum aestivum
MMEGGKFPGIIGAVSGQDGGVNFCDMAYYQKLGEGSTMSIDSLNSMQTSMHGGSIMSVDNSSVGSTDSRTGMLNHPSHRGPVAVVSYSVGNSIFRPGRVSHALSDDALAQALMDTRFPTETLKDYEEWTIDLGKLHMGLPFAQGAFGKLYRGTYNGMDVAIKLLERPEADPAQAQLLEQQFVQEVMMLAELRHPNIVKFVGACRKPIVWCIVTGYAKGGSVRNFLNRRQNRSVPLKLAVKQALDVARGMAYVHGLGFIHRDLKSDNLLISGDKSIKIADFGVARIEVKTEGMTPETGTYRWMAPEMIQHRPYNQKVDVYSFGIVLWELISGTLPFPNMTAVQAAFAVVNKGVRPAIPHDCLPALGEIMTRCWDANPNVRPPFTDVVRMLERVEMEVLNNVRKARFRCCIPQPMTLD

SEQ ID NO: 50029 - protein, 251 aa, Parvularcula bermudensis HTCC2503
MSQKPQAGEGKSLRGRLLLAIGGLGLLIALGYAAGIHNYLRLEALDDFAAWIDAHTFVATLTFVTIYAVLVAISFPGATLLTIAGGYLFGQWIGTIAVVIAATIGATVIFSLAKWVFKDSLAKQAGGALARMEKGFREDELNYMFLLRLVPAFPFVAINIGAGVLNVKLTNYLIGTFFGIIPGSFVYVSIGNAIQKGSATLQDAGLLSVFAQPQVYIPFIGLAVLGALPILIKRLGGGRAAKLADKATGGQ

SEQ ID NO: 50030 - protein, 211 aa, Triticum aestivum
  misc_feature (107)..(107): Xaa can be any naturally occurring amino acid
MGSRVFALFITGVVLLGSRILALDHTVVEKRLNENTVSLTTKGSPQLCQLCEQFATETLFYLKENETRIEIIDTLHQACLKFHSLKLECTKLVDYYAALFFAQIDSXSPEEFCVSASLCEEVTYIRLPGHEHACTLCHEVVDEIRTGLEDPEMELKIIEILLKGCNNTESFVQKCKKMIIQNAPLILEDIKKFLEKRDFCDSIRVCGGKIA

SEQ ID NO: 50031 - protein, 294 aa, Nostoc sp. PCC 7120
MGDFGTVLTAMITPFKADGSVNYAVAAELAANLVDNGTDTLVVCGTTGESPTLSWDEEYNLFVEVLQTVAGKAKVIAGCGSNSTKEAIAATQKAAKIGVHGTLQVVPYYNKPPQAGLYQHFQAIAQACPELPLLLYNVPGRTGQNLSPETVVRLAEIDNIVGVKEASGNLDQAGEIRRLTPKEFQIYAGDDSLTLPLLAIGAKGVVSVASHLVGNQLQQMIQAFNSGQVTVASDIHLRLLPLFKTLFITTNPIPIKQALKLQGWEVGSTRPPLSDADAEVSQKLEAVMKHLDLI

SEQ ID NO: 50032 - protein, 140 aa, Picrophilus torridus DSM 9790
MIMERCLILVKPDGVERNLIGEVISRFERKGLAIKALKMMRVTREQAEDHYSVHRLKPFFDDLVSYLTSGPIVAMIVEGNNAIASSRMLAGATDGSKAAPGTIRGDFSLDIERNIVHASDSLESYEHEYKIFFNENEIMD

SEQ ID NO: 50033 - protein, 249 aa, Xylella fastidiosa Dixon
MTRKLVLLRHGQSQWNSMNRFTGWVDIGLTEQGHQEATMAGHLMKEEGLEFDVAHTSLLKRAIHTLQDALKALDQDWLPIYKSWRLNERHYGALQGLDKIDTAAKHGEEQVNIWRRSYDIQPPPIDLDDPSHPMRDRRYAALDRKVLPVTESLKNTLERVLPYWNDAIAPQLNDNKTVLISAHGNSLRALYKYLNQESDEKILNVNIPTGIPLLFELSDTLQVVSYRYLGDPDAAQRAAEMVANQGKAK

SEQ ID NO: 50034 - protein, 321 aa, Ustilago maydis 521
MTGATDTRLSTVRVPDDQWLFAKSDLELTPSVLQGGLDPVEEKQRRYKGVNAIYRMAEYMRLPQHVMNTAAIYLHRFYMRKPLEYGPSKIGHSHYEIAATCVFLACKVEESHRKLLSVIDAAMASFDKTPSGNQRWAERTFRADPSSKEFARWRDIILLSEETVLETLCFDLIVEQPHEILVKACSRLNVNADVVRVAWTTLNDSLRDAICVIFEAPVLAAGAFYRACQQYQVDPSKFVAQWPKDAEDSRWTWTDIFDVDEDEAAEAAEAIQKDVLSVETELHGGASAASAEGYMAGFHKQHGGPCQDDQASTGEMIWTSA

SEQ ID NO: 50035 - protein, 512 aa, Aspergillus nidulans FGSC A4
MALLGLLETYRDPLAFVAALSAVFYLLSCLHRRWRRYQFAKENGCEPVVGKIPSYDPFLSLDRLYRLTKLARNRKLLENNVQRFKEFGNTHRAKRITTPMIVTRDPQNIKAILSLKFGDYSMGDRIRIFGPLLGHGIFTSDGEDWARSRHMIRPNFVKEQVAHLEIFEELMDDLFALIPTDGSTVDLQELFFGFTIDSATEFLCGHNVHSLKKRRSGVIDDEPDFAEAFNYSLDNISKNGRFGPLMFLNRDPKAVESHRICHESMDQFVDKAIRMRERYNEEKIVDEAAERRYMFLYGLAQQTGDRRRIRDEVLNILLAGRDTTASLLSNMFFLLAKHPSTWAKLQEEVATLEGRAPTYEQLRNMKYLKYCLNETLRLFPVVPVNSRTAIRDTVLPVGGGPDGQSPAFVPKGTMVAYSVYAMHRREDYYGADAEEFRPERWADLRPGWEYLPFNGGPRICVGQQYALTEAAYVTTRLAQRYSILESRDPGPWEEKLTLTLCSYNGTQVSLRH

SEQ ID NO: 50036 - protein, 522 aa, Ralstonia metallidurans CH34
MPPVASVIFPRCQRSRIDAMTDSAEPPDSSNSSGSSDPTKATSPSGAGKPPDSASTRHPDQPDRLSKLRLHARSTAFRKTRQFGRISRTTIRYGAFMCGAGFVALFSIVFAYIAEVALNWNAKLTTATPWLAFVILPFGLAALRWLTIRLAPQARGSGIPQVIAAVTLPPAGVAQTVLVSFRQSMWKVLLTTGALLAGASVGREGPSVQVGAAAMLAWGRLCHEKLQFRIGFHPNALIAAGAAGGLAAAFNTPLAGVVFAIEELGRGTSVRWDRLVLSGVLTAGFLSLAVLGNNPYFSVKVPMLVLHDAWGPVLLCAVVNGVMGGLFAKLLIAGVPGLTPSSWRGWLNAHPVMVAFFCGLIVAALGWATAGATFGTGYEQASGLINGTPHSTIWFGLAKFVATVVSYFAGIPGGIFTPSLAIGAGIGDTVSHFLSGATEPRVLALVSMAAFLAAATQAPITASVIVMEMTRTQDLTIYLLAASLLASFLSRQFNPHPFYHHMGHAFRREAMSIGRKSASASA

SEQ ID NO: 50037 - protein, 357 aa, Malus x domestica
MVSSDSVNSRVETLAGSGISTIPKEYIRPKDELVNIGDIFEQEKNNEGPQVPTIDLKEIESDNEKVRAKCREKLKKATVDWGVMHLVNHGISDELMDKVRKAGKAFFDLPIEQKEKYANDQASGKIQGYGSKLANNASGQLEWEDYFFHCVYPEDKRDLSIWPQTPADYIEATAEYAKQLRELATKVLKVLSLGLGLDEGRLEKEVGGLEELLLQMKINYYPKCPQPELALGVEAHTDVSALTFILHNMVPGLQLFYEGKWVTAKCVPNSIVMHIGDTLEILSNGKYKSILHRGMVNKEKVRISWAVFCEPPKEKIILKPLPETVSEDEPAMFPPRTFAEHIQHKLFRKSQEALLPK

SEQ ID NO: 50038 - protein, 532 aa, Haloarcula marismortui ATCC 43049
MKYNIISTNYLLSRDKYCYWPSMSTASDDSTETDSAIKQRHRDAAADAIPDNLSHYIGGEFVAGNSHKTIETRDPTTDAVLGEVPAGNAADIDDAVKAAQQAFDGGWKDASPGERQRVLSEMAHAVEENRKTLATLEVLDTGKTITEAMGDMGLVIDHLTYYAAAARNVNGETRQTNDLFDREKQVFTVKEPYGVVGAIVPWNFPLLIAIWKCGPALAAGNTVVLKPSEETPLSTLKLMELVDNTVPDGVINVVTGYGEDAGAPLSTHEDVPKISFTGSTEVGKEIIRNSAEDIKKTTLELGGKSPVIVYPDADLEEAVEAAMMAIFFNKGECCAAGSRLFVHEDIEEQFLETFTNAASGMTVGDPLLEETDMGPKVSDEQVQRTNEFVEAARESGATIRTGGSAPDDESLAGGAFYEPTVIDDIDHDHPSVQKEIFGPVMETFSWSDEDDVVELANDVDYGLAAGVISGDVTKALQTARRLEAGVVWVNHYNDVSAGQPFGGYKQSGTGRENAAEAIDEFTQTKAINVNLG

SEQ ID NO: 50039 - protein, 510 aa, Zea mays
MATPYAKWTTILNICSAVGAIGTVFGEMGALQPTHGVEYAFGAHNYSISGVLEVEPGSDLDPLQVREFMEIRSLNYNGDTFCLVFARYGLQKLFGLDCLALTSDQSPLYPDLPSNMVDTKRSTTILSGIQLDFLGCLSTMSTFDAEVYTMRRSGQIARTLIYAASTFMLPFLLAQLSSCILQINTQSVQDMHIDADPSHVPVVLIEKHGMVVPQHSSNKDLASNASEQKDTVVLPKLQGESLGHHLDLRLVRNQWLLLDPGADCLMSEANEDKTSRDFKEMGSRLAGEVIAFLKKKMDKLSRYGGCKELKLSFVGHSIGNIIIRSALAEPALQPYLKNLYTYMSISGPHLGHWYSSNSLFNSGLWLLKKLKNAQCIHQLTFSDDQDPHNTYFYKLCKLKTLENFKNIILLSSPQDGYVPYHSARMELCPAASSDTSKKGQVFTEMLNNCLDQIRAPSSDTRTFMRCDVNFDQSNHGQSLNTMIGRAAHIEFLETDIYAKFIMWSFPDLFR

SEQ ID NO: 50040 - protein, 454 aa, Enterococcus faecalis
MGKEKKTEKMLNYANGPSLEEINNTVEVPKNASFWRTLLAYSGPGALVAVGYMDPGNWITSIAGGAEYKYTLLSVILLSSLVAMLLQSMAARLGIVTGMDLAQATREHTSKRTGVALWVVTELAIMATDIAEVIGGAVALQLLFGFPLLIGVLITTFDVLLLLLLTKLGFRKIEAIVSCLIAVIFFVFAYEVALADPNVGEVLRGFIPDTKIATDKSMLFLALGIVGATVMPHNLYLHSSIAQARKFDRNDDVEKAKAIRFTTWDSNIQLTVAFVVNCLLLILGGALFYGTNSELGKFVDLFDALKNPDIVGNIASPVLSILFAIALLASGQNSTITGTLSGQIVMEGFIHLKMPLWARRVLTRLLAIVPVIICVIIYGGSETAVEDLLLYTQVFLSIALPVSIIPLTMYTSDKKLMGQFANPAWVKFLAWIIAIALTLLNLFLIYGTLTGLTN

SEQ ID NO: 50041 - protein, 370 aa, Brucella melitensis 16M
MKSRAAVAWEAKKPLTIETVEIGGPKAGEVLVEIMATGVCHTDAYTLSGLDSEGKFPAILGHEGAGIVREVGADVTSVKPGDHVIPLYTPECRQCKTCLSQRSNLCTAIRATQGQGLMPDKTSRFSCDGGEVFHYMGCSTFSNFTVLPEIAVAKVREDAPFDKICYIGCGVTTGIGAVIYTAKVRPGSNVVVFGLGGIGLNVIQGARMVGADKIIGVDINPAKVEMARKFGMTDFINPREIGNDKVVQAIQDLTDGGADYSFDATGNTDVMRQALECCHRGWGESIIIGVAEAGKEIATRPFQLVTGRVWKGTAFGGARGRTDVPKIVDWYMEGKINIDDLITHTMPLDEINTAFDLMHEGKSIRSVVIY

SEQ ID NO: 50042 - protein, 498 aa, Oryza sativa
MEAWTIRVVYFIVFSFFLVSARFGSCAPCSEEGRALLRYSESERDKSTDSLSNRGEGKVIGRVLNLLLKEKMFSSETPSELKELGTISESVADGTGGFEHCRKCLAKTVHNATPRQLLQARQLISNQTQKHHKSCRPPSASHLVPRWAIYALTVAGVLFIAAVATAIYVFFSRRKKDNTVMPWATGLSGQLKKAFVTGVPSLERTELEAACEGFINVIGTLPECTLYKGTLSSGVEIAVLSTSVNSSQQWSAQSEEQFRNKISVLSRVNHKNFMNLIGYCACEEPFTRMMVFEYAPCGSLFEHLHIREAEHLDWKTRLRIIMGVAYCLEHMSQLDPPPLLPTNLSSSSIYLTEDNAAKIADIEFWKDDINKQDDQESVVYKFGILVLEVISGRRPFSEDDRLLVLWASSYLDGKRPLSAMADRTLVRSSSAAPEKDVAALCDVVRQCVRRPEAGKRAISMGEVARLVRGIAGLSPEQAAPREKPLWWAELEIASSETA

SEQ ID NO: 50043 - protein, 162 aa, Shigella flexneri 2a str. 2457T
MGVSGSGKSAVASEVAHQLHAAFLDGDFLHPRRNIEKMASGEPLNDDDRKPWLQALNDSAFAMQRTNKVSLIACSALKKHYRDLLREGNPNLSFIYLKGDFDVIESRLKARKGHFFKTQMLVTQFETLQEPGADETDVLVVDIDQPLEGVVASTIEVIKKGK

SEQ ID NO: 50044 - protein, 187 aa, Zea mays
  misc_feature (139)..(139): Xaa can be any naturally occurring amino acid
  misc_feature (159)..(159): Xaa can be any naturally occurring amino acid
MVQTGTSARSRASEHLNIRSGGRGAVAPPLLSPLPHLCVRALCLFRRQPRGAMAAGRELVVSFGEMLIDFVPTVAGVSLAEAPAFLKAPGGAPANVAIAVSRLGGGAAFVGKLGDDEFGRMLAAILRDNGVDDGGVVFXDSGARTALAFVTLRADGERXEFMFYRNPSADMLLTADELNVELIKRVS

SEQ ID NO: 50045 - protein, 112 aa, Urtica dioica
MMMRFLAAVVIMSSAMAVGLVSAQRCGSQGGGSTCPGLRCCSIWGWCGDSEPYCGRTCENKCWSGERSDHRCGAAVGNPPCGQDRCCSVHGWCGGGNDYCSGGNCQYRCSSS

SEQ ID NO: 50046 - protein, 472 aa, Oryza sativa (japonica cultivar-group)
MAKKKDVEVEELDEEVVAAAAAPAADGGEEQEAEPPARRPSTFAELGVVPELVAACDAMGWKEPTRIQAEAIPHALEGRDLIGLGQTGSGKTGAFALPIIQALLKQDKPQALFACVLSPTRELAFQIGQQFEALGSAIGLSCTVLVGGVDRVQQAVSLAKRPHIVVGTPGRLLDHLTDTKGFSLNKLKYLVLDEADKLLNVEFQKALDDILNVIPKERRTFLFSATMTNKVSKLQRACLRNPVKVEVASKYSTVDTLRQEFYFVPADYKDCFLVHVLNELPGSMIMIFVRTCESTRLLALTLRNLRFKAISISGQMSQDKRLGALNRFKTKDCNILICTDVASRGLDIQGVDVVINYDIPMNSKDYVHRVGRTARAGNTGYAVSLVNQYEAMWFKMIEKLLGYEIPDRKVDNAEIMILRERISDSKRIALTTMKEGGGHKKKRRKNEDDEEEEERNAPVSRKSKSFNKSRRR

SEQ ID NO: 50047 - protein, 479 aa, Zea mays
QHQHSSLSTTSTRSLLSHDRLTPHPRGRLQEPVGQVVFTAEDAEAWHSQGKAAILVRAETSPEDVGGMHAAVGILTERGGMTSHAAVVARWWGKCCVSGCSGIRVNDAEKLVTIGSHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKFATERGRKARPNLKVGICGEHGGEPSSVAFFAKAGLDYVSCSPFRVPIARLAAAQVLV

SEQ ID NO: 50048 - protein, 245 aa, Parvularcula bermudensis HTCC2503
MIQNMGDGDVRRLIAGNWKMNGLEDDLAEVTTLAQRLETPRPDNVDVVICPPATLIAPMHALQFDTIGLGAQDCHTEESGAYTGDLSAAMLRDAGACYCIVGHSERRDYHGETDEVVKAKLAAALKADLIPILCVGENLETREAGKAVDTVVAQLKAAFPGAGKGVVVAYEPIWAIGTGKTAGPAEIEEMHAALRQATSPDTRLLYGGSVKPGNAAEILAVSNVNGALVGGASLKADDFEPIVRA

SEQ ID NO: 50049 - protein, 441 aa, Acinetobacter sp. ADP1
MSTVKNGTLEQDKLNWFKYLLFGIQHVLVMIAVPITSVFLVAKALSLSDQLTVNLMSATFLVCGLGTLLQSIGVYKFGSRLPFVMIPGGAPIVMFLGIAQEKDLATASGAVILTSLFYFIILPVFKRFLRFFPNIVIGTLLILVSINLIKIYGGLVIGKPDTADFASTLNIGLAFATIAASLFFARVLKGTLSQLSILLGLIFGTILSAFLGQMHFETITQPTIFSLPTIMPFGVPKFDLVATIPLLIFSLISMVEATGQTIAISDLVGKKETAFERVPPTIRGDALISLLGGWLGTSMIITSGENIGIVRATQVRSRYVTIIAGIILLIISVFTPLAHLANAIPVAVVSGTAIIVFSIIGTIGIDILRRVDLHEKGNMYVLAGALTMGLLPILVNGVYTNFPHALQPILNNGLAMGALTAILLNIVFSTHSQADAHQESK

SEQ ID NO: 50050 - protein, 341 aa, Anabaena variabilis ATCC 29413
MLAALLYGQEDLRLEQLADPSPEVGEVVIKVGAATTCGTDLKVWRRGGHAKMLKLPTLFGHEAAGEIVAVGAGVTGWQIGDRVVANNSAPCMKCFFCQRQEYSLCPNLTWNNGTFAEYLKIPAPIVQHNLLQIPDELPLPLAAMTEPLACVLHGVARSQIKPQDKVVVLGDGAIGLMFVATLADNVEVLLWGGNDQRLEIGQKLGAAKTFNYHQNPDIPGTVKDLTQGWGADVVIEATGVPKVWETALACARPGAIVNLFGGCPRDTTITVNTEQMHYSELTLKGVFHNTPEYVRAALALIASRKIPFELLISEQRPLKDLEQVFDDMKARKVIKVAMVSS

SEQ ID NO: 50051 - protein, 316 aa, Escherichia coli
TDKLTSLRQYTTVVADTGDIAAMKLYQPQDATTAPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 50052 - protein, 336 aa, Polaromonas sp. JS666
MQMTMIQALRSAMDVMLERDSNVVVFGQDVGYFGGVFRCTDGLQAKYGRSRVFDAPISEGGIVGAAVGMAAYGLRPVVEIQFADYFYPASDQIVSEAARLRYRSAADFTAPMTIRMPCGGGIYGGQTHSQSPEALFTHVCGLRTVMPSNPYDAKGLLIACIENDDPVIFLEPKRLYNGPFDGHHDRPAVPWTGHPLGEVPEGYYTVPLESATVFRPGADLTVLTYGTMVFVSQAAAQESGIDAEIIDLRSLWPMDLQTVVDSVKKTGRCVVVHEATRTSGFGAELAALVQEHCFYHLEAPIERVTGWDTPYPHAQEWAYFPGPARVGAAFKRAMEA

SEQ ID NO: 50053 - protein, 316 aa, Escherichia coli
TDKLTSLRQYTTVVADTGDIAAMKLYQPQDATTNPSLILNAAQIPEYRKLIDDAVAWAKQQSNDRAQQIVDATDKLAVNIGLEILKLVPGRISTAVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 50054 - protein, 316 aa, Escherichia coli
TDKLTSLRQYTTVVAATGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 50055 - protein, 316 aa, Escherichia coli
TDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLALLFSFAQARACAEAGVFLISPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 50056 - protein, 177 aa, Lemna gibba
MASSMMASTAAAVARAGPAQSSMVPFNACRSSVPFPATRKANNNLSTLPGNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 50057 - protein, 1117 aa, Mycobacterium avium 104
MPRRTDLNHVLVIGSGPIVIGQACEFDYSGTQACRVLKAEGLQVSLVNSNPATIMTDPEYADHTYVEPITPAFVERVIAQQAERGNKIDALLATLGGQTALNTAVALYENGALDRYGVELIGADFDAIQRGEDRQRFKDIVAKVGGESARSRVCFTMDEVRETVAELGLPVVVRPSFTMGGLGSGMARSVEEVDRMAGAGLAESPSANVLIEESIYGWKEFELELMRDGNDNVVVVCSIENVDPMGVHTGDSVTVAPAMTLTDREYQRMRDLGIAILREVGVDTGGCNIQFAVNPKDGRLIVIEMNPRVSRSSALASKATGFPIAKIAAKLAIGYTLDEIVNDITKETPACFEPTLDYVVVKAPRFAFEKFPGADPTLTTTMKSVGEAMSLGRNFIEALGKVMRSLETSRAGFWTKPDPDGGLDDVLARLQTPTEGRLYDLELALRLGAPVERVAQASGVDPWFIAQIGELVALRGELIGAPVLDADLLRRAKHHGLSDRQIAALRPELAGENGVRSLRERLGVHPVYKTVDTCAAEFEAKTPYHYSSYELDPAAETEVAPQPQRPKVLILGSGPNRIGQGIEFDYSCVHAATTLSQAGFETVMVNCNPETVSTDYDTADRLYFEPLTFEDVLEVFRAEQQSGAGGPGVVGVIVQLGGQTPLGLAQRLADAGVPIVGTPPEAIDLAEDRGSFGDVLTAAGLPAPKYGTATTFAQARRIAVDIGYPVLVRPSYVLGGRGMEIVYDEETLRDYITRATELSPEHPVLVDRFLEDAVEIDVDALCDGTEVYIGGIMEHIEEAGIHSGDSACALPPVTLGRSDIEKVRRATEAIAHGIGVVGLLNVQYALKDDVLYVLEANPRASRTVPFVSKATAIPLAKACARIMLGATISQLRAEEMLAASGDGAHAALNAPIAVKEAVLPFHRFRTVEGAGIDSLLGPEMKSTGEVMGIDRDFGSAFAKSQTAAYGSLPAQGTVFVSVANRDKRSLVFPVKRLADLGFRVLATEGTAEMLRRNGIPCDEVRKHFEDPQPGRPEMSAVDAIKAGEVDMVINTPYGNSGPRIDGYEIRSAAVSVNIPCVTTVQGASAAVQGIEAGIRGDIGVRSLQELHSQIASDKGPR

SEQ ID NO: 50058 - protein, 180 aa, Solanum lycopersicum
MASSVMSSAAVATRGNGAQASMVAPFTGLKSTASFPVSRKQNLDITSIASNGGRVSCMQVWPPINMKKYETLSYLPDLSDEQLLSEIEYLLKNGWVPCLEFETEHGFVYRENHKSPGYYDGRYWTMWKLPMFGCTDATQVLAEVQEAKKAYPQAWVRIIGFDNVRQVQCISFIAYKPEGY

SEQ ID NO: 50059 - protein, 180 aa, Pisum sativum
MASMISSSAVTTVSRASTVQSAAVAPFGGLKSMTGFPVKKVNTDITSITSNGGRVKCMQVWPPIGKKKFETLSYLPPLTRDQLLKEVEYLLRKGWVPCLEFELEKGFVYREHNKSPGYYDGRYWTMWKLPMFGTTDASQVLKELDEVVAAYPQAFVRIIGFDNVRQVQCISFIAHTPESY

SEQ ID NO: 50060 - protein, 360 aa, Coccidioides immitis RS
MSASTRNLLGNVRRLVPPMLEKFHKGQLGRVAVIGGSIDYTGAPYFSAMASAKLGCDMSHVICEPSAATVIKSYSPNLMVHPILQSSKSLSNPIPAPDPRHHAEPIISFLPRVHVLVIGPGLGRDPITQSIVVEVLREARAKAIPLVLDADALLLVQDRPDLVHGYEECILTPNVVEFRRLTEAFGVDVSVAGERREEGECEACERLSRALGGVMIVQKGIHDVISNGVTSLISDVQGGKKRSGGQGDTMTGSLGTFLAWRKAYHEGLWDAGEEDRSKQGEAESRSDVEVELQEDGGKMMKKMSRKTTMLLAAWAGSTITRECSRRAFLAKGRSMQASDLTDEVHGAFLDLIGEPEGSKL

SEQ ID NO: 50061 - protein, 295 aa, Zea mays
  misc_feature (175)..(175): Xaa can be any naturally occurring amino acid
  misc_feature (194)..(194): Xaa can be any naturally occurring amino acid
RESESEAASRRQGEMGKGAQGSDAAAAGGEVEENMAAWLVAKNTLKIMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANHVVHPADLCFQLPDGVSLXEGALCEPLTVGVPACRRAXLGPETGVLVVGRRPIGLLSVVAGPAFLRAPRVGPGVGPTPPGRASSLARPRPAGCPPPADLVAKWNPSPAWARNSFSLLRGFFRPSPARGDCSLERFPGVR

SEQ ID NO: 50062 - protein, 376 aa, Antirrhinum hispanicum
MMDRRFPRQDVISEILLFSSVKSLLRFRCVSKSWCSLIKSNDFIDNHLLRRQTNGNVMVVKRYVRTPERDMFSFYNINSPELDELLPDLPNPYFKNIKFDYDYFYLPQRVNLMGPCNGLICLAYGDCVLLSNPALREIKRLPPTPFANPEGHCTDIIGYGFGNTCNDCYKVVLIESVGPEDHHINIYVYYSDTNSWKHIEDDSTPIKYICHFPCNELFFKGAFHWNANSTDIFYADFILTFDIITEVFKEMAYPHCLAQFSNSFLSLMSLNECLAMVRYKEWMEDPELFDIWVMNQYGVRESWTKQYVIGPQVVVCSHVCWKNDECLIVEDGNGQLVSCAFRTNKIEKLPIYAVEETLRVLIVDESLISLNRVLNL

SEQ ID NO: 50063 - protein, 376 aa, Antirrhinum hispanicum
MMDRRFPRQDVTSEILLFSSVKSLLRFRLVSKSWCSLIKSNDFIDNHLLRRQTNGNVMVVKRYVRTPERDMFSFYNINSPELDELLPDLPNPYFKNIKFDYDYFYLPQRVNLMGPCNGLICLAYGDCVLLSNPALREIKRLPPTPFANPEGHCTDIIGYGFGNTCNDCYKVVLIESVGPEDHHINIYVYYSDTNSWKHIEDDSTPIKYICHFPCNELFFKGAFHWNANSTDIFYADFILTFDIITEVFKEMAYPHCLAQFSNSFLSLMSLNECLAMVRYKEWMEEPELFDIWVMKQYGVRESWTKQYVIGPQVVVCSHVCWKSDECLIVEDGNGQLVSCAFRTNEIKKLPIYAVEETLRVLIVDESLISLNRVLNF

SEQ ID NO: 50064 - protein, 308 aa, Brucella melitensis 16M
MILCCGEALIDMLPRETTGGETAFQPFAGGSVFNTAIALGRLGVPTGFFSGISSDFFGDVLRDTLARSNVDYSFAAISNRPTTLAFVRLVDGQARYAFYDENTAGRMLSRNDMPYVDETISAMLFGCISLISEPCGSVYETLLAREAPNRVMFLDPNIRANLITVRETHLTRVKRMIALADIVKLSDEDLDWFGEKGSHDEIAAEWLKLGPKLVVITKGAHGAVAYTNHATVPVPGVKVDVVDTVGAGDTVNAGILASLHSQGLLTKDALANLSEDQIHSAVALGVRAATVTVSRAGANPPWAHEMRD

SEQ ID NO: 50065 - protein, 389 aa, Brassica napus
  misc_feature (182)..(182): Xaa can be any naturally occurring amino acid
MALQATTTTFSFSAPTFRSTPPHALTSKRRLSIKASSSSGLSSPPLLSLSRSNLKGRAFASDGSTQESPSVVCFGEMLIDFVPTTSGLSLAQAPAFKKAPGGAPANVAVGIARLGGSSAFIGKVGEDEFGYMLANILKDNNVNNEGMRFDPGARTALAFVTLTNEGEREFMFYRNPSADMLXEESELDLDLIKKAKIFHYGSISLITEPCKSAHIAAAKAAKEAGVILSYDPNLRLPLWPSADNARDEILSVWDTADIIKISEEEIEFLTKGEDPYDDSVVRKLFHPKLKLLLVTEGPEGCRYYTKDFSGRVHGLKVEVVDTTGAGDAFVAGILSQLACDLSLLQDEERLREALMFANACGALTVKERGAIPALPTKEAVLEALLKAVV

SEQ ID NO: 50066 - protein, 162 aa, Yersinia pestis KIM
MTVIKYSDYNFRTSLNALRRYVVSAPLPYIKPGERVIIYDGVCALCTGWVNFLIRHDRRHTVRLSAVQSKKGHALLEWAGLPTDKINTLVLIENQQVYLRSEAIFRVIANLPWPWRILGVLRIFPRPLRDRCYDGIALNRYRLFGRYDAVRKLKADHERRFL

SEQ ID NO: 50067 - protein, 684 aa, Arabidopsis thaliana
  misc_feature (213)..(213): Xaa can be any naturally occurring amino acid
  misc_feature (253)..(253): Xaa can be any naturally occurring amino acid
MKAVAFPAKIANLSFPSNCCSLFFRSPATFLSPALPCRKLTKGIRGVEGLMSQCLSSSSQSLSFLSNSFSSQPESELLQALPSSKPKSPPLQLPWLIVGLGNPGKKYQGTRHNVGFEMVDALADAEGISMNTVNFKALFGKGVIGNIPIMLAKPQTFMNLSVLVVYDDLDLPFGKLRLLPKGGHGGHNGMRSIIDRPQGSRDFPRLRIGSGRXPPGTPRDYREPRPVFKPSGDKAQIENRSTLVVLCSHVRRXMKCQLLWLTWVRTLARLVTPAVFPSVIGAVDGVEAMDVDVDSTKTNSNSEDSKTESEKEKSKRKLYVGSQAMSYRRDHMEVLSPIKDGIVSDWDLVDNIWEHAFKSCLMIDPTEHPMLLAEPPLNTQQQREKAAELMFEKYKVPALFMAKNPVLTSFATGRATSLVVDCGGGSTTISPVHDGYVLQKAVVSSPLGGEFLTDCLLKSLESKGIKIRPRYSFKRKEVRAGEFQVEDVDIPDTTESYKLFCQRMIVGDIKDSICRVPDTPYDDKSYSNIPTTSYELPDGQTLEIGADRFKVPDVMFNPSIVQTIPGMEKYAEMIPSVRGLPHMVMESINKCDVDIRRELYSSILLAGGTSSMQQLKERLEKDLIEESPHSARVKVLASGNTTERRFSVWIGGSILASLGSFQQMWFSKSEYEEHGASYIQRKCP

SEQ ID NO: 50068 - protein, 371 aa, Methanocaldococcus jannaschii
  misc_feature (45)..(45): Xaa can be any naturally occurring amino acid
MFISYWLLQNVFERHYIKKFLVLSMMKVCVIEGDGIGKEVIPEAXKILNELGEFEIIKGEAGLECLKKYGNALPEDTIEKAKEADIILFGAITSPKPGEVQNYKSPIITLRKMFHLYANVRPINNFGIGQLIGKIADYEFLNAKNIDIVIIRENTEDLYVGRERLENDTAIAERVITRKGSERIIRFAFEYAIKNNRKKVSCIHKANVLRITDGLFLEVFNEIKKHYNIEADDYLVDSTAMNLIKHPEKFDVIVTTNMFGDILSDEASALIGGLGLAPSANIGDDKALFEPVHGSAPDIAGKGIANPMASILSIAMLFDYIGEKEKGDLIREAVKYCLINKKVTPDLGGDLKTKDVGDEILNYIRKKLKGY

SEQ ID NO: 50069 - protein, 337 aa, Methanocaldococcus jannaschii
MVISMHKICVIEGDGIGKEVVPATIQVLEATGLPFEFVYAEAGDEVYKRTGKALPEETIETALDCDAVLFGAAGETAADVIVKLRHILDTYANIRPVKAYKGVKCLRPDIDYVIVRENTEGLYKGIEAEIDEGITIATRVITEKACERIFRFAFNLARERKKMGKEGKVTCAHKANVLKLTDGLFKKIFYKVAEEYDDIKAEDYYIDAMNMYIITKPQVFDVVVTSNLFGDILSDGAAGTVGGLGLAPSANIGDEHGLFEPVHGSAPDIAGKKIANPTATILSAVLMLRYLGEYEAADKVEKALEEVLALGLTTPDLGGNLNTFEMAEEVAKRVREE

SEQ ID NO: 50070 - protein, 468 aa, Anaplasma phagocytophilum HZ
MGSSNYDVAVIGAGPGGYKCAIKAAKLGLSVVCIDKNSQWGGTCLRVGCIPSKAMLEYSYKFHSAKDLFPKLGVMAKDVAFDLKKMFEVRDNEIAVLSSGIDGLFSAAGVHKLRAEAKIAGKKGDFFEVVLSNQDGSLGQVLARNVVLATGSTPTSLPGIDVDGDSVIFSDGALSMDVPKRLLVIGGGAIGLEMSSIWSRLGSEVTVVEYADKIASGFDADISKALQGFLEKQGIKFNLAQKVVSVAKGNTGLLVNCESVVNGAMASMEVDKVLVAVGRSPSITGVVAMDGLLLDNRGFVCVNNRYETSIKGIYAIGDVIGGAMLAHKAEIEGHAVAELIAGNVTQVDYGVIPAVIYTHPAAASVGRGEESLKSVNYKYKVGKSSFAANGRARVACDSDGFVKVIACKETDVILGVHIVGAHADTMINEAAVALGYRATAKDICHICHSHPDVNEVFRDACEVVSHKR

SEQ ID NO: 50071 - protein, 367 aa, Oryza sativa
  misc_feature (254)..(254): Xaa can be any naturally occurring amino acid
MDSGAAAVCAEKASEIIKIGQVDDVQELQRRLCSATTVPERYIRDGDDRPDHAVVDDERAQERIPVIDVGELQRGSEDELDNLRLACEQWGFFQVVNHGVEEETMEEMEKAAREFFMLPLEEKEKYPMEPGGIQGYGHAFVFSDDQKLDWCNMLALGVEPAFIRRPNLWPTTPANFSKTLEKYSVEIRELCVRLLEHIAAALGLAPARLNGMFGEAVQAVRMNFYPPCPRPELVLGLSPHSDGSAVTVLQQDAXAFAGLQVLRGGGGWVAVHPVPGALVVNVGDTLEVLTNGRYKSVEHRAVASGEHDRMSVVTFYAPAYDVELGPLPELVADGEPRRYRTYNHGEYSRHYVTSRLQGKKTLEFAKI

SEQ ID NO: 50072 - protein, 441 aa, Mesorhizobium sp. BNC1
MLERPKRPNDLSAFWMPFTANRQFKQAPRMLVSAKDMHYTTDDGRKLLDGTAGLWCVNAGHCRPKITEAIRHQAGELDYAPAFQMGHPIVFEFASRLVDIAPEGMDHVFFTNSGSESVETALKIALAYHRAKGDGSRTRLIGRERGYHGVNFGGISVGGIVNNRKMFGTLLAGVDHLPHTYLPGKNAFSRGVPEHGVELADELERIVALHDASTIAAVIVEPVAGSAGVILPPKGYLKRLREICDKHGILLIFDEVITGFGRLGTPFAADYFGVVPDIMTTAKGITNGVIPMGAVFVKKEIHDAFMNGPEHMIEFFHGYTYSGNPIACAAGLATLETYREEGLLTRGEELGQHWEDALHSLKGEPHVIDIRNIGLVGAIEMEPIQGQPTKRAFSAFLKGFEKGLLIRTTGDIIALSPPLIITKGQIDEIVDHVREILRSID

SEQ ID NO: 50073 - protein, 162 aa, Arabidopsis thaliana
  misc_feature (16)..(16): Xaa can be any naturally occurring amino acid
  misc_feature (89)..(89): Xaa can be any naturally occurring amino acid
  misc_feature (132)..(132): Xaa can be any naturally occurring amino acid
  misc_feature (142)..(142): Xaa can be any naturally occurring amino acid
MASSMLSSATMVASPXAQATMVAPFNGLKSSAAFPATRKANNDITSITSNGGRVNCMQVWPPIGKKKFETLSYLPDLTDSELAKEVDYXLSRNKWDSLVVEFELEHGFVYPWSTGNLTRVTMMGRYWNMWKXLPLIGCIESXQVVERKWEKCKKVITPNAFV

SEQ ID NO: 50074 - protein, 316 aa, Escherichia coli
TDKLTSLRQYTTVVADTGDIAAMKLYQPQDATTNPSLILNAAQIPEYRKLIDDAVAWAKQQSNDRAQQIVDATDKLAVNIGLEILKLVPGRISTEVDARLSYDTEASIAKAKRLIKLYNDAGISNDRILIKLASTWQGIRAAEQLEKEGINCNLTLLFSFAQARACAEAGVFLIAPFVGRILDWYKANTDKKEYAPAEDPGVVSVSEIYQYYKEHGYETVVMGASFRNIGEILELAGCDRLTIAPALLKELAESEGAIERKLSYTGEVKARPARITESEFLWQHNQDPMAVDKLAEGIRKFAIDQEKLEKMIGDLL

SEQ ID NO: 50075 - protein, 550 aa, Acinetobacter sp. ADP1
MLIERTCAILGKMLEYCASLVALHSCVIMTTNTHITDDRILILDFGSQYSQLIARRVREAGVYSEMYAFDMSEEDIRAFNPNGIILSGGPESVHEEGSPRAPQVVFELGVPVLGICYGFQTMSEQLGGKVEPGTVHEFGYAEVDIQQRDQLVGNLQDRENQLHVWMSHGDKVSRLPEGFSTTASTPSCPFAAASDEARRFYGVQFHPEVTHTAKGAELLANFVHKICGCGGLWTPEHIIDLRVEQLRAQIGDEKVLLGLSGGVDSSVVAALLHKAIGDQLTCVFVDNGLLRLNEGDQVMQMFADNMGIRVIRADAEERFLTALAGEVDPEKKRKIIGREFIEVFAEEARKLDGVKFLAQGTIYPDVIESAASKQGKAHVIKSHHNVGGLPDDLEFELVEPLRDLFKDEVRKLGTTLGLPHSMIYRHPFPGPGLGVRILGEVKKEYADILRLADDIFMQELRASGWYDKTAQAFAVFQPVKSVGVVGDGRRYAWVIALRAVETVDFMTARFAHLPYELVDKISTRIMNEIKDVSRVVYDVSSKPPATIEWE

SEQ ID NO: 50076 - protein, 220 aa, Escherichia coli
  misc_feature (1)..(1): Xaa can be any naturally occurring amino acid
  misc_feature (17)..(17): Xaa can be any naturally occurring amino acid
  misc_feature (137)..(137): Xaa can be any naturally occurring amino acid
  misc_feature (152)..(152): Xaa can be any naturally occurring amino acid
  misc_feature (164)..(164): Xaa can be any naturally occurring amino acid
XKDIDTLISNNALWSKXLVEEDPGFFEKLAQAQKPRFLWIGCSDSRVPAERLTGLEPGELFVHRNVANLVIHTDLNCLSVVQYAVDVLEVEHIIICGHYGCGGVQAAVENPELGLINNWLLHIRDIWFKHSSLLGEXPQERRLDTLCELNVXEQVYNLGHSTIXQSAWKRGQKVTIHGWAYGIHDGLLRDLDVTATNRETLEQRYRHGISNLKLKHANHK

SEQ ID NO: 50077 - protein, 400 aa, Glycine max
MKTHSGLVILLILFLTSLVLLLILRRKTSQQKRDEKGVSGRSSTKPLTGYSFGRDGNIMDEGTAYYITLSELKEATNNFSKNIGKGSFGSVYYGKMKDGKEVAVKTMTDPSSYGNQQFVNEVALLSRIHHRNLVPLIGYCEEEYQHILVYEYMHNGTLREYIHECSSQKQLDWLARLRIAEDAAKGLEYLHTGCNPSIIHRDVKTSNILLDINMRAKVSDFGLSRLAEEDLTHISSVARGTVGYLDPEYYANQQLTEKSDVYSFGVVLLELLSGKKAVSSEDYGPEMNIVHWARSLIRKGDVISIMDPSLVGNLKTESVWRVAEIAMQCVEQHGACRPRMQEVILAIQDASNIEKGTESQLKLSSSGGNSKPQSSRKTLLASFLEIESPDLSNSCLPSAR

SEQ ID NO: 50078 - protein, 134 aa, Glycine max
RGRVGDHRLSRAKFFFIALECSFSWYVVPGYLFTTLTNISWVCWIFSKSVTAQQIGSGMRGLGVGALTLDWAAVALFLFSPLILPFFAIVNVFGGYALIVYVVIPLLYIFFLVYNDFQFLFFFLLLIFYLLISI

SEQ ID NO: 50079 - protein, 177 aa, Lemna gibba
MASSMMASTAAAVARAGPAQTNMVPFNACRSSVPFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 50080 - protein, 180 aa, Solanum lycopersicum
MASSIVSSAAVATRGNGAQASMVAPFTGLKSTASFPVSRKQNLDITSIASNGGRVSCMQVWPPINMKKYETLSYLPDLSDEQLLSEIEYLLKNGWVPCLEFETEHGFVYRENHKSPGYYDGRYWTMWKLPMFGCTDATQVLAEVQEAKKAYPQAWVRIIGFDNVRQVQCISFIAYKPEGY

SEQ ID NO: 50081 - protein, 178 aa, Glycine max
MASSMISSPAVTTVNRAGAGMVAPFTGLKSMAGLPTRKTNNDITSIASNGGRVQCMQVWPPVGKKKFETLSYLPDLDDAQLAKEVEYLLRKGWIPCLEFELEHGFVYREHNRSLGYYDGRYWTMWKLPMFGCTDASQVLKELQEAKTAYPNGFIRIIGFDNVRQVQCISFIAYKPPSF

SEQ ID NO: 50082 - protein, 118 aa, Ralstonia metallidurans CH34
MKTQDNCIFCKIVAGQIPSNKVYEDEDLLAFHDIHPKAPVHFLLIPKSHVDSLADCGPGESDVLARMMLKVPELARQAGCNNGFRTVINTGTDGGQEVFHLHIHVMGGPRSQWKAPAP

SEQ ID NO: 50083 - protein, 505 aa, Escherichia coli O157:H7 EDL933
  misc_feature (324)..(324): Xaa can be any naturally occurring amino acid
MCLDSFINVNGCFLLWRAKGETLMSAIDSQLPSSSGQDRPTDEVDRILSPGKLIILGLQHVLVMYAGAVAVPLMIGDRLGLSKEAIAMLISSDLFCCGIVTLLQCIGIGRFMGIRLPVIMSVTFAAVTPMIAIGMNPDIGLLGIFGATIAAGFITTLLAQLIGRLMPLFPPLVTGVVITSIGLSIIQVGIDWAAGGKGNPQYGNPVYLGISFAVLIFILLITRYAKGFMSNVAVLLGIVFGFLLSWMMNEVNLSGLHDASWFAIVTPMSFGMPIFDPVSILTMTAVLIIVFIESMGMFLALGEIVGRKLSSHDIIRGLRVDGVXTMIGGTFNSFPHTSFSQNVGLVSVTRVHSRWVCISSGIILILFGMVPKMAVLVASIPQFVLGGAGLVMFGMVLATGIRILSRCNYTTNRYNLYIVAISLGVGMTPTLSHDFFSKLPAVLQPLLHSGIMLATLSAVVLNVFFNGYQHHADLVKESVSDKDLKVRTVRMWLLMRKLKKNEHGE

SEQ ID NO: 50084 - protein, 177 aa, Lemna gibba
MASSMMASTAAVARAGPAQSSMVAPFNGLRSSVAFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 50085 - protein, 177 aa, Lemna gibba
MASSMMASTAAVARVGPAQTNMVAPFNGLRSSVAFPATRKANNDLSTLPSNGGRVSCMQVWPPEGLKKFETLSYLPPLSVEDLAKEVDYLLRNDWVPCIEFSKEGFVYRENHASPGYYDGRYWTMWKLPMFGCTDASQVIAEVEEAKKAYPEYFVRIIGFDNKRQVQCISFIAYKPT

SEQ ID NO: 50086 - protein, 180 aa, Nicotiana plumbaginifolia
MASSVLSSAAVATRSNVAQANMVAPFTGLKSAASFPVSRKQNLDITSIASNGGRVQCMQVWPPINKKKYETLSYLPDLSQEQLLSEIEYLLKSGWVPCLEFETERGFVYREHHHSPGYYDGRYWTMWKLPMFGCTDATQVLAEVEEAKKAYPQAWVRIIGFDNVRQVQCISFIAYKPEGY

SEQ ID NO: 50087 - protein, 135 aa, Zea mays
MRKHRIVSLVAALLVLLALAAVSSTRSTQKESVADNAGMLAGGIKDVPANENDLQLQELARFAVNEHNQKANALLGFEKLVKAKTQVVAGTMYYLTIEVKDGEVKKLYEAKVWEKPWENFKQLQEFKPVEEGASA

SEQ ID NO: 50088 - protein, 376 aa, Arabidopsis thaliana
MKNSIPIDLIIEIVSRSTAKSVARCHCVSKQWRAIFRRKYFIELFLTRSKARPRILFVVQDGEWSEWSFLSLPQPQNSSLVVESADIHMKKFSAGISGSIYFTYASGLIYFKCMRIPKEDEDEKPVLCDPLTGKYVILPEPRVFGMYSYLGFDPVDKEFKVLFMASGYTASKDVDHYILTLRTGELKWRTIQCPFTHEPLWTRICINGVLYYSAMNSDGNYVIVCFDVRYEKFKLVDTKCRSEFNGLINYKGKLCGVKLKYAYRVGFPVKLRMRVLEDVEKDEWSTYVKVKVKQNLSVAGMTATGDIVLFMKFASNPFYVFYFNPERNSLEVQSVEIQGLGANPDRIACNAFVDYVEDLSVNDAMLQLNSIPLQQD

SEQ ID NO: 50089 - protein, 513 aa, Zea mays
MLMEEECVEAPSYIHIDSNAFSYRKHKSQTEEDIAVCECQYDILDPESPCGDRCLNLLTNTECTPGYCRCGVYCKNQRFQKCQYARTRLVRTGGRGWGLVADENIMAGQFVIEYCGEVISWKEAKRRAQAYETQCLKDAYIIYLNADESIDATRKGNLARFINHSCQPNCETRKWNVLGEVRVGIFAKQNIPFGTELSYDYNFEWYGGVMVRCLCGAASCSGFLGAKSRGFQEATYLWEDDDDRFSVENIPLYDSADDEPTSINKEILVSSDGMVTQYSNISRVQSTENPGNTGTNEFAPIIVDELTSSNGLAPMNVEPLTVSSNEFTPSNAMPMVARLVENGSTGYSAQDTHDASQNSAPKAANHANQTGPQNNSNHSALVPVKPAPKRRGRKPKRVVHKQLDIPDICDRLTSSVACEEILYCEEVKNQAVSEIDALYDEIRPAVEEHERDSQDSVSTSLAEKWIEASCRKYKAEFDLYAAVLKNVASTPLRSKDDVGPREQNGLKYLENGS

SEQ ID NO: 50090 - protein, 415 aa, Picrophilus torridus DSM 9790
MEDLDPFTISRQQLQKAAKVMNLDKQALEILSYPREILQVSIPVKMDSGEVKVFTGFRVHYNNARGPTKGGIRYYEKENLSEVMALSAWMTWKTALLDLPLGGAKGGIICNPKELSQGELERLSRGYIDAIADFIGPDKDIPAPDVYTNPQIMAWMMDEYEKVMRRSSPGVITGKPLAVGGSEGRGDATAKGGMYVLREAARSIGLDLSKAKVAVQGFGNAGQYAVKFATEMFGAKVVAVSDSTGGIYAKDGVNYEKLLEHKRKDGTVMNYDGSENISEEEVLEQDVDVLIPAAIEDQIRGDNASKIKAKIILELANGPTTPEADEILYKNNVLVLPDFLSNAGGVTVSYFEWVQNVTGDYWDEETVYSKLDKKMTAATRSVLETSKRYEVDPRTAAYIIAVKKVADAMKARGWY

SEQ ID NO: 50091 - protein, 135 aa, Ralstonia metallidurans CH34
MAKKWLNKVKWDDNGLVPVIVQEVGSNDVLMFAFMNRDALQRTVELGEAVFWSRSRKRLWHKGEESGHVQKVHEIRLDCDEDVVLLKVTQIDSIACHTGRHSCFFQKFEGDVESGDWQTVEPVLKDPSSIYAAKP

SEQ ID NO: 50092 - protein, 180 aa, Solanum tuberosum
MASSVMSSAAVATRGNGAQASMVAPFTGLKSAASFPVSRKQNLDITSIASNGGRVRCMQVWPPINMKKYETLSYLPDLSDEQLLKEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 50093 - protein, 195 aa, Ralstonia metallidurans CH34
MRVAEVTRNTSETQIRVSLNLDGTGRQKLASGVPFLDHMLDQIARHGMFDLEVEATGDTHIDDHHTVEDVGITLGQAVARAIGDKKGITRYGHSYVPLDECLSRVVIDFSGRPGLEFHVPFTRARVGSFDVDLTIEFFRGFVNHAGVTLHIDNIRGINAHHQCETVFKAFGRALRMAVELDPRAANTIPSTKGTL

SEQ ID NO: 50094 - protein, 180 aa, Solanum tuberosum
MASSIVSSAAVATRANGAQASMVGPFTGLKSTASFPVSRKQNLDITSIASNGGRVRCMQVWPPINMKKYETLSYLPDLSDEQLLKEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 50095 - protein, 392 aa, Oryza sativa (japonica cultivar-group)
MLHLRQCLLPLLRAAAAAHPHTSAASSSSLHLSRRLFSTAAGPDTAPPFSVEEYLVATCGLTGAQALKASKKLSHLRSPAKPDAVLAVLSGVGLSRADLAAVVAADPMLLCARARNVARRLHSLRDRVGLSDADVARFLLAGGAMGLRKCDIAPRLEFWIGFVGSFDKLLPALKGNNGILMSDLDKVVKPNIALLQECGLSVCEIAKLSTLKWTVLSLSPERVKASVLCVEKLVVPRSSDRFKHVLKSACWISEDMLAMKMEFLRSTLGCSEDKLRAAVCISPHIFYLSDKNLCRKIDFLISEVGLEREFIVERPWVLGYSLEKRMVPRHSVMKILRTMGLMKDAVDFSSSLVYSEKKFVARYIDPYKQAAPTLADSYAAACAGKMPAHVHR

SEQ ID NO: 50096 - protein, 180 aa, Solanum tuberosum
MASSVMSSAAVATRGNGAQASMVAPFTGLKSTASFPVSRKQNLDITSIASNGGRVRCMQVWPPINMKKYETLSYLPDLSDEQLLKEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 50097 - protein, 419 aa, Rhodococcus ruber
AAERERMIWRVGDLLTQRAEEFGQLEALDNGKSAVIAAAVDTAWSADIFRYYAGWATKIEGSTVNVTMPFVPGGEFHAYTLREPVGVCGLIVPWNFPLLMAAFKLAPALAAGNTVILKPAEQTPLTALLLAEIFEEAGFPPGVVNIVPGFGDAGAALAAHDDVDKIAFTGSTEVGKKVVDAAKGNLKKVSLELGGKSPNIVFADADFDAAVQGSLDAWLFNHGQCCVAGTRLFVERPIFERFTEAVAEAASKVKIGPGLDPATQLGPLVSQEQLDRVTGYLREGLIDGARALTGGKRWGDKGFFVEPTVLVDVQPDFSVVREEIFGPVVNAMPFDADDGISAAANDSIYGLAAGIWTRDLSKAHRTARRLKAGSVWINQYNGFDTAMPFGGFKQSGWGRELGAGALDLYTQTKAVNIAL

SEQ ID NO: 50098 - protein, 393 aa, Aspergillus oryzae
MSKAQPIKRRPDGRSKFDLNIDSPQLQHLTRHIDEAEHVRIENCIGFVQVPVGIAGPLRITGPETTGEYYAPLATCEPTLVASCSRGCKVFNACGGLQFEVLSEAMSRAPMFLFASPAHAVAFARAVPSFRNEFARWAESTSRYVRLQELQASVIGSSVHLFCSYFCGNAAGQNMVSKATQHACEMLRAHRCAKQFQIQDFLIEGQLASDKKPSWGNVQRARGVEALAWGTITNAACQEILGCSTERLYRTQMALKEGGIRNGQFGCNINTANIIAAIFVSTGQDAGSVAEASWSHLTSEYDYESKELKMTIYFPSLPVGTVGGGTLYPSQKECLDMLGCAEPSGKRRLAGMIAAFAVALDASTSAAIANDTFTMSHMKLARGEIFGPRASKL

SEQ ID NO: 50099 - protein, 179 aa, Acorus calamus
MFPMVTGFMNYGQQTVRAARYIGQSFMITLSHANRLPVTIQYPYEKLITSERFRGRIHFEFDKCIACEVCVRVCPIDLPVVDWRLDTDVRKKQLLNYSIDFGVCIFCGNCVEYCPTNCLSMTEEYELSTYDRHELNYNQIALGRLPMSVIEDYTIRTTTNLTPIKIAKNKPLGSRTITN

SEQ ID NO: 50100 - protein, 321 aa, Candida albicans SC5314
MEVLHQLTTNHTSSLSNLINNHPTSFSSILKEVDITNHSLTYIEKLWASYYIYMNNDILATGLLFFITHELMYFGRCLPWFIIDKTPWFNRYKIQPTKIPTNQEQWECFKTVLKQHFLVEALPIWLFHPVCAKLGITYDVPFPNWKIQAIQIAIFFICEDFWHFVFHSLFHQGWFYKNIHKVHHKYAAPFGLAAEYAHPVEVMALGVGTVGFPILYAYLATVYTNMPPLHLFTLTTWIVLRLFQAVDSHSGYDFPWSLNKFFPLWAGAAHHDEHHHYFIGNYASSFTLWDWLFQTECGTYARKRRERNSRASAESKHKKTL

SEQ ID NO: 50101 - protein, 792 aa, Anaplasma phagocytophilum HZ
MRFAYSWLLDCLDAGCSAQVLVDELSSIGVEAALVEGGVKQGSFVVAKVLEVLAHPDAHKLKVCKVYDGVEVLQIVCGASNVRSGMITVLARVGAYIQESGITISKAVIRGIESSGMLCSLEELGMSSSWDPSSGIVDLSESSEYAVGEDFIPQEEIIEVSVTPNRGDCLGVYGIARELAAAGMGSLKELPVVGGDAALCKPSFALDMRVDGLIMGCSIKSISNKSASPRWIRERLLAAGVKTVSCVVDIVNYVMMLLNRPMHVYDADKIKGAALIVEKVARGDCIAINGKKYELAGDVVIRDADGIVHCIAGIMGSEQSKCTSDTENIFIESAWYDPVDIALSSRRLRLNTDSSYRFARYVDPKLVGFGLNYAAYLISKYCGGEVSEVVISGSAPNKAAHIEFDPEIVSKIGSVSIDRERILSILESLGFVIDAASGELWRVEVPSWRNDVSSPHDLVEEVLRIHGYDAIQEQEVLPARVLERKANAVDDSLNNRVRASMLSQGLTEVITWSFLAGAVVEKMGFSVEDLYIDNPISNQFNVMRPSVLPNLLQVVSNNQACGRDSISVFELGDVYIALDRSDCVVCGVRAGNDLPRNPHASIRKFDFFDVKADIERVFLQFGISEADLEFRASTRDYLHPSRSADVYCQGLLCGYVGELHPSFVEFFELKDKVACFEVFLSGLSSQEEKVRGGFFLNKYQVVKRDFAFILDKEIKARELVTVIKAVRYVEDVSVFDVYSGVNIPEGKVSIAVAVVITSGLGTMTEAEIKEVSDSIIESVKRELHGQLRLESA

SEQ ID NO: 50102 - protein, 135 aa, Vibrio vulnificus CMCP6
MHTTLAHTYPVKQRRYGVHMAEETIFSKIIRKEIPAQILFQDDLVTAFRDINPRAPKHILIIPNKLIPTVNDVEADDEAMMGRMFTVAKQLAKEEGIAEEGYRLIVNCNAHGGQEVYHIHMHLVGGKPLGPMLLG

SEQ ID NO: 50103 - protein, 566 aa, Acinetobacter sp. ADP1
MTAETNTNKHPLYIPYAGYTLLELPLLNKGSAFTQEERSHFNLHGLIPHVIETIEEQSQRSYQQYGAFNDDINKHIYLRNIQDTNETLFYRLINDHLEEMMPIIYTPTVGEACQRFSDIYRRHRGIFISYPDREHIDDILQNVSKRNVKVIVITDGERILGLGDQGIGGMGIPIGKLSLYTACGGISPAYTLPITIDVGTNNQQLLNDPIYMGWRQPRISGDEYYEFIDQVLTGIRRRWPHALIQFEDFAQKNAMPLLTKYRDKFCCFNDDIQGTAAVSVGSLIAASRAAGKQLKDQTITFLGAGSAGCGIAEQIVAQMVAEGLTDAQARARVYMVDRFGLITENQPNLLDFQRKLAQKAEVVSDWGNVEEVISLLDVVKNAKPTVLIGVSGQPGLFTEEVIRTLAENCERPIVMPLSNPTSRVEALPSDVIQWTNGRALIATGSPFAPVNYQGKLYNISQCNNSYIFPGIGLGVIASGAKRVTDNMLMASSNALADCSPLLQNPNADLLPAIADIQDVSKRIAFKVAKAAIEDGVALNMSDEVLLQNIEKEFWKPKYRGYKRVPF

SEQ ID NO: 50104 - protein, 128 aa, Anaplasma phagocytophilum HZ
MSGLLEKFNNKQIEQLRLATNLDIPEFRPGDTVKVNINVFDGVGWRIQTFEGVCIKKRNRGLHSSFTLRKISHNESIQLQVFTHSPNLKSVELVRTGKVRRAKLYYLLELFGKAARIKERTTTRKKTA

SEQ ID NO: 50105 - protein, 681 aa, Haloarcula marismortui ATCC 43049
MPQNHELVEELIQFFRDYYSEEIAQLAQRYPREQKSLHVDYDDLYRFDPGIADDVRNHPKELQEHLEEALRLYDLPVAVELNDAHVRIYNLPEIHVFDPSGVSRHENIGQLLDIRGQVQKVSDVKPRLTEAVWECQRCGTQTEIPQHGDSLQEPHECQGCERQGPFSLDASASSWIDHQYARIQQPPEKTNGGEAQSVDAHLEDDLIEGFDAGDRVVLTGVLDIEEPGADQGLDFDTNLDARSVVKEESDYDDVDVEEHLDEIEAIANGERGDPYQLLIDSINPKHRGDEHVKLAVALQLFGGWAHEYPDGSRDRGDCHMLLLGDPGCGKSTFLRYVDQIAPRSTYASGKGATAAGMTAAAVSDDFGDTEWGLEAGALVLADGGIACVDEIDKMQSDAVSSMHDALESQQVHVNKAGINATLNARTSLLAAGNPKDGRFDRYRPKGEQIDMGPTLLSRFDLMFMVSDEPDREDDADVVEHMLQSRQAAGRHTRGENLSEEEQKRVEPAIDRSVMRAYIAHAKQICHPIIEDEEVAERLKQFFVEFRAGAGEQDDDSPIPVTFRKVEAIQRLAESSARVRLSDTVEIEDIERAIKLVTKSMRQVGYDPESGEFDADIIETGLSENQRERRERIVTVIERLDGATVGEIDDKVKFEEEILQYDVEQLKEAGRIYAVNDEFRRT

SEQ ID NO: 50106 - protein, 495 aa, Escherichia coli K12
MNFHHLAYWQDKALSLAIENRLFINGEYTAAAENETFETVDPVTQAPLAKIARGKSVDIDRAMSAARGVFERGDWSLSSPAKRKAVLNKLADLMEAHAEELALLETLDTGKPIRHSLRDDIPGAARAIRWYAEAIDKVYGEVATTSSHELAMIVREPVGVIAAIVPWNFPLLLTCWKLGPALAAGNSVILKPSEKSPLSAIRLAGLAKEAGLPDGVLNVVTGFGHEAGQALSRHNDIDAIAFTGSTRTGKQLLKDAGDSNMKRVWLEAGGKSANIVFADCPDLQQAASATAAGIFYNQGQVCIAGTRLLLEESIADEFLALLKQQAQNWQPGHPLDPATTMGTLIDCAHADSVHSFIREGESKGQLLLDGRNAGLAAAIGPTIFVDVDPNASLSREEIFGPVLVVTRFTSEEQALQLANDSQYGLGAAVWTRDLSRAHRMSRRLKAGSVFVNNYNDGDMTVPFGGYKQSGNGRDKSLHALEKFTELKTIWISLEA

SEQ ID NO: 50107 - protein, 479 aa, Prochlorococcus marinus str. MIT 9303
MALHRSNPRSNDLEEHAIWETVDALVSPLPRATFPQECRPALTTFNLLKEELLLDGNSKQNLATFCQTYESHQVADLMALAVDKNLIDKDEYPQTAEIERRCVSMMADLWHAPGEAVGCSTIGSSEAAMLGGLAAKWRWREHRKAAGQSIDRPNMVCGSVQICWTKFARYWDVELREVEMTSGELCMSPERMLEQVDENTIVVVPTLGVTYHGLYEDVQAISQALDELQQRKGLDIPIHVDAASGGFLAPFCAPDLAPWDFRLPRVKSINSSGHKFGLAPLGVGWVLWRESSDLPEGLVFHVSYLGGDMPTFQINFSRPAGQVISQYYDFVRLGRDGYQAIHGASYANAQYVAQELKKLGPFELIHDGNPARGIPTVVWTLRAGQELGFNLYDLSDRLRLRGWQVPAYPFTGELAHQAFQRILVKRDFSREMADLLLTDIRNAITHFESHPVKISLNATEAASTNHLGRSMVESLDAHG

SEQ ID NO: 50108 - protein, 421 aa, Escherichia coli K12
MSNNEFHQRRLSATPRGVGVMCNFFAQSAENATLKDVEGNEYIDFAAGIAVLNTGHRHPDLVAAVEQQLQQFTHTAYQIVPYESYVTLAEKINALAPVSGQAKTAFFTTGAEAVENAVKIARAHTGRPGVIAFSGGFHGRTYMTMALTGKVAPYKIGFGPFPGSVYHVPYPSDLHGISTQDSLDAIERLFKSDIEAKQVAAIIFEPVQGEGGFNVAPKELVAAIRRLCDEHGIVMIADEVQSGFARTGKLFAMDHYADKPDLMTMAKSLAGGMPLSGVVGNANIMDAPAPGGLGGTYAGNPLAVAAAHAVLNIIDKESLCERANQLGQRLKNTLIDAKESVPAIAAVRGLGSMIAVEFNDPQTGEPSAAIAQKIQQRALAQGLLLLTCGAYGNVIRFLYPLTIPDAQFDAAMKILQDALSD

SEQ ID NO: 50109 - protein, 451 aa, Magnaporthe grisea 70-15
MGQTLSEPVVEKASARGEDDRFLYGVSAMQGWRISMEDAHTTVLDLLANDAEAAKQHKGKLAFFGVFDGHGGDKVALFSGDNIHKIVQNQDTFKSGNYEQALKDGFLATDRAILNDPKYEDEVSGCTACVGLLTDDKIYIANAGDSRSVLGVKGRAKPLSFDHKPQNEGEKARITAAGGFVDFGRVNGNLALSRAIGDFEFKKSAELAPEQQIVTAYPDVVVHDMGDDDEFLVIACDGIWDCQSSQAVVEFVRRGIAAKQALEKICENMMDNCLASNSETGGVGCDNMTMIIIGFLRGRTKEEWYEEIARRVANGDGPCAPPEYAEFRGPGVHHNFDDSDSGYDVDMDQSKGKTFGIGGYKGRVIFLGDGTEVLTDADDNAMFESEKQDLDSQVAKTGSSEDDGTTEDQTNKKEGTTDGKADKGTKDASEEAEAKAENIDAAVKKDEDIKV

SEQ ID NO: 50110 - protein, 453 aa, Prochlorococcus marinus str. MIT 9303
MEHPFDLIVLGAGSGGLAAAKRAASHGAKVAIVEGDRVGGTCVIRGCVPKKLLVYGSLYREQLEVAPSFGVELSDARINAGVLLANVRQEVDRLNALHIDLLAKNGVELVTGWGSFTSPNSVAVSRNGAIDASQELHGDHILIAVGGRPHRPDIPGAELGWVSDDMFMQSSFPDRVVVVGAGFIACEFACILHGLGVEVIQLVRGDHLLRGFDRELSTAVQDGMQGKGIDLRFGENPAALKGQPGDLVLSTQSGERFSCGGVLLATGRRPFLQGLNLDAAGVVLEGRRISVDANQSTNIPHIFAVGDVTDRINLTPVAIDEGRAFADSVFGQKPRQVNHDLVASAVFSQPELATVGLTEEQSIDRYGKDQVKVYRARFRSMAQALPKRGPRCLLKLIVDRNTDRILGCHMVGEHAAEIIQMASIALAMGATKADFDRTMALHPTVSEEFVTMT

SEQ ID NO: 50111 - protein, 189 aa, Cucumis sativus
MASSILSSAAVASVNSASPAQASMVAPFTGLKSSAGFPITRKNNVDITTLASNAGKVQCMKVWPPLGLRKFETLSYLPDMSNEQLSKECDYLLRNGWVPCVEFDIGSGFVYRENHRSPGFYDGRYWTMWKLPMFGCTDSSQVIQEIEEAKKEYPDAFIRVIGFDNVRQVQCISFIAYKPQVLLFLSSIC

SEQ ID NO: 50112 - protein, 219 aa, Escherichia coli O157:H7 EDL933
MTQDELKKAVGWAALQYVQPGTIVGVGTGSTAAHFIDALGTMKGQIEGAVSSSDASTEKLKSLGIHVFDLNEVDSLGIYVDGADEINGHMQMIKGGGAALTREKIIASVAEKFICIADASKQVDILGKFPLPVEVIPMARSAVARQLVKLGGRPEYRQGVVTDNGNVILDVHGMEILDPIAMENAINAIPGVVTVGLFANRGADVALIGTPDGVKTIVK

SEQ ID NO: 50113 - protein, 556 aa, Mycobacterium sp. MCS
MTSEPDASEPSHTEQPYLARRQNWTNQLARHALMQPGDTALRFMGRTTTWGELDDRVTKLAGALSRRGVGFGDRVLILMLNRTEFIESFLAVNKLGAIAVPVNFRMTPPEIAFLVSDCAARVVVTEAVLAPVATAVRDLDPTLETVIVAGGATDDGILGYDDLIAEPGEAPAPVDIPNDAPALIMYTSGTTGRPKGAVLTHVNIAGQAMTFLFTNGVDLNHDVGFIGVPLFHIAGIGNTIVGLLLGRPTVLYPLGAFDPGALLDVLAEEKVTGIFLVPAQWQAVCAAQRAKPRDLKLRVLSWGAAPASDTLLRDMAETFPGAQILAAFGQTEMSPVTCMLLGEDALRKLGSVGKVIPTVAARIVDEDMNDVPIGQVGEIVYRAPTLMAGYWNNPKATAEAFEGGWFHSGDLVRQDEEGYIWVVDRKKDMIISGGENIYCAEVENVLAAHPAIAEVAVIGRAHEKWGEVPVAVAAVRGAEDAAKPPALSLADLDEFLTERLARYKHPKALEIVDALPRNPAGKVLKTELRQRYAGPKPIDVGESSTAPTGSAAGPGS

SEQ ID NO: 50114 - protein, 130 aa, Arabidopsis thaliana
  misc_feature (93)..(93): Xaa can be any naturally occurring amino acid
MASKALILLGLFAILLVVSEVSAARQSGMVKPESEATVQPEGYHGGHGGHGGGGHYGGGGHGHGGHNGGGGHGLDGYGGGHGGHYGGGGGQYXHYGGGGGHGGGGHYGGGGHHGGGGHGLNEPVQTKPGV

SEQ ID NO: 50115 - protein, 411 aa, Arabidopsis thaliana
MESCCRSVIASRTFHLRSSGRLFPSLSLTHLKGKLSLSINSFSSKIQSHALRGVGIGESDKKNPLPRGAGEGVKEDARSKLLHVVLVSPQIPGNTGCIARTCAASAVGLHLVGPLGFQVDDARVKRAALLLLNLKHSFVVVKAHSSWAEFQEYFRLQEGEKRMIAFTKRGTRIHSDFSYRSGDYLLFGSETSGLPPEALSDCNHEPYGGGTLRIPMVETYVRCLNLSVSVGIALYEASRQLNYEQIECAPQGCVNGEEPLLTEDIFILRCQEENQIFCEKKPNLSMREDTMFKKALELSTLCDIEVCVILYSRDGELIKTWPEDQSKVRDMAERFSKLHERERRKKRTNLSLFLRKKILDNSKLSEKVLEMKDSLESGLRVLQDKLLLLQPEKNQTELGQIPVINNGQNHW

SEQ ID NO: 50116 - protein, 321 aa, Synechococcus elongatus PCC 6301
MSETQQPTVIITGASSGVGLYGAKALAARGWHVVMACRNLQKAAEAAKSLGINPENYSLMEIDLGSLASVRRFVDQFRATGRSLDALVCNAAVYLPRLKEPQRSPEGYEISVATNHFGHFLLCNLLLDDLKRSPAPEKRLVILGTVTANSKELGGKIPIPAPADLGNLEGLEAGFKAPIAMIDGKKFKPGKAYKDSKLCNMITTRELHRRFHDSTGIVFGSLYPGCVADTPLFRNTPKLFQKIFPWFQKNITGGYFTQELAGERVAQVVADPEFKTSGVHWSWGNRQQKDRQSFVQELSDKASDDRTAQRLWDLSAKLVGL

SEQ ID NO: 50117 - protein, 842 aa, Nostoc punctiforme PCC 73102
MRAVLMAGGSGTRLRPLTCDLPKPMVPILNRPIAEHIINLLKRHQITEVIATLHYLPDVLRDYFQDGSDFGVQMTYAVEEDQPLGTAGCVKNIAELLDETFLVISGDSITDFDLTAAIAFHKQNKSKATLILTRVPNPIEFGVVITDEERRIRRFLEKPSSSEIFSDTVNTGTYILEPEVLEYLPANIECDFSKDLFPLLLAKDEPMYGYIAQGYWCDVGHLDAYREAQYDALDRKVNLDFAYKEVSHELWVGQNTYIDHTAVIETPAVIGDNCRIGARVQIEAGTVIGDNVTIGADANLKRPIVWNGAFIGDEAHLSACVISRGARVDRRAHVLEAAVVGSLSTVGEEAQISPGVRVWPSKKIESGAVLNINLIWGNTAQRNLFGQRGVQGLANIDITPEFAVKLGSAYGSTLKPGSKVTVSRDQRNVSRMVTRSLIAGLMSVGIDIQNLDATAIPIARTVIPTMSVAGGIHVRVHPDRPDYILIEFMDAKGINISKALEKKIEGAYFKEDMRRALIHEIGDVSYPSQVMDRYCTAFEKLLHVHTLRNSRAKVVIDYVYAVSGAVLPQMLDKFGADAVVLNASVNKSAMSITDREGLLTQLGHVVEALKANFGVQVSANGEQLILVDESGYPIRGETLTALMVDMILTANPRGTVVVPVHASSAIEQVARRHDGRVIRTKANPTALMEACQKNPNVVLGGSGETGFIFPQLHPGFDSMFCIAKIIEMLTIQERSLAAARSELPRVIHKTYTVRCPWTAKGALMRYLVETHPAQNLELIDGVKICQPYDDSWLLVLPDASEPLVHLYANSNDREWVDETVRNYRTRVQSFVERQQEYQPAEM

SEQ ID NO: 50118 - protein, 423 aa, Candida albicans SC5314
MMNIDQHHQLQQQHQQQMLQQQAQAQAQAQAQAQQQQQQQQQAAAAAAAANAAATTSSSSPRQVSFNVSDHYQILEIVGEGAYGIVCSAIHKPSQQKVAIKKIEPFERSMLCLRTLRELKLLKHFNHENIISILAIQRPINYESFNEIYLIQELMETDLHRVIRTQNLSDDHIQYFIYQTLRALKAMHSANVLHRDLKPSNLLLNSNCDLKICDFGLARSIASQEDNYGFMTEYVATRWYRAPEIMLTFQEYTTAIDVWSVGCILAEMLSGRPLFPGRDYHNQLWLIMEVLGTPNMEDYYNIKSKRAREYIRSLPFCKKIPFSELFANTNNNTSTSTSNTGGRTNINPLALDLLEKLLIFNPAKRITVEDALKHPYLQLYHDPNDEPISDKIPEDFFDFDKMKDQLTIEDLKKLLYEEIMKPL

SEQ ID NO: 50119 - protein, 182 aa, Triticum aestivum
HYRTSLYKKAGWYRSGIPGISSTHASAFRFEPPPNPQQSTGGQATAMARTKQTARKSTGGKAPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 50120 - protein, 151 aa, Synechococcus elongatus PCC 6301
MSVERTFIAIKPDGVQRGLVGTIIGRFEQKGFKLVGLKQLKPSRELAEQHYAVHRERPFFNGLVEFITSGPIVAIVLEGEGVVAAARKLIGATNPLTAEPGTIRGDFGVNIGRNIIHGSDAIETAQQEIALWFSPAELSDWTPTIQPWLYE

SEQ ID NO: 50121 - protein, 926 aa, Yarrowia lipolytica CLIB122
MSDSEVEYDIAGSLNPGVDSEDDYSSGSESDSEIPDIIEDSEDETGPQQGEPGTMTFPNLELSDDDDDDDDDDEGRKKKKKKTDDSVESYFGAPQTGKKSSGSFAGLGLSQLVLKNIARKGFKQPTPIQRKTIPLVLEGKDVVGMARTGSGKTAAFVLPMLEKLKVHSAKVGARAVILSPSRELALQTLKVVKDFSAGTDLRLAMLVGGDSLEEQFKMMMSNPDIIIATPGRFLHLKVEMELSLASVEYICFDEADRLFELGFGEQMNELLASLPSNRQTLLFSATLPKTLVEFAKAGLHDPILVRLDAETKLPEHLEMTFFAVKENQRDACLAFILKEVIQMPFATPEQLKELERLDERAIDDGERDEDRKQKRPKFKKERLPPAHQLPSEKSTIVFCPTKHHVEYVIVLLQTLGYAVSYIYGTLDQHARKNQLYRFRTGKTSILVVTDVAARGIDVPVLANVINYSLPPSPKVFIHRVGRTARAGNRGWAYSIIKDNDIPYLLDLEVFLGRKLLTPRLFKQQNPDPSAEPDYVNTLTIGAPPRQALEIHGEELAQMVKDSYELQQLSEVAVKGERMYNKTKGSASQESAKRSKQIMALGWDDHHLMFGEDGESAKDALLARLGQKRIRETVFEFRKSKTTSGAEMMATRRAQLAPIQRRAAEKRAIQEKERLAGLVHSQDAEIARSTEEDMATEADLTGFTTEEDLRAAKKAQKSKKRSFRDSENFMSHYAPTNDDKGYAVGNFAGAASNATFDLINDGSEMQQKQGMKWDKKKGKFINAGSEGGKKFIRGEGGQRIAASFRSGRFDKWKAAHKVGNLKVGALEESGPATKRVLSAREFKHNKNEAPKRADKYRDDFHKQKTKVAAAKEDGRIQKPQPKSELKSTADVRKSRILAEKRKQKNARPSRGGRGGGRGGRGGGRGGR

SEQ ID NO: 50122 - protein, 778 aa, Gibberella zeae PH-1
MAFIRSLSILALALGATAVPYNTFDGPGFPACQDVAKVHDASSVRDIQNTVQDAIKAGQRVRASGKAHMWYDTMCSDDPNTVIVRTEQVNNIYDLDMEAGTVMIEAGVTFLQLAEYLHDHGASAGYTLVNWNITLAGCVAMGAHRSSIREDSMVAAGVLAMDIIDGTGKLRHLERDDSEEWLAASTSLGLLGVIVRMKFKVYPDFKVYADQKTLDEGDVLDGDIYGMIAPYATANLWWWPHKKKFHWRYYDVIPTNQSEQEGFQNTFSITQVEAGAISALWNTGKGVSLSNLLAEEILFGQWEKPNFREKTTNKPIEKWPVYGWNYDVLIGGLYPDQRPVWEYGIHGYTLELAFPVTQANAMLKRVRQLFDNEAKKLKFMASTYRSGINIKFGRPYFDLLGQVTYGTSDGADWDKGVIMLDFPSYKPSIGDGLRYNEPFYHKLAETLIDEFPCRPHWTKNTREVFERAAKNIDPDHISRFKAVREKFDPDGIFRSVVGEAIANMSAPETQPTAEGDEYEKTLLQLRCFDTMFLVDDSEAMQPYWPEIKTLIERIAPICAKHDPDGVDLYFVNHRPGGVLAKLPGVQSIRKSGYTHIGGFAGSMLLTSKGKQVGAIFDKVKPAGKCNMGARLGGLLKWYCDKFTAGEEKAALNIIVLTAGAFDDDIKTPLIQAARTLDEAKAPIHQAGVQLFRLGGPDLVRQKTLQHLDDELHKEAGTRDIVDTVTWSGHGTSMSDDELLKIVLGAVIKKIDIRASELHLDEAATTTRADREYDEGNVI

SEQ ID NO: 50123 - protein, 173 aa, Flaveria trinervia
MASIPATVAAVPQTNMVAPFTGLKANAAFPVTKKVNGFSTLPSNGGRVQCMKVWPPVGKKKYETLSYLPELTEAQLAKEVDYLLRNKWVPCLEFELEHGFVYRENASSPGYYDGRYWTMWKLPMFGCTDSAQVMKELQECKKEYPQAWIRIIGFDNVRQVQCVSFIASKPTGF

SEQ ID NO: 50124 - protein, 425 aa, Oryza sativa (japonica cultivar-group)
MSPKQKSLRSKRMAEASEEDGIDVLPDALLQHILSFLPAEDAVKTCVLSRRWRHLWKLTPILCITNTERWRSPKDFIKLVNHLVLFRGSSPLHKFEIKINSCAHWMIMSGDSNPFHCAIMWVMYALMCQVQVLTIKNMHAYIEMDDGFSLFSRHLTELNLSGLDFRKFVLNFSSCPALEYIYFSASCCFNSVEKILSQSVKYLTFDFPEFSEHHRTHIYAPNLITLRLDDCWGRVPFLESMPSLIAAFVRPHRDSDDLCSNTYSGNCEDEYCHGCYGMVDNAGNDSAKCVLLGGLSEAKKLELIAGPEMRIFRSDLRWCPLFSKLKSLLLNEWCVANNFWALACILEHSPVLLKLTLQISKETKPMIGAVENYSALVKPAAISKHLKVVKVHCKEVDEGVCETVKFLSTLDVVVLIRRMDRSTNR

SEQ ID NO: 50125 - protein, 178 aa, Helianthus annuus
MASISSSVATVSRTAPAQANMVAPFTGLKSNAAFPTTKKANDFSTLPSNGGRVQCMKVWPPLGLKKYETLSYLPPLTETQLAKEVDYLLRKKWVPCLEFELEHGFVYRENARSPGYYDGRYWTMWKLPMFGCTDSAQVMKELAECKKEYPQAWIRIIGFDNVRQVQCIMFIASRPDGY

SEQ ID NO: 50126 - protein, 132 aa, Brassica napus
  misc_feature (21)..(21): Xaa can be any naturally occurring amino acid
PRVGRLALACKAKERGVHAKXLVFTIKKLVAVEKFRVGIKGFLGMGMKGLEALNFFFGGFHPYRFFPGYLQGFGLNGPSLAHLTWGFGNAPYKMGLILTNPPYFITNGCIYVAFGAKGKGLKPWFEEVFGGL

SEQ ID NO: 50127 - protein, 189 aa, Larix laricina
MASSIMALSSTAAVAAVAAPSKTGNSNVVSAFTGLKSMAQFPSSKTMSNAGAEWEQKTTSNGSRVRCMQVWPPYANKKFETLSYLPRLTPEQLVKEVEYLLKNKWVPCLEFEEDGEIKRVYGNSPGYYDGRYWVMWKLPMFGCTEASQVLNEVNECAKAYPNAFIRVIGFDNVRQVQCISFIVHKPEYN

SEQ ID NO: 50128 - protein, 411 aa, Brucella melitensis 16M
MSISFDLTIDDTRDQLARHARASLEAKPSLIGMSREEMAAALIAAGVPERQVKMRISQLWHWLYVRGVSDFADMRNISKDLRAMLAQHFTIARPEVVEEQISQDGTRKWLFRFPPRGAGRPVEIESVYIPEEGRGTLCISSQVGCTLTCSFCHTGTQKLVRNLTSEEILAQLLTARDRLGDFPDKDTPDGAMVPAEGRKITNIVMMGMGEPLYNFEEVKKALLIASDGDGLSLSKRRITLSTSGVVPEIYRTGDEIGVMLAISLHAVRDELRDILVPINKKYPLAELIKACREYPGLSNAKRITFEYVMLKDINDSLDDAKLLVKLLQGIPAKINLIPFNPWPGTNYQCSDWEQIEKFADYVNAAGYASPIRTPRGRDILAACGQLKSESERLRKSERLALEAMMIAGHGE

SEQ ID NO: 50129 - protein, 244 aa, Brassica napus
RREMSTGMGSGKGKSRPSPSDPSILVSDKINAREKYALIPDRFTSLDQVSKALREAGLESSNLILGIDFTKSNEWSGKTSFNGKSLHALGRIQNPYEKAIFVIGQTLAPFDEDNLIPCFGFGDSTTHDEEVFSFHSDNSPCHGFEEVLACYKRITPNLILSGPTSYGPLIDAAVDIVEKNNGQFHVLVIVADGQVTRGFDKAEGELSQQERATIDAIVNASSYALSIVLIGVGDGPWEDTRKFD

SEQ ID NO: 50130 - protein, 316 aa, Clostridium acetobutylicum ATCC 824
MNNVLCIGELLIDFICSDIDTTLSKGENFKKKAGGAPANVTAAISKLGGSASFLGKVGNDPFGHFLKETLDEVKVDTSMLIMDNNSSTTLAFVSLQANGERDFVFNRGADGLLRYDEINLDKVYSNKIIHFGSATALLGGEMTDTYLKIMEEAKKRGIIISFDPNYRDNLWENRTEEFIAISRKCIELADFVKLSDEELKIISGEKNIKNGVKLLASNNKVIAVTLGKEGTMISNGEEVEIIESIKIKSIDSTGAGDAFVGAFLYKLSEALEARDILSDFNKIKENVRFANKVGAIVCTKLGAISSLPSLSEVEGD

SEQ ID NO: 50131 - protein, 80 aa, Anaplasma phagocytophilum HZ
MRDVVIYTKVPCPYCTRAKALFNKKSIPFKEIDITNDPAAQLEMVERSGRKTVPQIFIDGESIGGCDDLYELYESGKLEL

SEQ ID NO: 50132 - protein, 786 aa, Nostoc punctiforme PCC 73102
MDKLYWLDQIKLQDRAKVGDKAFYLSRIMQRGYPVVPGFVVSAEILRQFLENLNSSESLVADLPHSSLHLDVANWRQLQQVAGRLRQEILTATVPQQWVSTIFQAAREWQTSCLILRPTLAVSTATPSMKNISGLLESVFCQCEPEAIAWALKRTWSQIFRARSLLYWQRAGGINLQQINLGVLVQPVENAIASGLLKANSSGWEIEATWGLGVAIAQGEVQPDIYYIQQATGVVLEQQLGNKILAYGVNDAAPEAFSQPTPNSVLTPDHTSLSTYVLPEAQQKQYALQEEYLQQIIALGTQLVSELGKTFTIKWTIAQQTTSSKLYITQVSSPQSVIPHGQFIRGLGAAGGRVVATALVINNSQQKPEHLPKGVILVVPTITPDWLPLLHQVTGIITEQGGLTSHAAILARELRIAAVVNATSATTLIQTGERLLLDGDRGEVYRIKGDSKEEMEKEREEKLLSTHHPKPKAPYPTFTSHLPMIATQLLVNLSQSSLIEQVQSFPVDGVGLLRSELMVLNILDGQHPNSWILGGRQAELLELWSEQIMQFARAFAPRPVFYRSLDWRSQDLPSLSDSLESSPQSMLGERGTFSYLRNPAVFELELQALARVQQAGYTNVNLLLPFVRTVEEFVFCRRKVEQAHLTEVSQFQLWMMAEVPSVLFLLPEYVKAGTAGISIGTNDLTQLLLGVDREQGQLAKVFNERHPAVMGAIAQLIQMAKSAGIPCSICGQAPALYPEIIDKLVEWGITSISVEPEAVERTYQAIARAEQRIILAAARRELKQGK

SEQ ID NO: 50133 - protein, 109 aa, Anaplasma phagocytophilum HZ
MDNNLVNRIKHDIENNDVVLYMKGTATAPQCGFSSVVASVLVHLGIAFKDVDVLRDPELREGIKEFSNWPTIPQLYVKGEFIGGCDIVREMYQSGELQELLKKKGVITG

SEQ ID NO: 50134 - protein, 347 aa, Escherichia coli CFT073
MELVRSKVMKSILIEKPNQLSIIEREIPTPSAGEVRVKVKLAGICGSDSHIYRGHNPFAKYPRVIGHEFFGVIDAVGEGVESARVGERVAVDPVVSCGHCYPCSIGKPNVCTTLAVLGVHADGGFSEYAVVPAKNAWKIPEAVADQYAVMIEPFTIAANVTGHGQPTENDTVLVYGAGPIGLTIVQVLKGVYNVKNVIVADRIDERLEKAKESGADWAINNSQTPLGESFAEKGIKPTLIIDAACHPSILKEAVTLASPAARIVLMGFSSEPSEVIQQGITGKELSIFSSRLNANKFPVVIDWLSKGLIKPEKLITHTFDFQHVADAISLFELDQKHCCKVLLTFSE

SEQ ID NO: 50135 - protein, 294 aa, Acinetobacter sp. ADP1
MINFAEVSGITIENLGEHGLKALRISNTFCDALIALQGAQILEFNVKYQSYTQALLWLSELNSYQPAKAIRGGIPLCFPWFGGHAEEKSYPSHGFARNLEWALVDVVDIQESGHQLIFELTDNALTRAYWDVAFRLQMQIECGTQLRLSLSLVNLDEKQIHYGFAWHSYFPVKIDEAAVYGLQGKAFIDQLDQHRHKIQHEEAIHFSEEIDRIYPLTQGSFQLRANHRTTLLINSHAQSAVIWNPWIEKTARLADLKPESWREFVCVESGQIASQQQYLEAGQSVEYTLEISAV

SEQ ID NO: 50136 - protein, 151 aa, Prochlorococcus marinus str. MIT 9303
MIIAALIQLIVNVGNELFADSQQSWLGDDLIKVLGDLLTVLIALEVLQNVTSYLRRHVVQIELVLVTALTAVARKVIVLPPGSDDKPQLLAGLGIASIALAGAYWLVKRATIDPALSARSRTKPTKLSQGEDQFVPHDADGEGPNAADLQR

SEQ ID NO: 50137 - protein, 171 aa, Pinus thunbergii
MATGAGAGAATVVSAFTGLKSTAQFPSSFKMSNAAAEWEQKTTSNGGRVRCMQVWPPFGNPKFETLSYLPTLTEEQLVKEVEYLLRNKWVPCLEFDLEGSISRKYNRSPGYYDGRYWVMWKLPMFGCTEASQVINEVRECAKAYPKAFIRVIGFDNVRQVQCISFIVHKPE

SEQ ID NO: 50138 - protein, 387 aa, Escherichia coli O157:H7 EDL933
MSVIKMTDLDLAGKRVFIRADLNVPVKDGKVTSDARIRASLPTIELALKQGAKVMVTSHLGRPTEGEYNEEFSLLPVVNYLKDKLSNPVRLVKDYLDGVDVAEGELVVLENVRFNKGEKKDDEILSKKYAALCDVFVMDAFGTAHRAQASTHGIGKFADVACAGPLLAAELDALGKALKEPARPMVAIVGGSKVSTKLTVLDSLSKIADQLIVGGGIANTFIAAQGHDVGKSLYEADLVDEAKRLLTTCNIPVPSDVRVATEFSETAPATLKSVNDVKADEQILDIGDASAQELAEILKNAKTILWNGPVGVFEFPNFRKGTEIVANAIADSEAFSIAGGGDTLAAIDLFGIADKISYISTGGGAFLEFVEGKVLPAVAMLEERAKK

SEQ ID NO: 50139 - protein, 339 aa, Escherichia coli O157:H7 EDL933
MTVRVAINGFGRIGRNVVRALYESGRRAEITVVAINELADAAGMAHLLKYDTSHGRFAWEVRQERDQLFVGDDAIRVLHERSLQSLPWRELGVDVVLDCTGVYGSREHGEAHIAAGAKKVLFSHPGSNDLDATVVYGVNQDQLRAEHRIVSNASCTTNCIIPVIKLLDDAYGIESGTVTTIHSAMHDQQVIDAYHPDLRRTRAASQSIIPVDTKLAAGITRFFPQFNDRFEAIAVRVPTINVTAIDLSVTVKKPVKANEVNLLLQKAAQGAFHGIVDYTELPLVSVDFNHDPHSAIVDGTQTRVSGAHLIKTLVWCDNEWGFANRMLDTTLAMATVAFR

SEQ ID NO: 50140 - protein, 266 aa, Gossypium robinsonii
LSVEEIEVAPPQKNEVRVKIHFTSLCHTDVYFWEAKGQNPLFPRILGHEAGGVVESVGEGVMDVQPGDHVLPIFTGECKECPHCLSEASNMCDLLRINTERGGMLHDGQTRFSKDGKPIYHFLGTSTFSEYTVVHVGQIAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 50141 - protein, 183 aa, Pyrus pyrifolia
MASSMISSGTVATVSADRPAPAQARMVAPFNGLKSSSAFPVTRKSNDITSIASNGGRVQCMQVWPPLGLKKFETLSYLPPLSSESLAKEVDYLLRKNWVPCLEFELETGFVYRENHRSPGYYDGRYWTMWKLPMFGCTDSSQVLKELEEAKKAYPQSFIRIIGFDNVRQVQCISFIAYKPAGF

SEQ ID NO: 50142 - protein, 181 aa, Raphanus sativus
MASSMLSSAAVVTSQLQATMVAPFTGLKSSAAFPVTRKTNTDITSIASNGGRVSCMKVWPPIGKKKFETLSYLPDLSDVELAKEVDYLLRNKWIPCVEFELEHGFVYREHGSTPGYYDGRYWTMWKLPLFGCTDSAQVLKEVQECKKEYPNALIRIIGFDNNRQVQCISFIAYKPPSFTDA

SEQ ID NO: 50143 - protein, 266 aa, Gossypium raimondii
LSVEEIEVAPPQKNEVRVKIHFTSLCHTDVYFWEAKGQNPLFPRILGHEAGGVVESVGEGVMDVQPGDHVLPIFTGECKECPHCLSEASNMCDILRINTEWGGMLHDGHTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 50144 - protein, 177 aa, Silene latifolia subsp. alba
MASLMSNAAVVTASTAAQANMVAPFSGLKSTSAFPVSRKSNVDITSLATNGGRVNCMQVWPPRNLKKFETLSYLPTLSEESLLKEINYLLIKGWVPCLEFEVGPAHVYRENNKSPGYYDGRYWTMWKLPMFGCTDASQVAAEVVECKNAYPDAHVRIIGFDNKRQVQCISFIAYKPE

SEQ ID NO: 50145 - protein, 857 aa, Brassica napus
MIGDLVDLLTGGGGNAAKVKGTVVLMKKNVLDFNDFNASFLDRLHEFLGNKVTLRLISSDVTDPENGSNGKLGKAAHLEDWITTITSLTAGESAFKVTFDYDQDFGYPGAFLIRNSHFSEFYLKSLTLEDVPGHGRVHYICNSWVYPAKRYTKDRVFFSNKTYLPRETPEPLLKYREEELVSLRGTGEGELKEWDRVYDYAYYNDLGVPPKNPRPVLGGSQEYPYPRRGRTGRKPTTEDPETESRLPVTSSLDIYVPRDERFGHLKMSDFLAYALKAIAQIIQPALESVFDETPKEFDSFEDVLKIYEEGIDLPNQALIDSIVKNIPLEMLKEIFRTDGQKFLKYPVPQVIKEDKTAWRTDEEFAREMLAGLNPVVIQLLKEFPPKSKLDRETYGGQNSTFTKSHIEQSLDGLTVEEALEKERLFILDHHDTLMPYLGRINTTGNKVYASRTLLFLKDDGTLKPLVIELSLPHPDGDSFGAVSEVYTPGEGVYDSLWQLAKAYVGVNDSGNHQLISHWLQTHASIEPFVIATNRQPSVLHPVFKLLEPHYRDTMNINALARQILINGGGIFEITVFPSKYAMEMSSFIYKNHWTFPDQALPAELKKRGMAVEDPEAPHGLRLRIEDYPYAVDGLEVWYAIESWVQDYIPLYYKTDEDVQNDTELQAWWKEVREEGHGDKKSEPWWPKMQTRKELIDSCTIIIWVASALHAAVSFGQYPIAGYLPNRPTISRQFMPKENTPEFEELEKNPDKVFLKSITAQLQTLLGISLIEILSTHSSDEVYLGQRDSKEWAAEKEALEAFEKFGDKVKEIEKKIDERNLDENLKNRTGPVKMPYTSLFPTSEGGVTGRGIPNSVSI

SEQ ID NO: 50146 - protein, 222 aa, Prochlorococcus marinus str. MIT 9303
MQPLSPAFIDQLCFDDIGLIPAISQDWLDGAVLMMAWMNRTALEQTLKSGQVHYWSRSRQELWHKGATSGHTQTLKGIRYDCDADVLLLSIEQTGLVSCHTGARSCFFAEVNQHSQGDSLTLPPPMDACSELFRVIDQRHTTPEANSYTNKLLEGGDNRILKKIGEESAEFVMACKDDDAKAIANEAADLLFHLQVALAHHGVNWREVLEVLANRRGAPRRN

SEQ ID NO: 50147 - protein, 320 aa, Magnaporthe grisea 70-15
MENYQKLEKIGEGTYGVVYKARDLLNGGRIVAMKKIRLEAEDEGVPSTAIREISLLKEMRDPNIVRLFNIVHTDGTKLYLVFEFLDLDLKKYMEALPVADGGRGKALPEGTGPQLSRLGLGDTMIKKFMSQLCDGVRYCHSHRILHRDLKPQNLLIDREGNLKLADFGLARAFGVPLRTYTHEVVTLWYRAPEILIGGRQYSTGVDMWSVGCIFAEMCTRKPLFPGDSEIDEIFKIFRLLGTPTEETWPSVTDEHIYPDFKPSFPKWQRDPNMKLCPGLNDAGLDLLEMMLVYDPAGRISAKQACNHPYFEDNTPAPPRR

SEQ ID NO: 50148 - protein, 265 aa, Gossypium hirsutum
LSVKEIEVAPPQKNEVRVKIHFTSLCHTDVYFWEAKGQNPLFPRILGHEAGGVVESVGKGVIDVQPGDHVLPIFTGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPIQELIAEMTGGVDCSIECTGSTQAMVSAFECVHD

SEQ ID NO: 50149 - protein, 111 aa, Brassica napus
MLKTLLVHGPLLFFFFFLISSVVAGDENDGGLSICNCDDEDSYFSYEGILESQKVGDFLIAVAYFSIPIELLYFVSRTNVSSPYIWVVCEFIAFIVLCGMSHLLSGFTYGP

SEQ ID NO: 50150 - protein, 580 aa, Gibberella zeae PH-1
MAPPSMTVYFDDQNPNSEKGKEAGARRSLAGLDYSPLPRITGRSFLLATFVSMGGLLFGYDTGQISGFLEMPDFLDRFAQTNSNGEKEFSTVRSGLIVALLSIGTLIGALVAAPISDRIGRKYSISGWTWVIAIGFIIQISSNRDWVQIMMGRWVAGLGVGALSLLVPMFQAETAPPWIRGAMVCCYQLFITMGIFLAACFNYGTVTHQRNNSASWRIVIGIGWVFTLILGIGILFLPDTPRFDYRKGKIDRARDTLCKVYGATPNHWAIHTQMEEIESKLRAESQIKGNPAKEFVQMFKAPRMTYRILLGMGLQMFQQLTGANYFFYYGTTIFASVSIDSYKTQIILNTINFLVTFIGLYIVEHYGRRKSLIAGSTWMFICFLIFASVGHFSLDRANPSSTQGAGVAMIVFACLFILGFATTWGPMIWTIMAEIFPSRYRAKGMALATASNWLWNFLLAFFTPFITKDIDFRYGYVFAGCNVLGGLIVYFFVIEGQGRTLEEIDTMYLERVSPMKSSKWIPPPPEEMSRIRKEAGTDIETAAAAHHGSSDDETLARRSGVTDGGHGQRKEENAGATHRE

SEQ ID NO: 50151 - protein, 208 aa, Brassica napus
  misc_feature (193)..(193): Xaa can be any naturally occurring amino acid
MGTENSKESWRQESSSSSFRSASASSASPSSSSWASHQSYPQYGPESYNYPPTPSYAPPPPPEYAQPPPAPSYSTQPYSQPPSYSHGNDKKRLERKFSKISDEYSSLEQVTEALARAGLESSNLIVGIDFTKSNEWTGARSFNRKSLHYIGNNPNPYEQAITIIGRTLAAFDEDNLIPCYGFGDASTHDQDVXSFNPEDRFCRGRGRA

SEQ ID NO: 50152 - protein, 111 aa, Glycine max
MNLVGERKTITISGIGKGGRGLGKGGAKRHPKGLRDNIQRITKTAIRRLARRGTVKRINGLMYEETRSVLKILLQNVIRDAGTYTEHARRKTENAMDDGYSLQTQDKTLYR

SEQ ID NO: 50153 - protein, 566 aa, Brucella melitensis 16M
MSCNDRKHRQGARCQPIETNGNNMTVKTIATTPYQDQQPGTSGLRKKVPVFQQPNYAENFIQSIFDVLEGFKGKTLVVGGDGRFYNREVIQKLIKIAAANGFGRIMVGQGGILSTPAASNMIRKYKAFGGMILSASHNPGGPTQDFGIKYNIGNGGPAPEKITEAIFARSKVIDQYKIADAADIDIDKIGTSKIGDTEVVIFDPVADYAELMESLFDFAAIRAMIKGGFQMKFDAMHAVTGPYAKEIFERHLGAPEGSVVNFVPLPDFGGHHPDPNLVYAKDLYDLLMSSHAPDFGAASDGDGDRNLILGRGIFITPSDSLAMLAANAHLAPGYKGGIKGIARSMPTSAAADRVAEKLGIGMYETPTGWKFFGNLLDSGKVTICGEESSGTGSDHVREKDGLWAVLLWLNILAVRKESVKAIADDHWARFGRNYYTRHDYEAVDSDIATKLVADLRGKLAGLPGTSVNGLRIEKADDFAYHDPVDGSTSEHQGIRIYFEGGARIVLRLSGTGTSGATIRIYIERYEADPAKHNLDTQATLAPLIDAAEQIAEVKKRSGRTEPSVVT

SEQ ID NO: 50154 - protein, 154 aa, Glycine max
  misc_feature (126)..(126): Xaa can be any naturally occurring amino acid
RERERERERERERERERERERERERERERERERARADSSYYYRDTSLLFCVRIAQGLVHLGEGLLTLNPCHSDRFLLSPAALAGLVTVFRACLDVRALVLGKCLYVLYLLVLALRARMLLSVDEGXTPVSMPVRGGRAVSVVDQGVGRNRAVLG

SEQ ID NO: 50155 - protein, 320 aa, Arabidopsis thaliana
QPAEEEEEVVAVMMMMTSLGGGAGGGGGGGGSGGGRFVTYPPPLSVPPSAPQSPNFSGGLRSQPSFLVEQEKYLSELLAERHKLTPFLPVLPHVCRLMNQEILRVTTLLENALSQSRFDHPSPLASGGIFQNSRADMNGWASQFPSERSVSSSPAPNWLNSPGSSSGLIVKRTIRVDIPVDKYPNYNFVGRLLGPRGNSLKRVEASTDCRVLIRGRGSIKDPIKEDMMRGKPGYEHLNEPLHILVEAELPIEIVDARLMQAREILDDLLTPVEETHDFYKKQQLRELALLNGSLREEGSPMSGSISPYNSLGMKRAKTRG

SEQ ID NO: 50156 - protein, 112 aa, Chlamydomonas reinhardtii
GGSVIVIDSKAAWDAQLAKGKEEHKPIVVDFTATWCGPCKMIAPLFETLSNDYAGKVIFLKVDVDAVAAVAEAAGITAMPTFHVYKDGVKADDLVGASQDKLKALVAKHAAA

SEQ ID NO: 50157 - protein, 666 aa, Aspergillus oryzae
MSLAQNHYVIKLPVTPSRTRSLEPRAIAQQWIANLDVLLNRGDFSQLPELFHQESWWRDMLALAWDLRTIQNCNNIEDYLRQNQPRSQLSAFRLQHEGKFQPTFDRPVEGLSWISSMFFFETRVGRGTGVLRLTQNDAGAWKAYSIYTSLQEFKDFEEPLGSKRPEGTIETMPGGLSQGNWLERRQRQLEFMDEEPTTLVVGAGQAGLNMGARLQSLGVSCLIVDRNERIGDNWRKRYRSKNPANKTLLQTLVTHDPAEFTHMAYLPFPKNWPQFTPKDKLGDWFEAYASIMELNVWLQTSIKSAVYDDAKAQWSVVVTRGDGSERTLHPRHLIWCTGHSGEPKVPTFPGQPQFKGQVYHGSQHNDASKHDVRGKKVVVVGTGNSGHDIAQNFYENGAQVTMLQRSGTYVITAEKGVFMMHEGLHEDNGPPTEEADIMSESLPYPVQFALAVHFTKRAYAAERDILEGLQKAGFELDFGVDGAGISRAYMTRGGGYYIDVGCSPLIADGKIKVKRSPKGITGFNEHSLILEDGSSLEADIVVLATGYDNMRTTVRKILGDTVADRCKDVWDLDEEGEVNAVRSLAHLTLTVYPFLYPTIHSVSILSAQLAILTVIQMWRPSGHPGFWFHGGNLALCRIYSKFLALQIKAIEAGLVSQGQDQTQPKL

SEQ ID NO: 50158 - protein, 917 aa, Aspergillus oryzae
MSILVRPPKRKLSEIEGLEERNRLSYSGRYPSATPSSHLSSERNSGKDVGYPIITAYPLAEPAEATRESSSRELNSSRASPVSFDGPFQVQRKFAPNVSIVLVGIRGTGKSSLAVILAATSGRRLIDADRYFQQVTGRSRASFKKERGITEYRQQEARVMENMLSEHKEGWVIACGPGSMERSGQMLLREYAKTHPVIHIIRDPESIQAYLQAWDTDKVRRFLELSGPIYRACSNLEFFNVSETGHGDLTLGKNGQHHSQLELEVDQRSQTFTPFLTLKRLQRDFVRFIAFATGNATDLSNQHASFPLSTQPVETRVFTYAVSVPISTLFTRDLNIEDLESTADAFELKIDVTEGPSSRLGLESTLADRISQTMATIRRNIVVPLIYHVESDVGLVGSASPHNEPLHCSSTAYLNLMHHGLRLAPDFITVDLSYDDGVLSQIIAAKGSSKVIGHFASVQYVEQGWDGPVYLELYERAKRLGCDIVRLTQPASSMDDNHAVQRFRHRIQALPGPQLPLIAYNSGSLGRLSCCFNPILTPVINEALLPETQTKNLPCLTLREAQEALYASFALDPMQFFVFGANVTYSLSPAMHNAAYKACGMPHVYSLHQSPSLRGLNELVANPNFGGTSVSLPYKTEAIPLLHSMSPHARAIGAVNTLIPIRDLEDSALVSKGSSLYLEKSRAGPIKGLHGDNTDWIGICNCLRRGLSPANAIRPSSTGLVIGSGGMARAAVYSMIHLGVQNIFVWNRTFASAEKLAYHYNRQNLPTHSNNAPTTHSTVHVLRSLQDTWPANYNPPTVICSCIPAHSIGGQPAPNFRIPSQWLGSPTGGVVVELAYKPLDTPLVKQMRALSHRGWVALDGLDVLPEQGFAQFELFTGRRAPRRLMRTIVLQEYKAEEGQDDQNAIQSRLESLDGQPT

SEQ ID NO: 50159 - protein, 156 aa, Bacillus clausii KSM-K16
MEILDNFPLWAAFMAIIIAQAIKIPLAFFATKKLDFSLFTSTGGMPSSHSAAVTALSTAVAIEHGLDSSLFAVSAVLGIIVMFDATGVRRHAGYHATVLNQLVQDFNKLVEEIKTWPKKENEQKLKELLGHQPIEVFFGALLGIILALLLHTWFIG

SEQ ID NO: 50160 - protein, 266 aa, Gossypium barbadense
LSVEEIEVAPPQKNEVRVKIHFTSLCHTDVYFWEAKGQNPLFPRILGHEAEGVVESVGEGVIDVQPGDHVLPIFTGECKECPHCLSEASNMCDLLRINTERGGMLHDGHTRFSKDGKPIYHFLGTSTFSEYTVVHVGQVAKINPEAPLDKVCVLSCGMSTGFGATVNVAKPKKGGSVAIFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 50161 - protein, 187 aa, Sesamum indicum
MATKTQAAALLLCLLISTSSPTAYSRKPRRRSPCRELTFFFHDVLFNGHNYHNATSAIVGSPQWGNKTAVAKPYNFGDVVVFDDPITVDNNFHGAPVGRAQGMYLYDQWSTYGAWLGFSFLFNSTEYVGTLNFAGADPLMNKTRDISVIGGTGEFFMARGIATLSTDAYEGDVYFRLRVDIQLYECW

SEQ ID NO: 50162 - protein, 266 aa, Gossypium tomentosum
LSVEEIEVAPPQKNEVRVKIHFTSLCHTDVYFWEAKGQNPLFPRILGHEAGGVVESVGKGVIDVQPGDHVLPIFIGECKECPHCLSEASNMCDLLRINTERGGMLHDGHTRFSKDGKPIYHFLGTSTFSKYTVVHVGQVAKINPEAPLDKVCVLSCEMSTGFGATVNVAKPKKGGFVAVFGLGAVGLAAAEGARVCEASRIIGIDLNPNRSEEAKKFGCTEFVNPKDHNKPVQEVIAEMTGGGVDCSIECTGSTQAMVSAFECVHD

SEQ ID NO: 50163 - protein, 400 aa, Bacillus clausii KSM-K16
MNKARIVIAGAGYGGMNTAVTLSKKLGPNDASITLVNKHDYHYQTTWLHEPAAGTLEPDRTRVKIADVLNTSRVNFVQDEVLEVKTDEKKVMLKEGELEYDYLVLALGATAETFGIPGVHEHAFTKWTLNGARQVKDHIDAQFANYNNVEDKHEGLLTFVVAGAGFTGIEFIGELSERVPELCKTYDVPREKVRLFVVEAAPTALPGFDPELVEYAMNLLESRGVEFKINTPIKEVTASGVIVGEGEEIKAETVVWATGVRGNPVIEKSGFEAMRGRVKVNPDLRAPGHDDVFIIGDCALIINEEINRPYPPTAQIAMQMAKTCANNLIALNKGSTDLETFKFDNKGTVASLGGKQAIGVVGSRKIYGGTANFMKKMIDNRALFILGGPLLTLKKGKFPF

SEQ ID NO: 50164 - protein, 178 aa, Trifolium repens
MALISSAAVTTINRAPVQANLATPFTGLKSSAGFPVTKKNNDITSITSNGSRVNCMQVWPPVGKKKFETLSYLPPLTDEQLLKEVEYLLRKGWVPCVEFELEKGFVHRQYNSSPGYYDGRYWTMWRLPLFGTTDAAQVLKEVAECKAEYPEAFIRIIGFDNVRQVQCISFIASTPKVY

SEQ ID NO: 50165 - protein, 471 aa, Bacillus thuringiensis serovar konkukian str. 97-27
MSKLLKKKSVTQLLEHNQSKTLTKTLGAFDLIMLGIGSIIGTGVLVLTGLVAARDAGPAVIFSFVLAAIICGFIALCYAEIASTLPASGSVYTYSYATIGEFVAHLVGWSLLLIYIVATAAVAAGWTGYFHNLIKGFGLEIPKALVTIPSHGGIVNLPAVIITLILAWMLSRGTRESKRINNIMVLIKIGMILLFITVGIFYVKPMNWIPIAPYGLSGIFTGGAAILFAFTGFDILATSAEEVKDPKRNLPIGIIASLIICTIIYVMVCLVMTGMVSYKELNVPEAMAYVMEVVGQGKVAGAIAAGAVIGLMAVIFSNMYAATRVFFAMSRDGLLPKSFAKVNKKTGAPTFITGLAGIGSSIIAGFIDLKELVNLVNIGSLVTFALVCLSVIILRKSHPNLKRGFMVPFVPVLPCVAIVCCVFLMLNLPLRTWVYFSIWITIGVVVYFLYSIKHSNLNEETISKLHDKIAR

SEQ ID NO: 50166 - protein, 549 aa, Oryza sativa (japonica cultivar-group)
MAAAAARRGSSLLSRCLLSRPAAAASPAVPSALRRADGTQGLLPGILQRFSTAAVAEEPISPPVQVNYTQLLIDGKFVDSASGKTFPTLDPRTGELIAHVAEGDAEDINRAVHAARKAFDEGPWPKMTAYERSRILLRFADLIEKHNDEIAALETWDNGKPYAQAANIEVPMVARLMRYYAGWADKIHGLVVPADGPHHVQVLHEPIGVAGQIIPWNFPLLMFAWKVGPALACGNTVVLKTAEQTPLSALFASKLLHEAGLPDGVVNVVSGFGPTAGAALASHMDVDKIAFTGSTDTGKVVLELAARSNLKSVTLELGGKSPFIIMDDADVDHAVELAHFALFFNQGQCCCAGSRTFVHERIYDEFVEKAKARALKRVVGDPFKNGVEQGPQIDDEQFNKILRYIKYGVDSGANLVTGGDRLGDKGYYIQPTIFSDVQDNMRIAQEEIFGPVQSILKFNDLNEVIKRANASQYGLAAGVFTNNLNTANTLTRALRVGTVWVNCFDVFDAAIPFGGYKQSGIGREKGIDSLKNYLQVKAVVTPIKNAAWL

SEQ ID NO: 50167 - protein, 323 aa, Oryza sativa
MAGRSELVVSFGEMLIDFVPTVAGVSLAEAPAFVKAPGGAPANVAIAVARLGGGAAFVGKLGDDEFGRMLAAILRDNGVDDGGVVFDAGARTALAFVTLRADGEREFMFYRNPSADMLLTHAELNVELIKRAAVFHYGSISLIAEPCRSAHLRAMEIAKEAGALLSYDPNLREALWPSREEARTKILSIWDQADIVKVSEVELEFLTGIDSVEDDVVMKLWRPTMKLLLVTLGDQGCKYYARDFRGAVPSYKVQQVDTTGAGDAFVGALLRRIVQDPSSLQDQKKLEEAIKFANACGAITATKKGAIPSLPTEVEVLKLMESA

SEQ ID NO: 50168 - protein, 266 aa, Gossypium mustelinum
LSVEEIEVAPPQKNEVRVKIHFTSLCHTDVYFWEAKGQNPLFPRILGHEAGGVVESVGEGVMDVQPGDHVLPIFTGECKERPHCLSEASNMCDLLRINTERGGMLHDGHTRFSKDGKPIYHFLGTSTFSEYTVVHVGQVAKINPEAPLDKVCVLSCEMSTGIGATVNVAKPKKGGSVAVFGLGAVGLAAAEGARVCEASRIIGIDLNPNRFEEAKKFGCTEFVNPKDHNKHVQEVIAEMTGGGVDCSIKCTGSTQAMVSAFECVHD

SEQ ID NO: 50169 - protein, 663 aa, Escherichia coli O157:H7 EDL933
  misc_feature (612)..(612): Xaa can be any naturally occurring amino acid
MSSRKELANAIRALSMDAVQKAKSGHPGAPMGMADIAEVLWRDFLKHNPQNPSWADRDRFVLSNGHGSMLIYSLLHLTGYDLPMEELKNFRQLHSKTPGHPEVGYTAGVETTTGPLGQGIANAVGMAIAEKTLAAQFNRPGHDIVDHYTYAFMGDGCMMEGISHEVCSLAGTLKLGKLIAFYDDNGISIDGHVEGWFTDDTAMRFEAYGWHVIRDIDGHDAASIKRAVEEARAVTDKPSLLMCKTIIGFGSPNKAGTHDSHGAPLGDAEIALTREQLGWKYAPFEIPSEIYAQWDAKEAGQAKESAWNEKFAAYAKAYPQEAAEFTRRMKGEMPSDFDAKAKEFIAKLQANPAKIASRKASQNAIEAFGPLLPEFLGGSADLAPSNLTLWSGSKAINEDAAGNYIHYGVREFGMTAIANGISLHGGFLPYTSTFLMFVEYARNAVRMAALMKQRQVMVYTHDSIGLGEDGPTHQPVEQVASLRVTPNMSTWRPCDQVESAVAWKYGVERQDGPTALILSRQNLAQQERTEEQLANIARGGYVLKDCAGQPELIFIATGSEVELAVAAYEKLTAEGVKARVVSMPSTDAFDKQDAAYRESVLPKAVTARVAVXAGIADYWYKYVGLNGAIIGMTTFGESAPAELLFEEFGFTVDNVVAKAKELL

SEQ ID NO: 50170 - protein, 266 aa, Gossypium darwinii
LSVEEIEVAPPQKNEVRVKIHFTSLCHTDVYFWEAKGQNPLFPRILGHEAGGVVESVGEGVIDVQPGDHVLPIFTGECKECPHCLSEASNMCDLLRINTERGGMLHDGHTRFSKDGKPIYHFLGTSTFSEYTVVHVGQVAKINPEAPLDKVYVLSCGMSTGFGATVNVAKPKKGGSVAIFGLGAVGLAAAEGARVCEASRIIGIDLNPNRFEEAKKFGCTEFVNPKDHNKPVQEVIAEMTGGGVDCSIECTGSTQAMVSAFECVHD

SEQ ID NO: 50171 - protein, 266 aa, Gossypium hirsutum
LSVEEIEVAPPQKNEVRVKIHFTSLCHTDVYFWEAKGQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 50172 - protein, 467 aa, Nostoc punctiforme PCC 73102
MTSAIDKNSQLEAQAWELLEESVIFYQGKPIGTVAAHDPESDALNYDQCFLRDFVPSALVFLMYGKAEIVRNFLVETLKLQSHEKQIDCFEPGAGLMPASFKVHFNGNEEFLVADFGEQAIARVPPIDSCMWWILLLRAYEKATGDLSLARQPDFQAGIKLILDLCLVHRFSMYPTMLVPDGAFMIDRRMGVYEHPLEIQVLFYASLRAASELLLPDGDGDSYLGKVNRRLGSLKYHIRNYYWLDLKRLGEIYRYKDNEFGKEIVNKFNINSESIPSWLTEWLPETGGYLAGNLGPGRIDFRFFALGNLMAILTSLASEKESQSIMNLFVQRWQDLIGYMPVKICFPALEGLEWRIVTGCDSKNRAWSYHNGGNWPVLLWLFASAAQKAGRTELAQAAIAIAERRLLKDKFPEYYDGNNGRLIGKEARINQTWSIAGLLTAKKFVENPDYLELISFAEGLEVPGCSL

SEQ ID NO: 50173 - protein, 535 aa, Cryptococcus neoformans var. neoformans B-3501A
MPDPAPFWLCHECGAQMRPVTVDGTPHCASCNGEFIEILDPEVNPDPDYELPPPPPTRPGQQTPSRFDPHFLSNFPPPPQSEGSSSPARQRDTNNTGNFLSSLFSMLGTGSRQGSEETPRRPPPSFHGEPSASQRNGQSQNTDRPGMRTYAFNFGNARGSVTIGSFGSNLGRQGYRMNNDPTSPSGNLFNDPDPFRADPFDARFRPPGDGNRDINGDMPLPLGANEALQLIAALLDGNPPPNMGNLGDFATSDADFMRILQETFMEAAGPQGPVPANETVIEGLPRFTFDSGSLAKSQFRDCPVCKDDFEIGNEVMLIPCGHIYHPDCLVPWLRQNGTCPVCRFSLVSEDEQPNNQRTTNVGTEHTRNAEEERPATPTIPAAVSNFFRNLFGGSESQPPTPRAAAGGGHGSNASQDPHSSVNVVSESTISADASSRHSPTIHGATRREQVQQCDEVASEGSSNDSLVRVYPEHSSGETHGDDATNGEAGRIAEQEQQVASRDRLADRVNRDFNERWQRLRREREEDDTVYHPDLD

SEQ ID NO: 50174 - protein, 325 aa, Arabidopsis thaliana
MASNGDKGLIVSFGEMLIDFVPTESGVSLAEAPGFLKAPGGAPANVAIAVSRLGGRSAFVGKLGDDEFGHMLAGILRKNGVDDQGINFDTGARTALAFVTLRADGDREFMFYHNPSADMLLRPDELNLDLIRSAKVFHYGSISLIVEPCRSAHLKAMEVAKEAGALLSYDPNLREPLWPSKEEAKTQIMSIWDKAEIIKVSDVELEFLTGSNKIDDETALTLWHPNLKLLLVTLGEKGCRYYTKTFKGAVDPFHVNAVDTTGAGDSFVGALLNQIVDDRSVLEDEERLRKVLRFANACGAITTTKKGAIPALPSDAEVRSFLEKK

SEQ ID NO: 50175 - protein, 750 aa, Desulfitobacterium hafniense Y51
MSERTYHGLVLDRFQEEALDAIDEGQSVIVAAPTGTGKTLVADYLVEKVMAEGRRIIYTAPIKALSNQKFKDYKQLFGVDQVGILTGDVVLNSEAPLLIMTTEIFRNQVITNDPSLESVSYIIFDEIHWLNDEERGTVWEESIILAPPHMKLLGLSATIANAQQLVDWIGTIRQEDVALIQENRRIVPLEYYYFSRDTGLVNYEKLWKYYRQQIQSAPPTEGSLFAPTNHLDLIKVIQKQYLPALYFVFSRKQCADKASELAYLTNYLNPQEKRQVEDAFLEHFGPESDWYPSTRLLRRLAVKGIAFHHAGLMPSQKVLVEELFLKRLIHVLYCTETFSVGINYPVRSVCFDTLNKFDGRNFRPLANHEFFQMSGRAGRRGLDERGYSFALVDLNYMEKSPPPRFNINRLEPLTSQFKLSYNTVLNLQATLSYEQIQIYFQKSFAAHSNLQTHGQLIAELAQLEEQFNGKGEHVCRHTDSYACPVKYLPKKKELDRLKRAYQALGPRRQNRVYGREMARKIKNWEKLLATTPQKCPNAKLALCEEESKQRRKLQQRMIEIRKDLKTLPDQNFFFNEFQFKKNQLIQMGYIREDELLPRGECACHIYVQELLVTELIFSGIMETLDDDQLNALLSAIDFEARKNDYFQRLPVLDWTPLQDLARYIQSVCGPESVRYDPRVAVIVYSWSQGVSFAEVQRLSNLDEGDIISVIRRTIDLLRQMRDAVKEPALLQRLKLCMDKLDRDEAAVLAL

SEQ ID NO: 50176 - protein, 537 aa, Aspergillus oryzae
MSILSLVEDRPTPKEVYNWKIYLLAAVASCTSCMIGYDSAFIGTTISLQSFKDEFDWDSMSAAHQDLVSSNIVSLYQAGAFFGAFFAYPIGHFWGRKWGLMVSALIFTLGAGIMLGTNGDRGFGLLYGGRVLAGLGVGAGSNITPIYISELSPPAIRGRLVGVYELGWQIGGLVGFWICYGVDETLPPSHKQWIIPFAVQLIPSGLLIIGALFLKESPRWLFLRGRREEAIKNLCWIRQLPEDHVYMIEEIGAIDQTLEHQRATIGLGFWKPFAAAWTNKKILYRLFLGSMLFFWQNGSGINAINYYSPTVFKSIGVTGSNTSLFTTGIFGVVKTVVTFIWLLWLIDRVGRRLLLLIGAAGGSICLWIVGAYIKIARPSERENKQMDGGGIAAMFFFYLWTVFYTPSWNGTPWVINSEMFDPNIRSLAQACAAGSNWLWNFLISRFTPQMFAKMDYGVYFFFASLMILSIIFVFFLIPETKGIPLESMDRLFETQPIWRAHGTLLKQIREDEERFRHDLEDSGFVKSTDRQVEVVDA

SEQ ID NO: 50177 - protein, 288 aa, Synechococcus elongatus PCC 6301
MSALTGRTRLLGIIGDPIEHSLSPLIQNAAIAELGLDYCYVPFPVKGADLATALAGLAAIGVQGFNVTIPHKQAVMPLLSQVSELAQSVGSVNTVWQTEQGWVGTNTDVLGFLAPLQTLRSDWSGCRVVLLGCGGAARAVVAGCLQLGCSAIATVVRDAQKGDAFQQSWGDRADSLTIHDWSDIPDVLSTADLVVNTTPLGMDPHIERSPLDNSAAQQLRPETIAYDLIYTPSPTRFLQQAIAQGCHAIDGLEMLVQQGAAGLKIWTGAEAVPVDTMRSVLNAHLGLA

SEQ ID NO: 50178 - protein, 577 aa, Oryza sativa (indica cultivar-group)
MAIAAPLFRLAAAAAVVMGVVSPAVKAAGGGNSSTACPLDLGYVRSFPWDTAPCMPPVANQTACCTTLLSVLGVGLAARLRATGHFRLPSANASAACLGAFSDELASPPLSLQDTLVPACWPVSSQLAISPSYCAGVTTAKHSAGPTSPGTANCALGLALSTPSSSSSPASSSNHTNMAVATAIPVASALLVSVIAALLVWRRRQDSIRSKSRRLSGERRLSRPRPNVGSVLFSLGELAKATCGFAERNLIGRGGFGVVYRGVLDDGSVVAVKKMLDPDMEGGDEEFTNEVEIISHLRHRNLVPLRGCCISDDDADEGKQMFLVYDYMPNGSLDHYIFKDGGDGGRRPPPLSWAQRRGVVLDVARGLEYLHHGVKPGIYHRDIKATNILLGTDMRARVADFGLARRSREGQSHVTTRVAGTHGYLSPEYALYGQLTEKSDVYSFGVLVLEVMSGRRALDLSDPSGVVLITDWAWALVRAGRAAEVVAAALREREGPAGVHAMERFVLVGILCAHVTVACRPTMPEALRMLEGDMDVPDLPERPQPYGQRIAFDEGEANFSASSVLSGPFMDFGDMLR

SEQ ID NO: 50179 - protein, 347 aa, Oryza sativa (indica cultivar-group)
MDSTAGSGIAAPAAAAVCDLRMEPKIPEPFVWPNGDARPASAAELDMPVVDVGVLRDGDAEGLRRAAAQVAAACATHGFFQVSGHGVDAALARAALDGASDFFRLPLAEKRRARRVPGTVSGYTSAHADRFASKLPWKETLSFGFHDRAAAPVVADYFSSTLGPDFAPMGRVYQKYCEEMKELSLTIMELLELSLGVERGYYREFFADSSSIMRCNYYPPCPEPERTLGTGPHCDPTALTILLQDDVGGLEVLVDGEWRPVSPVPGAMVINIGDTFMALSNGRYKSCLHRAVVNQRRERRSLAFFLCPREDRVRHYRADTRTLDAFTRWLAPPAADAAATAQVEAAS

SEQ ID NO: 50180 - protein, 486 aa, Prochlorococcus marinus subsp. pastoris str. CCMP1986
MSSNELDEIKFGTDGWRGIIGFDFNLSNLSRVVVASCQELYYQYFEETNSKKILIGYDRRFMANEFAKEIASFVKGCGFEPILSTSYVPTPSCSLYAKKFMFLGCLVITASHNPYNWLGLKIKSFKGCSVDESFTKEVEKRLLLGNSIERLEGAYEKVDIKKFHLDQIKSNFNIDFIANNLKKMNLHIFVDSMHGSAANCLSQIFEGYDSKIFTEIRADYDPLFGGNPPEPLLKYLDNLTKTLTKTSKNGIKTLGIIFDGDGDRIAVIDEKGRFCSTQVLLPFFISYLGEKNKNLYPVLKTVSGSDIISNIAKNQDREVFELPVGFKYIAKKMIKEKIFIGGEESGGVGFGDFMPERDALYAAMILLNGIAEKSKYLYETLDQIQENFGPSFYRRIDVKFPNQSEKEILEKYIKNNIPSKICGYSIKSVSNIDGIKLRMDNNFWLLFRFSGTEPLLRLYCEAKSENDLNEVLEWSQKYINKVKNIK

SEQ ID NO: 50181 - protein, 266 aa, Gossypium tomentosum
LSVEEIEVAPPQKNEVRVKIHFTSLCHTDVYFWEAKGQNPLFPRILGHEAGGVVESVGEGVMDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 50182 - protein, 201 aa, Prochlorococcus marinus subsp. pastoris str. CCMP1986
MSSLRQSEIKRKTNETDISVFINLDGNGISEIETGIPFLDHMLHQISSHGLFDLKIKAIGDTHIDDHHTNEDVGIALGKAFSKALGERKGISRFGHFFAPLDEALVQVTLDCSGRPHLSYDLQLKAPRIGNYDTELVKEFFIAFVNNSGITLHINQIRGSNSHHIVEACFKAFSRAMRMATEIDLRRSDSIPSSKGMLENQ

SEQ ID NO: 50183 - protein, 491 aa, Arabidopsis thaliana
MNSKKLNIGPKDIINSLPEALIYHILSFLSTKEAAITSLLSRKWRYFFAFVPNLDFDDPVRMQPDMGNQEETEIHTSFMDFVDRVLALRGNSHVNKFSLKCGNGVDGVGVTRWILNTLELSVSELDLSIASDTTYLFPSKVFVSKSLVRLRIEARNGLAFGSLVIDVGDVSLPKLKTLYLDSVELDYQIICLAKLLSGCHVLEELVMIDVVWNFWESCSASIPTLKRLTFFTEEGWNNPPPSVTFDNPALVYFEYTDTVALKYEKVNFDSLVEARLGLRVGYEESENPIQVPFGFPFPLIEYAMVGDATDLLMGIRNVQVLYLYASTVEVLTFRCKAIPIFNNLTRLTIESNTKVGWDSLPNLLKNCPNLKTLVFQGLLHKATDRCGDMCPCKPPENIHTCLSSSPVKVLEILKFGEINDKTELEQTKHFLELMPHLEQLNIYYDTSVDDNLVKVSKQLQEIPGVASAKCKVQVISDNLTLSVTLPSSSSI

SEQ ID NO: 50184 - protein, 165 aa, Arabidopsis thaliana
MANPIPSNSSLVMRSAMPPTISATNLVSRKEFYYHWYSGKNENHPMILIKKDLGLSSLFKVDLLSRDIAVSSMVSGHKTFLKLVGCCLEFEDSVKVYHGVKKHYKLEISEHPWKRRMKIVEDIATALAYLHTAFPRLFVYRILSHWNILLDEDGVAKLTDFSHCV

SEQ ID NO: 50185 - protein, 266 aa, Gossypium mustelinum
LSVEEIEVAPPQKNEVRVKIHFTSLCHTDVYFWEAKGQNPLFPRILGHEAGGVVESVGEGVTDVQPGDHVLPIFTGECKECPHCLSEASNMCDLLRINTERGGMLHDGQTRFSKDGKPIYHFLGTSTFSEYTVVHVGQVAKINPEAPLDKVCVLSCGMSTGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 50186 - protein, 464 aa, Escherichia coli O157:H7 EDL933
MPDAKKQGQSNKAMTFFVCFLAALAGLLFGLDIGVIAGALPFIADEFQITSHTQEWVVSSMMFGAAVGAVGSGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAGLNVLFILLTLWLVPETKHVSLEHIERNLMKGRKLREIGAHD

SEQ ID NO: 50187 - protein, 201 aa, Brassica napus
MGDSASSSSSSSSVHRSLGGGSVADLLLWRNRTGAVILLVSSTAFWFLFERAGYNLLSFVSNVLLLLVAILFLWAKSASLLNRPLPPVPNMEIPEEFAIKAADEIRVLINHVLSIPSDITIARNPIRLLQVSFVLWAISYVGTLINSLTLVYIVVLLSLSVPVVYENYQEHIDDKLSSTSEVIRNISRKIPMPVSKEKKYQ

SEQ ID NO: 50188 - protein, 379 aa, Oryza sativa (japonica cultivar-group)
MATAGKVIKCKAAVAWEAAKPLVIEEVEVAPPQAMEVRVKILFTSLCHTDVYFWEAKGQTPVFPRIFGHEAGGIVESVGEGVTDLAPGDHVLPVFTGECKECAHCKSAESNMCDLLRINTDRGVMIGDGKSRFSINGKPIYHFVGTSTFSEYTVMHVGCVAKINPAAPLDKVCVLSCGISTGLGATINVAKPPKGSTVAIFGLGAVGLAAAEGARIAGASRIIGIDLNANRFEEARKFGCTEFVNPKDHDKPVQQVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFSEINTAFDLMHKGEGIRCIIRMEN

SEQ ID NO: 50189 - protein, 272 aa, Gossypium barbadense
LSVEEIEVAPPQKNEVRVKIHFTSLCHTDVYFWEAKGQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMTYSSSLLAGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAMVSAFECVHD

SEQ ID NO: 50190 - protein, 376 aa, Oryza sativa (japonica cultivar-group)
MATAGKVIKCKAAVAWEAGKPLSIEEVEVAPPQAMEVRVKILYTALCHTDVYFWEAKGQTPVFPRILGHEAGGIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVQVLIEMTNGGLDRAVECTGNINAMISCFECVHDGWGVAVLVGVKDDVFKTHPMNFLNEKTLKGTFFGNYKPRTDLPNVVELYMKKELELEKFITHSVPFSEINTAFDLMLKGESLRCVMRMDE

SEQ ID NO: 50191 - protein, 104 aa, Methanosarcina mazei
MPEADLSILNRVYDIILDRKENYDENSYVCKLLNHRKGMNKILEKVGEESIETILAVRNEDHREIVSESSDLIFHLLVLLAANNITLEEIADELSTRHEKMRRD

SEQ ID NO: 50192 - protein, 272 aa, Gossypium darwinii
LSVEEIEVAPPQKNEVRVKIHFTSLCHTDVYFWEAKGQNPLFPRILGHEAGGVVESVGEGVTDVEPGDHVLPIFTGECKECPHCLSEASNMCDLLRINTERGGMLHDGQTRFSKDGKPIYHFLGTSTFSEYTVVHVGQVAKINPEAPLDKVCVLSCGMTYSSSLLAGFGATVNVAKPKKGGSVAVFGLGAVGLAAAEGARVCEASRIIGIDLNPNRFEEAKKFGCTEFVNPKDHNKPVQEVISEMTGGGVDCSIECTGSTQAVVSAFECVHD

SEQ ID NO: 50193 - protein, 297 aa, Oryza sativa (japonica cultivar-group)
ELSPGDHVLPVFTGECGDCRHCLSEESNLCDLLRINTDRGAMIGDGQTRFTARGGQPVYHFLGTSTFSEYTVVHVGCVAKIHPAAPLDKVCVLSCGISTGFGATVNVAKPPKGCTVAIFGLGAVGLAAMEGARISGASRIIGVDLNPAKFELAKKFGCTDFVNPKDYDKPVQQVIIEMTNGGVDRSVECTGNAAAMISAFECVHDGWGVAVLVGVAGKDAAFKTHPTNFLNERTLRGTFFGNYKPRTDLPGVVEMYMNKELELEKFITHSVPFSEINTAFDLMLSGESLRCIIRMED

SEQ ID NO: 50194 - protein, 498 aa, Oryza sativa
  misc_feature (196)..(196): Xaa can be any naturally occurring amino acid
LPSPTTLFLSPIPLSSRRAGNVPPPPPEPAGLPLVGHLHLFRKPLHRTLARLAARHGGAVFGLRLGSRRVAVVSSAPAAEECLGAHDVAFADRPRLPSGRILSYDWSTMGTASYGPYWRHVRRVAVTEILSARRVQHFADVHVREARAMARHLHRAAVRHGVGGAARVRVELKSRLFELLMNTMMAMICDKTYYGXSDDDGKVSKEARWFREMVEETMALSGASTVWDFLPAALRWVDVGGVGRRLWRLRESRTRFLQGLINDERKEMEQEQGGDRAQPAARRRTMIGVLLSVQRQDPDACPDQLIRSLCISSLEAGTDTSADTIEWAMSLLLNNPNVMRKARDEIDAFIGQPCIIMETLRLYPPAPLLVPHEASTDCSIAGFHITRGTMLLVNTFAIHRDPQVWNEPTSFIPERFENGRSEGKMAIPFGMGRCKCPAENLGMQMVGLALGTMIQCFEWERVGEELVDMTEGSGLTMPKEVPLQAFYQPRASLMHLLY

SEQ ID NO: 50195 - protein, 266 aa, Zea mays
MTTARLVSTSPARLPSTSASPIPRTSLCVVGRAPAFSARALGFSLRLKPSPAMAAAGPPTAHGDSIGSSRIGEVKRVTKETNVHVKINLDGTGVAECSTGIPFLDHMLDQLASHGLFDVYVKAIGDTHIDDHHSNEDIALAIGTALLEALGDRKGINRFGHFTAPLDEAAVEVILDLSGRPHLSCGLDIPTQRVGTYDTQLVEHFFQSVVNTSGMTLHIRQLAGKNSHHIIEASFKAFARALRQATEYDLRRQGTVPSSKGVLSRS

SEQ ID NO: 50196 - protein, 453 aa, Zea mays
MEKKPTILMNRYELGRTLGQGTFAKVYHGRNLASGESVAIKVIDKEKVMRVGMIDQIKREISVMRLVRHPNVVQLHEVMASKSKIYFAMEYVRGGELFARVARGRLKEDAARRYFHQLVGAVDFCHSRGVYHRDLKPENLLVDEHGNLKVSDFGLSALRECQKQDGLLHTTCGTPAYVAPEIINKKGYDGAKADIWSCGVILFVLLAGYLPFHDANLVEMYRKISRADVKYPQWFSPELRRLMPKLLEPNPNNRITIEKLVEHPWFKKGYRPAVMLAQPHGSSSLKDVQVAFSNADHKDSSTKVEQPADSSLKPASLNAFDIISHSRGFDLSSLFEVDQEQKASNSRFMTQKPASAIVSKLEQIAETERFMVKKQDGLVKLQGSKQGRKGQLAIDAEIFEVTPAFHVVEVKKSAGDTLEYEMFCSKGLRPSLSDICWSSRSEENMAPSVVQPS

SEQ ID NO: 50197 - protein, 293 aa, Nostoc punctiforme PCC 73102
MTANFGAFAKSVGEAIAPERGKSPQLSWTNVVFFTTFHALALMSPWFFSWSALGLLVFLHWLFGSIGICLGYHRLLSHKSFQVPKWLEYAIALIGALALQGGPIFWVGGHRQHHAHTEDINLDPYSAQRGFWWSHILWIFYPRPEFFDYDTYKKYAPDLARQPFYCWLDRYFLLLQIPFALLLYGLGGWPFVFYGVFLRCVLLWHSTWFVNSASHLWGYRTFDANDGARNLWWVSLVTYGEGWHNNHHTYPHMAKSGLSWWEIDVTWWSILVLQTLGLAKKVVSRPPQGATHG

SEQ ID NO: 50198 - protein, 280 aa, Brassica napus
  misc_feature (275)..(275): Xaa can be any naturally occurring amino acid
MATKRSVGTLKEADLKGKSVFVRVDLNVPLDDNSNITDDTRIRAAVPTIKYLMGNGSRVVLCSHLGRPKGVTPKFSLKPLVPRLSELLGVEVVMANDSIGEEVQKLVAGLPEGGVLLLENVRFYKEEEKNDPEFAKKLAALADVYVNDAFGTAHRAHASTEGVAKYLKPSVAGFLMQKELDYLVGAVANPKNPFAAIVGGSKVSTKIGVIESLLSTVDILLLGGGMIYTFYKAQGHSVGSSLLEEDKLDLARSLMEKAKAKGVSLLLPTDVVIAXQFAPD

SEQ ID NO: 50199 - protein, 464 aa, Zea mays
MVNGEQRADAECTRASLLGRYEIGRTLGEGNFGKVKYARHIATGGHFAIKILDRSKILSLRIDDQIRREIGTLKLLKHPNVVRLHEVAASKTKIYMVLEFVNGGELFDKIAIKGKLSEHEGRRLFQQLIDGVSYCHDRGVYHRDLKPENVLVDRKGTIKISDFGLSALPQHLGSDGLLHTTCGSPNYIAPEVLQNRGYDGSLSDLWSCGVILYVMLVGCLPFDDRNLVVLYQKIFKGDCQIPKWLSPAAQDLLKRILQPNPMKRINVAGIREHEWFKKDYVPAVPHDDDEDVLPSPAPSIKEPIDEPAQEKCTPINAFQLIGMASSLDLSGFFEEEDAAQRKIRFTSTHPPKDLFDKIESVVMEMGFKVHRGAGKLKVLKNSKCSRNSRNPSSLLVCTEVFELGPSLYVVELRKSHGDSMLYRQLCERLSDELGACKTDQIARTESSSDDLSSLDGEAFPLSGF

SEQ ID NO: 50200 - protein, 418 aa, Desulfitobacterium hafniense Y51
MSRIKNLREEALEFHKVQPGKLEVRVTVPAQDRDDLTLAYSPGVAEPVKEIAADLENLDIYTNHANYVSIVSNGTAILGLGDLGAAASMPVMEGKSLLFKAFGDVDAFPLCVNTTDVDKIVEIVELTSPTFGGVNLEDIKAPECFEIEEKLKARGIFKGPIFHDDQHGTAVVTLAGLVNALKVVGKKIEDIKVVANGAGAAGIAIIKLLMSMGLKNVIMCDTKGAIYEGRTVGMNPWKEEIAKATNPEKFSGDLAGALVGADAFIGISAANVLNEDMIRSMAKDPIVFCQANPIPEIWPIERAFEAGAKVISTGRSDVINQINNVLAFPGMFRGAIDVRATDINDAMKVAAAYAIAGIVKDEELSADYIIPSTFNPEVAPAVAAAVAKAAIDSGIARRPMDPQEVADGLKKRLANQYK

SEQ ID NO: 50201 - protein, 198 aa, Brassica napus
  misc_feature (145)..(145): Xaa can be any naturally occurring amino acid
IENDVIVFSDEVYDKLDFEMDHICIASLPGMYERTVTMNSLGKTFSLTGWKIGWAVAPPHLTWGIRQAHSYLTFATSTPMQAAAVAALEAPESYYTELKRDYSEKKEILVKGLKEVGFEVFPSSGTYFVVVDHTPFGFGDDVAFXYLIKEVGVVAIPTSVFYLNPEDGKNLVRFAFCKDEETLRSAIERMKLKLKRVV

SEQ ID NO: 50202 - protein, 125 aa, Zea mays
  misc_feature (76)..(76): Xaa can be any naturally occurring amino acid
MGGDLYALDFDGVLCDSCGESSLSAIKAAKVRRPSLFEQVDAAMEEWIVEQMYTLRPVVETGYENLLLVRLLVEIXDGLSIQEILENWSKLKPTLMDEWQEDRESLVDLFGRVRDDWIENDFSGW

SEQ ID NO: 50203 - protein, 500 aa, Gibberella zeae PH-1
MSLDIQLTAPNGRTYKQPTGLFINNEWVKSSNGEKITSINPTNEQEITSVYAGSSEDVDKAVRAARRALHNPSWRDLPGTERGKLLSRLATLVEENKEILATIETWDNGKPYTVALNDDVNEVAETLRYYGGFADKVYGQVIETTGDKFGYTIREPIGVCGQIIPWNFPLAMAAWKLGPALACGNAVILKPAEQTPLSILYLANLIVEAGFPPGVVNIINGLGTVAGAALASHMDVDKIAFTGSTPTARSIMKMASSNLKNITLETGGKSPLIVFDDADVDLAAYWAHAGIMYNQGQVCTATSRILVQESIYDKFMAAFGAQVKNISKVGDPFEESTFQGPQVTKAQYERILSFVDVGKKEGAKLALGGQPFKVGDGKGYFVEPTVFTDVTPKMRVFQEEVFGPFVVVTKFSSEDEAIHLANDTQYGLGSALFTTNLTRAHQVAKRIEAGMVWVNSSNDSDWRIPFGGVKQSGIGRELGEAGLAAYSNIKAVHVNIAAKL

SEQ ID NO: 50204 - protein, 171 aa, Synechococcus elongatus PCC 6301
MDLKTLIREIPDFPKPGILFRDYTTVLKDPQGWRYSIDRLTELIKPLEPTAIVGIESRGFILGAPLAYQLGLGFVPVRKPGKLPADTHSVEYELEYGSDRLEIHQDALAPGDRVVVVDDLIATGGTASATATLIDRCSATLAGFAFVIELEGLNGRDRLPEVPIISLVSYD

SEQ ID NO: 50205 - protein, 575 aa, Magnaporthe grisea 70-15
MADIQPARPSSGDKAKGAVGGDHVETTSGGPAEKALNEKEALEFARNGGDGEMNSLISSLERELEAEGGLRNGFFDLQFSNTKYFNWMIIAFASMGGMLSGLDQSLISGANLFLPTDLGLSTRELSLVNSAMPLGAVGGALILSPCNEFFGRRMSIMISCFLYTVGAAVCAGSINFGMIVAARVILGMGVGLEGGTVPVYVAETAERRIRGNVVSLYQLNIALGEVLGYAVAAMFLHVEGNWRWILGSSLVFSTIMWGGMLFLPESPRYLMHKRRTLDAFRVWKRIRGTDTPEAREEFFIMKVSVLDEQNAVTETARNKRFPWMDFFTVPRARRALVYANIMILLGQLTGVNAIMYYMSVLMKQIGFDDEKATYMSLVGGGSLLIGTIPACLYMEKFGRRFWANTMLPGFFVGLVIIGASYHIPIDTNTTGAAACYLVGLALYMGFFGCYACLTWVVPSEVYPTYLRSYGMTTSSGLLFLASFVVTYNFSAMQEAMTRTGLTLGFYGGIAVLGWFYQLIFMPETKDKTLEEIDQLFERPTREIVSENMRNLFGRRKSREDAAAAAVSEEKADVYA

SEQ ID NO: 50206 - protein, 197 aa, Glycine max
IEIMEKVGVRLVVLLCFIVTAAMAQNCGRQAGGQTCGNNLCCSQYGWCGNSEDHCSPSKNCQSTCWGSGGGGGGGESASNVRATYHNYLPEQHGWDLNAVSAYCSTWDAAKPYSWRSKYGWTAFCGPVGPRGRDACGKCLRVTNTGTGANIIVRIVDQCSNGGLDLDVGVFNRIDTDGRGYQQGHLIVNYQFVNCGD

SEQ ID NO: 50207 - protein, 491 aa, Ralstonia eutropha JMP134
MKTQEVLPICIAGEWRLGTGDRYATRYPATGEVVAELNAASLADVEEAVQGAQRAFETSGWARRKPHERAAVLYRVAELIRAQAEPLAQRQRLDNGKPISETRALVASAASTFQFFAAACETLEEQITPQRGECLTMSVYEPMGVVAAITPWNSPIASEAQKMAPALAAGNAVVVKPAEVTPLMALELARICDEAGVPKGLISVLPGKGSVIGDAITKHPLVRRVSFTGGTTTGKHIAHIAADKMMPVSLELGGKSPTMVFDDADLDHAVNGVLYGIFSSSGESCIAGSRLFVARSQYEPFIERLAAGAAHLRVGDPADERTQMGPLITDRHRDSIESYVAMGVQDGGQLRTGGLRPDVAGLPNGYFYTPTIIEGLDNHARIAQEEIFGPVLVAIPFDDEDDLIEQANDSVYALAAGIWTRDYKRAWRVARAVQAGNVWINTYKQFSISAPFGGWRDSGLGREKGRLGILQYMEQKSVYWGLNEQPLPWAN

SEQ ID NO: 50208 - protein, 283 aa, Xanthomonas axonopodis pv. citri str. 306
MPVSRYAVFGHPVAHSLSPAIHADFGKQTGIALDYTAIDASLEDFSAALQRFADEGGKGANVTLPLKEAAYALASSLSDRARLAGAVNTLVRNDGQWQGDNTDGAGLVRDLTERQGLDLRGRRVLLLGAGGAARGVAPALLEAGITAMVVVNRSPERADALCDALGEPARVTSRYIEDLRELGDFELIVNATAAGRDRDAGAFALPLGLVNSLTAAVDLNYGDTAIAFLAWARAAQCRYAIDGLGMLVEQAAESFALWHGVRPDTDPVYAALRAREAVLISAD

SEQ ID NO: 50209 - protein, 117 aa, Triticum aestivum
KIFEVGDVVMLDSSRDVVASNNRRLAALYCNRVSGFEEIMGLVDSIVKVVRAPHVNFGKNYYVPTDEPEFFPKRQCKIVTSDGKQVGYLGIVHAEVLRKFGIPDPCTFVEMDLEALL

SEQ ID NO: 50210 - protein, 353 aa, Prochlorococcus marinus str. MIT 9303
MPSLRTFLAGDLGGTKTLLALYSWDEKQLKQQHRRRYLSNQWTSLEPMLSDFIAHLPGEMEQPNNGCIAVAGPVRHGEARITNLPWSLKEKDLCAATGLKHLELINDFGVLIYGLPFLNDSQQVELQLPQQHLSGQGPIAVLGAGTGLGMARGLPTKDGMVALPSEGGHREFAPRSECEWQLCEWLKADLQLERLSLERVVSGTGLGHVARWRLQHSDADGHPLRDLADAWRHGADDHSDHLDLPALASQAASEGDSILQEALQLWLAAYGSAAGDLALQELCVGGLWVGGGTAAKQLQGLRSSTFLEAFRNKGRFRPFLEQLPVMAVIDPEVGLFSAACRAHMLAEQGGTLT

SEQ ID NO: 50211 - protein, 390 aa, Synechococcus sp. RS9917
MATLLEQLSAMTVVVADTGDLEAIRRFTPRDATTNPSLILAAAQIPAYQSLIDEALRSSRKLIGDNAPVEDVVHEALDEISVIFGKQILKIVPGRVSTEVDARLSYDTDATIAKGRKLIRLYNDAGISNDRVLIKIASTWEGIKAAEVLEKEGIHCNLTLLFGFAQAVACAEAGVTLISPFVGRILDWFKAETGRDSYPGPEDPGVLSVTRIFNYFKTYGYKTEVMGASFRNTDEIVELAGCDLLTISPKLLDQLRQSDAVLSRKLDGANPSSSEPQIQVDRERFDALMREDRMASDKLGEGIKGFSKAIETLEQQLAHRLAELEGGSAFRHAVQEIFLLNDMNGDGSITRDEWLGSDAVFDALDQDHDGRLTPDEVRQGLGAALSLTTA

SEQ ID NO: 50212 - protein, 1066 aa, Gibberella zeae PH-1
MAIKDGGKKSGQIPGPKGLPVLGNLFDLDLSDSLTSLINIGQKYAPIFSLELGGHREVMICSRDLLDELCDETRFHKIVTGGVDKLRPLAGDGLFTAQHGNHDWGIAHRILMPLFGPLKIREMFDDMQDVSEQLCLKWARLGPSATIDVANDFTRLTLDTIALCTMGYRFNSFYSNDKMHPFVDSMVAALIDADKQSMFPDFIGACRVKALSAFRKHAAIMKGTCNELIQERRKNPIEGTDLLTAMMEGKDPKTGEGMSDDLIVQNLITFLIAGHETTSGLLSFAFYYLLENPHTLEKARAEVDEVVGDQALNVDHLTKMPYVNMILRETLRLMPTAPGFFVTPHKDEIIGGKYAVPANESLFCFLHLIHRDPKVWGADAEEFRPERMADEFFEALPKNAWKPFGNGMRGCIGREFAWQEAKLITVMILQNFELSKADPSYKLKIKQSLTIKPDGFNMHAKLRNDRKVSGLFKAPSLSSQQPSLSSRQSINAINAKDLKPISIFYGSNTGTCEALAQKLSADCVASGFMPSKPLPLDMATKNLSKDGPNILLAASYDGRPSDNAEEFTKWAESLKPGELEGVQFAVFGCGHKDWVSTYFKIPKILDKCLADAGAERLVEIGLTDASTGRLYSDFDDWENQKLFTELSKRQGVTPTDDSHLELNVTVIQPQNNDMGGNFKRAEVVENTLLTYPGVSRKHSLLLKLPKDMEYTPGDHVLVLPKNPPQLVEQAMSCFGVDSDTALTISSKRPTFLPTDTPILISSLLSSLVELSQTVSRTSLKRLADFADDDDTKACVERIAGDDYTVEVEEQRMSLLDILRKYPGINMPLSTFLSMLPQMRPRTYSFASAPEWKQGHGMLLFSVVEAEEGTVSRPGGLATNYMAQLRQGDSILVEPRPCRPELRTTMMLPEPKVPIIMIAVGAGLAPFLGYLQKRFLQAQSQRTALPPCTLLFGCRGAKMDDICRAQLDEYSRAGVVSVHRAYSRDPDSQCKYVQGLVTKHSETLAKQWAQGAIVMVCSGKKVSDGVMNVLSPILFAEEKRSGMTGADSVDVWRQNVPKERMILEVFG

SEQ ID NO: 50213 - protein, 349 aa, Nostoc punctiforme PCC 73102
MAKTPESLESSINEITDRALDRDCTTLSRHVLQQLQSFSPDAQDLSALMNRIALAGKLVARRMSRAGLMEGVLGFTGEVNVQGESVKKMDVYANDVFISVFKQSGLVCRLASEEMENPYYIPENCPIGRYTLLYDPIDGSSNTDNNLSLGSIFAIRQQEGTDSDGKATDLLANGRKQLAAGYILYGPCTMLVYTIGKGVHSFVLDPSLGEFILTEENIRIPNHGSVYSVNEGNFWQWEESIREYIRYVHRTEGYSARYSGAMVSDIHRILVQGGVFLYPGTIQNPEGKLRLLYETAPLAFLIEQAGGRATTGLVNILDVVPKKLHQRTPLIIGSKEDVAKVESFIQNGH

SEQ ID NO: 50214 - protein, 286 aa, Agrobacterium tumefaciens str. C58
MADSRETLTINAFVVGYPIKHSRSPIIHSYWLKKFGIAGSYTAVEVSPDDFPKFIATLKEGKPGAAVGGNATIPHKEAAYRLADHPDALAEELGAANTIWMEEGKLHATNTDGYGFVSNLDERHPGWDKTQRAVVFGAGGASRAVIQSLRDRDVAEIHVVNRTVERARELADRFGPRVFSHPQAALQEVMHGAGLFVNTTSLGMNGTEAPHLDFSHLAANAVVTDIVYVPLKTPILNMAQEQGIATVDGLGMLLHQAKPGFRRWFGRIPEVDETLRSLIIADMEKH

SEQ ID NO: 50215 - protein, 459 aa, Arabidopsis thaliana
MAATRQLRTLQSQPENKVCVDCAQKNPQWASVSYGIFMCLECSGKHRGLGVHISFVRSVTMDSWSAIQIKKMEAGGNERLNKFFAQYGIAKETDIISKYNSNAASVYRDRIQALAEGRPWNDPPVVKEANKKPPLAQGGYGNNNNNNNGGWDSWDNDDSYKSDMRRNQSANDFRASGNREGAHVKSKSSEDIYTRSQLEASAAGKESFFARRMAENESKPEGLPPSQGGKYVGFGSSSAPPPRNNQQDDVFSVVSQGFGRLSLVAASAAQSAASVVQTGTKEFTSKVKEGGYDHKVSETVNVVANKTTEIGHRTWGIMKGVMAMATQKVEEFTKEGSTSWNQQSENEGNGYYQNFGNGNKAANSSVGGGRPQSSSTSGHYNNSQNSNSWDSWGENENKKTEAVAPKGSSASNDDDGWTGWDDHDAKDDGFDGHYQSAGDKKSAGHNGKSDTAWTGGGFL

SEQ ID NO: 50216 - protein, 186 aa, Zea mays
MGSKAPFCLTLLLLLAAACGPAAHAHDAVELPHHGSALKEQISSTKIPARLKSGSGLCSACENFTSEAVTYLGKEQTQDRIMEFLHDACSQSFSFEQKCVELMDSYATLLFAKITEIRPEAFCKRYGLCRDTALLSGVGSDSTCVFCHHLLDEIMSKLKDPDAEFEIIQILVKECNKIEGHVQQTM

SEQ ID NO: 50217 - protein, 176 aa, Prochlorococcus marinus subsp. pastoris str. CCMP1986
MENNSSPESSEEIVKQNGIVSNQLSQDGITNESLGNDHIGVEILSVKPEKLYEAISTLRGYGFNYLQCQGGYDEGPGKCLVSFYHLISLGDIQDIKEIKEIRVKVFLNRDSDLSVPSLYKIFKGSDWQERETYDMFGINFADHPNPTRLLMPEDWRGWPLRKDYIQPDFYELQDAY

SEQ ID NO: 50218 - protein, 405 aa, Vibrio vulnificus CMCP6
MAGVLGMILAGGEGSRLRPLTESRSKPAVPFGGSYRLIDFALNNFVNADLMRIYVLTQFKSQSLFHHMKKGWNINGITDRFIDPIPAQMRTGKRWYEGTADAIYQNLRFMELSEPEQVCIFGSDHIYKMDIKQMLSFHKEKLAALTVSALRMPLAEASQFGVIEVDAEGRMVGFEEKPSAPKSIPGDPDFALVSMGNYIFEADVLFAELIEDADNENSSHDFGKDIIPKMFPRGDVFVYDFSQNRISGEKAEVYWRDVGTIDAYWQAHMDLLKTDAPFSLYNRKWPLHTYQPPLPPATFTDSDNGRVQIIDSLVCNGSYVRGSRIEKSVLGFRSNIASACDISESILLGDVKVGEGCVLRRVIVDKDVDIAPGTQIGVNLQEDKKIFHVSDDGIVVIPKGARVGY

SEQ ID NO: 50219 - protein, 255 aa, Escherichia coli CFT073
MFNSDNLRLDGKCAIITGAGAGIGKEIAITFATAGASVVVSDINADAANHVVNEIQQLGGQAFACRCDITSEQELSALADFAVSKLGKVDILVNNAGGGGPKPFDMPMADFRRAYELNVFSFFHLSQLVAPEMEKNGGGVILTITSMAAENKNINMTSYASSKAAASHLVRNMAFDLGEKNIRVNGIAPGAILTDALKSVITPEIEQKMLQHTPIRRLGQPQDIANAALFLCSPAASWVSGQILTVSGGGVQELN

SEQ ID NO: 50220 - protein, 244 aa, Zea mays
MEAGGAGAEGVMRVLLVDDSPVDRRVAQLLLSSNSCAGSFHVIAVDSAKKAMEFLGLKDGGKEQAIDMVLTDYCMPEMTGYDLLKAIKALNPLKPIPVIVMSSEDEPQRISRCLNAGAEDFIVKPLQSKDVQRLRNCSTVGRPSNKGGATLPCEENAVAKWSNNKLPPSAGAGAGASATSPSGRRANLAGVAMRQVLHSSSVEISQYLPLLLKLVVLAYAALCLGELLHRWSSGGSCSLSPWCA

SEQ ID NO: 50221 - protein, 393 aa, Calycanthus floridus var. glaucus
MNVPATRKDLMIVNMGPHHPSMHGVLRLIVTLDGEDVIDCEPVLGYLHRGMEKIAENRTIIQYLPYVTRWDYLATMFTEAITVNAPEQLGNIQVPKRASYIRVIMLELSRIASHLLWLGPFMADIGAQTPFFYIFRERELLYDLFEAATGMRMMHNYFRIGGVAADLPHGWIDKCLDFCDYFLTGVVEYQKLITRNPIFLERVEGVGIIGGEEAINWGLSGPMLRASGIQWDLRKVDHYECYDEFDWQVQWQKEGDSLARYLVRISEMTESIKILQQALEGIPGGPYENLEGRRFDRESDSEWNDFDYRFISKKPSPTFELSKQELYVRVEAPKGELGIFLIGDNSVFPWRWKIRPPGFINLQILPHLVKRMKLADIMTILGSIDIIMGEVDR

SEQ ID NO: 50222 - protein, 109 aa, Bacillus thuringiensis serovar konkukian str. 97-27
MNSQRQGYAGWWQGGHGGWPGGHGGWQGGHGGWQGGHGGWQGGHGGWQGGHGGWQGGHGGWQGGHGGWPGGHGGWQGGHGGWQGGHGGWPGGHGGWQGGHGGWQGGHGY

SEQ ID NO: 50223 - protein, 170 aa, Glycine max
  misc_feature (15)..(15): Xaa can be any naturally occurring amino acid
  misc_feature (21)..(21): Xaa can be any naturally occurring amino acid
YMLLCKIMLNTQKDXQALVSXKLALGYAGRQTEALKCVAQASKNRSLADFEKALTDYRAELRDDPIISTHLAKLYDNLLEQNLIRVIEPFSRVQIEHISSLIKLSKADVERKLSQMILDKKFHGILDQGEGVLIIFDEPPVDKTYEAALETIQNMSKVVDSLYSKAKKLT

SEQ ID NO: 50224 - protein, 175 aa, Triticum aestivum
  misc_feature (107)..(107): Xaa can be any naturally occurring amino acid
MAPPLMASSATSVAPFQGVKSTAGLPSSRRSKGVSLGSVSNGGRIRCMQVWPIEGIKKFETLSYLPPLSTEALLKQVDYLIRSKWVPCLEFSKVGFIFREHNASPGXYDGRYWTMWKLPMFGCTDPTQVINEVEEVKKEYPDAYVRIIGFDNMRQVQWVSFIAFKPPGCEESGKA

SEQ ID NO: 50225 - protein, 294 aa, Yarrowia lipolytica CLIB122
MNTSSQFQQLEKLGEGTYATVYKGRNRTTGQLVALKEINLDSEEGTPSTAIREISLMKELKHENIVTLYDVIHTENKLNLVFEYMDKDLKKFMDTNGNKGALETKQVKWFMYQLLRGILFCHDNRVLHRDLKPQNLLINAKGQLKLADFGLARAFGIPVNTFSNEVVTLWYRAPDVLLGSRTYSTSIDIWSAGCIMAEMFTGRPLFPGSSNDDQLQHIFKLMGTPNESTWPNISSLPNYRSNFQVYAPQDLRVIIPQIDNVALDLLLSLLQLKPENRITARQSLEHPWFAEYHQ

SEQ ID NO: 50226 - protein, 376 aa, Aquifex aeolicus VF5
MASSTKKDYYEILGVPRNASQEEIKKAYRRLVRKYHPDICKKPECEEKFKEINEAYQVLSDPEKRKLYDMYGHAAFEGAGAQQRVETTEIPPIEEILREFFDFDIGSIFERATGRRRARRRRSVKGEDIVVPVEITLEEAFKGTTVPIEVEREVPCSACGGTGYDESKSRTCPTCGGRGETVQGNWFFQVRQTCPTCGGEGVIYENCHACTGRGYGLVKETIKVKIPPGVRDGSKLVVEGKGHAGRYGGPPGDLYIIVKVKPHKIFERKGDDLYVDVNITYPEAVLGTEVEVPTLDGEKVKVKIPPGTKEGELIKVPGKGMPRLKGSGRGDLYVRVHIDVPKIGVLSKLLGDGKKVEELLKQLQEVLPKPERIVER

SEQ ID NO: 50227 - protein, 393 aa, Desulfitobacterium hafniense Y51
MGGKVLKARRLSSLGASVFTEMDDLRKELEKAGKQLINLSIGSPDRSPSAEIRKVLAEGVLDGGSYGYTLTRGTESFRSGCARWYKERFGVNLDPEKEVLPLMGSQDGLAHIFLALCDPGDVALIPDPGYPIYTAGLVLAGGEKVALPLREENGFLPDLSAIADEVAQQAKIMFLNYPNNPTAAVAPLSFFEEVVDFARKNRIVVCHDAAYSELAFDGYRPVSFLQVPGAKEVGIEFHSVSKTYNLAGVRLGFAVGNREIIGALAELKSNIDYGVFEPALQAGAYALSASQENVEQNRRAYQERRDIWVKGCAQAGWSMPSPRGSMFIWAPVPTAQDSRSFAFALAREAGVIVVPGVAFGEYGEGYVRIGMVQDQEVLQEAVRRVQEFLAAQG

SEQ ID NO: 50228 - protein, 1543 aa, Cryptococcus neoformans var. grubii
MSATGVPAELNNLGAPITATTQNPSGLANSQVTSGPVSSATQHDEHRSSAGNTLADEEDDKAVEAEKAEAIDAAGDGKQKRLPADSSEDIVAELEPHHVSVHRGKEEFAALERKYSNLSQRSQHELHRPTTRHSVRSSFSRKDRVVSRLTQDDAEKAKEGEGEFNLVEILRSGRENQDEAGIKRKAVGVVWEDHEVIGAGGMRINIRNFSSAIIEQFMMPAIKVLGIFGFNPFAPKPKAILHPSSGLLKPGEMCLVLGRPEAGCTTFLKTITNQRAGYMEINGNVEYAGVGWKEMRKRYAGEVVYNQEDDDHLPTLTVAQTIRFALATKTPKKKIPGVSAKQFQDDMLDLLLSMLNIKHTANTIVGNAFVRGVSGGERKRVSIAEMFCSGATVCSWDNSTRGLDASTALDYAKSLRLLTDIMGQTTFVSLYQAGEGIYDQFDKVLVLNEGHVAYFGPAKEARQYMIGLGYRDLPRQTTADYLSGCTDVNERRFADGRDATNVPATPEEMGQAYRESEICARMTREREEYKHLMAEDATARENFKQAVLEQKHKGVGKKSPYTVSFLQQVFIIFKRQLRLKFQDHFGISTGFATSIIIALIVGSVYFRLPETASGAFTRGGLLFLGLLFNALTSFSELPSQMLGRSVLYRQNEYRFYRPAAFALAAVLADVPYNASVIFLFSIVLYFMGGLYSSGGAFFMFFLFVFLTFMVMSAFFRTLGVATSDYNVAARLASVLISFMVTYTGYMIPVQRMKRWLFWIFYLNPLSYGYEAIFANEFSRISLTCDSSYTIPRNIPEAGITGYPDTLGPNQMCSIFGSTPGDPNVSGSDYMAVGYSYYKAHIWRNFGILLGFFTFFMFLQMLFIEVLEQGAKHFSINVYKKEDKDLKAKNERLAERREAFRAGELEQDLSELKMRPEPFTWEGLSYTVPVPGGHRQLLNDIYGYVKPGSLTALMGASGAGKTTLLDVLASRKNIGVVEGDILMNGRPIGTDFQRGCAYAEQQDTHEWTTTVREALQYSAYLRQPQHVPKQEKDDYVEDIIELLELQELADAMIGFPNYGLSVEARKRVTIGVELAAKPELLLFLDEPTSGLDGQSAYNIVRFLKKLCAAGQKILCTIHQPNALLFQSFDRLLLLQRGGECVYFGDIGPDSKVLIDYLERNGAEVPHDANPAEFMLEAIGAGSRKRIGSDWGEKWRNSPEFAEVKREIQELKAEALAKPIEEKSNRTEYATSFLFQLKTVLHRTNVALWRNADYQWTRLFAHLAIGLIVTLTFLQLDNSVQSLQYRVFAIFFATVLPALILAQIEPQYIMSRMTFNREASSKMYSSTVFALTQLLSEMPYSLGCAVSFFLLLYYGVGFPYASSRAGYFFLMILVTEVYAVTLGQAVAALSPTILIAALFNPFLLVLFSIFCGVTAPPPTLPYFWRKWMWPLDPFTRLISGLVSTVLQDQEVVCKDGEYQVFPAPSGQTCQQWAGAFAEAVGGYINNPDSTGDCQFCQYRSGQAFFVPLEISFSTRWRDFGIFICYVVFNILVLLIAARFLKWQRR

SEQ ID NO: 50229 - protein, 98 aa, Triticum aestivum
IGERVAALQQLVSPFGRTDTASVLQEPSGYIKFLHQQLEVLSSPYMRAPPVPGAAPEDPDHYSLRNRGLCLVPVDQTLQLTQSNGADLWAPANTTRRR

SEQ ID NO: 50230 - protein, 435 aa, Aspergillus oryzae
MILFSTSRESLLRPQWNPLRLQNNLPNGSTIATTKLQSSTPSPSPVIKEQSLPARAISVVVPSPSSQLKKEIESAKWASSSQSCTPELKGVLEKFYPTNAHVERGRKGAYPAARKVNRAAIPLPTGTPGPILQKRPEALDQQYRTLERKLSTIKGPKITFAPADGPKLAKVTANFQFINSYKLHKGVSPAPAEFIGGCSCGKHCDPERCPCSEKEDDSTENIIPYQRAKDRPDLLVLTPEFLRRTAMIFECGAQCACDKSCWNRVVQRGRTVELEIFYTGNRGFGLRSPRYIREGQFIDCYLGEVITKQHADIREETAVKNGHSYLFGLDFSPEVDEEDIYVVDGQRFGCATRFMNHSCKPNCRMFTVTNTIGDERLYNLAFFALKDIPPMTELTFDYNPGTERSEKVDSSVVACLCGEDNCRGQLWPSKRKGTK

SEQ ID NO: 50231 - protein, 155 aa, Triticum aestivum
  misc_feature (64)..(64): Xaa can be any naturally occurring amino acid
  misc_feature (68)..(68): Xaa can be any naturally occurring amino acid
  misc_feature (140)..(141): Xaa can be any naturally occurring amino acid
LITAVDHTTMAARPMLVVALLCTAATAATVQQAINVRATYHYYRPAQNNWDLGARAVSAYCATXDASXPLSWQSNYGWTAFCGPACALGQSSCSKCLQVTNPATGAQITARIVDHCANGGLDLDWDTVFSSIDTNGMGYXXGHLNVNYLFFDCRD

SEQ ID NO: 50232 - protein, 268 aa, Arabidopsis thaliana
MEDQYEKKITWTIKNFSFVQSQAIDSDIFVVGDSKWHLVAYPKGNGESTNKCLSLYLNVADFQSLPNGWKRHIKYRLTVVNQMSEKLSEQEVIQGWFYKNFHISGFQTMLPLSKLLDKNGGFLVNGDVKIVVEVGVLEVVGKSDVLEETLLVHESIDINGFQVLPSQVESVNNLFEKHPDIVSEFRSKNPLMRTTYLNDLLCLTEILCESSEELSTGDMANAYSTLTCLKKAGFKLDWLEKKLKEVCEARVQEIDEEWKDLTDLKEKF

SEQ ID NO: 50233 - protein, 1153 aa, Aspergillus oryzae
MSGKRARAAFEADLQTQESPYAFYGTPLPPLDAGVRDDGSYVPIWKQEVTDDRGRKRLHGAFTGGFSAGALKVVASFRYFNTVGSKEGWTPSTFVSSRQSRAKDARQQRVEDFMDEEDIREAEESRNLHITDEFSGFGSTDVDANRRGGLMDLFRSGGETMGVKLLKRMGWKEGQGVGPKVRRRAHLGDDAAYSSGSTDKTYLFAPENSRMVSFTHKTDHKGLGFEGESRLGSQKAGGDGSDEDADPFFAQRLTGQGISKRSAQKGPRRGAFGVGVLNDTGSDDEDPYSLGPQISYNRVIGKDKKKKKKLLEDVKPKVASNPLLTNKPVFISKKAIAGRNSTGFRKCHDGRLPLDGFVLADGVSSLTISAQEKKYAPPEVPKDWKCSKTPSKERDASKYVSTAEAAKASSLDPTSRAALLGEAQLPGKSIFDWMTPEARERIVKITGKTDLPPALGEKAPEGYEMSEAQKRKDLWDLVPKLDKQVAVQALTRAASGWMPYSEDPDKRSRYRTFLQVRAGLRESLPDRVSGSSTDEWVAELHEFARAAEVFKPMSGAMASRFTSASSGPKGSSDEAESSADSLLQNPAKKPEDPAVAAAKIGMFGPMTRSNISFYPTRLLCKRLNVKPPDHVQSNPSDPAKPSDTAPGGRFQSAGYQTTGPKELVPQEVMDQLLLEAGTSSGAVEKPKPIVVEPERNEALEAERPGEEIFKAIFGSDDEDDEKGWMTNTSTADPRDKHNSPNQRSIELIERYRVKKERERESGKNSSHVVVSFLFFTANHPLGNPSVRFFKIENLFFATSLNLSFQLLISPIPNTSCDGSRPWAIKFPKSLSHTISAQGISGILELFTLLFLAEWSPVFNIYKMGCCLSTSRDNRSAYATQTATEERRPEASSRGVSSTTAAAIPSNSARVVIRSSPDHLPLNENFNAPIRRHVWYSKRRLWNRAQLDQERKEFFETRVTGKPEIWAALSAAISLMHTGDLTTAQSIIDAAGVTVPTGDLCQGAYDEQGVLYRLPQCIVSDPENLVKSNLGEDDFDTDDGKLSLDEESGDELIADDAERRRDEKGKVSERDLIRVKARLSDRGGPDMVVTVGKTQNVAYIARKLQQEAEIPKTQRVKIAYLGKILKEHVPLVDQGWKQGNVINALVVARPSPSC

SEQ ID NO: 50234 - protein, 252 aa, Brassica napus
SSIIDRKLAGGLHFHLGLKCEIRTKGADAESYSELEVGADDRKVLDQIIDSLTRLANPDDEEDYIISPRKETNKISLKIGKVQQENEEKPEEMTKRSAVLILGAGRVCRPAAEFLASVRNISSQQWYKTYLGGEQRDVHVIVASLYLKDAKETVEGMSEVEAVQLDVSDNESLLKYVSEVDVVLSLLPASCHAAVAKTCIELNKHLITASYVDDETSMLHEKAKSAGITILGEMGLDPGIDHMMAMKMINDA

SEQ ID NO: 50235 - protein, 1516 aa, Aspergillus oryzae
MTEEKRTGSSRSSSIHEDVTDMRQQYKRRGSKFDDASVFESINPENRAELTRIASNFPLQRRATGSQESEARLQRKDTLEDIGLDHPSLDPTSGQFDQYKWTRMRLKLMDKEGIPRPPSTGVVFQNLNVSGSGSALQYQSTVGSILLEPFRPSGWLSFAKKSPEKHILRNFDGLLKSGEMLIVLGRPGSGCSTFLKTLCGQLHGLKLRKSSEIQYNGVSMEKMHKEFKGEVLYNQEVDKHFPHLTVGQTLEFAAAARTPENRLLGLKRQQFAKHITKVAMAVFGLLHTYNTKVGDDYIRGVSGGERKRVRLVCPIYRDFSGAPMGAWDNSTRGLDSASALEFVKALRLSSNLVGTSHAVAIYQASQAIYDVFDKAIVLYEGREIYFGPCDEARDYFTGMGWHCPPRQTTGDFLTAVTNPQERQARDGMENKVPRTPDDFEKYWKKSPQYAALQQEIDEYHMEYPVGGEAEQSFGEMKRVKQAKHVRPESPYIISIPMQVKLCTIRAYQRLWNDKPSTLTTVLGRIFMALIIGSMYFGTPTASAGFYSKGAALFFAVLMNALISITEINSLYDQRPIVEKQASYAFVHPFTEAFGGIVSDIPVKFVSAVIFNIIFYFLAGLRYEPSQFFIFFLFTFLSTLAMSGIFRTLAAATKTLAQAMAMAGVLVLAIVIYTGFVIPVPQMHDIPWFSWIRWINPIFYTFESMIANEFHGRQFICSQFVPAYPSLSGDSFICSVRGAVAGERTVSGDAFIESQYTYTYTHEWRNLGILIGFWIFFSVIYLLATEINSQTSSKAEFLVFRRGHVPAHMRDLDKTQGDSGSTEVAQSHKEKETENAASVIPKQRSIFTWRNVCYDIPVKGGQRRLLDHVSGWVKPGTLTALMGVSGAGKTTLLDVLAKRVSIGVVTGDMLVDGKTLDNSFQRKTGYVQQQDLHLATTTVREALRFSALLRQPKSVSRKEKYDYVEEVIEMLNMQDFAGAIVGTPGEGLNVEQRKLLTIGVELAAKPELLIFLDEPTSGLDSQSSWSIVAFLRKLADHGQAVLSTIHQPSALLFQQFDRLLFLAKGGKTVYFGEIGDQSRTLLDYFEGNGARACGPEENPAEYMLEIIGAGASGKASKDWSAVWNESPESSNVQKEIDRIYQERASASNGSDDTHHGKPAEYAMPFMYQLWYVTHRVFQQYWREPAYVWAKILLATLSSLFIGFTFFKPNSSQQGFQDILFSAFMLTSIFSTLVQQIMPKFVVQRSLYEVRERPSKAYSWAAFLIANVIVEIPYQILAGVISWACYYYPIYGANQASQRQGLMLLFIVQFYIFTSTFATFIISALPDAETGGTIATLLFIMATTFNGVMQPPNALPGFWIFMYRVSPLTYLIAGMTATGLHGRAIRCDTAELSVFNPPSGSTCGDYLAPYLQSAPGVLYNPSATQGCEYCQLRNADQYLASSNIYYSERWRNYGLGWAYIGFNVMGTVALYYLFRVKHYNPTSLVRGVANGAKLVCRVFKRRSGTTPRGREAENGRLV

SEQ ID NO: 50236 - protein, 495 aa, Aspergillus oryzae
MTSPSNGPSSNHADQPDSQRLLQHDSTLTVAQSVSLSIGGDSLLVVGTCSIWLTVPITAKTTHSIGLYNILDADLSPAGLTITYAQAATKGSISVAALEYPISEKEKANAQTWVSRLLDLAYGEAQRYKRLKVLINPFGGKGAASKIYHKHAAPVFAAARCVVDVQQTTHRGHATEIVEQIDIDAYDAIVCCSGDGLPYEVFNGLGKKPNAGEALAKVAVAMVPCGSGNAMAWNLCGTGNVSVAALAIVKGLRTPMDLVSLTQGNTRTLSFLSQSFGVIAESDLGTDNIRWMGAHRFTYGFLVRIMQRTVYPCDLAIKVEIDDKRAIKDHYNTYAHNPAPRRSPEETAGQSKGLPELRYGTVQDDLPKDWEVVPGEEMGNFYAGKMAIVSKDTNFFPASVPNDGLMDIVTINGTLPRTTTLKMMTAIPENEFFDMPDVKIRKAAAYRLVPRQKEGYISVDGESIPFEALQAEVHKGLGTVLSKSGHLYEAEGPRP

SEQ ID NO: 50237 - protein, 414 aa, Arabidopsis thaliana
MATGPVVHPQPVRGDPIDLKNAAAKNRRALGDIGNVDSLIGVEGGKLNRPITRNFRAQLLENAQVAAAANKKAPILDGVTKKQEVVRAVQKKARGDKREPSKPIEVIVISPDTNEVAKAKENKKKVTYSSVLDARSKAASKTLDIDYVDKENDLAAVEYVEDMYIFYKEVVNESKPQMYMHTQPEIDEKMRSILIDWLVEVHVKFDLSPETLYLTVNIIDRFLSLKTVPRRELQLVGVSALLIASKYEEIWPPQVHDLGYVTDNSYNSRQILVMEKTIWGNLEWYLTVPTQYVFLVRFIKASGSDQKLENLVHFLAELGLMHHDSLMFCPSMLAASAVYTARCCLNKTPTWTDTLKFHTGYSESQLMDCSKLLAFIHSKAGESKLRGVLKKYSKLGRGAVALISPAKSLMSSAP

SEQ ID NO: 50238 - protein, 646 aa, Xanthomonas axonopodis pv. glycines
MFNINRLLRSRPRTDTADQAPAEDRPSHQPSAAEGLLSPLLARPRRRESASAPRNAGQRSPFRSPLRASGQPAALAGASSAPPRSIEHDIDDWLAQSLPMAERVRTGYNLHDGQRDTSREVLQSVADAIRRAATRHSTELVLDYGLPATTLPDVIGRLDALQKLTLLHTGLQSLPDSLGQLHQLRHLQIAGALGLKTLPPSLTRLSNLRTLQLTMIPLDELPVGIGRMQGLRSLTLGGGHYARLPASIVELSGLTELRMPYSSHFRELPENIGLMQGLRSLEVASNSELEQLPGSLTQLHRLEKLTLSSNRRLAHLPEDIGQLRGLTELSLKNCAALRQLPDSVGDLAQLQLLDLRGTGLQTLPQSLARLPAQCDIKVPDHLAGQLLQIRDPERAAREPQRAAQRLAERRRRAPVPAAQQAGASWNRMPEFARVLRTVDADLGERFDKWTQGLAQTARISGASITPADMPLLDQVVTEAIRSPEFRSSFGQFLSDHTLKTLNMDGMTQVGGFGPAVRGDVKTAFAEMLKHKLMHTQDHQTALGLLQDALQNPDLGLSREMLLRSRNELTGRVEMWPPLKAYISMHDVEGQAAQDAAITWTMAQFEEAQQGGIGDAEAKQESERAQANANRFIEQRARVLLREWDIR

SEQ ID NO: 50239 - protein, 831 aa, Aquifex aeolicus VF5
MKGVILAGGFGTRIQPLTNSIPKPMLPVANRPIMEHVVHRLKEAGIEEIVVLLYYQAEVIKNYFKDGSDFGVKITYVQPEADYGTAGAVKQAQNYLNETFIIVSGDVITDFNLSELIAFHKSKSSKFTLALYSVENPLQFGVVITNKEGKVLKFLEKPGWGEVFSDTVNTGIYVVEPEILNYIPEDKPFDFAMDLFPKLMKSGIDLWALKMRGYWRDIGNIDSYRDVHKDIFAGLVKIRIPGRIITTKEARIYVEEGTEIPENVSLKGTVILGKNVKVGEGSELKNCVIGNNTVIGRNVKLFDSVLWWNVSIDEESEIRNGVICNDVKIGKRVKAKEGVVIAEDCEVEDEVLFLKDVVVWPEKVIEKGSVVTKNIVCESKWEKGIFKGNKVIGRINVELTPDNATKLGMALGSVLPPKSTVILARDYHRASRTIKRSFLGGILSTGINVIDLHLSPLPVMRFTLTEDKKAVCGVYFSISQEFPGSVEICVFDENGLPIDTNFQKKIERVFFREAYRFETFTDLGLIKEKPYFSENYVTKLLSSIDGDSIKLSSNKVVYDALHSPISPFISEVLGKLEIENVILNALYDERKLSRISTYASSSEGNVSKVLKALSYDVGFVMEPSATKLKLVDDRGRTISGDRLLLVVLMLLDKSAEKQLRVYLPVWAPEVLDAILNNVIVERGKFTNLRKSFIEDFYMLADTDGSFTFTEFSYSPDALYASLKIMEMLTKLKVKVSEIYDSLPEYYFLHEVVSCSSEKKGTVLRKISEMAEGKEASFIEGVKIYEDYGNWVLVLPDSYKDLIHVYVQSTERERAEELIKNYMEIVRGICKK

SEQ ID NO: 50240 - protein, 572 aa, Cryptococcus neoformans var. neoformans B-3501A
MSIPYETEKDKSISGGSQGAMTPINGKSGNEVLVTPALGEKGGFEGSGGNPGEGTVHRTLKQRHMAMIALGGAIGTGLFVGSGSALATGGPVGFWLGYVFMGLMVYSMMVALGEMASLYPVAGAFTHYAARFVDPALGFATGINYWYSYAITIPTEIVAATIVISYWDATTNAAVYITVCFVSIIAINFLGARAYGEAEFWFSSIKIVTIVGLIILGIVLMCGGGPNHDAIGFRYWRNPGPFAQVTIENGAGVIPGRWGQFLAFWNVFVQAAFSFIGTEIIATTLGEAENPRKTVPRAIKQVFFRILFFYVMGTFVISVLVPYTEPDLLNGSGTAAASPFVIAINNAGIKALPSIVNAVLLIAAWSAGNSDLYAASRTLYALALERQLPRVFRRCTKRGLPIWCVTVTALFGAFAYLNTGGEAAEEAFNWLYNLSAITGILTWWAILLSYLRFYYGLKKQGISRDDFPYRAPLQPYLSWLGFIFFTLVTIFSGFTVFLKGNWDTSSFFATYITIPIFVGCWIGWKVVKKTKIVPLEHMDFTTGRRELDELEALDAERFKAETKYQKIISILF

SEQ ID NO: 50241 - protein, 493 aa, Pseudomonas putida KT2440
MTLVRFQMCIDGQWRDAQSGKTFDSLNPATAQAWAQLPDADEADVELAVQAAQRAFDSKAWRSITATARGKLLRRLGDLIAENKEHLAQLESRDNGKLIRETRGQVGYLPEFFHYTAGLADKLEGGTLPLDKPDLFAYTVHEPIGVVAGIIPWNSPLYLTAIKLAPALAAGNTIVLKPSEHASATILELARLALEAGFPAGVVNVVTGYGPSTGAALTRHPLVRKIAFTGGAATARHVVRSSAENFAKLSLELGGKSPNIIFADADLDSAINGAVAGIYAASGQSCVAGSRLLVQDEIFDEFVERLIARAKRIRIGNPQDDASEMGPMATAQQLAVVEGLVAAAKAEGAKLHMGGKRADVEGDGWFYEPTLFECDSNAMTIMQEEVFGPVAAVIRFKTEEEALAMANDSQFGLAAGIWTRDLGRAHRLARDVRSGIIWVNTYRAVSAMAPIGGFKNSGYGRESGIDSVLAYTELKTVWINLSTAPMPDPFVMR

SEQ ID NO: 50242 - protein, 435 aa, Streptococcus agalactiae 2603V/R
MSIITDVYAREVLDSRGNPTLEVEVYTESGAFGRGMVPSGASTGEHEAVELRDGDKSRYGGLGTQKAVDNVNNVIAEAIIGYDVRDQQAIDRAMIALDGTPNKGKLGANAILGVSIAVARAAADYLEVPLYSYLGGFNTKVLPTPMMNIINGGSHSDAPIAFQEFMIMPVGAPTFKEALRWGAEVFHALKKILKERGLETAVGDEGGFAPKFEGTEDGVETILKAIEAAGYEAGENGIMIGFDCASSEFYDAERKVYDYSKFEGEGGAVRTAAEQIDYLEELVNKYPIITIEDGMDENDWDGWKALTERLGGRVQLVGDDFFVTNTDYLARGIKEEAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 50243 - protein, 352 aa, Neurospora crassa
MSSSKAKDKASSADVSKKGKKDKKEKKASKTAKEVTAASEPAEVIAETESASKKEKKSRKSKNDSSRQDGKRKREEDNDDMAKNNDEKAAGDEVKPSKKRKSEDKSKSNDKDEKKKEEKKTKDKKDKKRKHGDHHSDEEEEQKDEPVVKVAKIVTGEGAEPNKAEKEKKSKKDAKKSKGEKESSDSSEKKHKEEKKEKKEKKDKKSKTDKEEEEPVVEKEEKAESKKESKKSKKEKKEKKEKKERKKGDETKTTEAKGSTATLAATTTTIPNPAAVLAANWNVNALDGGASRQSKMMRLLGGKKLAADGAAAAAAAKKTFDVNQVSQELEQQFKAGIHQKFETGGQRRGLGA

SEQ ID NO: 50244 - protein, 488 aa, Aspergillus oryzae
MTIEQRANLGRVNVELNKIKKISFKLSMTIMDSVAIIRNQLKERGVENHDLIQACYAFATEFGKRSSNVDPNRRAMNTARLVELSLDWVSFICDDCDAADRKTFKWAVSALEFAMAITSNRRVDEDAKRQALGRVLEGSNEADRSLAVLSSSATNVTLRWQQGQFIGGGTFGSVYAAINLDSNYLMAVKEIRLQDPQLIPKIAQQIRDEMGVLEVLDHPNIVSYHGIEVHRDKVYIFMEYCSGGSLASLLEHGRVEDETVIMVYALQLLEGLAYLHQAGIVHRDIKPENILLDHNGIIKYVDFGAAKIIARQGRTVVPMDAFASAGHKEAIVPKDAQIANQRGKNQKTMTGTPMYMSPEVIRGDSNKLIHRQGAVDIWSLGCVILEMATGRRPWSALDNEWAIMYNIAQGNQPQLPTHDQLSDMGIDFLRRCFECDPLKRPTAAELLQHEWIVSIRQQVVLEPPTPSSDHSGSISSSTSGSRQNSTYL

SEQ ID NO: 50245 - protein, 521 aa, Solanum tuberosum
MAASIGALKSSPSSNNCINERRNDSTRAVSSRNLSFSSSHLTGDKLMPISSLRSQGVRFNVRRSSLIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGLVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPLVASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVEIINKDNVQEAARETDGYFIKSGIVTVIKDALIPSGIII

SEQ ID NO: 50246 - protein, 508 aa, Euphorbia characias
MGFARKEYEFLSEIGLSERNLGCYVNGTWKANGPVVTTSNPANNQAIAEVVEGSIEDYEEGMKACSEAAKIWMQVPAPKRGDIVRQIGDALRGKLEHLGRLVSLEMGKILAEGIGEVQEIIDMCDFCVGLSRQLNGSIIPSERPNHAMLEMWNPLGIVGVITAFNFPCAVLGWNACIALVCGNCAVWKGAPTTPLMTIATTKLVAEVLERNNLPLAIFTSFCGGADIGQAIAKDTRIPLVSFTGSSKVGLMVQQTVNQRYGKSLLELSGNNAIIVMDDADIPLAARSILFAAVGTAGQRCTTCRRLILHEKIYDTVLDQLLKSYKQVKIGDPLEKGTLLGPVHTAESRKNFEKGIELIKSQGGKILTGGSVIESEGNYVQPTIVEISSKAEVVKEELFAPVLYVMKFQTLEEAIEINNSVPQGLSSSIFTRRPDVIFKWLGPHGSDCGIVNVNIPTNGAEIGGAFGGEKATGGGREAGSDSWKQYMRASTCTINYGSELPLAQGINFG

SEQ ID NO: 50247 - protein, 457 aa, Yersinia pestis CO92
MEQQLQNSSLKRGLKNRHIQLIALGGAIGTGLFLGIAQTINMAGPSVILGYAIGGFIAFLIMRQLGEMVVEEPVAGSFSHFAYKYWGDFAGFLSGWNYWAMFILVGMAELTAVGIYIQYWWPEIPTWVSAAVFFIIINAINLVNVRLYGETEFWFAIIKVAAIIGMIVFGAYLLASGSGGPAASVTNLWAQGGFMPHGFRGLIMAMAVIMFSFGGLEMVGITAAEAEDPRNSIPKATNQVVYRILIFYIGSLTVLLSLFPWNNVVEGGSPFVMIFDALDSPWVATALNVVVLTAALSVYNSGVYCNSRMLFGLASQGNAPKLLTKLNKRGVPIRSIALSALATSAGVVINYIMPGKAFELLMALVVSTLVINWVMICLAHLKFRKAKVKEGVVPRFKALWYPYGNYLCLVFLALILVIMYLTEGIRISVLMMPVWIALLWCGFVLTRRKCPKTVTSL

SEQ ID NO: 50248 - protein, 134 aa, Triticum aestivum
  misc_feature (15)..(15): Xaa can be any naturally occurring amino acid
  misc_feature (35)..(35): Xaa can be any naturally occurring amino acid
  misc_feature (51)..(51): Xaa can be any naturally occurring amino acid
  misc_feature (59)..(59): Xaa can be any naturally occurring amino acid
  misc_feature (79)..(79): Xaa can be any naturally occurring amino acid
  misc_feature (89)..(89): Xaa can be any naturally occurring amino acid
FVPRVLFKVKDVMKXHNELPLFKEGNMIMDHLTEXTSLGCGCLLEVVDEYXLIGTFTDXDLRRTLKAWGPSIFSLTVVXMFNRNPRTIXADSLAVVFMDIMELPSSPVHFIPVFDDKNIKSLIISLHELFSAGL

SEQ ID NO: 50249 - protein, 478 aa, Magnaporthe grisea 70-15
MALPPKVYQWLIGVFASLGSATYGYDLGIIAQVISAPSFVKRVGDNPAEIGGIVSIFTGGAFFGALAAAPTADRLGRKLCIMMGATIFIAGGLLQALAQSTAYMMAGRGIGGVGIGAMIMIIPVYQAELTHPSIRGTVTALQQFMLGVGALFAGWFSYGMTVGVSDDDENQWRISLGLQVVPAGVLALLIMLFPESPRWLIDHGRADEGLQTLARLHAHGDVDDAWVRAEYSQIRESIDAEHEAEAKSYAELFRDRSCLRRLWLAASIQASVQMTGVSSIQYYSVAIFAKMGISGSDTLKYQGISGVWALVAQALCMAFVDRLGRRWPLILGNAFNCISFIVTTALLASFPPGESGGNMSASWAFIVMTWLYNFSFSATCGPLSWIIPAEIFDMKTRAKGVSIATAVCNATNAIYFWAVLPETARRPLEEMRYLFTEAPFFIPTMDPSRAYSNDLADRLEQAERKQDAAVEGRDETHV

SEQ ID NO: 50250 - protein, 199 aa, Capsicum chinense
VLLENYSLGKSLTQRQIVQLASKGEQRNAINIVLTASDVAVDGFCVNRCGTHGSSKGAIIKGKTYKFAYIWVGNSETLCPGYCAWPFPQPIYGPQSPPLGAPNNDVGVDGMVINLASLLAGTATNPFGNGYYQGEADAPLEAAFACPGVYAKGAYPGYAGDLLVDKTTGASYNAHGTNGRKYLVPALFDPFTSSCSTLV

SEQ ID NO: 50251 - protein, 146 aa, Zea mays
MSVELILWLFSFVSVMVLIGLTAYQLICLSDLEYDYINPYDSSSRINAVVLIEYSLQGALCASFLLTLHWFPFLVMTPFFLFRYLARKHLVDVTEIFRQLSDEKKYRMIKLAFYFCLFIITIYRLVMTAVMLFIDEDINLAETRSI

SEQ ID NO: 50252 - protein, 390 aa, Aquifex aeolicus VF5
MTKVVNYGEVQYGFAKRYFEEFLSERKGRIEKLLKPEKTPVLLMDIQGVKKKYLEVKYHFPEFNVYYAVKANDDESVIRALVEVGAGFEVASSQELEKVLRLGGKIEKVISSNPVKPPEFIEFAYQKGVRTFAVDSITEVKKIKDIAPRSKVYVRIAVPNEGSDWPLSRKFGVSVEEAVEILEYANDLGLVPYGITFHVGSQCNNLRNWFIAVKLSAQLWEKARAKGLKLQMLNMGGGIPVRYNYEALSVEDIAYYVKGLMRKYFPVQPYELQIEPGRGIVGDQGIMVTKVIGKAKRGSENWLYIDTGVFNGLAEALGGIRYPFFLEREGELKEWTIGGVSCDSMDVVAKNVYLPEPEVGDYLYILSAGAYTTVYASNFNGFPKPEVVPF

SEQ ID NO: 50253 - protein, 401 aa, Cryptococcus neoformans var. neoformans B-3501A
MSTSTRRHVPDDKLANHKADPNAAANAGQVQERTTKGSSSSAPRKVRFNVGNNYHVVDVIGEGAYGVVASAVHRPSGTKVAIKKIAPFDHSMFALRTLRELKLLKYFAEEGVSENIISVLDIIKPPSYDTFKEVYLVQELLETDLHRVIRTQDLSDDHCQYFLYQTCRALKALHSAEIIHRDLKPSNLLLNANCDLKVCDFGLARSTQTAFPAEGNNQGFMTEYVATRWYRAPEVMLSFRMYTKSIDVWSVGCILAEMLSGKPLFPGKDYHNQLALILDVLGTPTIDEFHAITSKRSKDYIRSLPFRKKRTFESIYPSANPLAIDFLRKTLTFDPRKRYTVEQCLAHPYLDAYHDPEDEPSAKPLPPSFFEFDMMKDDISREELKRLLYEEIMGFRPVLEG

SEQ ID NO: 50254 - protein, 502 aa, Clostridium acetobutylicum ATCC 824
MKVGTSKIMNKIDQFCTTSLGIPGNILMENAALKVVKNIGEEFKDIVLVCGVGNNGGDGMACARHLNAIGRNLKIFCVGNIEKMSSDCKFNYDILSNIGIQVINLANEDDLEEFKTAVQSADLILDCIFGTGLSREVKGIYRDVISIINDEGNYIMAVDTPSGLSSDTGIEMGIAIKAHKTISFVMYKRGFFRYRSEDYTGEIVIENIGVPKFVIDKFHENEYIVDEEMASNSIIKRDKYAHKGNFGRVAIFAGAKGYSGAAYISTEAAVRSGSGLITLCTKEELQNLLSSKLVEAMTASFNDKEKIEKIITSSDAIAVGPGMGNTEETFYKVKEILSTACCPIVIDADGINVLKGRLDTLKNSKNKVILTPHPGEMSRISGVSIEKLEKNRIDIAKNFAAKYDVIIVLKGYKTVITDGKEVFVNTTGSSYMASGGMGDCLTGIIVSLVGQGYSPIMAAAIGTFIHGYCGDVLANKMANITASDILKEIPYSIKKISYNKMR

SEQ ID NO: 50255 - protein, 461 aa, Arabidopsis thaliana
MTRVNQLPCDCVSTAEESLTSGTCITPTHVTSLSSPLDRSGDVDPLPVSDESGGSKADESMTDADETKKRKRILSGDCEADENNKSDGEIASLNDGVDAFTAICEDLNCSLCNQLPDRPVTILCGHNFCLKCFDKWIDQGNQICATCRSTIPDKMAANPRVNSSLVSVIRYVKVAKTAGVGTANFFPFTSNQDGPENAFRTKRAKIGEENAARIYVTVPFDHFGPIPAEHDPVRNQGVLVGESWENRVECRQWGVHLPHVSCIAGQEDYGAQSVVISGGYKDDEDHGEWFLYTGRSRGRHFANEDQEFEDLNEALRVSCEMGYPVRVVRSYKDRYSAYAPKEGVRYDGVYRIEKCWRKARFPVCRYLFVRCDNEPAPWNSDESGDRPRPLPNIPELETASDLFERKESPSWDFDEAEGRWRWMKPPPANHEQRERMKMAMTCLLLFVLIILVGSSSILYQY

SEQ ID NO: 50256 - protein, 668 aa, Arabidopsis thaliana
  misc_feature (35)..(35): Xaa can be any naturally occurring amino acid
QNLSSSSSMSNSILFLSLFLFLPFVVDSLYFNFTXFRQGDPGDIFYHGDATPDEDGTVNFNNAEQTSQVGWITYSKKVPIWSHKTGKASDFSTSFSFKIDARNLSADGHGICFFLAPMGAQLPAYSVGGFLNLFTRKNNYSSSFPLVHVEFDTFNNPGWDPNDVGSHVGINNNSLVSSNYTSWNASSHSQDICHAKISYDSVTKNLSVTWAYELTATSDPKESSSLSYIIDLAKVLPSDVMFGFIAAAGTNTEEHRLLSWELSSSLDSDKADSRIGLVIGISASGFVFLTFMVITTVVVWSRKQRKKKERDIENMISINKDLEREAGPRKFSYKDLVSATNRFSSHRKLGEGGFGAVYEGNLKEINTMVAVKKLSGDSRQGKNEFLNEVKIISKLRHRNLVQLIGWCNEKNEFLLIYELVPNGSLNSHLFGKRPNLLSWDIRYKIGLGLASALLYLHEEWDQCVLHRDIKASNIMLDSEFNVKLGDFGLARLMNHELGSHTTGLAGTFGYMAPEYVMKGSASKESDIYSFGIVLLEIVTGRKSLERTQEDNSDTESDDEKSLVEKVWELYGKQELITSCVDDKLGEDFDKKEAECLLVLGLWCAHPDKNSRPSIKQGIQVMNFESPLPDLPLKRPVAMYYISTTTSSSSPSVNSNGVSVTFSGIEYGR

SEQ ID NO: 50257 - protein, 286 aa, Arabidopsis thaliana
MENKTQEEASTIKVSSLTCIDLANPNFQQSAVSLKQACLDCGFFYVTNHGISEELKDEAFEQSKKFFALPLEEKMKVLRNEKHRGYSPVLDQILDPENQVDGDYKESFFIGIEVVLPGWRATMEKYHQEALRVCKAIARLLALALDLDTNYFDKPEMLGNPIAVMRLLRYEGMSDPLKGIFGCGAHSDYGMLTLLATDSVTGLQICKDKDVKPRKWEYVPSIKGAYIVNLGDLLERWSNGIFKSTLHRVLGNGQDRYSIPFFIEPSHDCLVECLPTCQSENNLPKS

SEQ ID NO: 50258 - protein, 514 aa, Arabidopsis thaliana
MEISVACVTVSVVVVVVSWWVWRTLQWVWFKPKMLESYLRRQGLAGTPYTPLIGDLKRNVNMLTEATSKPIKLTEDITPRVLPHPFQMLKTHGRTFFTWLGPKPTITIMDPELIKEVFNKVYDYPKAQTFLLGRLIATGIINYDGDKWAKHRRIINPAFHIEKIKNMVPAFHQSCSDVVGEWSKLVSDKGSSSCEVDVWPWLVSMTGDVISRTAFGSSYKEGQRIFELQAELVHLILQAFWKVYIPGYRYLPTKSNRRMKAAAREIQVILKGIVNKRLRAREAGKAAPNDDLLGILLESNLGQAKGNGMSTEDVMEECKLFYFAGQETTSVLLVWAMVLLSHHQDWQARAREEVKQVFGDKEPDTECLSQLKVMTMILYEVLRLYPPVTHLTRAIDKEMKLGDLTLPAGVHISLPIMLVQRDPMLWGTDAAEFKPERFKDGLSKATKSQVSFFPFAWGPRICIGQNFAMLEAKMAMALILQTFTFELSPSYVHAPQTVVTIHPQFGAHLILRKL

SEQ ID NO: 50259 - protein, 374 aa, Natronomonas pharaonis
MGLLARLKAIGPGALVAAAFVGPGTVTTASVIGAEYAYLLVWTIAFSILATMVLQEMSARLGLITRDGLGEALRNEFSNPLAKWATVGLVVSAIGIGTAAFQTGNIVGGAAGLATITGVSENVWGPAIGLVAAALLWSGNYKLIERVFIALVAVMGVAFVLNTIIVRPDLGALGGGLVPTIPEGSAYLIVGLVGTTVVGYNLFLHASTAQERWDDKSDLTECRTDTIAMVAAGGIITTAIVVTAAAVFPAGTEIDDVGEMANQLEPVFGGYALTFFAVGLFAAGFTSAMSAPLAGAYATAGALGWERDLTSMRVRAIWMTILGVGIVGSAMDLNPVSVIVFAQVANGLLLPILAVFLIYAMNNDDLLGEYTNSR

SEQ ID NO: 50260 - protein, 364 aa, Nostoc punctiforme PCC 73102
MSATPLVSQVDSHNPEKSKLIPPLLGASVAELSAWVQQQGQPAYRGKQLHEWIYDKGVRSLADISVFSKQWRAEVAEIPIGRSTLHYRSVAPDGTVKYLLRLTDGQIIETVGIPTFAERGEGPKARLTVCVSTQVGCPMACDFCATGKGGYKRNLARHEIIDQVLTVQEDFQQRVSNVVFMGLGEPLLNTENVLAALKSLNQDIGIGQRSLTVSTVGIRDRIRQFAQNNLQITLAVSLHAPNQALREKLIPSARAYPLEELLAECREYVEITGRRVTFEYVLLAGVNDLPEHALELSKCMRGFQSHVNLIPYNPIQEVDYKRPNRDRIEAFVNVLKQQNTAVSVRYSRGLEADAACGQLRASKN

SEQ ID NO: 50261 - protein, 457 aa, Triticum aestivum
  misc_feature (69)..(69): Xaa can be any naturally occurring amino acid
  misc_feature (357)..(357): Xaa can be any naturally occurring amino acid
MAVLSSARRLLPWGRAPAGGVSGGLRALLGTDGGGGRSLLPSRWKSSQPQLDPVDRCVSGMQAHRSFPXLVSIRLQFDRSPMAFNILRRSSHSNLTLELSPPGHPCAVWLGCRSDEEGGGDIDWDNLGFGLTPTDYMYVMRCSQEEGGFSRGELARYGNIELSPSSGVLNYGQGLFEGLKAYRRADGPGYMLFRPEENARRMQHGAGRMCMPAPSVEQFVHAVKQTVLANRRWVPPQGKGALYLRPLLIGSGAILGLAPAPEYTFMIYAAPVGTYFKEGMAAINLLVEEEIHRAMPGGTGGVKSISNYAPVLKAQMDARSKGFADVLYLDSVHKRYVEEASSCNLFVVKGGAVATPXATAGTILPGVTRRSIIELARDSGYQVEERLVSIDDLISADEVFCTGTAVGITPVSTITYQGTRYEFRAGEDTLSKKLYTTLTSIQMGLAEDKKGWTVTVD

SEQ ID NO: 50262 - protein, 478 aa, Prochlorococcus marinus subsp. pastoris str. CCMP1986
MAERFSQKNLRVRPSSDEDKIVTNAKKHFEKTLVEISGELVGSVAALEHPTKNLKLNYGEIFLRDNVPVMIYLITQKRYDIVKKFLKVCLELQSTNYQTRGVFPTSFVEEEGKLIGDYGQRSIGRITSADASLWWPILCWFYVNKSGDHSFGKSQSVQRGIQLLLDLVLHPTFEGTPVLFVPDCAFMIDRPMDVWGAPLEVEVLLHGCLKSCINLMELSREDHVSRLLDQRLILTSQWVEDLRSFLLKHYWVTSQTMQILRRRPTEQYGDDQHFNEFNVQPQVVPSWLQDWLENRGGYLIGNIRTGRPDFRFYSLGNSLACMFGVLPSEEQRALFRLVLHNRQHLMAQMPMRICHPHMDVEEWQNKTGSDPKNWPWSYHNGGHWPSLLWYFGASVLLHQKKFPTEDVILMEEMRSLIEESYWCQLNQLPKQEWAEYFDGPTGTWVGQQSRTYQTWTIVGFLLMHHFLREENDLDMFNL

SEQ ID NO: 50263 - protein, 710 aa, Methylococcus capsulatus str. Bath
MACSVLSCAREGLCCLMRNPRTKAITLAGLAEFLALGLLVDWGTAFAFTAALSALLYGILSIGWVNAQPAGNERMVDIATAIQQGAQAYLNRQYRTIGIVGWLLFFVIGAFLGWSIAFGFVIGAALSGAAGYIGMNISVRANSRTAQAAITGMDEAFSTAFRGGAITGMLVVGLGLLGVAGYYALLKSVGATDPLHALVGLAFGGSLISIFARLGGGIFTKGADVGADLVGKVEAGIPEDDPRNPAVIADNVGDNVGDCAGMAADLFETYAVTIVATMLLGGLLTGGSEAATVYPLVLGGISIVASIIGTFFVRITPGKKIMSGLYKGVIVSGGLAAAAFLPITGFMFGGGVSLGGIDVSWIGIFFSALIGLGLTGLMVVITEYYTATEFAPVRHIAEASTTGHGTNIIAGLGVSMKATAAPVLAVCASIWGAYELAGLYGIAVAATAMLSLTGMIVALDAYGPITDNAGGIAEMAELPDSVRAVTDPLDAVGNTTKAVTKGYAIGSAGLAALVLFADYTHNLGGNVNFDLSNHMVIIGLFIGGMVPYMFGALAMEAVGRAAGGIVNEVRRQFREIPGIMEYTAKPDYSKAVDMLTQAAIKEMVVPSLLPVAIPVLVGLLLGKEALGGLLIGTIITGLFVAISMTTGGGAWDNAKKHIEDGNFGGKGSEAHKAAITGDTVGDPYKDTAGPAVNPMIKIINIVALLIVPLL

SEQ ID NO: 50264 - protein, 323 aa, Prochlorococcus marinus str. MIT 9303
MATVTELLQPVELDLETLLTDLRSLIGAGHPILQAAAEHLFSAGGKRLRPGIVLLISRALSADGDLSARHRRLAEITEMIHTASLVHDDVVDEAATRRGVATVHSRFNHRVAVLAGDFLFAQASWHLANLDNLAVVKLLSRVIMDLADGEVKQGLYRYDTGQSFATYLEKSYCKTASLMANSVQAAGVLSGESVEHQKSLHHFGRQLGLAFQVVDDILDFTGSEQQLGKPAASDLASGYLTAPALYALEEHLALARLIEREFSEEDDLDQALELVRNSQAISRSRQLAEDFARESREAIAWLPDSPCQRALMELPDFVLSRLY

SEQ ID NO: 50265 - protein, 431 aa, Clostridium perfringens str. 13 [sequence omitted]

SEQ ID NO: 50266 - protein, 173 aa, Triticum aestivum
MAFWDYSEKKLIQKAKAEWSVISEWSPDGRHFMTATTAPRLQIDNRIKIFDHTGSLQFIKEFEKLYQVDWKPESPERFVDIAELTISLNGLKIEETKKQGQGSKSAQTSSKAAKPAGAYRPPQSKHTAALQDKLFGGLAPTGGEMSKTALRNKKRREKQKEKKAGEGSSADDS

SEQ ID NO: 50267 - protein, 512 aa, Clostridium perfringens str. 13
MSKKPVMLMILDGFGISPNKEGNAVAAANKPNYDRLFNKYPHTELQASGLEVGLPEGQMGNSEVGHLNIGAGRIIYQELTRITKEIKEGTFFTNKALVKAMDEAKENNTSLHLMGLLSNGGVHSHIDHLKGLLELAKKKGLQKVYVHAFMDGRDVAPSSGKDFIVELENAMKEIGVGEIATISGRYYAMDRDNRWERVELAYNAMALGEGEKASSAVEAIEKSYHDNKTDEFVLPTVIEEDGHPVARIKDGDSVIFFNFRPDRAREITRAIVDPEFKGFERKQLHVNFVCMTQYDKTLECVDVAYRPESYTNTLGEYVASKGLNQLRIAETEKYAHVTFFFNGGVEQPNTNEDRALIASPKVATYDLKPEMSAYEVTDELINRLDQDKYDMIILNFANPDMVGHTGVQEAAVKAIEAVDECLGKVADKVLEKEGTLFITADHGNAEVMIDYSTGKPMTAHTSDPVPFLWVSKDAEGKSLKDGGKLADIAPTMLTVMGLEVPSEMTGTCLLNK

SEQ ID NO: 50268 - protein, 248 aa, Clostridium perfringens str. 13
MRTPIIAGNWKMHYTIDEAVKLVEELKPLVKDAKCEVVVCPTFVCLDAVKKAVEGTNIKVGAQNMHFEEKGAFTGEIAPRMLEAMNIDYVIIGHSERREYFNETDETCNKKVKAAFAHNLTPILCCGETLEQRENGTTNDVIKAQITADLEGLTKEQAEKVVIAYEPIWAIGTGKTATSDQANETIAAIRAMVAEMFGQEVADKVRIQYGGSVKPNTIAEQMAKSDIDGALVGGASLVAADFAQIVNY

SEQ ID NO: 50269 - protein, 256 aa, Xanthobacter autotrophicus Py2
MIFDTDLKGAQARLAELLDEASCAVAFTGAGLSTECGIPDFRSPGGLWTQNKPIPFDVFVSHKAARNEAWRRKFAMEEAFASARPGRGHRALARLHGHGRLKGIITQNIDGLHQASGVPDAALIELHGNGTYATCLDCGARYELDWVKARFDASGGSAPDCPECGGPIKAATISFGQAMPETEMARADELTRKCDLFIVIGSSLVVFPAAGFPLKAKKKGARLVILNREPTDFDELADLVVRTEIGDLLEPFAQDA

SEQ ID NO: 50270 - protein, 546 aa, Methylococcus capsulatus str. Bath
MPQSTDLPAWRTLSEHFKTIAPRHMRDMFADDPGRFEAFSVRLGDLLFDYSKNRITRETVATLIQLAEEAGLREKIDAMFRGERLNVTENRAVLHVALRNRSNRPIRVDGKDVMPEVNRVLDRMRRFSQSVRTGEWRGATGKAITDVVNIGIGGSDLGPKMVVKALQPYADPRLRAHFVSNVDESDLVEILRPLNPETTLFVVASKTFTTQETMTNGRSARAWFLERISDESAIARHFVAISTNRNKVAEFGIDPRNMFEFWDWVGGRYSLWSAIGLPIALSVGMDRFEELLEGAHFVDEHFRTAPFERNIPVLMGLLGIWYINFFGAQSHAVLPYDQYLEDLPAHLQQADMESNGKTVDVEGRPVNYSTGPVIFGQPGTNGQHAFYQLLHQGSMLVPCDFLAAAESHHPLAEHHDILISNFLAQTEALMRGRTTDEARQEIASEELPPERLEALAAAKTFPGNKPTNSFLYRRLDPHTLGMLIALYEHKIFTQGVIWYINSFDQMGVELGKQLAKTILAELPGDAPVASHDASTNGLIRYFKSLR

SEQ ID NO: 50271 - protein, 397 aa, Clostridium perfringens str. 13
MNFNKKTIEDVQVKGKKVLVRCDFNVPLKDGVITDENRLNGAMPTIKYLVDNGAKVILCSHMGKPKGEAKPEFSLAPVAKRLSEMLGKEVVFAADDNVVGENAKKAVAEMKDGDVVLLQNTRYRKEETKNGEELSKELASLAEMFVNDAFGTAHRAHCSTVGVTEYLKPAVCGYLIQKELKFLGDAVETPERPFVAILGGAKVSDKINVINNLLEKVDTLIIGGGMAYTFLKAQGYTVGSSLVEEDKVEYAKEMLAKAEEKGVKLLLPVDHRVAKEFKDVEAVVTEDQNIAEGFMGLDIGPKTEAIYAEAIKDAKTVIWNGPMGVFEFENFNKGTIAVAKAMAEADATTIIGGGDSAAAVNILGFGDKMSHISTGGGASLEFLEGKVLPGIAALNDK

SEQ ID NO: 50272 - protein, 332 aa, Clostridium perfringens str. 13
MVKVAINGFGRIGRLALRLMIDNPEFEVVAINDLTDAKTLAHLFKYDSAQGRFNGEIEVKEGAFVVNGKEIKVTAKSNPAELPWGELGVDVVLECTGFFASKEKASAHLTAGAKKVVISAPAGNDLPTVVYNVNHDILDGSEDVISGASCTTNCLAPMAKALNDNFGLNKGFMTTIHAYTNDQNTLDAPHKKGDLRRARAAAANIVPNSTGAAKAIGLVIPELAGKLDGNAQRVPVITGSLTELVCTLDKKVTVEEVNAAMKAASNESFGYTEDPIVSSDVIGISFGSLFDATQTKIMEVDGQQLVKVASWYDNEASYTNQLIRTLKCLVSK

SEQ ID NO: 50273 - protein, 465 aa, Yersinia pestis CO92
MKIVNHWIDGKNITSNDYFTTINPATGEVLADVASGGIKEINQAVAAAKSAFPHWANLPMKVRARLMRRLGELIEQQIPEIAQMETQDTGLPIYQTQNALIPRAAHNFEFFAEICQQMNGQTYPVDDQMLNYTLVQPVGVCALVSPWNVPFMTATWKVAPCLALGNTAILKMSELSPLTADKLGELALEAGIPAGVLNVVQGYGATVGDALVCHQDVRAISFTGGTATGNRIMQRAGLKKYSMELGGKSPVLIFDDADIERAMDAALFSIFSLNGERCTAGSRIFIQESLYSAFIQRFAERASRLRVGDPQDLDTQVGALISKPHWDKVSGYIQLGIEEGATLLAGGPDKPIDLPAHLRGGHFLRPTVLADVDNRMRVAQEEIFGPVACLIPFKNEDAGLRLARSIEAGMVFVNTQNVRDLRQPFGGIKASGTGREGGKYSFDVFAEVKNVCISMGEHPIPRWGM

SEQ ID NO: 50274 - protein, 553 aa, Zea mays
MVFSSLPIFLDPPNWGQMHMQQQQPLQCLLDGGAGSDHHHLMPPPSCLAPLRGGPADTAASAPAGGGSSTSVPTTAGAGAGAGATQPRPVVSMAERARLVRVPLPEPGTLRCPRCDSANTKFCYFNNYSLSQPRHFCKACRRYWTRGGALRNVPVGGGCRRNTKRSSKKSSRGGGAGATAATSSSSTTSTSTTATTTTTSAAMAAAEAIASMQAQLPHLGLPPAAAAAALEASLEGYHHHYLPLQMQPQFLQQAGLHGYHFADDGSGVLADGFPRGVVASGLLAQLAAVKMEEHSSNGGGAVTAHQQEQSYSYWPGSTGGGSGWPAEFLSGFSSSSSGNVLIERGPSGEVWPLGTDQERVMTDEHPPAQLPLKATGGDRREEEELSCGSREGNKQAARARSWGAGGSDLLASKARPERRFERSCDMGEQENNKIGGSGNDNAMAVDEAGAGAAANKGKSLGAADPRLQAISDAIRVVPHFPKPGIMFNDITELLLRPGVFRDAVDMFVERYRGMGIAAVAGIEARGFIFGPAIALAIGAKFIPLRKPKKLPGE

SEQ ID NO: 50275 - protein, 107 aa, Agrobacterium tumefaciens str. C58
MSAFSLSDLERIVAKRAAASPDESWTAKLVAAGQERAAKKLGEEAVEAVIAAIAQDRDGLKNEAADLLYHLLVVLKIADIPLSDVFAELERRTGQTGLAEKAARPTP

SEQ ID NO: 50276 - protein, 198 aa, Agrobacterium tumefaciens str. C58
MAERKGEIIRKTNETSVSVRVDIDGTGKSKISTGVGFFDHMLDQLSRHSLIDMDIEVQGDLHIDDHHTVEDTGIAIGQAIAKALGDRRGITRYASLDLAMDETMTKAAVDISGRPFLVWNVNFSAPKIGTFDTELVREFFQALAQNAGITLHILNHYGANNHHIAETCFKAVARVLRTATEIDPRQAGRVPSTKGMLA

SEQ ID NO: 50277 - protein, 489 aa, Arabidopsis thaliana
MLFKMRSFVAFVLLLSWFGSCCSLKDQAVDFLKSEDSLKKDLSSDEDSTYLKAFGFHRKTLVRNPYKDLPSRKDRKNRVVAATTTPSSSPEPAPKHVSTKASTVSEPQKRSSTQDVSPSPSAPLANSPIPRNSHSSVPLVVGCVGGAFFLLLVATGLYFFTSKAGKTVNPWRTGLSGQLQKVFVTGIPVLKRSEIEAACEDFSNVIGSCPIGKLFKGTLSSGVEIAVASFATTTAKDWKDSTEIHFRKKIEMLSKINHKNFANLLGYCEEKEPFTRILIFEYAPNGSLFEHLHYKESEHLDWGMRLRIAMGLAYCLDHMHQLNPPIAHTNLVSSSLQLTEDYAVKVSDFSFGSSETETNINNNTVIDTHISALNPEDNIYSFGLLLFEMITGKLIESVNKPDSVDSSLVDFLRGETLAKMVDPTLESYDAKIENIGEVIKSCLRTDPKERPTMQEVTGWLREITGLSPNDATPKLSPLWWAELEVLSTA

SEQ ID NO: 50278 - protein, 207 aa, Agrobacterium tumefaciens
AAIFFAGTPILESAMVYPLAICGACILTSIAGTFFVKLGTNNSIMGALYKGLIATGVFSVAGLAVATYATVGWGTIGTVAGMEITGTNLFFCGLVGLVVTALIVVITEYYTGTNKRPVNSIAQASVTGHGTNVIQGLTVSLESTALPAIVIVGGIIGTYQLAGLFGTGIAVTAMLGLAGMIVALDAFGPVTDNAGGIAEMAGVDRDV

SEQ ID NO: 50279 - protein, 221 aa, Agrobacterium tumefaciens
AGLGALVLFAAYANDLSYFAANGDTYPYFKDIGEISFSLANPYVVAGLLFGGLIPYLFGGIAMTAVGKAASAIVEEVRRQFREKPGIMAGTEKPDYGRAVDLLTKAAIREMVIPSLLPVLAPLVVYFGVLLISGSKASAFAALGASLLGVIINGLFVAISMTSGGGAWDNAKKSFEDGFIDKDGVRHVKGSEAHKASVTGDTVGDPYKDTAGPAVNPGHQD

SEQ ID NO: 50280 - protein, 612 aa, Mycobacterium sp. JLS
MTQTLADPREPTTDLTPQQRVDAWLADFEAALAVRDIERVVAKFATDSFWRDLVAFTWNIKTLEGRDGIADMLTARLTETDPARFRTREAPTVDGDVTTAFIEFETGVGRGVGHLRLRGDECWTLLTTMQEIKGHEERKGPSRVLGAVHGSDPDPRSWAEKRAEEDAALGRTVQPYALVIGGGQGGIALGARLRQLGVPAIVVDRHERPGDQWRKRYKSLCLHDPVWYDHLPYLPFPQNWPVFAPKDKIGDWLEFYTRVMEVPYWSKTTCLSAVFNPGSDGAPDTWTVEVDRDGERLTLRPTQLILATGMSGKPSVPTLPGQDVFRGEQHHSSAHPGPDRYVGKRAVVIGSNNSAHDICKALVENGVDTTMVQRSSTHIVKSDSLMDLGLGDLYSERALAAGMTTEKADLTFASLPYRIMHEFQTPIYDAIRERDKDFYERLTAAGFELDWGDDGSGLFMKYLRRGSGYYIDVGACDLVADGTIKLAHGQVSHLTEDTVVLADGTELPADVVVYATGYGSMNGWAADLIGQDVADKVGKVWGLGSSTTKDPGPWEGEQRNMWKPTQQENLWFHGGNLHQSRHYSLYLALQLKARFEGIPTPVYGLQEVHHLS

SEQ ID NO: 50281 - protein, 221 aa, Glycine max
MACSVHLLLLLLTSLLALFFNPTCVYGNDELRALLDLKSSLDPEGHFLSSWTMGGNPCDGSFEGVACNEKGQVANVSLQGKGLSGKLSPAIAGLKHLTGLYLHYNSLYGEIPREVANLTELSDLYLNVNHLSGEIPPEIGKMENLQVLQLCYNQLTGSIPTQLGDLKKLSVLALQSNLLGGAIPASLGDLGMLMRLDLSSNNLFGSIPIKLADLPSLQVLD

SEQ ID NO: 50282 - protein, 398 aa, Oryza sativa (indica cultivar-group)
MARNRKVVLREYIAGRPPREDDMVLVDGGTVALRVPEAAAPAPAVLVKNLYLSCDPYMRGRMRDFHGSYIPPFKPGSVGFLLPFACSPFNQRCISPSTRRIALLVIEGSICVKVIEGLGVARVVDSTHPGFSAGDIVSGMTGWEEYSLIDRPEQLSKIQQSDIPLSYHLGLLGMPGFTAYAGFYEICSPKKGEFVFVSAASGAVGQIVGQLAKLHGCYVVGSAGTNQKMHHSGFTAMFQVELLKGKFGFDAAFNYKEEPDLTAALKRYFPEGIDIYFENVGGPMLDAVLLNMRTHGRIAVCGMVSQNALTDPVGIHNIFCLVPKRIRMQGFIQSDHLHMFPQFVSDMAKHYRDGKIVYVEDMSIGLENAPAALVGLFSGKNVGKKVVCVSQELSQCTF

SEQ ID NO: 50283 - protein, 140 aa, Brassica napus
QKLLAHPMHKSEDDQQMKSFQRKAEVNYEIQQFKSKMRDSQLQKFRDELRNRSRVLKKLGHIDADGVVQLKGRAACLIDTGDELLVTELMFNGTFNDLDHHQVAALASCFIPVDKSNEKVELKNELNRPLQQLKDSARRI

SEQ ID NO: 50284 - protein, 557 aa, Nostoc punctiforme PCC 73102
MANLTDFKLFAPRNKGAALIGSFSDWKEIPMSKSEDGYFRTKIKLEDGVYQYKFRIQTKSPNFAPDEWIDVIDPKATEVNETEKYGIVRIQDGQRIVDSYFWQHDEMPLPDNRELVIYEMHVADFTGDEVDSNERGKYLGIIAKLDYLCELGINAIELMPVNEYPGDYSWGYKVRHFFATESSYGSTEDLKRLIDECHGRGIRVFMDGIYNHTDEECPLILIDRNYWYYEHKHYPEDPANYWGPEFNYDFYDKNLNIQPAWEYIGDVVRFWIQEYHIDGIRFDAVRQLANFEFLNWLTKQAKNHAAPKQFYNIAEHIPDTNTVVKPDGPLDACWHESFRYFLVPYICGKSFELEQLKQILDPKQQGYAIATNVINYLATHDRERLLRELGNCGIFDAAAFERAKLAAVLLMTAMGIPMLWMAEEFGEYQQKSEDVTKPQKITWSLLLDDQNYDLFEYYQKLITLRQQTPALQSDNIKFFYENADDKVLAYSRWDEQNSHVVVVVNFSDRSLNQYKISDFPTTEDWRDWVGNREVKSGEDGLVTDLPSYTAKIFVLQT

SEQ ID NO: 50285 - protein, 203 aa, Brassica napus
MHSVPVILTLTVLTVLLTSTVQVIGWRPYPPKTNGSDQIFDASKKYEGSSNLVRLRYHMGPVLTNNITVHPIWYGTWQKSQKKIIREFINSISAVGSKHPSVSGWWKTVQLYTDQTGSNISATVRLGEEKNDRFYSHGKSLTRLSIQSVIKSAVASRSRPLPVNPKGGLYLLLTSDDVYVQDFCGQVCGFHYFTFPSIVGFTL

SEQ ID NO: 50286 - protein, 150 aa, Triticum aestivum
AYLGDTIEQVCTKKQAGTGPEFPGYRRPTRPTNRIQVSQQEIVSLYERFCQLDRSAKGFVSEDEFLSIPEFSTNPLSKRLLRMVDGLNFKEFVSFLSTFSARASLQQKIELIFKVYDIDGKGKVSFKDLVEVLRDLTGSSMSEQQREVLI

SEQ ID NO: 50287 - protein, 518 aa, Listeria monocytogenes EGD-e
MFKIMKDFTEQEKIIVLDFGSQYNQLITRRIREFGVYSELHPHTITVEEMKALNPTGIIFSGGPNSVYDEDAFRADERIFDMGIPILGICYGMQLMTTHFGGKVERAKDREYGKADIHVEKPNRLFAGLPTDQVVWMSHGDLVVEEPAGFEVTVTSKSCPIAGIADEERSLYGVQFHPEVRHSVYGNELLKNFALNVCGCKGDWTMENFSEVEIAKIQEIVGDKKVLLALSGGVDSSVVGVLIHKAIGDQLTCIFVDHGLLRKGEADQVMETLQGEFNMNIIKVDAKKRFMDKLAGVSDPEQKRKIIGNEFIYVFDDEANKLDGVEFLAQGTLYTDIIESGTATAQTIKSHHNVGGLPEDMQFKLIEPLNTLFKDEVRALGTELGMPDAIVWRQPFPGPGLGIRVLGEITEEKLEIVRDSDYILREEIKNAGLEREIWQYFTALPNIRSVGVMGDGRTYDHTVVVRAVTSIDGMTADWARIPWDVLEKISVRIVNEVDHVNRVVYDITSKPPATVEWE

SEQ ID NO: 50288 - protein, 339 aa, Hordeum vulgare subsp. vulgare
MENILHATPAPVSLPESFVFASDKVPPATKAVVSLPIIDLSCGRDEVRRSILEAGKELGFFQVVNHGVSKQVMRDMEGMCEQFFHLPAADKASLYSEERHKPNRLFSGATYDTGGEKYWRDCLRLACPFPVDDSINEWPDTPKGLRDVIEKFTSQTRDVGKELLRLLCEGMGIRADYFEGDLSGGNVILNINHYPSCPNPDKALGQPPHCDRNLITLLLPGAVNGLEVSYKGDWIKVDPAPNAFVVNFGQQLEVVTNGLLKSIEHRAMTNSALARTSVATFIMPTQECLIGPAKEFLSKENPPCYRTTMFRDFMRIYNVVKLGSSLNLTTNLKNVQKEI

SEQ ID NO: 50289 - protein, 219 aa, Malus x domestica
MDGCSNYYVDPPGESSSASDTSRPMFLTLSDKEVLLASTCPKKRAGRKKFRETRHPVFRGVRRRNSGKWVCEVREPNKKTRIWLGTFPTAEMAARAHDVAAIALRGRSACLNFADSARRLPVPASSNAKDIQTAATEAAEAFRPTEESDEVCGSPVAAPSESTSASEQQQVFYMDEEAVFGMPGLLADMAEGMLLPPPHYSDDDDVDVCADVPLWSFSI

SEQ ID NO: 50290 - protein, 466 aa, Mycobacterium sp. JLS
MTHYDVVVLGAGPGGYVAAIRAAQLGLNTAIVEPKYWGGVCLNVGCIPSKALLRNAELAHIFTKETKTFGISGEATFDYGAAFDRSRKVAEGRVAGVHFLMKKNKITEVHGYAKFTDDHTIEVDLNEGGTETLTFDNAIISTGASTKLVPNTSLSENVVTYEEQIMERELPGSIVIAGAGAIGMEFGYVMKNYGVDVTIVEFLPRALPNEDAEVSKEIEKQFKKLGVKIMTGTKVESIKDEGGDGSVTVTVSKDGKSQELKTDKVLQAIGFAPNVEGYGLDKAGVELTDRKAIGIDDYMRTNKPHIYAIGDVTGKLQLAHVAEAMGVVAAETIAGAETLPLGDYRMMPRATFCQPQVASFGLTEEQAREEGYDVKVAKFPFTANGKAHGMGAPGGFVKLIADAKYGELIGGHLIGHDVSELLPELTLAQKWDLTANELARNVHTHPTLSEALQEAFHGLAGHMINF

SEQ ID NO: 50291 - protein, 213 aa, Myxococcus xanthus DK 1622
MPTASTPPISAQDALARLREGNQRFVLNARNMENPLGRSARQALVAGQSPFAIILSCSDSRAPSEYIFDQGLGDLFVIRVAGNVVAPSLVGSVEFAAAKFGTRLAVVMGHSHCGAIQATLDYLRDGKSEASENIRDIVERCREPVATVVSAAGPKADPEFLMKESVRANIRNSCDNLRHGSRLLERLCREEGMLIVGAEYSLETGAVDFFNGV

SEQ ID NO: 50292 - protein, 314 aa, Zea mays
  misc_feature (80)..(80): Xaa can be any naturally occurring amino acid
MACYNTASLAATLLAFALTFQACLAGRRLTALVQEPAITMRYHKGALLSGPIAVNFIWYGDFSAPQRAAITDFVSSLTAXAPAAAQPEPSVATWFKTARKYYASSKVPFPALRLGSHAVDRNCSLGRRLTERDLLRLAARGAPSRAINLVLTAADVAVDGFCESRCGTHGASPRSRSGRFAYAWVGNPASQCPGQCAWPFHQPVYGPQAAPLTPPNGDVGVDGMVISLASMLVGTVTNPFGNGFYYQEGSADAPLEAATACAGVYGKGAYPGYAGSLLVDQASGASFNANGAHGRKYLVPALVDLDTSSCATLV

SEQ ID NO: 50293 - protein, 1100 aa, Oryza sativa (indica cultivar-group)
MDTGMRVALHRQVSSGSLKESGELRRQSSLESPRTGRAATRFLFGRQSSMDPNRRRGRSQSPVGLAEDLTVPDNLDATMQLLFLACHGDAAGVEALLRGGVDVNSINLDGRTALHIASCEGHPDVVRVLLTWKANIDARDRWGSTAVADAKCYGHTEVYNLLKARGAKIPRNRRTPMMVSNPGDVPEYELNPSELQFKKGDEVVKGVYQVAKWNGTKVHVKILDRECYCDQEVINSFRHELTVLEKVRHPNVVQFVGAVTQNIPMMIISEYLPNGDLSSCIPRKGKLHGQKVLKYGLEIARGMTYLHQCKPDPIIHCDLKPKNIFLDSGGQLKIAGFGLTRLSKISPGRVKLADHESMVDSFSHYTAPELYRNEIFDASVDAFSFGFILYEMVEGTHTVHGKSSEESGHTIRYDGMRPSLKNKLRGYPPDFKALIEECWDTQGNDTCGLSCMNAFLCTYHCEANASLSVKKKPELALTRLEEDDTTYRQICAGAAAVRAMEEGRGGDPPSSSSSSAAAAGVAIGYPFLEPQQGARLRRRRTISPFKKYFSRGFAIAQIRGDESYDSSVPTARDPLHAQIELYPFRRVVYPSLWPSDSCKESLDASNNFSFGFFDGILSDFSKVFKFKSVHLEGDEVNTSCCTAIPHIKKWEEIFNNFGYKLDHRAVVHNCFPDVWVPLLVGTRVSLTSAWTREEVALYRKALKPWRECPFDIQLECNSLTGSKAVQDHSRYNLPSQCTNAPDPPPLPGTSYGAHRTSRNAKACRCVPEEIQDFWDKMFFEAYQYDLRVLTEDGNEVMSHSCVVQGIKSPVLRAMLEEAKVQGGIRHILIPGVPSEAVHVFIRFLYSSRFEQYQMKRYVLHLLVLSHVFSVPSLKRVCINQLETSLLSPENVVDILQLARLCDAPRLSLICTRMIIQDFKTITQTEGWRVMRQANPSLEQELLESLVEEDTKRQERARKLEENKVYLQLHEAMEAIVHICRDGCRTIGPRDQTLKSGQAVCRFPACKGIELLLRHFSACKMRVPGGCANCKRIWQLLELHSRMCSAPETCHVPLCRHFKEKMQHLSRKEEAKWNLLVSKVLESKATTSSISERRKFPSLKT

SEQ ID NO: 50294 - protein, 441 aa, Zea mays
MATAVSCPYSSSRAGAPALLLVALLLAAASWTTTAAAKNDTQRFRPGDELRRYRRVQALLKRLNKPALRSIQARACSAALFSSSPDGDLIDCVPAHLQPAFDHPRLRGQRPLVAGPPPARPKGNRLRDPIRNDTAEAAGVQQLWAASGESCPEGSVPIRRVTESDVLRASSVRRFGRAPAGRVRRDSVSGGHEHAVGYVAGDEYYGAKASINVWAPQVSTASEFSLSQIWVIAGSFGNDLNTIEAGWQVSPELYGDNAPRFFTYWTTDAYQTTGCYNLLCSGFIQTNSRIAMGAAISPTSAYNAGQFDISLLVWKDPNHGNWWLEFGSGELVGYWPSLLFSHLASHASMVQFGGEVVNTRASGSHTATQMGSGHFAGEGFGRASYFRNLEVVDWDNSLVPLAAGFHVTADHPSCYDIQGGVNAVWGNYFYYGGPGRNVRCT

SEQ ID NO: 50295 - protein, 218 aa, Oryza sativa
MEVEEAAYRTVWSEPPKRPAGRTKFRETRHPVYRGVRRRGGRPGAAGRWVCEVRVPGARGSRLWLGTFATAEAAARGHDAAALALRGRAACLNFADFAWRMPPVPASAALAGARGVRDPVAVAVEAFQRQSAAPSSPAETFANDGDEEEANKEVLPVAAAEVFDAGAFELDDGFRFGGMDAGSYYASLAQGLLVEPPAAGAWWEDGELADSDMPLWSY

SEQ ID NO: 50296 - protein, 475 aa, Ralstonia eutropha JMP134
MYQDLALYIDGEFIKGGDRKEQDVLNPATQEVLGKLPHASRADLDRALAAAQRAFESWKKTSPLERSKILRRVGELARERAKDIGRNITLDQGKPLAEAVGEVLVCAEHADWHAEECRRIYGRVIPPRQPNVRQIVVREPIGVCAAFTPWNFPFNQAIRKIVSAVGAGCTLILKGPEDSPSAVVALAQLFHDAGLPPGVLNIVWGVPSEVSTYLIESPIVRKISFTGSVPVGKQLAALAGAHMKRVTMELGGHSPVLVFDDADIEPAAEMLARFKLRNAGQVCVSPTRFYVQEKAYDKFLARFTEVIGSIKVGNGLEDGTQMGPLAHERRVFSMEQFLDDANQRGGKVVAGGSRIGDKGYFFAPTVVTDLPDDAKLMVDEPFGPVAPVTRFKDTAEVLRRANSLPFGLASYVFTNSLKTATEVSNGLEAGMVNINHFGMALAETPFGGIKDSGIGSEGGQETFDGYLVTKFITQV

SEQ ID NO: 50297 - protein, 133 aa, Synechococcus sp. RS9917
MPASASPEAINTPAAPAPVGPYNQAVRAGEWLYCSGQIPLDPHSGAMVGAGDVEAETRQVLHNLEAVLSAAGASAAQVVRTTVFLADLNDFQAVNAIYAEMFGAGVSPARACVQVAALPKGARVEIDCVAYLG

SEQ ID NO: 50298 - protein, 210 aa, Brassica napus
  misc_feature (159)..(159): Xaa can be any naturally occurring amino acid
MKGRISKIGSYAISSSTRDCISCTTFNILAPIYKRLSQNDQSIRESDNRAYWMGRNHRILDWLLYERSSIICLQEFWVGNEELVRLYEKRLGDAGYLCYKLGRTNNRGDGLLTAVHKDYFRVVRSRDLLFNDCGDRVAQLLHVELVPPYSQYDAHQQVXIVNTHLLFPHDSTLSIVRLQQVYKILQYVESYQESYLSPMPIILCGDWNGA

SEQ ID NO: 50299 - protein, 1391 aa, Oryza sativa (indica cultivar-group)
MGDQSELITGCDEDDHGLAKTKGKNWGIFICWLLGNGCLFGFNGMVTIEDYYVYLFPNYHPTRMITLVYQPFVLTTTALFAYHEAKINTRMRNLAGYMLFFLSSFGVIVLDVASSGRGGIAPFVGLCLIATAFGVADGHVQGGMTGDLSLMCPEFNQSFFAGIAASGAITSALRFLTKAIFENSRDGLRKGAMMFSSIACFFELLCVILYAFVFPKLPIVKFYRTKAASEGSLTVTADLAAGGIKSQPENPLDEEDQAFAERLSNRQLLNQNMDYALDVFMIYVLTLSIFPGFLAEDTGTHSLGSWYALVLIATFNVSDLIGRYMPLIEQIKLTSRKWLLIAVVARFLFVPAFYFTVKYCDEGWVIMLTSFLGLSNGHLTVCVITEAPRGYKGPEQNALGNMLVFFLLAGIFCGVVLDWMWLIGKGWIEEHGRGVTWKLPSLLPLLSLVFRLGHVGEVNTDGSSLFTAIDRATATKPRARNLRHRIVHRFVDVYSATHAPNRDTIGAAVRHLYALDLKVSWGVNVAHELKLLAPKSHCHDLDAAINGIVDLDIQRNNNLFRAVAIRVVVCARTQCPSVNLAMNSLVALRGKCWGIFICWLLGNGCLFGFNSMLTIEDYYTSLFPNYHPTRVVTLTYQPFVLGTTAIFTYHEAKVNTRLRNLAGYTLFFLSSFAAIVLDVATSGRGGIAPFVGVCIIAAAFGVADGHVQGGMTGDLSLMCPEFIQSFFAGLAASGMITSALRLITKAAFENSRDGLRKGATSEGSLTVAADLAAGGIQNRANPLLKTLDHTAWALGTVLTFVLDFGSIIDRYALVLIASYNVWDLIGRYIPLIEQVKLRSRKVILIAVVSRFLLIPAFYYTAKYSDQGWMIMLTSFLGLSNGYLTVCILTEAPKGYKGPEQNALGNLLVLSLLGGIFCGAILDWLWLIGRVMKYIYKGQLREYLFFLLTVVGTQEGQSERRPMFPRNHSSPLRSVIRLAHAQVNFIMSLEVAGAGAPQAQGKFLGILVCWVLGNGSLFAWNSMLTIEDYYSILFPTYHPTRVLTIAYQPFAFGITCILTYHEAKLNTRKRNLIGFALFLVSSFALIMLDIGTKGRGGLGPFIGVCIISALFGTADASVQGGLVGDLSFMCPEFIQSFLAGLAASGVLTSALRLITKAAFENSQNGLRNGAILFFSITCFFELVCLLLYAYVFPKLPIVKYYRSKAAAEGSKTVASDLAAAGISNEHSIQAEEDPKKCDRLSTKELLIQNIDYAFDIFLIYVLTLSIFPGFLSEDTGAHSLGTWYALTLIAMYNVWDLIGRYLPLIKCIKLTSRKGLTGAILARFLFIPAFYFTAKYGDQGYMIFLTSFLGLTNGFLTGPEQNALGNVLVVCLLGGIFSGVVLDWLWLIGKGW

SEQ ID NO: 50300 - protein, 107 aa, Aster tripolium
GGHVNPAVTFGLAVGGNITILTGLFYWIAQLLGSVVACFLLQFVTGGLAVPTHGVADGMNGLQGVVMEIIITFALVYTVYATAADPKKGSLGTIAPIAIGFIVGANI

SEQ ID NO: 50301 - protein, 470 aa, Exiguobacterium sibiricum 255-15
MVVGEFAQETDLLVIGAGPGGYVAAIRGAQLGLKVTIVERENVGGVCLNVGCIPSKALITAGHNFQHAKGSDSMGITSENVAVDFSKVQSWKQSVVNKLTGGVGGLLKGNNVETVVGEAYFQSEDTVRIINEDSSTPYKFKKCIIATGSTPIELPAFKWSKRVLSSTGALNLPELPKKLIVIGGGYIGMELGTAYANFDTEVVILEGTKDILSGFEPAMTQVVKKKLKQKGNITIHNEALAQSVEETEEGVKVTFEVKGETQTVEADYVLVTVGRRPNTSDLGLEMAEVKVSERGLVEIDDQCRTSNENIYAIGDIVPGPPLAHKASFEAKIAAEAAAGHPAYLDYSAIPAVVFTDPELATVGYTEAQAKEEGLDYIASKFPYAANGRALALNEPDGFLKMITRKADGLLIGAQIAGTGASDMIAEMGLAIESGMTAEDIALTIHAHPSLGEIAMETAEVAIGSPIHIMK

SEQ ID NO: 50302 - protein, 432 aa, Exiguobacterium sibiricum 255-15
MGLFEFKLPDIGEGIHEGEIVKWFVKAGDTVKEDDILLEVQNDKAVVEIPSPVDGTVKEVKVDEGIVAVVGDVLITFDVEGEGSAPSEEEAPEQPKAADNAKDVQDTDKKVEDKPNEVQIHKSERVIAMPSVRKYAREKGVDIREVQGSGDNGRVVKEDIDAFANGGQSSTAPAAEEKAPAAQASASKSEVKPYVAAQPELETREKIKGIRKAISKAMVNSKHTAPHVTLMDEVDVTNLVALRKNFKEVAAAQGTKLTYLPFVVKALTAAAKKYPAINASIDDVNEEVVYKNYFNIGIAADTDNGLVVPVVKDADRKSIFGLADNINDLAGKARDGKLSGDEMKGGSITITNIGSAGGQWFTPVINHPEVAILGIGRIAEKAVVKNGEIVAAPVLALSFSFDHRLIDGATAQNALNLVKRLLNDPQLLIMEG

SEQ ID NO: 50303 - protein, 325 aa, Exiguobacterium sibiricum 255-15
MAQMTMIQAITDAMRVEMKRDEQVLLFGEDVGKNGGVFRATEGLQDELGEDRVFDTPLAESGIGGLAVGFSLTGFRPIMEIQFFGFVFEVFDSVAAQLARLRYRSGGTYSAPVTIRSPFGGGVKTPELHADNLEGLMAQSPGLKVVIPSTPYDAKGLLIASIRDNDPVVFLEHMKLYRSFRGEVPEGDYTIELGKADIKREGTDVTIVTYGAMVHASLKAAEELEKENISVEIIDLMTISPIDIDTIVESVKKTNRVVVVQEAQKQAGVAAMVATEIQERAILDLEAPILRVAAPDTIFPFAQGEDSWLPDHKDIVEKVKTVYNF

SEQ ID NO: 50304 - protein, 648 aa, Flaveria trinervia
MISLNSSFLERSSVTGGSRTQSQSLRLSARRPVVTSMLNSNSLPERNVSVSVDSAVRDVNAPVAVEVDRSVGEKPFAAVGGGVEDMYGEDTATEDHYITPWSVSVASGYSLLRDPHHNKGLAFTEKERDAHFLRGLLPPVVVNHDLQVKKMMHNIRQYQVPLQRYQAMMDLQQRNERLFYKLLIENVEELLPIVYTPTVGEACQKYGSIFENSQGLFISLKDKGRILEILKNWPHKKIQVIVVTDGERILGLGDLGCQGMGIPVGKLALYTALGGVRPSACLPITIDVGTNNEKLLNDDEFYIGLKQKRAAGQEYAELMNEFMSAVKQNYGENLLIQFEDFANHNAFDLLEKYRTTHLVFNDDIQGTASVVLGGLISALKLVGGSLADQKFLFLGAGEAGTGTAELIALEISKQTNIPLEESRKKVWLVDSKGLIVRSRLDSLQHFKKPWAHDHEPVNEFLDAIKTIRPTVLIGSSGTGQTFTKEVVETMSSLNEKPIILALSNPTSQSECTAEQAYTWSEGRAIFASGSPFKPVEYNGKLYVSGQANNAYIFPGFGLGLIISGAIRVHDDMLLAASEAPAEQVTQEHFDKGLIFPPFTSIRKISAHIAAKVAAKAYELGLASRLPQPENLVAYAESCMYSPKYRIYR

SEQ ID NO: 50305 - protein, 450 aa, Haemophilus somnus 2336
MGIFFGYAAYYFVRANFDLAQKGLIEAGLYNKAELGIIGTGAGLAYGLSKFVMAGISDRSNPKVFLPFGLLLSGLCMTMMGLMPWATSGIAVMFVMIFLNGWFQGMGWPPCGRTMVHWWSKSERGTIASIWNCAHNIGGMVPGLMVLLASAIYFSEFGVQATAKDIWQQALYYPGIAAMICAIPVYFVMKDTPQSCGLPAIEKWRNDYPDDYNEKTYENNLTTKEIFVTYVLKNKLLWYIAIANVFVYLIRYGVLKWSPVYLGEVKHFNIKGTAWAYTIYELAAVPGTLLCGWVSDKVFKGKRGLTGFIFMILTTIAVVALWMNPATPEHELAQYAGKAWYQNPYQLTDFILMTTVGFLIYGPVMLIGLHALELAPKKAAGTSAGFTGLFGYLGGTVSASAVVGWAAEYYGWDGGFYVMITGGILAILLMFITMIEEGKHKAKLDDHYGK

SEQ ID NO: 50306 - protein, 323 aa, Oryza sativa (indica cultivar-group)
MAGRSELVVSFGEMLIDFVPTVAGVSLAEAPAFVKAPGGAPANVAIAVARLGGGAAFVGKLGDDEFGRMLAAILRDNGVDDGGVVFDAGARTALAFVTLRADGEREFMFYRNPSADMLLTHAELNVELIKRAAVFHYGSISLIAEPCRSAHLRAMEIAKEAGALLSYDPNLREALWPSREEARTKILSIWDHADIVKVSEVELEFLTGIDSVEDDVVMKLWRPTMKLLLVTLGDQGCKYYARDFRGAVPSYKVQQVDTTGAGDAFVGALLRRIVQDPSSLQDQKKLEEAIKFANACGAITATKKGAIPSLPTEVEVLKLMESA

SEQ ID NO: 50307 - protein, 378 aa, Oryza sativa (japonica cultivar-group)
KIREQESDHGEDGSAPKAAAVRGGSPRGGVRWWLSVAADMFMVLCGQTVATLLGRLYYNSGGNSKWMATLTQSAGSPLLAILLLFTPAPAADEPRPAAAKMAPIYVGLGIIIGFDNLMYSYALQYLPVSTFSLVAATQLGFNSVTSRLINAQRFTVLIANSVVVLTFSAALLGIGASSDETASSVPRGKYPAGFALTLAASAVFALILSLFEATFEKVVRTRTLRWVLRAQLWTNVVASTVSAVGLLASGDWRTIPAEMAAFKDGRARYVATLVGTAVSWQVMAVGSLRLIVRVSSLFANVTGTLSLPLVPVFAVALFGDRMTGIKAVSMLMAVWGFLSYAYQQYIDGRRAAGAGKGRAAAECRVCAARAGSDPDSPA

SEQ ID NO: 50308 - protein, 204 aa, Yarrowia lipolytica
MPQPTDLRRKLVIVGDGACGKTCLLIVFAKGTFPEVYVPTVFENYVADVEIDGRRVELALWDTAGQEDYDRLRPLSYPDANVIIICFAIDSPDSLDNVQEKWISEVLHFCQGVPILLVGCKVDLRNDPKTIEELRRTSQRPVTTEEGNAVAQKIGAGKYLECSARTHDGVREVFEHATRAALTAHGQKGSKSSSREGKKKCLIL

SEQ ID NO: 50309 - protein, 129 aa, Desulfovibrio desulfuricans G20
MSAKKAIATTKAPGAVGPYSQAILSGDLLFLSGQLPINPQTGTMPEGDIRDRVHQIFANIKAVAESAGASLDDVVKVTVFLADISDFAAVNEVYAQYFSTPYPARSAVQVAALPLKADVEIEAIIRIAE

SEQ ID NO: 50310 - protein, 713 aa, Xanthobacter autotrophicus Py2
MLALVLIIACGLLAVAYGVWAIRELMAADPGTARMQEIAAAIAEGAQAYLKRQYTTIGVVGVVIFVLVGVFLGWLVAVGFAVGAILSALAGFIGMNVSVRANVRTAQAATLSLAGGLDLAFKAGAVTGLLVAGLALLGVTVYFLVLTQILGFAGNSRTVVDALVALGFGASLISIFARLGGGIFTKGADVGGDLVGKVEAGIPEDDPRNPATIADNVGDNVGDCAGMAADLFETYAVTVVATMVLAAIFFAAAPASLATMMVYPLAIGGACIITSIAGTFFVRLGANSSIMGALYKGLMATAGFSIIALAAVTWLLPGFGPIAGADFTGTSLFLCGLVGLAVTGAIVVITEYYTGTGYRPVVSIAQASVTGHGTNIIQGLAVSLESTALPTLVIIAGILFAYGLAGLFGIAIAATTMLALAGMIVALDAFGPVTDNAGGIAEMAGLPKEVRQSTDALDAVGNTTKAVTKGYAIGSAGLGALVLFAAYSQDLKYFIAQAGQGTYFYGVTPNFSLENPYVVVGLLFGGLLPFLFAAMGMTAVGRAAGAIVEEVRRQFREKPGIMAGTEKPDYSRAVDMLTKAAIKEMIIPSLLPVLSPIVCYFVIYFVAGGGAAGKSAAFSAVGAMLLGVIVTGLFVAISMTSGGGAWDNAKKSFEDGFVDKDGVRHMKGSEAHKASVTGDTVGDPYKDTAGPAVNPMIKITNIVALLLLAVLGH

SEQ ID NO: 50311 - protein, 886 aa, Thermoplasma volcanium GSS1
MAQTKKYIYLFEEGGKELVDLLGGKGAGLAEMTKIGLNVPPGFTITTEACIDFLRDGNFPKGMMEQTMDALHMIEEKVSRKFGNPENPLLVSVRSGAPVSMPGMMDTVLNVGLNDETVKGLAFMTDNERFALDAYRRLIQMFGEIVYGLPHEEFRGLIEKVKREKGYDEDKFTTSDITEIIKGENEIYRKHKKSFPQDPQEQLVESIKAVFNSWNSRRAKTYREINHIPENMGTAVSIVTMVFGNMGSDSATGVAFTRDPNTGEKRIFAEYLTNAQGEDVVAGIRTPKYIDDMKMEMPQAYSDLIRMCDILEHHYRDMQDIEFTIERGKLYMLQTRTGKRSAKAAIRIAVEMYEEGIISEEEAIMRVTPEIFDRILHPQVKTNGKETPLGKGLAASPGAAIGSIVFSSERAIELGKSKKMILVRPETTADDVRGMAVCEGFLTQKGGMTSHAAVVARAMGKPAVVGVETMHVDTTNNTLTINGKTLHEGDVVTIDGTSGLFYLGELPVEKPEIDKFSKKLLELADKNRKLGVRANANTPEEAHLARENGAEGIGLARTERMFLGNERIPIMRSMIMSESKEERQKYLEQLLPMQISDFVEFFKTMEGYPVIIRLLDPPLHEFLPDKETILNKIYEIKSGKNGSDELQYYEKLLKTVRDLEEFNPMLGFRGCRVGLVYPEIYDMQVRAIMEAAVRVQKEGRRIMPEIMIPLVGHHNELKILMERLEKTAKSVKDSDQVDYKFGTMIEIPRACVTADKIAKYADFFSFGTNDLTQMTFGYSRDDAEGKFMFFYLENGILEKDPFSSVDEDGVGELMRMAVEKGRKSNEKLEVGICGEQGGDPDTIYFCHKIGLDYVSASPYRIPIARLAAARANISEMKPELASTYRY

SEQ ID NO: 50312 - protein, 107 aa, Aster tripolium
GGHVNPAVTFGAFVGGHISFFKSILYWIAQCLGSVVACLLLKFATGGLETSAFALSSGVGEWNAVVFEIVMTFGLVYTVYATAIDPKKGDLGIIAPIAIGFIVGANI

SEQ ID NO: 50313 - protein, 366 aa, Triticum aestivum
MLGAARRSGCVLGQLMQTLRPAASAATAARSYSATPKEMTVREALNSALDEEMSADPSVFLMGEEVGEYQGAYKITKGLLDKYGPDRVLDTPITEAGFTGIGVGAAYQGLRPVVEFMTFNFSMQAIDHIINSAAKSNYMSAGQISVPIVFRGPNGAAAGVGAQHSQCYAAWYAHVPGLKVLTPYSAEDARGLLKAAIRDPDPVVFLENELLYGESFPIKAEVLDSSFSVPIGKAKIEREGKDVTITAFSKMVGYALQAAEILSKEGISAEVINLRSIRPLDRAAINASVRKTNRLVTVEEGFPQHGVGAEICMSVVEDSFEYLDAPVERIAGADVPMPYAANLERLAVPQVEDIVRAAKRACYRSS

SEQ ID NO: 50314 - protein, 107 aa, Aster tripolium
GGHVNPAVTFGLAIGGNITILTGLFYWIAQLLGAVVASFLLGFVTGGLAVPTHGVADGMNAIQGVVFEIIITFALVYNVYANAADPKKGSFGTIAPVAIGFIVGANI

SEQ ID NO: 50315 - protein, 166 aa, Zea mays
VRKFSMDAGAFDAVVCSHHAHSGKGAVDLGIAVEKACQNITQPLRFLYPLDIGIKDKIEAIAKSYGASGVEYSDQAEKQIEMYTQQGFSNLPICMSKTQYSFSHDASKKGAPSGFVLPIRDVRGSIGAGFIYPLVGTMSTMPGLPTRPCFYEIDIDPETGKVRGLY

SEQ ID NO: 50316 - protein, 453 aa, Synechococcus sp. RS9917
METSFDLVVLGAGSGGLAAAKRAARYGARVAIVEGDRVGGTCVIRGCVPKKLLVYGSRVSEQLQEAPAYGVEIASAQFHTSRLLANVRQEVDRLNALHISLLEKAGVTLVSGWGRFQDPHRIAVSSRPGGEAEQVLQAGRTLIAVGGRPHRPQIPGAELGWVSDDMFLQDQFPERVVIVGAGFIACEFACILSGLGVQVTQLVRGDHLLRGFDRELSAVVQEGMEEKGIALRFCHSPAAIEGAPGDCTVITQAGERLACGGVLLATGRRPFLEGLNLEAAGVAVEGHHIAVDADQATNVPHIHAVGDVTDRICLTPVAVDEGRAYADTVFGRSPRRVDHDLVASAVFSQPELATVGLSEELALERYGAEAIVVHRARFRSMAQALPKSGPRCLLKLVVNKESDRVLGCHMVGEHAAEIIQMAAIAVGMGATKADFDRTMALHPTISEEFVTMA

SEQ ID NO: 50317 - protein, 107 aa, Aster tripolium
GGHVNPAVTFGLAVGGQITIITGVFYWIAQLLGSVAASFLLSFVTGGLAVPIHGCADGVGAIQGMVMEIIITFALVYTVYGTACDPKKGDVGTIAPIAIGFIVGANI

SEQ ID NO: 50318 - protein, 826 aa, Aspergillus nidulans FGSC A4
MSFSVQGKTAIVTGAGSGINLSFAKQLLENGCNVLIADLALRPEAQSLVDQYTAKIPRAVFQRTDVREWKQLEQMFEVAEKEFGEVDIVCPGAGIYEPHWSNFWRPPGTAVSRDPPDGDRYALIDINLTHPIRTSQLAISHFLRSGTDSTRRKAIVHISSIAGQNPFLAAPIYVATKHAINGFVRSLAKLDERCGIRVTAVAPGIIKTPLWTDHPEKLKIVDDTKDAWVTPDEVATVMLALVQQDQANEVIGDSLEQGREGGISYQRRHDLGGVEDGKTSPLLLDRFRGSSSSRLFQSFKGLSRSPSNSASRLSPFSPKMMDVETAVGAVPSDGYRSNSIRARRGVRGKQNPGSHGQASWISCVINLVNTIVGAGVLAMPLAISHMGIVLGISVILWSGVTAGFGLYLQSRCAQYLDKGSASFFALSQITYPNAAVIFDAAIAIKCFGVGVSYLIIIGDLMPGVVQGFVGEAAYDFLVDRHFWVTAFMLIIIPLSYLRRLDSLKYTSIAALVSMAYLVILVVYHFIIGDTKEGRGPIRVIRWAGAVPTLSSFPVIVFAFTCHQNMFSILNEISNNSHFRTTAVVLASIGSSATTYILVAITGYLSFGNSVGGNIVGMYPPGVWATIGRAAIVILVMFSYPLQCHPCRASVDAVLHWRPKRFTRSRSEGSPHRHPLLPAGPRGSRTPEPMSDLRFSVITTSILILSYIVAMSVSSLEAVLAYVGSTGSTSISFILPGMFYYKISAPDSAAHQRLMKEDDEAEDGYISGASEEDGIQSRSLTESGILRRHTRNWRRALLRKLSLGLAIYGVIVMITCLVTNSVFLASH

SEQ ID NO: 50319 - protein, 107 aa, Aster tripolium
GGHVNPAVTFGLAVGGQITILTGIIYVVAQLAGSIVACYLLSFVTGGLAVPIHGVADGVGAIQGVVMEIIITFALVYTVYATACDPKKGALGTIAPIAIGFIVGANI

SEQ ID NO: 50320 - protein, 292 aa, Nostoc punctiforme PCC 73102
MISQNLQEQQPKPPFPEQQQEVPGLESQMNPKPDYGENSYRGSGKLQGKAAIITGGDSGIGRAVALAFAREGADVLIAYLNEEPDAEETVRIVEKEGRKCVAIAGDIQQEAQCQQIVERAQSEFGKIDILVNNAAFQMTRESLDEISSEEFDRTFKTNIYAMFYLCKAAVPHMQPGSAIINTASINAAEPKPKLLAYSATKAAIVNFTGGLAQLLAEKGIRVNAVAPGPVWTPLIPATMPNEQVTQFGQQYPMKRPAQPAELAPVYVLLASSEASYVSGAVIPVTGGQPVLP

SEQ ID NO: 50321 - protein, 107 aa, Aster tripolium
GGHVNPAVTFGAFVGGNITLLRGIVYIIAQLLGSTVACLLLKFVTNDMAVGVFSLSAGVGVTNALVFEIVMTFGLVYTVYATAIDPKKGSLGTIAPIAIGFIVGANI

SEQ ID NO: 50322 - protein, 187 aa, Cucumis sativus
MAMSAAHTLQIPASTAITRRRSITPSAGTAVSLWRRPSPAIPSISSHQMSFKCHAISKCTTEIIGIATDNAPEALGPYSQGIIANNLVYVSGSLGLIPETGQLISDDVGEQTEQALKNVGAILRAGGADYDRVIKTTIMLANVADFTLVNEIYGKYFPNSPAPARSTFAAGALPKNAKIEIDAIAVL

SEQ ID NO: 50323 - protein, 1374 aa, Magnaporthe grisea 70-15
MSFRRLANDATAESAIGSFTHLRPATPFDDEVQTINRAMTLLLDGSSPHEVLLERSSASAAAGDAAQSNNAFSLSREHAYTPRRMRVITIGAGFSGLLMAHKFQHRFPELRDAVQHTIFEALPDVGGTWLVNQYPGLRCDVPAHIYAFPFDPKPDWDRVYATGEDIRGYIMATVRKWGLDENLHLNSRVVAARWLEQDGQWRVTVSHGGVERDEYCEVLISGQGVLRGQNWPSIPGLADFGGHLVHSASWDLEIDYSGKRIAVIGNGASGVQIVPEMARLPGTTVTNFIRGPTWVYSRALEAAEAAAPATCPDPNPKYTPEDKIRFRDPRAHAEYRKGLVAKANKAFCAMRKGEMNIAAANVATAQMAARLGHDKRLCDILIPKWELGCKRVVPGFGYLESFRESNVHLSNSAIVKITKNAIYTADGQVYDVDIIICATGFDTSHLPRYPIIGQDQTTDLASDWKNSPYNYMSVAVPKYPNFFMQMGPRCLGGQGSLIQCLDWTGDYIARWVAKMASENIKYVAPRDDKTRDFMRYGDSIHSGLVWSGGCASSYKRGTVDGPVTVLFGGGIQLFCRLISEIRAEDFDIVYRSPNPWRFMGDGFLDWEFKEDSDLAWYVEVASGPEEDSSRREGEPPEGAPEFVGGSFSTEPAPVPINCQSSLETATNGSNSAESLCQNKLRSQIVDWIRKISTNHRLISRNCNQNNILAVDAYHGLPSATMGARDTQVFPPLFDAKRYCKAPSNTAKCQKARDAPDSIPLEEFMCNEEYGRRPFAKSRNPFTCGLTGRTYTPAELFLRSTHLARALARRTAWGPNDDLTPWDKVVAVFSVNTIDYILPIYATHRLNGIATAANAVYTAGELEHQLRSAGAGVLFTCAQLLDIALQAADAVGMARDRVFLLPTVQGAPETPFPTVEELIDEGRGLAPLEPLRWVSGQGKRQVAFITYSSGTSGLPKAVLISHHNVISNVVAHVAYDSVGRRIHGIETEVELGLVPMSHTYGLLVVSHTATWRGDEVIVLPKFEIKSYLDAIQTFRIQRLLVVPPIIVAMLHRRELCAQYDLSSVRFVFCGAAPLGQETVVRLAREYPAWTVGQAYGMTEAAVIVTNTSEHDVLNGSSGSLLPGTRAKIIDPLTREEITSYNSPGELWIQATAETFVYDSDGRWLRSGDEVCMAISPQGYEHLFVIDRIKELIKVKGQQVAPAELEAHILTHPAVADVAVTQTSDPWAGEVPKAFVVVEAPEYKDLPPGEIENMVVGYVAEHKAPYKWIKGGVEIVDTIPKSPSGKILRRLLRDRERTKAGSEGGKKNANDLGLVNGRQKHLDFPAINLLETVGPRLNSGLNVTQRTPIRKALPKHKLAAAAEELGSLTTVADEFD

SEQ ID NO: 50324 - protein, 158 aa, Triticum aestivum
MDFFLKEKNQSPKSLFLKIGAAPFRRRRHRRSTAAAMPYLQPPRPHPTPRFSRASPPSPFPFFPTGTSRSGRLHPVPVSGHSASRTSTDGIKSLRLITAVKTPYLPDGRFDLEAYDSQINTQINGGAEGVIVGGTTGEGHLMSWDEHIMLIGHTVNCF

SEQ ID NO: 50325 - protein, 298 aa, Haemophilus somnus 2336
MTTHRPLFYGSITALITPMDNHGEVDFNALKKLVEYHIASGTHAIVSVGTTGESATLSIAENVKTILKTLEFADGRIPVIAGTGANATSEAITMTKLLNDSGVAGCLSVVPYYNKPTQEGMYQHFKAIAECTDIPQILYNVPSRTGSDLLPETVGRLAQISNIIGIKEATGDVSRVAKIKQAAGDDFIFLSGDDATGLESMKLGGQGVISVTNNIAAADMAKMCELALAGKFDEAEIINDKLSALHKDLFIESNPIPVKWAAYKLGLIPEPILRLPLTTLSEQSQPKVIEALKNAGLL

SEQ ID NO: 50326 - protein, 206 aa, Thermoplasma volcanium GSS1
MLNIIGIGLRGTGSLTLDEFDALRTSDIVYLDIYTSIGPKDILEKLRNIADREIIPADRNMIESESILKDAEKLNVSLLVIGDGLTATTHNQLRYSAMEKGIKVKIFENASAVNTAAGKIGLLHYKVGPPVSLPFVSSNFFPLSVIDKVKRNYDSGLHTPILIDLKDGQNMPFASAWNIIMEMQKRKGVCNNRRKCMRCLEAFISG

SEQ ID NO: 50327 - protein, 424 aa, Methylococcus capsulatus str. Bath
MPESMHASSRFVSRLTRQTLALILAGGRGSRLQKLTEWRAKPAVPFGGKFRIIDFPLSNCVNSGIRQVGVLTQYKADSLIRHIQQGWGFLRGELGEFIDIMPAQQRLQESWYAGTADAVYQNLDIIRQRDPEFIMILAGDHVYKMDYGLMLAYHVERKADLTIGCMEVPLADAKAFGVMQMDGEQRIRKFVEKPSDPPPMPNRPDHAAASMGIYIFNTAFLFEQLIKDADTPGSNHDFGMDIIPQVIQKYRVFAYRFRNAQSGVQAYWRDVGTVDSYWAANMELIGVDPELNLYDQEWPIWTYQAQTPPAKFVFDDDDRRGMAVDSMVSGGCIISGAEVRHSLLFSNVRVNSFSRVLDSVILPDVNIGRHCRISRAVIDKGCNIPPNTVIGENLEDDRKRFYVSPEGIVLVTPDCLGQRLHFHR

SEQ ID NO: 50328 - protein, 404 aa, Nocardia farcinica IFM 10152
MRSQPHVLGIVLAGGEGKRLFPLTADRAKPAVPFGGAYRLIDFVLSNLVNAGYLRLCVLTQYKSHSLDRHISQTWRLSGFAGEYITPVPAQQRLGPRWYTGSADAIMQSLNLIYDEDPDYIVVFGADHVYRMDPEQMVSHHIDSGAGVTVAGIRVPRSEASAFGCIDSDESGRITQFLEKPAHPPGTPDDPNMTFASMGNYVFTTKVLVDSIRADAENSDSDHDMGGDIIPALVEAGEAGVYDFADNQVPGATDRDHGYWRDVGTIDAFYDAHMDLVSVHPVFNLYNKHWPIRGAAENLPPAKFAQGGLAQECIVGSGSILSAATVRNSVLSSNVVVDDGATVEGSVLMPGVRIGRGAVVRRAILDKNVVVGEGEIIGVDLDRDRERFAVSNGGVVTVGKGVWV

SEQ ID NO: 50329 - protein, 863 aa, Oryza sativa (japonica cultivar-group)
MLGGLKDKLTGKNGNKIKGLAVLMSRKLLDPRDFTASLLDNVHEVFGNSITCQLVSATVADQNNEGRGIVGSEANLEQGLTDLPSVSQGESKLTVRFNWEMDKHGVPGAIIIKNHHSTKFFLKTITLHDVPGCDTIVFVANSWIYPVGKYHYNRIFFANISYPPSQMPEALRPYREDELRYLRGEDRQGPYQEHDRIYRYDVYNDLGEPDRDNPRPVLGGSQKHPYPRRGRTGRIPTKKDPNSESRLSLLEQIYVPSDERFAHLKMSDFAGYSIKAIVQGILPAIRTYVDLTPGEFDSFEDILKLYRGGLKLPSIPALEELRKSFPVQLIKDLLPVGGSYLLKFPKPDIIKENEVAWRTDEEFAREILAGLNPMVIRRLTEFPPKSTLDPSKYGDQTSTITPAHIEKNLEGLSVQQALDSNRLYILDHHDHFMPFLIDINSLDGIFTYATRTLLFLRDDDTLKPLAIELSLPHIEGNLTSAKSKVHTPASSGIESWVWQLAKAYVAVNDSGWRQLISHWLNTHAVMKPFVIATNRQLSVTHPVYKLLQPHYRDTMTINALARQTLINGGGIFEQTVFPGKHALAMSSAVYKNWNFAEQGLPDDLIKRGIAIKDPSSPSKVKLLIKDYPYATDGLAIWQAIEQWVTEYCAIYYPNDGVLQGDVALQAWWKEVREVGHGDLKDADWWPKMQSLPELTKACTTIIWIASALHAAVNFGQYPYAGYLPNRPTISRRPMPEPGSKEYTELDENPEKFFIRTITSQFQTILGVSLIEILSKHSADEIYLGQRDTPEWTSDPKALEAFKRFSRQLVEIESKVLNMNKDPLLKNRVGPANFPYTLMFPNTSDNKGAAEGITARGIPNSISI

SEQ ID NO: 50330 - protein, 468 aa, Novosphingobium aromaticivorans DSM 12444
MPRSRDRLLTQVLNVAQMHAAEQALIAAGTDVHQLMQRAGRGAGEWVRRIAAGRPVTVLCGPGNNGGDGWVIAEYLREHGNPVTVVVAREPGTGAAKTARSLYRGAAVPGDAAVEGEVLVDCLFGSGLTRGLSDDLFELLACLARRHPHRIAIDVPSGVESDSGRPLNAGLPQSTLTIALGAWKHAHFAMPACAMMGVLRLVDIGVNEVPGAARVLARPSISVPAADAHKYRRGMLGIVAGAMPGATILASTAALRAGAGYVKLAASAAPANAPAELVVTSDLSAMLADDRLAALLVGPGFGRGDEAARILARSLHAARPSVVDADGLMLLRPAMLSGTPMVLTPHDGEMAALERAFDLPASGLRRERALALAAASKAVVVLKGPDSVIAGPEGELVVSPRASSWLSVAGTGDVLAGTIASRLAVHGDAMRAAEEGLWLHGEAARIVGSAFTAGELACAVRAAVEECL

SEQ ID NO: 50331 - protein, 248 aa, Mycobacterium sp. JLS
MGDSTLILLRHGESEWNAKNLFTGWVDVDLTDKGRAEATRAGELIADLDRLPDELYTSLLRRAITTANIALDKADRHWIPVHRDWRLNERHYGALQGLNKAETKEKYGEEQFMAWRRSYDTPPPPIEAGSEYSQDRDPRYADIDGGPLTECLADVVARFVPYFEQTIVPDLREGKTVLIAAHGNSLRALVKYLDGMSDEDVVGLNIPTGIPLRYDLDSDLKPTVAGGTYLDPEAAAAGAAAVASQGAK

SEQ ID NO: 50332 - protein, 336 aa, Thermoplasma volcanium GSS1
MALDLEKLKFGTELIKRGFSSMTKGGVIMDVTTAEQAKIAEKAGAVAVMALERVPADIRAAGGVARMADPKKIREILDAVTIPVMAKVRIGHISEAYTLEKLGVDMLDESEVLTPADPFFHLYKKKLTVPVVSGARNLPEAVRRIFEGAAMVRTKGEAGTGNIIEAVRHIRKVNEEIAIVRRMTQDEIKTAAENIASSYFQLRNEASTDLFGQSGKVLYDDVYYGMSREKIVKGISDILRQIRKLNRLPVVNFAAGGVATPADGALMMELGADGVFVGSGIFKSPDPEKMAKSIVEAVENYKDYDVVARVSEGLQGMPGIDIESIPRDSRLQERGW

SEQ ID NO: 50333 - protein, 424 aa, Aquifex aeolicus VF5
MKNEKLYREALQVMPGGVNSPVRAFKAVGGKPIFLVKGRGPRVWDAEGNEYIDFLASWGAIILGHAPKKVVKAVQEEAEKGLSFGLTNPHEVTLAKLVVEMVPSVEKVRFVNSGTEATMSAVRLARGVTGRKYIVKFEGCYHGHYDSLLVSAGSGVATFGIPGTPGIPEEIAKLTIVLPYNDVQALEEAFKEYGSEIAGVIVEPIAGNMGVVPPKKEFLIRLRELTKEYGSLLMFDEVITGFRLSKGGAQELFGIEPDITCLGKILGGGLPVGAYGGRREIMERVAPEGEVYQAGTLAGNPLAMVSGSETLKDLRDKEPYKELEEKMEKLARGVKDILTEKGIQHTINKVGSMMTVFFTDKKVVDFQTAKTSDTELFAKFFRALLNKGVLIPPSQFEAWFLTTAHEEEVIDEALERIRDAVKEL

SEQ ID NO: 50334 - protein, 319 aa, Yersinia pestis CO92
MSKIVSLGIHVLDVLGRHVNRFPPGGELDIINEIRLTVAGTAAGMSVDLAKLGGDVYAMGAVGLDESGNFIIDTLRRYGVNTDHIVRKSEVQTSCSMLPIRPNGERPVLHVLGANATYRLEDIHWDVIASADILHFGGTYLLPGLDGPPTATILKFAKEHGVTTTLDLLVNAQPDLLAKLEPALPYIDYFMPGLDEARAICGLEKRADVIAFFLNRGVGHTVFKMGAEGSSIASLEMAEILIPAYKAQVVDSTGCGDSYCAAFIMGLTKGWDLATSGRFASAAASLVVSGLGSDAGIIDFEHTLKVMNTAETLPIAQET

SEQ ID NO: 50335 - protein, 174 aa, Triticum aestivum
MVYHSSFTDDDGITKACGCPLLPLKTHIKGPAPASDSDKADIVDEAITFFRANVFFKNFHVKSPADKLLIYLTSYINIALKRLESCRTLAVGTKAIINLGLETVPVPGEPGFPFPGLFTLPESQEEAELLRNYLKQIREETSGRLLNCAYRANGTPNKWWLAFAKRKFMNLVIL

SEQ ID NO: 50336 - protein, 131 aa, Synechococcus sp. RS9917
MPLERHPIRTEHANQPVASYSQGYRIGQFVFVSGQMPVDPVTNQTVAGGTAEHTRQCLKNVFGVLEAAGCTYRDVGQAVVYMTNIDEIEEMDAVWQEFFPNADNYCSRAVIGISKLVVGARIEISCIAIKD

SEQ ID NO: 50337 - protein, 520 aa, Geobacter sulfurreducens PCA
MSTDIHTEKILILDFGSQYTQLIARRVREAHVYCELHPFDMGLEAIRAFAPKGIILSGGPKSVYEEGAPAVEEALFDLGVPVLGICYGMQLMSRHFGGEVVPAGKREFGHADLLAAGTPGPLFEGFFVEGKSPVWMSHGDHVSRMPQGFQVVAETANAPVCAIQDTARNLYGVQFHPEVNHTPRGEILIDTFVRKICGCTGQWTPGHIIEDAVNRIRAQVGRERVILGLSGGVDSSVAAALIHRAIGDQLTCVFVDNGLLRLAEGDQVMATFAENLGVKVIRVDAEQRFLTALADEADPEKKRKIIGNLFVEIFEEESSRIEGATWLAQGTIYPDVIESAGAKTGKAHNIKSHHNVGGLPEYMKLKLLEPLRELFKDEVRAIGEELGLPRQMVWRHPFPGPGLGVRILGEVKKEYADILRRADAIYIEELYAAGHYDKISQAFAVFLPVKSVGVMGDGRTYEYVIALRAVETKDFMTAGWYPLPYEDMARISGRIINEVKGVNRVVYDISSKPPATIEWE

SEQ ID NO: 50338 - protein, 287 aa, Bordetella bronchiseptica RB50
MTLPASPPRYAVIGNPIAHSRSPQIHAMFSAQTGRPLRYERLLAPVDGFLPTVQAFRESGGLGLNVTVPFKLEAYALAEARLSERARLAGAVNTLSWRDGAWHGCNTDGVGLVNDLLRLGVALAGARVLLVGAGGAARGVLQPLAAAGCARIHIVNRTAARAAELAAAWRAAAPRTGTQVSAGALAQAAEPGGWDVAINATASGLQDAAPDLPGGLYAPDALAYDMMYGARPTAFMRQAEADGAARCADGLGMLVGQAAESFHIWHGVRPDPGPVLLALRTELLAAG

SEQ ID NO: 50339 - protein, 336 aa, Sulfobacillus acidophilus
MIRVGINGFGSIGRRFLRIALTRDDMEIVAINDLTDAKTLAHLLKYDSNYGPLPVEVSAGPESTIRVGSRTIQVLSERNPGNIPWKNFGVDLVIESTGLFTKAEKARAHIDEGGARRVIISAPADGEDATLVIGVNHHEYDPGHHYVISNASCTTNCLAPVAKVLHDQFHIEAGLMTTVHSYTNDQRLLDLPHSDLRRARAAGQNIIPSSTGAARALHKVIPALKGRMNGMALRVPTSVVSIVDLTVTTAKPVSVDAVNQALAEAANGSLKGVLQVTDEPLVSSDFRGNPHSSIVDARETMQIGDNMVKVLAWYDNEWGYANRLVELAAYVGQQEG

SEQ ID NO: 50340 - protein, 381 aa, Thermoplasma volcanium GSS1
MLSQRLQYVNESATVSASNYVEKLKKQGIKVYNFGIGEPDFTTPQHIIEYAFEMAKEGKTHYTPSNGIHELREKVSEKLKNRNNINASPDEVLITPTKFGINLAMMVILNPGDEVLIPEPYYVSYPDIVRLAGGKPVTVSTLEDYSLDFDLMRKYVTPKTKAIIFNNPTNPTGKVYDEKEIKSLVDFALEYGLYIVSDEIYEDLIYNGKLISPASYSEMWGKSITLNGFSKGYAMTGWRIGYMAAPREIVEAANVIQQQTITCVSSISQYAALRALDDTESPKKMKDEFKRRRDLILSILDSSDKLNVTEPDGAFYVFPEYNSDISSNKVSEDLLEKYQVVVTPGSAFGRQGEHHFRISFATSEDIIKEGAERIIKFFASV

SEQ ID NO: 50341 - protein, 673 aa, Sulfobacillus acidophilus
MAINNPSAELDQRMINTLRTLAIDAVEQANSGHPGMPMGAAPMAHVLWTRFLRHNPKNPRWVNRDRFILSAGHGSMLLYALLYLTGYDISLDDLKRFRQWGSKAAGHPEYGWTPGVETTTGPLGQGFATGVGMAIAERHLAARYNQPGFPLIDHYTYAIVSDGDLMEGIASEAASLAGHLKLGKLIYLYDNNHISIEGTTDVAFTENVGARFKAYGWHVLTVDDGNDIQAIHEAIVSARSTPDQPSLIMVRTHIGYGSPNKQDTPDAHGAPLGKEEARLAKQAYGWPEDQPFWVPTEVLSQYRTQESLGPLWERQWQTLWREYQQKFPELARSLRSIWEADSPSWPDVPPFPSGQEMATRTASGRVINLIADQRPHFIGGSADLGPSNETRIKNGGDFTPDTPDGRNLHFGVREHAMGALLNGISLHGEFRVFGGTFLIFSDYMLPAMRLAALMHQPVTYVLTHDSIGVGEDGPTHQPIEQVTHLRAIPNLVLIRPADANETREAWRLAFTSQSRPVALALTRQKVPVLDADRTTGVAQGAYILEDASTGRPRCILLASGSEVHLALAARQTLEAKGIPTRVVSMPSWALFEEQSDEYRQRVIPPDVPARIAIEAASPLGWDRYVGPQGQILAMRRFGASAPGPELYRQFGFTPENIVAIAESLVASLDLDRV

SEQ ID NO: 50342 - protein, 372 aa, Thermoplasma volcanium GSS1
MPTRLPIKDRFDDHAHSLSFPVFFTSSYDSRKDRKYRYSRELNPTVEELSRQLSLLENTERSICFSSGMGAITGTILALAKPGDKLVMPTDVFGRTYLFAKNFLTKFGINVKFVEPGTDSLLGAVEEHADIVFFESLSNPLLRLYDVDRICRKASDIGAITIVDNTLATPILLKPSLYGCDIIIESLSKFIGGHNNAIGGSASGSLMMDTIDENRRSLGSSMDPMSAYLFILGLKTIDLRIKRSSETAKAIARFLNENNFVSKVYYPGLSDNSDNISAKTLLNGSPPIVSFLLDEGKDVQKFMESLRIITPANTMGGSNSTISNPYTMSHRNLSEDEKLRLGITKNLMRLSVGLEDLDQIIQDLEQAIKYAQ

SEQ ID NO: 50343 - protein, 376 aa, Saccharomyces cerevisiae
MTLAPLDASKVKITTTQHASKPKPNSELVFGKSFTDHMLTAEWTAEKGWGTPEIKPYQNLSLDPSAVVFHYAFELFEGMKAYRTVDNKITMFRPDMNMKRMNKSAQRICLPTFDPEELITLIGKLIQQDKCLVPEGKGYSLYIRPTLIGTTAGLGVSTPDRALLYVICCPVGPYYKTGFKAVRLEATDYATRAWPGGCGDKKLGANYAPCVLPQLQAASRGYQQNLWLFGPNNNITEVGTMNAFFVFKDSKTGKKELVTAPLDGTILEGVTRDSILNLAKERLEPSEWTISERYFTIGEVTERSKNGELLEAFGSGTAAIVSPIKEIGWKGEQINIPLLPGEQTGPLAKEVAQWINGIQYGETEHGNWSRVVTDLN

SEQ ID NO: 50344 - protein, 368 aa, Burkholderia mallei ATCC 23344
MKTKAAIAWKAGEPLTIEEVDLEGPRAGEVLIEVKATGICHTDYYTLSGADPEGIFPAILGHEGAGVVVDVGPGVGTLKKGDHVIPLYTPECRECKFCLSRKTNLCQKIRATQGRGLMPDATSRFSVGGKPIFHYMGTSTFSNYIVVPEIAVAKVREDAPFDKICYIGCGVTTGVGAVVYSAKVEAGANVVVFGLGGIGLNVIQGARMVGADKIIGVDLNPKRVELARKFGMTHFINPNEVENVVDHIVQLTDGGADYSFECIGNVKVMRQALECTHKGWGQSFIIGVAAAGEEISTRPFQLVTGREWKGSAFGGARGRTDVPKIVDWYMEGKINIDDLITHTLPLEKINEGFELMKKGESIRSVVLY

SEQ ID NO: 50345 - protein, 257 aa, Bradyrhizobium sp. BTAi1
MYLEKFKLDGKTALITGGAQGIGLACVEALAEAGAHVVIADRDAKAAADAQAAMKARGFDTATALMDVTNSAQVTQIADDLAARHGKVDILVNNAGIARSETPAETVTDEHWLNVLDVNLNGTFWCCRAFGKHMLAAKSGTIVNIGSMSGFIVNKPQEQCFYNASKAAVHHLTKSLAAEWGARGIRVNAVAPTYIETPLNAFVKNNPRMYDAWIGGTPMGRMGQVEEIASVVLFLASEAASLMTGSVVVVDGGYTCW

SEQ ID NO: 50346 - protein, 174 aa, Nitrosomonas europaea ATCC 19718; identical to SEQ ID NO: 1094

SEQ ID NO: 50347 - protein, 373 aa, Nocardia farcinica IFM 10152
MRPPVVSRGRVSSLLPDFPWDTIAAVKAKAAAHPGGIVDLSVGTPVDPVAPVIRTALDSVAEVPGYPTTHGTPELRAAAVDALKRRYGVTGVDPAAVLPVIGTKELIAGLPRLLGVGPADLVVIPEIAYPTYEVGALLAGAQILRADGLTRLGPQSPALIYLNSPSNPTGRVLGVEHLRKVVAFARERGAVVASDECYLGLSWDARALSILDPQVCDGDHTGLLAIHSLSKTSNLASYRAGFVAGDPELVAELLEVRKHSGMMVPFPIQAAMTAALADDTHEAQQRERYRVRREQLRAALTAAGFRIDHSEAGLYLWSTRGENARTTLDWLAERGILAAPGDFYGPASGEHVRIALTATDERIAAAVARLTTN

SEQ ID NO: 50348 - protein, 315 aa, Bradyrhizobium sp. BTAi1
MILSCGDALIDFVPARLADGRDGLRPVVGGSCLNVPVGLARLGAPAGFVGGISTDLFGSMIAAHAQASGVDLSHATRSADQTTLAFVRHVGGEAQYAFYDAETAARKWTYRHGSIPFTSIDAIHVGSTTLIHDLGAAETRALIAATQGGVTISFDPNCRPNLVQDKAAYRVQMDGFAASADLIKMSDVDFDYLHGHDDYAARAEALLARGAKLVVVTRGPKGALGWHAGAGAAEVAAPAVEVVDTIGAGDSFQAGLLFALHRLGRLGKAALAELTATELRKVLAFAAACAAVTCTREGADPPRWADMTATWNDLG

SEQ ID NO: 50349 - protein, 421 aa, Bradyrhizobium sp. BTAi1
MAPAARTEPLSRHALAFVLAGGRGSRLLELTDRRAKPAVYFGGKSRIIDFALSNAVNSGIRRIAVATQYKAHSLIRHLQMGWNFFRPERNESFDILPASQRVSETMWYVGTADAVYQNIDILETYNTKYIVVLAGDHIYKMDYELMLQQHVDQRADVTVGCLEMPREESSGFGVMHINEDDTIRDFIEKPADPPPMPGKPDKSLASMGIYVFDAKFLFEELKRDAGDPNSNHDFGRDIIPYIVKNGRAVAHQFSRSCVRAGHDQTSYWRDVGTVDAYWAANLDLTDVVPELDLYDRSWPLWTYSEITPPAKFVHDTDGRRGEATCSLVSGGCIVSGAQVQRSLLFTGSHLHSYAKVHNAVLLPYVNVARHARLTNVVVDRGVQIPEGLVVGEDPEFDAKRFRTTENGVTLITQPMIDGLNS

SEQ ID NO: 50350 - protein, 191 aa, Clostridium perfringens SM101
MKKVLVFLAEGFETIEALSVVDVCNRAKVTCHACSLTENRTVNSAHGTMVLCDKLISDNDLETYDAIVLPGGMPGSTNLRDNEKVQSLIKKYNEENKIVAAICAAPIALAKAGVIEGKKVTSYPGFKEELGNVNYVEEDTVVVDGNTITSRGPATALVFGLEILKKLGYEKEAEEIREGMLINFFLEKECK

SEQ ID NO: 50351 - protein, 345 aa, Bradyrhizobium sp. BTAi1
MKALVYHGPGQKSVDERPKPTILEPGDAVVKILKTTICGTDLHILKGDVPTCTPGRILGHEGVGVVEAVGSAVRAFKPGDHVIISCISACGTCDYCRRGMYSHCRHGGWILGNKIDGTQAEYVRTPHADTSLYHVPPGTEEEALVMLSDILPTGFECGVLNGKVEPGSTVAIVGAGPIGLAALLTAQFYSPAEIIMIDLDDNRLEVAARFGATSTINNADGKAVEKVMALTHGRGVDTAIEAVGVPATFVTCEDIIAPGGTIANVGVHGVKADLHLEKLWDRNIAITTRLVDTVTTPMLLKTVQSKKLEPKLLITHRFRLDQILDAYETFGAAARTHALKVLIEA

SEQ ID NO: 50352 - protein, 507 aa, Novosphingobium aromaticivorans DSM 12444
MTVAEAETYWTALAGLPRPTLKELFSDAGRLDRYAATLDLPGGPIRFDWSKTHLSAEVEAVFAALASAMDFEGRRAALIEGAKINNTEGRAAEHTAQRGIGNEASVEEAEALHARMRMLVDAIHAGALGEVRSLIHIGIGGSALGPALAIDALTRDGAKVAVHVVSNIDGCALEAAMKACDPATTMIAVASKTFTTTETMTNAASALEWLRENGVADPYGQVVALTAAPEKAVEWGVDETRVLPFSETVGGRYSLWSSIGFPVAMALGWEGFAAFLDGAAAIDRHFIDADLAGNVVVRAAFADLYYTQVRGCQTRAVFAYDERLALLPDYLQQLEMESNGKRVLADGSPLTRPSAPVTWGGVGTDAQHAVFQLLHQGTHLIPVDFLAVKTQGHDLDPAHHQILLSNCFAQGAALMAGKASDDGARAYPGDRPSATILCDDLNPATLGALIAFHEHRTFVSAVMLGINPFDQFGVELGKAIAKQIESGGGEGFDPSTEALLAAVGLAG

SEQ ID NO: 50353 - protein, 453 aa, Novosphingobium aromaticivorans DSM 12444
MAEQEFDYDLFVIGAGSGGVRASRIAASHGARVAVAEEYRVGGTCVIRGCVPKKLLVYGSHFAEELQDAANYGWTVEKMSFDWPTLRDAVLKDVDRLNTAYTSTLENNKVERFLERATVTGPNTVRLGGSGREISARYILVATGAWPVMPDFPGNEHCITSNEVFHLENLPKRVVISGAGYIAMEFAGIFNALGCHVTVVNRSETILRGYDESLRDRLLQITMARGIEYKFNCPFEKVEKQADGSLQVFLAGQPDPLAADIVLVATGRLPKTDGLGLETAGIELGAQGEIPVDDHGRTACDSIYAVGDVTNRVQLTPIAIREGHAFADRVFGGKDTSVSYDCIPSAVFSQPPLAGVGLTESQARQAFGGNIKVYSSDFRPMKNIFGHRPERGLYKMIVEATSERVLGIHMIGPEAPEILQAAAIAVKAGLTKADFDATVALHPSMAEELVLMR

SEQ ID NO: 50354 - protein, 193 aa, Exiguobacterium sibiricum 255-15
MRRGTSERVSSESEIKVAVDLSGGPVEIKTGVGFFDHMLTLFAFQARIGLVIEAKGDLWIDAHHTVEDTAIVLGAALTEALGDKAGIERYGESRVPMDETLASVVLDFSGRPYTVFLAEFKNPKLGDFDTELAEEFFQGLSRSARMTIHAQVLYGSNTHHMIEGLFKALGRAVRQAVAVTGDGVPSTKGLIDQ

SEQ ID NO: 50355 - protein, 311 aa, Arabidopsis thaliana
MAALSDKLADAYQNARPRYPIDWFTKLAARTGQHKSAWDVGTGNGQAAIGLAEYFEKVTATDINEAQLKRAVKHERISYHHTPTTMSEDQMVALVGGDNSVDLIVAAQAVHYFDLAPFYNVAKRVLRKEGGLIAVFVYNDIIISPEVDSIMKRLVDSTFPFRTPVMNLAFDGYKTLPFPFESIGMGSEGKPIMLDIPHKLSLKGFIGFLRSWQPAMKAKERGVELVTEDLISKFEDAWGDDDDVKDIFYKAHMIVGKLSASDIERHRKRFDTNCVVTTLKDHNNSAVIASVTAAAFAGVAAYCAYSARKNS

SEQ ID NO: 50356 - protein, 107 aa, Exiguobacterium sibiricum 255-15
MIELNFSKGLVAAVILDETTNDVLMVGFMDQAAYDKTLATGLVTFFSRTKNRLWTKGETSGHTLELRRMWIDCDQDSLLITVKANGPTCHTGNRTCFYTEVEVPHAT

SEQ ID NO: 50357 - protein, 100 aa, Brassica napus
  misc_feature (3)..(3): Xaa can be any naturally occurring amino acid
  misc_feature (51)..(51): Xaa can be any naturally occurring amino acid
  misc_feature (59)..(60): Xaa can be any naturally occurring amino acid
  misc_feature (67)..(67): Xaa can be any naturally occurring amino acid
  misc_feature (69)..(69): Xaa can be any naturally occurring amino acid
  misc_feature (75)..(75): Xaa can be any naturally occurring amino acid
GLXFKSLRDKQPVDLEKAKEETQKIQEVTKESVGSESRRNIYLGLIGIVAXAIADSFVXXPDWRKVXVXGAILVXLLTQFVNEQTLLSEEAGKGKGNKKE

SEQ ID NO: 50358 - protein, 375 aa, Arabidopsis thaliana
MNEEEAPSEQKKTLSLVPSPTTNLFLPDDILLSSLSRISRLYYPTFSLVSKSFRSLIASPELYQTRSILGRTESCLYVSLRLLNDSNLRWYTLCRVPDRKLTNFSGGHLLVPILSRYAPPAHWSSVVAVDYNIYAIGGPINDAPSSSVSVLDCQCEKWREAPSMRVARNYPTATVLDGKIYVAGGCEDCTSLDCIEVFDPKTQTWDSVASPGTERCERLVYKSVGIEGKYHLFGGAGHVAYDPKEGRWDSVGMDMEMGRTWVSYCVINNILFYYNDREFKWYDYKGRFWRKLMGLERLIKFLCYSRVNLAAYGEKMAVLWDTFVPSSSKNKMIWCAEITIERHDIYEICGKTEWFDVVLRVPKSYELVHVLAATV

SEQ ID NO: 50359 - protein, 167 aa, Burkholderia sp. 383
MILIAMGVSGAGKSLIGEMLAERLSCSYTDGDAFHSAANKEKMHNGIPLTDDDRWPWLRTIRAAIEEKQRAGETAVFTCSSLKRSYRDVLRGTDTDVRFVYLKGTFEMLHERLKSRTGHFFDPSLLKSQLDTLEEPGPDEAIEVSIELTPEQIVDQVMLKIGIAQQH

SEQ ID NO: 50360 - protein, 182 aa, Pisum sativum
MSYYHHHHHHDYDYPTTENLYFQGAMDPEAELERTFIAIKPDGVQRGLISEIISRFERKGFKLVGIKVLIPTKQFAQQHYHDLKERPFFNGLCDFLSSGPVIAMVWEGEGVITYGRKLIGATDPQKSAPGTIRGDLAVVVGRNIIHGSDGPETAKDEIKLWFKPEELVSFTSNSEKWIYGDN

SEQ ID NO: 50361 - protein, 261 aa, Physcomitrella patens
MVEKVVVSSLRRKRGGNLLAPLKRNVSSIAKKSSTPKSGKPVGSPKVYKGVRMRTWGKWVSEIREPNKRSRIWLGSFPTAEMAAKAYDAAAVCLRGRSVKLNFPDSPPRCAARCNSPREVQAAATAAAVACIPSATALTVANFQSPAQTLESSPLHSSPSSSDMSSGDEDSGEDSVQSFVAEGSQISPSEVVPVLEWVKVEFGDKETVAAGDVDFDCDYSFISEFAADSLLACSYNSKGRTEYLPIETHDAALYDSTLWFF

SEQ ID NO: 50362 - protein, 1118 aa, Hordeum vulgare
MDCLRLAVAAAALLLAALAAAADDAQLLDEFRMALPSQAPLEGWTAREGACRFPGAVCRGGRLTSLSLAAVTLNADFRAVANTLLQLSAVERLSLRGANVSGALAAARCGGKLEELDLSGNAALRGSVADVAALAGSCGALRTLNLSGDAVGAAKPAGGGGGGQGFAALDALDLSSNKIAGDADLRWMVGAGLGSVRWLDLAWNKISGGLSDFTNCSGLQYLDLSGNLIAGDVAAAALSGCRSLRALNLSSNHLAGAFPPNIAGLTSLTALNLSNNNFSGEVPADAFTGLQQLQSLSLSFNHFSGSIPDSVAALPDLEVLDLSSNNFSGSIPDSLCQDPNSRLRVLYLQNNYLSGSIPEAVSNCTDLVSLDLSLNYINGSIPESLGELSRLQDLIMWQNLLEGEIPASLSSIPGLEHLILDYNGLTGSIPPELAKCKQLNWISLASNRLSGPIPSWLGKLSNLAILKLSNNSFTGKIPAELGDCKSLVWLDLNSNQLNGSIPPELAEQSGKMTVGLIIGRPYVYLRNDELSSQCRGKGSLLEFSSIRSEDLSRMPSKKLCNFTRMYMGSTEYTFNKNGSMIFLDLSFNQLDSEIPKELGNMFYLMIMNLGHNLLSGAIPTELAGAKKLAVLDLSHNRLEGQIPSSFSSLSLSEINLSSNQLNGTIPELGSLATFPKSQYENNSGLCGFPLPPCESHTGQGSSNGGQSNRRKASLAGSVAMGLLFSLFCIFGLVIIAIESKKRRQKNDEASTSRDIYIDSRSHSGTMNSNWRLSGTNALSINLAAFEKPLQKLTLGDLVEATNGFHNDSLIGSGGFGDVYKAQLKDGRVVAIKKLIHVSGQGDREFTAEMETIGKIKHRNLVPLLGYCKIGEERLLMYDFMKYGSLEDVLHDRKKIGVRLNWAARRKIAIGAARGLAFLHHNCIPHIIHRDMKSSNVLVDENLEARVSDFGMARMMSVVDTHLSVSTLAGTPGYVPPEYYQSFRCTTKGDVYSYGVVLLELLTGKPPTDSTDFGEDHNLVGWVKMHTKLKITDVFDPELLKDDPTLELELLEHLKIACACLDDRPSRRPTMLKVMTMFKEIQAGSTVDSKTSSVATGLSDDPGFGVMDMTLKEAKEEKD

SEQ ID NO: 50363 - protein, 427 aa, Bordetella bronchiseptica RB50
MSTNAELFDRACRSIPGGVNSPVRAFRSVGGTPRFIQRAQGPYVWDAEGKQYIDYVGSWGPAILGHAHPEVVRAVQEAAVHGLSFGAPTEAEVELAEMLIARLPSLEQVRLVSSGTEATMTAIRLARGATGRHKIIKFEGCYHGHSDSLLVKAGSGLLTFGNPSSAGVPPEFVAHTLTLEFNNLAAVDAAFSQHGAEIACVIVEPVAGNMNLIKPAEGFLAGLRELCTRHGAVLIFDEVMTGFRVGPQGVQGLTGVRPDLTTLAKVIGGGMPVGAFGGRADLMAHIAPLGGVYQAGTLSGNPVAVAAGLATMRLIGEPGFYERLSAQTARLAQGLQERARAAGVPFSADAIGGMFGLYFGDRVPASFAEVSACDTEAFKRFFHAMLERGIHFAPSAFEAGFVSATHDDAVIDATLEAAEQVFATLRA

SEQ ID NO: 50364 - protein, 567 aa, Saccharomyces cerevisiae
MASEQSSPEINADNLNSSAADVHVQPPGEKEWSDGFYDKEVINGNTPDAPKRGFLGYLIIYLLCYPVSFGGFLPGWDSGITAGFINMDNFKMNFGSYKHSTGEYYLSNVRMGLLVAMFSVGCSIGGVAFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYSNTAQWRIPVGLCFLWALIIIVGMLLVPESPRYLIECERHEEACVSIAKIDKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAASMMACMVIFASIGVKCLYPHGQDGPSSKGAGNAMIVFTCFYIFCFATTWAPVAYIVVAESFPSKVKSKAMSISTAFNWLWQFLIGFFTPFITGSIHFYYGYVFVGCLVAMFLYVFFFLPETIGLSLEETQLLYEEGIKPWKSASWVPPSRRGASSRETEAKKKSWKEVLKFPKSFN

SEQ ID NO: 50365 - protein, 534 aa, Debaryomyces hansenii CBS767
MRGEPTLPDWVTIISGYSSIISSVIIFSSIILHLRNYRKPFQQRLMIRIQLIVPLFALSCFSMLKNPESLFNRYLLESIREVYEAFVIYTFFSLLTDMLGGERNIIIMTSGREPVDHPGILRCILPAIDISDPTTFLIIKRGILQYVWLKPVICVSTILTELIGWYNVNDVSATSTYLWLTILYNLSVTTSLYCLAMFWKVLWNDLKPFKPVGKFLCVKLIIFASYWQGVMLAILNFSGVLPGSASTKANNTNIGVYIQDALLCVELIAFAIGHWHSFSYKPFTISAIPNGRLEFYYAVKDMFGIKDLVHDFKLTFHGDYYKDYKRFDSVEAITAHPESKGRMSRINQGLRYHGDGKHKHWLPNNQSPVQSSTNVRSTSEANALLYQPLLGSTLQYAPSLNSTGTSTRGIYPSSPKNITPPDSPVVPASAGTFNLTNGPTITEVLNTNEISYDKELLDEDEIYYQNACSVINNYRLDQNEVKKLINYPIVDEVVDGHMFGYKVKKLRADRIRQQQRNDNSSNGGNKNNYYGSIA

SEQ ID NO: 50366 - protein, 357 aa, Saccharomyces cerevisiae
MSQNSNPAVVLEKVGDIAIEQRPIPTIKDPHYVKLAIKATGICGSDIHYYRSGGIGKYILKAPMVLGHESSGQVVEVGDAVTRVKVGDRVAIEPGVPSRYSDETKEGRYNLCPHMAFAATPPIDGTLVKYYLSPEDFLVKLPEGVSYEEGACVEPLSVGVHSNKLAGVRFGTKVVVFGAGPVGLLTGAVARAFGATDVIFVDVFDNKLQRAKDFGATNTFNSSQFSTDKAQDLADGVQKLLGGNHADVVFECSGADVCIDAAVKTTKVGGTMVQVGMGKNYTNFPIAEVSGKEMKLIGCFRYSFGDYRDAVNLVATGKVNVKPLITHKFKFEDAAKAYDYNIAHGGEVVKTIIFGPE

SEQ ID NO: 50367 - protein, 448 aa, Clostridium perfringens SM101
MEVKKYVDNLMEDLKKNNPGESEFLAAAEEVLYSLVPVLEKNPKYIEEGILERIVEPERVIMFRVPWVDDAGNVRVNRGYRVQFNSAIGPYKGGLRFHPSVNLSIIKFLGFEQIFKNSLTTLPIGGGKGGSNFDPKGKSDREIMRFCQSFMSELYRHIGPNTDVPAGDIGVGGREIGYMFGQYKKLKNSVDAGVLTGKGLTYGGSLARKEATGYGLVYFVDEMLRDNGQTIEGKTVVISGSGNVAIYATEKVQELGGKVVALSDSLGYVYDENGIDLEIVKEIKEVKRGRISEYVNYVKTAKFTEGFSGIWNVKCDIALPCATQNEIDKSSAKTLIDNGVIAVGEGANMPSTLEAQKLFVDNKILFAPAKAANAGGVATSALEMSQNSLRMSWTFEEVDAKLKDIMKNIYYNSKNAASEYGHNGNLIVGANIAGFKKVADAMLDHGII

SEQ ID NO: 50368 - protein, 632 aa, Nocardia farcinica IFM 10152
MSSARDFRNVAIVAHVDHGKTTLVDAMLRQSGAFAERAEPVDRVMDSGDLEREKGITILAKNTAVHRHHPDGSVTVINVIDTPGHADFGGEVERGLSMVDGVVLLVDASEGPLPQTRFVLRKALAASLPVILVVNKTDRPDARIAEVVEESHDLLLDLASDLDDEAAEAAELALDLPVLYASGREGKASTERPENGNAPDAPNLDALFDVLLKHVPAPKGDAQAPLQAHVTNLDASPFLGRLALVRIHNGTLKKGQNVAWMSAEGTKTVKITELLATVGVERNPAEEAEAGDIVAVAGIPDIMIGDTLADPDNPVALPRITVDEPAISVTIGINTSPLAGRNGGTKLTARLLKARLDQELVGNVSLRVLNTDRPDTWEVQGRGELALAILVETMRREGFELTVGKPQVVTRMVDGKVHEPFEELTIDVPEEHLGAVTQLLAARKGKMVQMTNQGHGWVRMEFIVPSRGLIGFRTDFLTETRGTGIANAVAHGYAPWAGEIRSRHTGSLVSDRAGSVTAYAMLQLADRGTFFVEPGAETYEGMVVGINPRAEDLDINVTREKKLTNMRSSTGDVLETLARPLVLDLEGALEFCAADECVEVGPDVVRVRKVILNANERARELSRRKARDRAAL

SEQ ID NO: 50369 - protein, 583 aa, Corynebacterium efficiens YS-314
MNQPPQDRWGTTLSGARNTMSPTTAPAQAAKPARPARKPKPEGQWKIDGTAPLNHVEEVKQDEAAFEVKQRVIDIYSKQGFSSIHPDDIAPRFKWLGIYTQRKQDLGGELTGQVPDAELQDEFFMMRVRFDGGQASPERLRVVGEISRDYARSTADFTDRQNIQLHWIRIEDVPTIWEKLESVGLTTMLGCGDVPRVILGSPVAGVAAEELIDATPAIDAIRERYLDRDEFHNLPRKFKSAITGNARQDVTHEIQDVSFVPSVHPEHGVGFECFVGGGLSTNPMLAQPLGAWIPLDEVPEVWAGVAGIFRDYGFRRLRNRARLKFLVAQWGIEKFREVLETEYLERTLIDGPEITTNPGYRDHIGIHPQKDGKFYLGVKPTVGHTTGEQLIAIADVAEKHGISRIRTTADKELLFLDIEREKLTEVARDLDEVGLYSSPSEFRRGIISCTGLEFCKLAHATTKSRAIELVDELEERIGDLDVPIKIALNGCPNSCARTQVADIGFKGQTVTDADGNRVEGFQVHLGGSMNLDPNFGRKLKGHKVIADEVGEYVTRVVTKFKEQRTEGEQFREWVQRAAEEDLS

SEQ ID NO: 50370 - protein, 256 aa, Oceanobacillus iheyensis HTE831
MCLITFAIQKHSEYPFILIANRDEFYDRPTAKASFWDDAPAILAGRDLKSKGTWLGITKQGKIAAITNYRNPSLPETGTYSRGKIPVDFLNNEIDASHFLSRLEENKSLYAGYNALFGNYQNLYTYNNIYNSSEQLVSGIHSLSNDKLNTPWPKVVKARGLLQNHLESNQDISNEALFRILQNADKPNDQDLPDTGIGLQLERNLSSMFIDTGNYGTRASTIILIDKNNDATFIERTYHQGNVIEDKNYYFSIVSD

SEQ ID NO: 50371 - protein, 264 aa, Triticum aestivum
  misc_feature (166)..(166): Xaa can be any naturally occurring amino acid
MTSLPERGAAPPSNPTPSSSREGDAAVASSSSSASEEQKKDGSPKQCKASILSSVLTIFEPDQDQSGRSGGHASGSYAWSRVLRRFVGGGSMWRFLGCGKALTAGDVWFLGKCYKLSSEESSSDSDSEGGHAAFLEDFSSRVWITYRKGFDAISDSKLTSDVNWGXCMVRSSQMLVAQALIFHHLGRSWRKPAQSPSDPEHTRILHLFGDSEVCAFSIHNLLQAGKSYGLAAGSWVGHIYVGKLSDKQRAPEINRMKSYGAYVA

SEQ ID NO: 50372 - protein, 186 aa, Glycine max
MGDDSGSNRSKPEWLQQYDLIGKIGEGTYGLVFLARIKSSTNRGKSIAIKKFKQSKDGDGVSPTAIREIMLLREITHENVVKLVNVHINHMDMSLYLAFDYAEHDLFEIIRHHRDKVNQSINQYTVKSLLWQLLNGLNYLHSNWIIHRDLKPSNILVMGEGEEHGVVKIADFGLARIYQAPLKPLS

SEQ ID NO: 50373 - protein, 454 aa, Novosphingobium aromaticivorans DSM 12444
MTQLPRVCIIGAGCSGFTTAKCLQDYGIPFVVYEASDDIGGNWYFNNPNGMSACYQSLHIDTSKWRLAFEDFPVPAEWPDYPHHAQLLQYFHGYVDHFDLRPHIRFNTRVEKATRRDDGGWKIRLSTGEVERFDALVVANGHYWAARIPEYPGHFDGPQIHSHAYRSPFDPIDCVGKRVLVVGMGNSAMDIASELSQRPIASRLFVSTRRGVWVLPKYYRGQPLDKNPAPAWMPKGLRNWIATRMIKKLVGRMSQYGLPEPEIGPFESHGTVSGEFLLRAGSGDIAMKPGIERLDGNAVIFSDGTREEIDAIVWATGYDIRFPFFDDPELVADADNRPPPLYKRILKPGMPDLFYVGLAQPLPTLVNFAEQQSKLVAAYLAGQYAPPPPDEMHRIIAEDEAYYTGQYYAARRHTIQLDFDHYVRALKKELAAGSKRAKASGGALPVLPRNLEPA

SEQ ID NO: 50374 - protein, 428 aa, Burkholderia sp. 383
MSSQLQSIPSYLHADDLGPWGNYLQQVDRVAPYLGSLSRWLETLKRPKRILIVDCPIELDNGTVAHFEGYRVQHNVSRGPGKGGVRYHQDVTLSEVMALSAWMSVKNAAVNVPYGGAKGGIRVDPRKLSRGELERVTRRYTSEIGIIIGPNTDIPAPDVNTNEQVMAWMMDTYSMNQGQTSTGVVTGKPIALGGSLGRKEATGRGVFVVGSEAAKKKGLEIEGARIAVQGFGNVGGIAAKLFQEAGAKVIAVQDHTGTIYQPAGLDSNKLLDHVARTGGVAGFEGAEPMPNDEFWTVETDILIPAALENQITEKNAGKIRTKIIVEGANGPTTTAADDILTANGVLVIPDVIANAGGVTVSYFEWVQDFSSFFWTEDEINHRLERVMREAFSGVWAVAEEHKVSVRTAAFIVACKRILMAREMRGLYP

SEQ ID NO: 50375 - protein, 438 aa, Mycobacterium sp. JLS
MGAHHTATEQSARLFADACAVIPGGVNSPVRAFNAVGGTPRFITSANGYWLTDADDNRYVDLVCSWGPMILGHAHPAVVEAVQRVAADGLSFGAPTPSETELASEIISRVAPVERLRMVNSGTEATMSAIRLARGFTGRPKIVKFSGCYHGHSDALLADAGSGVATLGLPSSPGVTGAATADTIVLPYNDVDAVDEIFEQVGDQIAAVITEASPGNMGAVPPEPGFNAALRRITEEHGALLILDEVMTGFRVSRSGWYGLDPVDGDLFTFGKVMSGGLPAAAFGGRAEVMERLAPLGPVYQAGTLSGNPVAMAAGLATLRTADDAVYAALDKNADRLAGLLTDALTDAGVTHRVQRGGNMLSVFFTAEPVGDFATARASETWRFPPFFHALLDAGVYPPPSAFEAWFVSAALDDEAFDRIAAALPGAARAAAEASRPA

SEQ ID NO: 50376 - protein, 311 aa, Robiginitalea biformata HTCC2501
MGELLIDFVGENQGSDLSRAVMFTKKAGGAPANVASAIARLGGRSAFVGCIGEDPFGEFLLDVLRENRVDTQFLQRSETFTTLAFVSIAEDGERDFVFSRGADRELQYMPEVKKSFRGNMIHLGAATALLGGPLEKAYGHYFFDGLTQRAFISFDPNYRHDLWKNKAAVFRKKCIPFIEKSNLCKFSLEEAQLLSGEESLEKACSVLHDIGTEIIVITLGGDGTWLSTRAGQRTIPSIRVEPVDTTGAGDAFIGCLLWQLAAREDLEHIASDVEALAEMVRIANAAGAVTTTRFGAIEALPDQEQLNRALA

SEQ ID NO: 50377 - protein, 205 aa, Colocasia esculenta
MALMGGIVDVEGAQNSAEVEELARFAVDEHNKKENALLQFSRLVKAKQQVVSGIMHHLTVEVIEGGKKKVYEAKVWVQAWLNSKKLHEFSPIGDSSSVTPADLGVKRDAHEAEWLEIPTHDPVVQDAANHAVKSIQQRSNTLFPYELLEILHAKAKVLEDLAKIHLLLKLKRGSREEKFKVEVHKNIEGTFHLNQMEQDHSDSGN

SEQ ID NO: 50378 - protein, 517 aa, Robiginitalea biformata HTCC2501
MTEVALDFGIEKALKALGVEDVNPGSSTGMEHFGSGEEIASVSPVDGATIARVRATTQEDYRRVAETAASAFTSWRLVPAPQRGEIVRQFSDRLRELKEPLGKLVSYEMGKSYQEGLGEVQEMIDICDFAVGLSRQLHGLTMHSERPGHRMYEQYHPLGVVGIISAFNFPVAVWAWNTALAWVCGDVCIWKPSEKTPLCGIACQKIAAEVFHRNGMPEGITCLINGDYRVGEMLTGDTGVPLVSATGSIRMGKIVAQAVAARLGRSLLELGGNNAIIVTPDADIKMTVIGAVFGAVGTCGQRCTSTRRLIVHEDVYDEVKSALKQAYGQLRIGNPLDEENHVGPLIDREAVDMYRKALEQVVAEGGEILVPGGVLDGPGYESGCYVKPAIAEAENHFEIVQEETFAPVLYLIRYSGDVHDAIALQNGVKQGLSSAIMTTNLRESEAFLSAAGSDCGIANVNIGTSGAEIGGAFGGEKETGGGRESGSDAWKIYMRRQTNTINYSDNLPLAQGIRFDL

SEQ ID NO: 50379 - protein, 493 aa, Thermoplasma volcanium GSS1
MDGKLYIDGQWVDSSNGDTLTKYNPVTGEVIGKFAAASRDDVDRAFDAAEDAFQKWMDLGSVERSKIIYKAKELIEENRKELENIIIQENGKPVKEAAEEVDGVLDQMQYYAEWARKLNGEVVEGTTNHRKIFQYKVPYGTVVALTPWNFPAGMVARKLAPALLTGNTVILKPSSDTPGSAEWIVKKFIQAGVPKGALNYITGRGSVIGDYIVEHKKVALITMTGSTSTGQRIMQKASANMAKLMLELGGKAPFMVWKDADINNALKTLLWAKYWNAGQSCIAAERLYVHEDIYDTFINKFVELSKKIVVGDPSRADMGPLINTTALKGTEEVVEEAKESGARILYGGSKPDLSGPYKNGYFFLPTIIDNVDQKSKIFQEEIFAPVIGARKVSDVEEMYSLANDSKYGLASYLFTKDPNLIFEAAERIRFGELYINMPGPEASQGYHTGFRLTGQAGEGSRYGILEYLKIKNIYVDYSGKPLQINTVRDDLFQ

SEQ ID NO: 50380 - protein, 733 aa, Debaryomyces hansenii CBS767
MSKNKLPSRSNHANSLTGGSAISRLVFIFAQLPNLVKALPIFSRNVDIEHNDIAEAMIMTPELFYTNLFTSVFLVLAGGVFAGLTLGLMGQDEVYLKVIATSGEPQERSHARKVLKLIGRGKHWVLVTLLLSNVITNETLPIVLDRCLGGGWPAVITSTVSIVIFGEIIPQSICVRYGLQVGAMFSPFVLMLMYVMYPVAYPCALLLDHILGEDHGTVYKKSGLKTLVTLHKTMGVERLNQDEVTIISAVLDLKEKPVAHIMTPMDRVYTMSADAILDEKTVEEIFNAGFSRIPIHLPNEPMNFIGMLLVRVLISYDPEDALPVASFPLATLPETGRDTSCLNILNYFQEGKSHMIVVSENPGEPTGSLGVLTLEDVIEELIGEEIVDESDVYIDINKNIKRTQPGPLSKRNLTTYLNNMYHKSASASKRNSLDDSALTPLKDSFAEVSSSPSRQKLFHGSGSAGNSPKIGPVDATKGWKPLNPASNPLELNKSFVKIKRPDMESVKNSVMPPPKRLPPKNTTSYGAIHATEEGALNSAKNLSAESQNEIGNHDRAQRFLLPEEKETDLSEIMGRKKNQNGHDQNPDDFQHHHGSHNGEGYDVHYHNDYSSSHSHNIVPEYQEARSYRTGGIIESVVNVQGVHKTIIENVDEENDYSHLRNSFGDSLENSQVSGLADNRDDNEEAEGLLAGLKKKAIGSSVLSGNSSNSDDSKKRKSSVWDKFMNNSNSNSNS

SEQ ID NO: 50381 - protein, 414 aa, Desulfovibrio desulfuricans G20
MHDHIRTFFMLYPSVLARRRLHMNVLKMTDLDLRGKRVLIREDLNAPIKDGAVANDNRLRAAAPTIRLAMQAGARVMVMSHLGRPAEGAFDESASMAPVAARLADILGCPVPVVRDWLDGVDVPEGGVVLTENVRFNKGEKKNDEELGRRMAALCDVYVMDAFGTAHRAQASTHAVAAFAPVACAGPLLAAELEALGKALGAPRHPVVGIIGGSKVSTKLTLLETLSSKVDKLIVGGGIANTFIRAAGFAVGKSLYEEDLVAEAARLMQAAAAAGGEIPVPVDVVVATEFAETATPVCKPVDQVADNEMIMDIGPQTAAMYAEVLRGAGTIVWNGPVGVFEFDAFGAGTEALCRAVAQSSAFSIAGGGDTVAAVDKYGVRDGVSYISTGGGAFLEFLEGKELPAVAMLEQRAKA

SEQ ID NO: 50382 - protein, 664 aa, Desulfovibrio desulfuricans G20
MASRKDLANAIRALSMDAVEKAKSGHPGAPMGMADMAEVLWNDFMKHNPANPGWADRDRFVLSNGHGSMLIYSLLHLSGYDLSIDDIRNFRQLHSKTPGHPEYGVTPGVETTTGPLGQGIATAVGMAMAERMLAEAFNRDGFTVVDHHTYVFLGDGCMMEGLSHEACSLAGTLGLGKLVALYDDNGISIDGRIDSWFGDDTPARFRAYGWHVVAGVDGHDAEAVRKAIEEARAETGRPSLICCKTKIGMGAPNMADSSKVHGAPLGADEIAATRANIGWNHPPFEIPADVYAGWDARPRGAAAQQVWDDMFAAYAAAHPALAAEFTRRMAGDLPEGWKELCEKALAQIVAAAENLATRKACNKSLEAIGPALPEMVGGSADLTGSVGTKWSGSRLLDSANWGGNYISYGVREFAMGAIMNGLTLHGGFLPYAGTFLIFSDYAKNAFRLSALMGIRTVWVLTHDSIGVGEDGPTHQPVEQLAGLRLIPGAHVWRPCDTVETQVAWQSAVEYKNGPTALSFTRQGVPFMQRDDAAVRNIARGGYVLRDCEGTPEVILIATGSEVGVAAGACDRLTAEGRRVRLVSMPCSNIFDRQDAAYRESVLPAAVEARVAVEAAASDFWWKYVGLKGRVVGMTTFGESAPGKVLFEHFGFTADNVAAVAKEVL

SEQ ID NO: 50383 - protein, 216 aa, Chlamydomonas reinhardtii
MSHKPDDDYDYLFKVVLIGDSGVGKSNLLSRFTRNEFSLESKSTIGVEFATRSIQVDGKTIKAQIWDTAGQERYRAITSAYYRGAVGALLVYDITKSVTFENVERWLKELRDHADSNIVIMLVGNKSDLKHLRDVQTEVAQAFCEREGLSFIETSALESTNVEKAFQQILTEIYHIVSKKVLDSEDNRPKIGEGRDVIVIDNAHDDGGKKKGGCCS

SEQ ID NO: 50384 - protein, 1066 aa, Methylococcus capsulatus str. Bath
MQVTRRQFFRLSAATLGGSSLAVMGFSPREALAEVRQFKLARTTETRNTCPYCSVACGLIMYSLGDKAKNAKAEIIHIEGDPDHPVSRGSLCPKGAGLLDFVRSPSRLKYPEYRAPGSDAWKRVSWDWALERIARLLKEDRDRNFIARNEQGQTVNRWTSLGFLAASAGSNETGYLTNKIARALGIVMLDSQARICHAPSVSALASSFGRGAMTNTWMDIKNADVILVMGGNPAEAHPVGFKWAIEAKARNKARLIVVDPRFNRTAAVADFYAPIRAGTDIAFLNGVIRYLLEKDAINHEYVRAYTNASFIVREDFRFEDGLFSGYDAGKTEQHYDRSTWTYELDEHGYARIDPTLRHPRCVFQLLKTHVERYTPDKVTELTGTPTDAFLKICDLIASTAVPDRTLTSLYALGWTHHSVGVQNIRVMAMIQLLLGNIGVSGGGVNALRGHSNIQGLSDLGLLTDMLPGYITLPKDGETSRAVYLEKRTLKPLRPGQLSYWSNLPKFHTSLMKAWYGKAATRDNDYCYDWLPKLDKPYDSLRMFDLMAQGKVNGFICQGFNPLASYPDKGKIATALARLKFLVVMDPLATDTSVFWQNHGEYNPVNPADIQTEVFRLPTTCFAEEDGSLVNSSRWLQWHWKGAEPPGEARNDIEIMSALYLRLREMYEKESGAFPDPILNLHWPYQKPEEPTPEELAREYSGYAVADVADPKDPSKVLVKAGQQLAGFAQLQDDGSTACGNWIFSGAFTEAGNQMARRDTSDPTGLGIAPGWAWAWPANRRILYNRASCDPDGKPWNEKRPIIHWDGSRWTGLDVPDYKADVPPGSDMSPFIMNPEGVGRLFGADRLTDGPFPEHYEPYETPLDTNPLHPKVVSNPAARVFPGDKAMLGGKDDFPYVATTYRLTELFNTWTDHVRINASLQPEQFVEIGQELARELGIANGEIVTVRSRRGFIKAVAMVTKRIKPLTVAGQTVHQIGIPVHWGLQGQTRKGFFANNLTPYLGDANTQTPEYKAFLVKVEKDLSEPGPHTQKRGEAQEGRRRSGGNGTAGATEKSSWLTRVLKGRLEV

SEQ ID NO: 50385 - protein, 182 aa, Brassica napus
MALRSIKTPPFVAATTVVSSSIIKKPRSFRFFSKPSASLAVHNLHQPISIIRSNLIPKLKPSSPAAKFRCSASAALTPQLRDTLEKLVNSEKVVLFMKGTRDFPMCGFSNTVVQILKNLNVPFEDVNILENEMLRQGLKEYSNWPTFPQLYIGGEFFGGCDITLEAFQSGELQEVVERAICS

SEQ ID NO: 50386 - protein, 626 aa, Novosphingobium aromaticivorans DSM 12444
MADINSKLEIGVTTGPIRGSRKIHVESARFPGLTVAMREIQLEPSSGEPPVRVYDTSGPYTDPKVTIDIAAGLPTLRRDWIMARGDVEEYDAREVKPEDNGLKGPDRSAGVPPFPNVVKRPLRAKAGQNVSQMHYARRGIITPEMEYVAIRENLGRKQAKEAMIRDGQDWGASIPDYVTPEFVRDEVARGRAIIPSNINHPESEPMAIGRNFLVKINANIGNSAVASDVASEVDKMVWSIRWGADTVMDLSTGRNIHDTREWILRNSPVPIGTVPIYQALEKVGGVAEDLTWEVFRDTLIEQAEQGVDYFTIHAGVRLPYIPLAAKRMTGIVSRGGSIMAKWCLAHHKESFLYENFDEITEIMKAYDVAYSLGDGLRPGSIYDANDEAQFAELYTLGELTKRAWEQDVQVMIEGPGHVPMHKIKENMTKQLEACGEAPFYTLGPLVTDIAPGYDHITSGIGAAQIGWYGTAMLCYVTPKEHLGLPDRDDVKVGVVTYKLAAHAADLAKGHPAAQARDDALSKARFEFRWRDQFNLSLDPETAEQYHDQTLPAEGAKTAHFCSMCGPKFCSMKISQEVRDFAAKQNAGIETFVANEAEAEAGMKAMSDKYDEMGRELYIGAGGREHD

SEQ ID NO: 50387 - protein, 434 aa, Oceanobacillus iheyensis HTE831
MKIAALGFQHVLAMYAGAILVPLIVGEALGLTVEQLTYLVAIDIFMCGIATLFQVMNNRFFGIGLPVVLGCTFTAVAPMIAIGGQYGITAIYGAIIVSGIFVVLISGFFGKLVRFFPPVVTGSVVTIIGITLIPVAINNLGGGQGASDFGSLANISLGFGTLLFIILMYRFTTGFLRSISILIGLAIGTIIASFMGRVDFTAVADASYFHMIQPFYFGTPTFEWPAIITMILVAMVSLVESTGVYFALGDITDKKLKEKDLTKGYRAEGLAILLGGIFNALQYTAFSQNVGLIQMTGVKKLRVIVVAGIMLIALGLIPKIAALTTIIPTAVLGGAMVAMFGMVIAQGIKMLSAVISDSHENSMIIACSVGMGLGVTVVPELFAQIPNSLQILTSNGIVAGSVTAIVLNILFHMLPQRSKKQQTTDSRELAEDIV

SEQ ID NO: 50388 - protein, 202 aa, Shewanella sp. MR-4
MYTEFDGIIFDMDGTLVDSGQLHEQAWRQTLNHFGIPVEPALMRSLAGVPTIGTLEILIAHFGVTPTASCEAMNEYKEALVRDTMHLYVKPTALAEFAKQNQGKRPMAVGTGAYTEEAIQILTLCGLLELVDYVVGADQVASPKPAPDTFLRCAELMGIAPERCIVFEDAKAGIQAAEAAGMFVVDVHAELQIENDYFLGAQ

SEQ ID NO: 50389 - protein, 428 aa, Bdellovibrio bacteriovorus HD100
MKALGRHILVEFSGCNAEVLNDVSIIERSMVEAAQIAGATVINSTFHHFSPWGVSGVVVIQESHLAIHTWPEYRYAAVDLFTCGDSVDPWVSFEHLKKAFQANYSALEMNRGSLHVIQKSDFQPKIMREKPSFDLSKGHQIDRNVWFTDKDENQALSLRYTGDVLFDETNPFQRVRVLDSYSHGKFLAINNMVMCTERDEYHYHEMITHPVMQTHGNAKNVLVIGGGDGGTIRELFKYNVDNVTMVEIDEAVVRASKEHLPKIACEFNNPKLNLIIGDGIQFVKDAPANSYDVIIVDGSDPVGPAKGLFTAEFYNNCKNALKDGGLVITQGESPMFHEGTFVELNHCLKGIFGKQSVHTMLFHATTYPSGMWSLQVAVKGSKHPAKDFNKDQAAKFAQDKGLKYYNEDLHTAAFSLPTFVKTMLGDNA

SEQ ID NO: 50390 - protein, 256 aa, Zea mays
MAREENVYMAKLAEQAERYEEMVEYMEKVAKTVDVEELTVEERNLLSVAYKNVIGARRASWRIVSSIEQKEESRKNEEHVNLIKEYRAKIEAELSNICDGILKLLDSHLVPSSTAAESKVFYLKMKGDYHRYLAEFKTGPERKESAESTMMAYKAAQDIALAELAPTHPIRLGLALNFSVFYYEILNSPDKACNLAKQAFDEAISQLDTLGEESYKDSTLIMQLLRDNLTLWTSDLTEDGADEGKEAPKGEAGDGQ

SEQ ID NO: 50391 - protein, 370 aa, Pseudomonas fluorescens Pf-5
MSRINPAVKPPHRIAVIAGDGIGREVVPEGLRVLEAVSRRFGIALQFDHFNWCSEHYQAHGSMMPDDWAQQIGGHEAIFFGAVGAPDIVPDHIAVWDSLLKIRRQFDQYVNIRPVRLMPGVPCPLAGRAPGDIDFIVVRENTEGEYSSVGGRMWEGTPREIALQESVFSRHGVDRVVNYAFELASRRPRRNLVAATKSNGIAITMPFWDERVEALAQAYPQVATRKFHIDILCAHFVQHPDWFDVVVASNLFGDILSDLGPACTGTIGIAPSANLNPERLYPSLFEPVHGSAPDIAGLGVANPIGQIWSAALMIEHLGQGDELYQRAAAAIVESIETVLAEGPRTREMGGNASTVEVGRAIAECLAGNRS

SEQ ID NO: 50392 - protein, 699 aa, Thermoplasma volcanium GSS1
MISQEMPVERIKDLWRDFFRTYGYSDKINSIHQDYPEVRTLYVSFKDIEDYDRQFAASILASPEIYLKTGEEIVMEDYLLDKVSRRFRIFHLRIKDLEDRNTSYNIRDIRSANIGTLISVSGIVRKNTEVFPKLKNAAFECSNCHELNYVEQNESRLTEPLYCANCGQSKVKDKISFKLRPNLSEFIDVQKIEIQEDPETLEGGAQPQRLIIIVEDDLAGLLFPGNRVVVDGILQAEQRRQGNVPLTEFYTFLYAVNIRKDVKEIESVKITEEDKQKIIEISKRPNVIDVIAKSIAPTIHGLDMIKKALALQMFGGVRKTMKDGTTMRGDIHILMVGDPGTAKSQLLKYMAEVSPRGIFTFGRGSSAAGLTAAAVRDEFGEGRWTLEAGALVLADNGFVAIDELDKMDEHDTAAMHEAMEQQTVTISKAGIMATLRARASVLAAANPKFGRYDLNRNLAEQINFPLPLLSRFDVIFKMVDQPNKDTDSQLAEHVLKAHRLGEIYKSMEKNDIEIDVPDEAKYEPDIDKDLLRKYVAYAKNNVFPRLSDEAIAILQDQYVRTRTGSRDSIPITVRQLESTIRLAEAAARARLSTIVTVEDAMLAKKIVDYYLTDVSTENGKMDIDIIYTGSSSKQRNEMETVLDIIKEIKEEKGIAEVSDVIGVAESKGITAKKAEEAILKLKNAGQIFERSYGKLDVIK

SEQ ID NO: 50393 - protein, 798 aa, Marinobacter sp. ELB17
MKFSEQWLREWVNPALDSQQLMDQITMAGLEVDGFEPVAGKFTGIIVGEVLSVEAHPDADKLRVCQVSNGSTQVQVVCGAPNVRAGIKVPFAELGAVLPGDFKIKKAKLRGQPSVGMLCSGAELGLSEDHDGILELPADAPVGQSFADYLQLNDIAIDVDLTPNRADCLSIKGLAREVGVLNSLPLNTPAINPVAAVHNEVPDVRVEAPAGCPRYLGRILRNVDLTAQSPLWLQEKLRRSGTRSIDAAVDVTNYILLELGQPMHAFDRAEIDGGIVVRMAKPEEKLVLLDGQEVTLTEQTLVIADHSKPIAIAGVMGGEHSGVRPKTRDLVLESAYFDPITLAGKARHYGLHTDASHRFERGVDYNLARSAMERATELLISIVGGEAGDVVDVTSAEHLPKPVSIVLREKRLADVLGLAIANAKVEDILTRLGLAVEERLDNGWKVSAPSFRPDITIEEDLIEEVGRIYGYNNLPVTEPTGSLGLRPKAEDTRPLSAIRNYFVANGYQEAITYSFVDPKVQEQLDPQNEGIALANPISADLSVMRTTLWSGLLKTVVHNQNRQQPRIRLFESGLRFMKEGERILQQPMLAGVVTGNQNPENWVNGRRNADFFDVKGELESLFRLLGITVDFRAGKHPALHPGQTAELLRDGQPVGWLGTLHPQVQKNMELNGTVIMFELFLNPIVTGYVPNFKDVSKFPEVRRDLAIIIGSDVKFADVERVATHHAGEHLNALRAFDVYQGESLGKGEVESESEGNRSLALSLFWQHPQRTLTEDEVHGLFNGVIEALKAELGATLRS

SEQ ID NO: 50394 - protein, 244 aa, Brassica napus
MEISIASATLSIAIAVVSWWAWRTLNWVWFKPKMLESYLRRQGLSGSPYTPLVGDFKRNFSLLKEARTKPIKLTDDITPRLVPYPLKMLKTHGRTYFTWLGPIPTITIMDPELIKEVFNKVYEFQKPHTFPLFRLIGTGLANYDGDKWAKHRRIINPAFHLEKIKNMVPAFHQSCSEVVGEWDKLVSEKGLSCEVDVWPGLVSMTADVISRTAFGSSYKEGQRIFELQAELAQLIIQAFRKHII

SEQ ID NO: 50395 - protein, 357 aa, Trichoderma atroviride
MAEFVRAQIFGTTFEITSRYSDLQPVGMGAFGLVCSARDQLTNQNVAVKKLMKPFSTPVLAKRTYRELKLFKHLRHENVISLSDIFISPLEDIYFVTELLGTDLHRLLTSRPLEKQFIQYFLYQIMRGLKYVHSAGVVHRDLKPSNILVNENCDLKICDFGLARIQDPQMTAYVSTRYYRAPEIMLTWQKYDVEVDIWSAGCIFAEMLEGKPLFPGKDHVNQFSIITELLGTPPDDVINTIASENTLRFVKSLPKRERQPLRNKFKNADDSAIDLLERMLVFDPKKRITATEALAHDYLAPYHDPTDEPVAEEKFDWSFNDADLPVDTWKIMMYSEILDYHNVEGVPQMEDQQFPPQ

SEQ ID NO: 50396 - protein, 1665 aa, Mycobacterium tuberculosis CDC1551
MGRCEMSYVIATPEMMATAAFDLARIGSQVSAASAVAAMPTTEVVAAGADEVSAGIAALFSAHAQEYQALSAQAAAFHDQFVHTLTAAARWYTATEIANAAAMRVVLGAVNAPTQTLLGRPLIGDGAHGTAPGQPGGAGGLLFGNGGNGAAGAVGQVGGAGGAAGLFGIGGAGGAGGAGAPGGTGGTGGWLAGGGGVGGMGGAGGGAGGAGGNAGLFGNGGAGGAGGAGGGAGGAGGNAGWFGHGGAGGVGGVGAAGANGATPGQDGAAGVAGSDDGAGGDGLAGSDGGDGGAGGVGGNGGRGGWLLGNGGAGGVGGVGGAGGAGAAGGAGGAGATGINGPAGISAAGGDGGAGGNGGAGGNGGVGGAGGAGGSAGLLGYVGRAGDGGAGGGGGLGGAPGDGGAGGNGGSWLAAGDGGAGGHGGDPGLGGAGGAGGASGGAGARAGANGLAAGNDGPVSGGNGGKGGNGAHAPVAGGHGGNGGAGGNGGLVGDGGAGGHGGDGAAGAGYADMTAIFLGSSGTPGEDGGNGGAGGAGGAGGAHAGDGGAGGAGGNGGAGGAGGNGAHGFNAVLVSDGGNGGDGGAGGRGGDGGAGGAGGDAPAGRAGSQGVGGDGGAGGAGGAPGNGGSGGRGDMAFKDGDGGAGGDGGDPGAGGKGGAGGAGATEGVTGATGATVHSGGNGGKGGNGADATVAGANGGKGGAGGNGGLVGDGGAGGDGGSGAAGANGANVGEDGADGTLSGQPGEGSEANGGQGGVGGGGAGGAGGDGGAGSSALGSGGNGGRGDAGQAGGAGGAGGAGGAGGSVSGDGGPGGKGGAGGAGGAGASGGGGGKGASGADSAEAVGGAGGKGGDGGVGGVGGDGGPGGDGGAGGAAPAGQVGSHGVGGVGGDGGLGGAGGNGGDGGHGSDGGDGGDGGDPGAGGLGGLGGDSGNGTRAASGVDASDHGPGSGGNGGNGGNGAQASVAGGAGGNGGDGGNAGRVGDGGAGGNGGDGAAGANGANSGAPGSDALALGQPGGNGGQGDAGQAGGAGGAGGAGGAGGSVSGDGGAGGNGGAGGNGGVGASGGAGARGANGIDSIGGTGGAGGGGGDGGAGGVGGHGGDGGVGGAAPSGTVGSHGTGGVGGDGGLGGAGGVGGAGGNGGIGITVGGAGGAGGNGGDPGAGGRGGLGGDSGNGTSAANGVDASKHGPLTGGDGGVGGNGAKAAAAGGDGGQGGDGGNAGLFGDGGAGGDGADGTAAEALGGDGGAGGAGGKGGDAGDIGDGGDGGKGGDGAHGALGGLTVAGGNGGAGGAGGAGGAGGAFLGDGGNGGAGGQGGAGRGGSPGGGGGVGGHGGAGGDAGMNGGGGTGGQGGNGAAGGAGWSPDSDLKGFDGFDGGSGGAGGDGGAGGAGGTQTGDGGDGGAGGLGGAGGVGGNGVDGFDINETTGRDGGDGGDGGYGGWGGAGGNGGAGGSAPAGEVGNRGVGGDGGDGGSGGDAGNGGLGGDGFTYLADFDGEPGGDGGDGGDGGWGRPGGQGGFGSTSGAHGKAGFGAPGGDGGDGGNGGHGGDGNGSFADAGDGGPGGNGGNGGLGGAGRDGGAPGGDGGDGGTGGSGGFGAPPPRSIGGGDGGDGGRGGDGGRGAGGLTSGGVGSSGESGGSGNGRGDPGSGGSGGEGGEGGPSISVNVT

SEQ ID NO: 50397 - protein, 319 aa, Solanum nigrum
MGSKYSKATNSINDASNSSYRVPFESLRVPFVDLQEATNNFDDKFLIGWGVFGKVYMGVLRNGTKVALKKHMPESSQGIEEFRTEIEILSLCSHPHLVSLIGYCDERNEMILIYEYMENGNLRSHLYGSDLPAMSWEQRLEICIGAARGLHYLHTSAVIHRDVKSINILLDDNFVPKITDFGLSKTGTELDQTHVSTAVKGTVGYLDPEYFIRGQLTEKSDVYSFGVVLFEVLCARPAIAHSHSREMISLAEWAVESHNNGQLEQIIAPNIAAKIRPESLKKFGETVVKCLALSSEDRPSMGDVLWKLEYALRLQESVI

SEQ ID NO: 50398 - protein, 105 aa, Medicago sativa
MADVEDRCFVGGLAWATDNDALEKAFSQYGEIVDSKIINDRETGRSRGFGFVTFANEKSMNDVIEAMNGQDLDGRNITVNQAQSRGSGGGGGGRGGGGYGGGGGG

SEQ ID NO: 50399 - protein, 687 aa, Bradyrhizobium sp. BTAi1
MQKCPTPSRQPHTTPRPSTSPAQKRRKSLPRRRHPSRRSPRPPPSRRATASRRQRTADRARGTAGLGPGHDSPALCLFRRYFGRLALPGRRLDIGRQMPRRDRGADASRDQHQATIRDDQRGRFMERIWLKHYPAGVPADIDPSKYQSLVELLEESFKTFADRRAFICMDKAISYRELDDMSVAMGAYLQGLGLAKGARVALMMPNVLQYPIAISGVLRAGYAVVNVNPLYTPRELEHQLKDSGAEAIIVLENFAHTVQQVVGQTKVKHIIIASMGDLLGFKGVIVNLVVRRLKKMVPAFSLPGAVPFNDALAAGRSKRFQKPVIGPDDVAFLQYTGGTTGVSKGATLLHRNVVANVLQNDAWLQPVMERPPHVDQLLIVCALPLYHIFALTCCFLLAVRAGGANLLIPNPRDIPSFIKELMKYQVNNFPAVNTLYNGLLHHPDFRKLDFSKLKVSNGGGMAVQRPVAEQWKQVTGCSIAEGYGLSETAPVLTCNLPTSTEFTGTIGLPLPSTWLSIRDDDGNEVPLGQAGEICAKGPQVMAGYWNRPDETAKVMTADGFFRTGDIGIMAADGSIKIVDRKKDMILVSGFNVYPNEVEEVIATHPGVLETAVIGLPDEKTGEVVKAFVVKKDPALTAEDIVKHCHAQLTNYKVPKQIEFRTELPKTNVGKILRRELRDEKKNPAAAA

SEQ ID NO: 50400 - protein, 291 aa, Glycine max
  misc_feature (159)..(159): Xaa can be any naturally occurring amino acid
DNESNSVSKCEIHWEHLQLREEIGQGSCAVVYHGIWNGSDVAVKVYFGNEYTEETLQDYRKEIDIMKRLRHPNVLLFMGAVYSQERLAIVTELLPRGSLFKNLHRNNQTLDIRRRLRMALDVARGMNYLHHRNPPIVHRDLKSSNLLVDKNWTVKFFVXVGDFGLSRLKDATLLTTKSGRGTPQWMAPEVLRNEPSNEKSDVYSFGVILWELMTQSIPWKNLNSLQVVGVVGFMDRRLDLPEGLDPHVASIIDDCWRSDPEQRPSFEELIQRTLFLVNRVTAVSIRRISES

SEQ ID NO: 50401 - protein, 249 aa, Pseudomonas fluorescens Pf-5
MQFDPKRLAQARHVVVFSGAGVSAESGIPTFRDALTGLWEHFDPARLATVQAFREDPALVWGWYEWRRQKVLQAQPNPAHLALAELARRVPRLTLITQNVDDLHERAGSPSVLHLHGSLHTPKCFACSRPFKGQLPLPDLPEQGASLEPPRCTGCNGKIRPGVVWFGEPLPQATLKAAFNAAEECDLLLSVGTSGLVQPAARIPQLALQHGACVVHINPQPQACTGAEEYSLEGKAGQLLPELLRQAFA

SEQ ID NO: 50402 - protein, 296 aa, Exiguobacterium sibiricum 255-15
MMERQQGSDRVKRGMAEMQKGGVIMDVVNAEQAKIAEAAGAVAVMALERVPSDIRRDGGVARMADPLITEEVLQAVSIPVMAKCRIGHIVEARVLESLGVDFIDESEVLTPADEEYHLLKSSFTVPFVCGARDLGEAARRIAEGAAMIRTKGEPGTGNVVEAVRHMRKIQAQLHQILHSQPDELMTRAKEWGASYEVLQQIQTTGRLPVVNFAAGGIATPADAALMMHLGAEGVFVGSGIFKSEHPERVAKAIVEAVTYKDDFERIAHLSKGLGTAMKGIDVTSMPFEERMAPRGW

SEQ ID NO: 50403 - protein, 562 aa, Vibrio fischeri ES114
MNNNKRPLYIPYAGPALLSTPLLNKGSAFSTTERKYFNLEGLLPEAIESIEEQTGRAYKQYQNFENDMDKHIYLRNIQDTNETLFYRLVQNHISEMMPIIYTPTVGAACENFSNIYRRGRGLFISYENKNRIDDLLNNAANQNVKVIVVTDGERILGLGDQGIGGMGIPIGKLALYTACGGISPAHTLPIVLDVGTNNPQRLADPMYMGWRHPRVTGDEYADFVEDFIQAVQRRWPEALVQFEDFAQKNAMPLLERYKNRICCFNDDIQGTAAVTVGSLLAACKAAGSSLSEQRVTFLGAGSAGCGIAEAIIAQMVSEGISDAQARSQVYMVDRWGLLQEGMPNLLDFQQRLVQKAENTKDWVSEEPNFSLVDVMRNAKPTVLIGVSGAPGLFSKEVIQEMHKHCERPIVFPLSNPTSRVEATPNDIIRWTDGQALVATGSPFDPVAHNGQTYPIAQCNNSFIFPGIGLGVLAIKATRVTDEMLMESSRALAECSPLAIHGTGALLPPLEEIHSVSKRIAFAVAKKAIEQGHALEITDEALQQKIESYFWKPVYRRYKRTAF

SEQ ID NO: 50404 - protein, 391 aa, Pseudomonas fluorescens Pf-5
MTAACLMSTYQPLALSFCKGLGSRLWDQAGREYLDAIAGVAVTGIGHSHPRLVGAISEQAGLLLHSSNLYDIHWQQQLAAKLTQLSGMDRAFFNNSGAEANETALKLARLHAWHKGIEQPLVVVMENAFHGRTLATLAASDGPAVRLGYGQLPGGFLKVRFGDLAALESAVAEHAPRICGVLMEPIQGESGIQLAPPGYLKAVRELCTRRNWLLMLDEIQSGIGRTGRWFACQHEDVVPDVMTLAKGLGNGIPIGACLARGKAAQLFTPGSHGSTFGGNPLACRAACTVLDVIEDQQLLANAEQRGAQLLRRLREELAAHPAVREIRGLGLMVGIELRQPARELVQVAARDHGLLINVTRGTTIRLLPPLVIDGQEVEMIVDGLRQTLEAL

SEQ ID NO: 50405 - protein, 336 aa, Rhodococcus sp. RHA1
MNSSQQIVLAQRPHGHVSVEDFRVEDVALPELEAGDVALETLFISIDPAIRGWLDDRPSYLPPVALGEPVRAFGLARVRASRNSNFTAGDIVRGFVGWQRRQIVSSPGTDWDRITSREDVPLEHYLGVLGMTGLTAWAGVCDILRPEPGHTVLISGASGAVGSVAVQLAKQAGAQVVGVAGGAEKCSMVARLGADAVVDRKAPDWKDQLEAATPDGIDRLFENSGGPMFEASITRLNNHAHIALCGLIDGYNLTERPSGPDNFGQLLTKRILTQGFVALDYMDRAAEVEVTLGELIRSGQLEAVQSVLPGFEQLPAAFVDSFSDGHPGKLIIDLTA

SEQ ID NO: 50406 - protein, 450 aa, Robiginitalea biformata HTCC2501
MADYKDKIDAFMEEVTSRNGHEPEFIQAVQEVAETVIPYIAEQEIYSGKNILLRMVEPERLISFRVAWVDDDGEIHVNRGYRIQMNSAIGPYKGGLRFHPSVNASILKFLAFEQVFKNSLTTLPMGGGKGGSDFDPKGKSDDEVMRFCHAFMTELCRHIGPNTDVPAGDIGVGAREIGFLFGMYKKIRNEFTGVLTGKGLSWGGSKIRPEATGYGTVYFAQNMLETRNDSIEGKTVAVSGSGNVAQYAAEKVLQLGGKVVTLSDSGGHIHDPDGIDAEKLAWVMDLKNNRRGRISEYVKQYPGASYHKGKAPWHVACQVALPCATQNELNGEDAKTLIKNGCICVAEGANMPSTPEAIHAFHDARILFAPGKASNAGGVATSGLEMSQNSLRISWTREEVDQRLKGIMSDIHDSCIEYGREDDGYCNYVKGANIAGFVKVADAMLAQGVI

SEQ ID NO: 50407 - protein, 552 aa, Pseudomonas fluorescens Pf-5
MYVYDEYDQRIIEDRVKQFRDQTRRYLAGELSEEEFRPLRLQNGLYIQRFAPMLRVAVPYGQLTSRQARMMAKIARDYDKGYAHISTRQNVQFNWPALEDIPDILAELATVQMHAIQTSGNCLRNVTTDQFAGVAADELIDPRPWCEIVRQWTTFHPEFAYLPRKFKIAINGSTSDRAAIEVHDIGLEPVYNAAGELGFRVLVGGGLGRTPVVGAFINEFLPWQDLLSYLDAILRVYNRYGRRDNKYKARIKILVKALTPEVFAEKVEAEMAHLRGGQTTLTDAEVHRVAKHFVDPDYKTLSNQDAELAALDQQHPGFARWRTRNTLAHKKPGYVAVTLSLKPTGVAPGDVTDKQFDAIADLADRYSFGQLRTSHEQNIILADVEQSQLFTLWGELRENGFATPNIGLLTDIICCPGGDFCSLANAKSIPIAESIQRRFDDLDYLFDIGELDLNISGCMNACGHHHVGHIGILGVDKKGEEFYQVSLGGSASRDASLGKILGPSFAQDDMPDVISKLIDVYVEQRTEDERFIDTYQRIGIDLFKERVYAANH

SEQ ID NO: 50408 - protein, 459 aa, Desulfovibrio desulfuricans G20
MNALQPDTERLRALDTAHVWHPFTQMATWHEDAPLIIEKARGNWLVDTDGNRYLDGVSSLWTNVHGHRHPHIDAAIRAQLDNVAHSTLLGLSSRPAIELAAMLARVAPQGLNRVFYSDSGSTAVEVALKIAYQYQKQRGPAGEGRSKFLCLRGAYHGDTVGAVSLGGIDLFHAVYGGLLFKTVRAEAPYCYRCPFGRQKESCRHECFTHLEETATRHAPELAAMVIEPLVQGAAGQITHPDGYLAHARALCDRLGILLIADEVAVGFGKTGTMFACEQEKVTPDLLCLAKGISGGYLPLAATMVTDAVYEAFLGDHAQCRTFFHGHTYTGNALACAAGIASLQLFRTEGTLERLQHIITIYDALLRQLETLPHVGDIRRRGIMTGIELVEDRATRRPYPFALRTAHKVVLAARRRGVIIRPLGDVLVLMPPLSITAQECGLLVEATAEAIQEVTGGPRV

SEQ ID NO: 50409 - protein, 483 aa, Mycobacterium sp. MCS
MTYVPKWSTIPEMVLSAADRFGDAEAVVDGPLRLSFAEVVHRIRCAAGAFADLGIGKGDRVAIWAPNSAEWIIAAFGLLTAGGVLVPVNTRFKGEEAADVITRSGARAVLVQQGFLGVEYAAPEGVPVIDLKSDFLAGGEPFSRTVDSSDISDIIFTSGTTGRPKGVMMNHRQNLRLYEEWCNLADLRQGDRYLMVNPYFHTFGYKAGLIASFIRGATMVPVPVFDVDRVVDLIAAERITMLPGPPTLYHSLLSVADKSKLATLRAGVTGAADIPVELVRRVLEELPFQTLATGYGLTEAGTATLSRPGDSFADIATTVGTACDGVEVRIADDGEVLVRGYSVMQGYLDDPAATAEAIDPDGWLHTGDLGTLDDAGRLRIVGRKKDMFIVGGFNAYPAEIEGFLLEHPDVAQAAVIGVPDERMGQVGKAFVVRRDGHAGPLSAEGLIAWSRERMAGFKVPRYVEFLDELPLNATGKVMKDQLR

SEQ ID NO: 50410 - protein, 370 aa, Kineococcus radiotolerans SRS30216
MLAAVLSPDSAEFVLERVPVPAPRAGEALIRVAACGVCHSDLHVLKGEIAFPRPAVLGHEISGTIVQLGDGVENLRVGDAVVGGFIMPCTRCDECQRGRDDLCPQFFAQNRLKGALFDGETRLRRTDGSPLAMYSMAGLAEYSVCPVSALAVLPSEVSMTSAAVLGCAGMTAYGAVHRAGSVQPGATVAVVAVGGLGMSMVQLAAAAGASTVVAVDVNDEKLAMARRLGATHTVNSAKEDAHAAVRAATGGRGVDVAIEALGRPATLRLAVDVLADGGRAVAVGLAAGNAEVGIEITPFVRRSRSLMGSFGARTRTDLPAVVDLAARGSFDPDALVTDVFSLEDVNEAYSRLDGGDILGRAVVSMGSSLS

SEQ ID NO: 50411 - protein, 326 aa, Oryza sativa (indica cultivar-group)
MAHFQGQQHGHPAARVDEYGNPVAAGHGITGTQEAGAGGYGAAGNVAQPQHAFGGATDAGGYGRQAGYGATGTGTHDAAGYGGSGQPAYGATGTGVHDAGGLMPGHTAGHGTTGTGVHHGAGAGLPAGQTAGYGTTGVTGAQHGAGGLGTGHTAGYGTTGAHHGAGGLGTGHMAGHGATTTPDTMAYGTTGTGAPHGATAGTGAYPHAGGQFQPAREEHKTGGILRRSGSSSSSSSSEDDGMGGRRKKGIKEKIKEKLPGGNKGGQQQPTATAATGGYGAGTGHTAAAGTTTDAGGTAYTPTTQPTHEKKGMMEKIKEKLPGGGHH

SEQ ID NO: 50412 - protein, 430 aa, Idiomarina baltica OS145
MTEKIVVVGGGAGGLELATQLGRSLGRSGKAEVLLVDRNSTHVWKPLLHEVASGALDSRLAELDYRGQGARSGFRFIVGTLEAVDKDNKTITLAAIEEEGEEVLAPRTLNYDKLILSVGSVTADFGTPGVAEHCYFLDSTAQADAFHHHLLNEFLRVNQALEDGHDVTLDVAIVGGGATGVELAAELVHSVSLLSIYGLGHLTRDRLNITLVEAGKRLLPALPERLSQSVHKKLNKLGVKVLLGNPAKEAQKGQLVLNDGQSIKGDLMVWAAGVRAPDFLTELGLPTRKNNQIEVDSFLQAKGADSIYALGDCAACAIDENRFVPPRAQSAHQMADCLYKNIRRMQKGKAPKAFKYKDRGSLVSLSRFSAVGNLMQSKSLSMSIEGTLARYAYASLYRMHQRALHGWWKMLLVIAVDKLNHAVKPRLKLH

SEQ ID NO: 50413 - protein, 1075 aa, Oceanobacillus iheyensis HTE831
MPKRKDINKVLVIGSGPIIIGQAAEFDYAGTQACLALKDEGIEVVLVNNNPATIMTDEQIADNVYLEPLNKETLVKIIEKEKPDGLIGTLGGQTGLNLSIELFEAGILEKYEVELLGTSVDSIQKGEDREKFRELMIEINEPISESKIVTNVEEGLRFIDQIGFPIILRPAYTLGGEGGGFAHNEAEFEELLNRGLGLSPIHQVLVEKSIKGWKEVEYEVMRDANDTCIIVCNMENMDPVGVHTGDSIVVAPSQTLTDHQYQMLRSASVKVIRALNVVGGCNIQFALNPDSNEYCIIEVNPRVSRSSALASKATGYPIASMAAKCAIGLNLDELKNPVTGSTYASFEPALDYIVVKLPRFPFDKFSEADRSLGTQMKATGEVMAIDRTFEGALNKAVRSLELGVSGLDWPKMDERGDQELFRLIETPNDLRLFALAEALNRGISVETLHQKTFIDFWFLAKIQHILHTEKELANYTLASLPVHLFKKAKRYNISDVQIAKLLQTTSKKVRDFAKEIDVHPVYKLVDTCAGEFDAVTPYYYSTWYGEDEVQINLDSKKILVVGSGPIRIGQGVEFDYCSVHAVQALQKAGYETIMINNNPETVSTDYSVADKLYFEPLALEDVLHVIEKEKVDGVMLQFGGQTAINLANELEKEGIPLLGTKPKEIDQMEDREQFYQFLNQLGIPHIKGEIVHNQKEVISTVKDLGFPVLIRPSYVIGGQSMYICYNEKDLLSYVSKIQEDTHDRCWPLLIDDYLPGMEYDVDVISDGENIVIPGIVEHIEKAGVHSGDSIGVFPPRELKSEQQERMIEIAKQIAGKLPIVGIMNIQFVIHHQTIYVLEVNPRASRTVPVISKVTGVPMIEWAVYSQLGYPLTDIVSKVGLLPAPHYYTIKAPVFSSSKLKGVDQILGPEMKSTGELIGMSMSFEDAIKKAIVPVNFNDKYKLGVFLSVSDLWKEDSIAFMNKYSHVFSRLSATEGTSKFLQEKGFSIEAISKDIGMIEEYFNEHQPDVVINIPNQGRDKTRLGYLLRELCNRYKIPYFTSFETAQTVLGSMKSTELKVQSLQSYTASLQEVMTLN

SEQ ID NO: 50414 - protein, 132 aa, Glycine max
  misc_feature (107)..(107): Xaa can be any naturally occurring amino acid
MAAATATATAADDEARLLRLEEQAEHGGGGAWEYLSLARRLRARRPAPVLRLGLSLLNDASARSRLASEQWTLYEQVAVAAMDCQRLDVAKDCIGVLSRQFPGSARXGRLEALLFEAKGDWAEAERAYALIL

SEQ ID NO: 50415 - protein, 188 aa, Pseudotsuga menziesii var. menziesii
DDVTVITMDGAPKEGCQHISVLTEADETQCPSVEIHPDDVVALPYSSGTTGLPKGVMLTHKGLVSSVAQQVDGENPNLYFHSEDVILCVLPLFHIYSLNSVLLCALRAGAATLIMQKFNLTTLLELIQRYKVTVAPIVPPIVLDITKNPVVSQYDVSSVRMIISGGAPLGKKLEDALRDRFPKAIFGQ

SEQ ID NO: 50416 - protein, 149 aa, Geobacillus kaustophilus HTA426
MAERTFIMVKPDGVQRNLIGEIVARFEKKGFQLVGAKLMQVSRELAEQHYAEHKERPFFGELVDFITSGPVFAMVWEGENVIAAARQMMGKTNPQEAAPGTIRGDFGLTVGKNVIHGSDSPQSAKREISLFFKEEELVSYSKQINAWLY

SEQ ID NO: 50417 - protein, 320 aa, Geobacillus kaustophilus HTA426
MKLKAMYSFLNDDLAAVEEELERTVRSEYGPLGEAALHLLQAGGKRIRPVFVLLSARFGHYDFERIKHVAVALELIHMASLVHDDVIDDADVRRGRPTIKARWSNRFAMYTGDYLFARSLERMAELDSPRAHQVLAKTIVEVCHGEIEQIKDKYRFDQPLRTYLRRIRRKTALLIAASCQLGALAAGAPEAVANQLYWFGHCVGMSFQITDDILDFTGTEEQLGKPAGSDLQQGNVTLPVLYALCDEQVRAKITAVNADTDAEEMAAVLAAIKQTDAIERSYALSDRYLEKALRLLGELPANEARTLLHDLALYIGKRDY

SEQ ID NO: 50418 - protein, 188 aa, Pseudotsuga menziesii var. menziesii
DDVTVITMDGVPKEGCQHISVLTEADETQCPSVEIHPDDVVALPYSSGTTGLPKGVMLTHKGLVSSVAQQVDGENPNLYFHSEDVILCVLPLFHIYSLNSVLLCALRAGAATLIMQKFNLTTLLELIQRYKVTVAPIVPPIVLDITKNPVVSQYDVSSVRMIISGGAPLGKKPEDALRDRFPKAIFGQ

SEQ ID NO: 50419 - protein, 526 aa, Arabidopsis thaliana
MTGGGFATSANGVEFEAKITPIVIISCIMAATGGLMFGYDVGVSGGVTSMPDFLEKFFPVVYRKVVAGADKDSNYCKYDNQGLQLFTSSLYLAGLTATFFASYTTRTLGRRLTMLIAGVFFIIGVALNAGAQDLAMLIAGRILLGCGVGFANQAVPLFLSEIAPTRIRGGLNILFQLNVTIGILFANLVNYGTAKIKGGWGWRLSLGLAGIPALLLTVGALLVTETPNSLVERGRLDEGKAVLRRIRGTDNVEPEFADLLEASRLAKEVKHPFRNLLQRRNRPQLVIAVALQIFQQCTGINAIMFYAPVLFSTLGFGSDASLYSAVVTGAVNVLSTLVSIYSVDKVGRRVLLLEAGVQMFFSQVVIAIILGVKVTDTSTNLSKGFAILVVVMICTYVAAFAWSWGPLGWLIPSETFPLETRSAGQSVTVCVNLLFTFIIAQAFLSMLCHFKFGIFIFFSAWVLIMSVFVMFLLPETKNIPIEEMTERVWKKHWFWARFMDDHNDHEFVNGEKSNGKSNGFDPSTRL

SEQ ID NO: 50420 - protein, 188 aa, Pseudotsuga menziesii var. menziesii
DDVTVITMDGAPKEGCQHISVLTEADETQCPSVEIHPDDVVALPYSSGTTGLPKGVMLTHKGLVSSVAQQVDGENPNLYFHSEDVILCVLPLFHIYSLNSVLLCALRAGAATLIMQKFNLTTLLELIQRYKVTVAPIVPPIVLDITKNPVVSQYDVSSVRMIISGGAPLGKKPEDALRDRFPKAIFGQ

SEQ ID NO: 50421 - protein, 467 aa, Solanum tuberosum
MEGFFKLISYFQTQSEPAYCGLASLSMVLNALAIDPGRKWKGPWRWFDESMLDCCEPLEKVKAKGISFGKVVCLAHCAGAKVEAFRSNLSTIDDFRKHVMACTTSDDCHLISSYHRGLFKQTGSGHFSPIGGYHAEKDMALILDVARFKYPPHWVPVPLLWEAMNTIDEATGLHRGFMLVSKLHRAPALLYTLSCKHESWVSISKHLMDDLPVLLSSENVKDIKDVLSTLLSNLPPNFAEFIKWVAEVRRQEENGQKLSEEEKGRLAIKEEVLKQVQDTPLYKHVTSLLLSEDSVYQLKAEMESSLTNVAASICCQGADIFAGRSGLSDRFCCRQTCVRCYRATGDNPATVVSGTVVNGNGNGEQGVDVLVPTSQAKTSCCSSGQNGCSPMHPGSNDVLTALLLALPPQTWSHIKDMKVLQEIENLVSAENLPPLLQEEILHLRGQFLLLKRCKDNKVEEDLAAPPF

SEQ ID NO: 50422 - protein, 291 aa, Neisseria meningitidis FAM18
MLQGSLVALITPMNQDGSIHYEQLRDLIDWHIENGTDGIVAVGTTGESATLSVEEHTAVIEAVVKHVAKRVPVIAGTGANNTVEAIALSQAAEKAGADYTLSVVPYYNKPSQEGMYRHFKAVAEAAAIPMILYNVPGRTVVSMTNDTILRLSEIPNIVGVKEASGNVGSNIELINRAPEGFVVLSGDDHTALPFMLCGGHGVITVAANAAPKLFADMCRAALQGDIALARELNDRLIPIYDTMFCEPSPAAPKWAVSALGRCEPHVRLPLVPLTEGGQAKVRAALKASGQL

SEQ ID NO: 50423 - protein, 467 aa, Solanum tuberosum
MEGFFKLISYFQTQSEPAYCGLASLSMVLNALAIDPGRKWKGPWRWFDESMLDCCEPLEKVKAKGISFGKVVCLAHCAGAKVEAFRSNLSTIDDFRKHVMACTTSDDCHLISSYHRGLFKQTGSGHFSPIGGYHAEKDMALILDVARFKYPPHWVPVPLLWEAMNTIDEATGLHRGFMLVSKLHRAPALLYTLSCKHESWVSISKHLMDDLPVLLSSENVKDIKDVLSTLLSNLPPNFAEFIKWVAEVRRQEENGQKLSEEEKGRLAIKEEVLKQVQDTPLYKHVTSLLLTEDSVYQLKAEMESSLTNVAASICCQGADIFAGRSGLSDRFCCRQTCVRCYRATGDNPATVVSGTVVNGNGNGEQGVDVLVPTSQAKTSCCSSGQNGCSPMHPGSNDVLTALLLALPPQTWSHIKDMKVLQEIENLVSAENLPPLLQEEILHLRGQFLLLKRCKDNKVEEDLAAPPF

SEQ ID NO: 50424 - protein, 514 aa, Thermoplasma volcanium GSS1
MHMAAVLEEDALSILGLERVNSGIYDGEWKKPAGKMLTVYSPIDGSEIAKISMATREDYDEMVKKAQEEFKKWRMIPAPKRGLIIKDIGDELRKEKRNLGRIVTIEAGKTPSEGEGEIQEMIDISDLALGLSRQLYGLTIASERPYHRMYEQWVPLGPIAVITSFNFPASVWSWNSFIAAVTGDVVIWKPSSKAALTAVAVMKVIERVLKRNNVPNIFYLMVSSGSEGGDWITNDPRIPLVSFTGSVPVGRKISENVAKRLGKSILELGGNNGAIVSDKADIDLALRGVVFGALATAGQRCTTTRRVIVSEKIYDEFVKKLVNAYSKVKVGDPREKGVLVGPLIDEDAVRDYEGAISEAVKQGGKVLYGGKKISLKGYEKGHYVEPTIIEANPNMPIVKEETFAPILYVMKYKTIEEALEIHNSVPQGLSSSIFTTDLREEEAFLSPYGSDCGLANVNTSTAGAEIGGAFGGEKDTGGGRESGSDAWKFYMRRQTVTKNWGQTLPLAQDVVFDF

SEQ ID NO: 50425 - protein, 485 aa, Streptomyces coelicolor A3(2)
MRTAYSVETVRNAERELMARLPEGALMQRAAAGLAAACAQVLARVAGRVYGSRVVLLVGSGDNGGDALYAGARLARRGAGVTAVLLAPDRAHGGGLTALRRAGGRVAEGGPAGSAEELIARADLVLDGIVGIGGSGGLRKEAGPLADAAARSRAAVVAVDLPSGVDADTGRVRGDVVRADLTVTFGTHKPGLLIDPAREYAGSVRLVDIGLPLPGEAAELEALQHPDVARLLPVPAGESDKYRRGVVGIAAGSARYPGAAVLAVAGALRGGAGAVRYVGPAGDAVIARFPETLVSDQGPKRAGRVQAWVVGPGAGDDAATVAQVLAAEVPVLIDADGLRLADADAVRARTAPTLMTPHAGEAAALLGVGREEVEAARLDSVRELAARYGATVLLKGSTTLVARAKGGPVRVNATGTSWLATAGSGDVLSGLAGSLLAAGLSAVDAGSVGAYLHGLAGRFAAEGAPAGAHDVAAAIPRAWRDVRGD

SEQ ID NO: 50426 - protein, 503 aa, Solanum tuberosum
MAMAGLYRRVLPSPPAIDFASNEGKQLFLEAIQNGTMEGFFKLISYFQTQSEPAYCGLASLSMVLNALAIDPGRKWKGPWRWFDESMLDCCEPLEKVKAKGISFGKVVCLAHCAGAKVEAFRSNLSTIDDFRKHVMACTTSDDCHLISSYHRGLFKQTGSGHFSPIGGYHAEKDMALILDVARFKYPPHWVPVPLLWEAMNTIDEATGLHRGFMLVSKLHRAPALLYTLSCKHESWVSISKHLMDDLPVLLSSENVKDIKDVLSTLLSNLPPNFAEFIKWVAEVRRQEENGQKLSEEEKGRLAIKEEVLKQVQDTPLYKHVTSLLLTEDSVYQLKAEMESSLTNVAASICCQGADIFAGRSGLSDRFCCRQTCVRCYRATGDNPATVVSGTVVNGNGNGEQGVDVLVPTSQAKTSCCSSGQNGCSPMHPGSNDVLTALLLALPPQTWSHIKDMKVLQEIENLVSAENLPPLLQEEILHLRGQFLLLKRCKDNKVEEDLAAPPF

SEQ ID NO: 50427 - protein, 159 aa, Triticum aestivum
MLPSQHILSPSSSVVTTLFNQPPTIILSLFILHRCNMVRVFLILRCSPSSRIVHSIVVVSRSTSVQHDDFLPSMTKKLVAEGLIQQLFKGLQLLMIPSTGSITFQNLKRNTASMGLVELRDDELQQMMREEDIIGDSTLDQPEFFIIMISMMPELIEQQ

SEQ ID NO: 50428 - protein, 534 aa, Saccharomyces cerevisiae
MEVAPALSTTQSDVAFQKVETHEIDRSSYLGPCYNSDELMQLISAYYNVEPLVGYLEQHPEYQNVTLQFPDDLIKDSSLIVRLLQSKFPHGKIKFWVLADTAYSACCVDEVAAEHVHAEVVVHFGDACLNAIQNLPVVYSFGTPFLDLALVVENFQRAFPDLSSKICLMANAPFSKHLSQLYNILKGDLHYTNIIYSQVNTSAVEEKFVTILDTFHVPEDVDQVGVFEKNSVLFGQHDKADNISPEDYHLFHLTTPQDPRLLYLSTVFQSVHIFDPALPGMVTGPFPSLMRRYKYMHVARTAGCIGILVNTLSLRNTRETINELVKLIKTREKKHYLFVVGKPNVAKLANFEDIDIWCILGCSQSGIIVDQFNEFYKPIITPYELNLALSEEVTWTGKWVVDFRDAIDEIEQNLGGQDTISASTTSDEPEFDVVRGRYTSTSRPLRALTHLELEAADDDDSKQLTTRHTASGAVIKGTVSTSASALQNRSWKGLGSDFDSTEVDNTGADIEEGISGVARGYGFDREDAMKKENK

SEQ ID NO: 50429 - protein, 326 aa, Thermoplasma volcanium GSS1
MKSFYEWELALHSKIEEVNERLFEVVKSEEPDLDRMAKYTIEAGGKRFRPLLTILAFESSTDDPYFKILDLAAGYELIHTASLIHDDIIDDSPMRRGRPTLSYKEGINNAIVVADYLFAKAYELGSRYGPLVSKVMADASSRLAEGQILEAVNLGNLDITEDTYYKIIENKTAHFFEACALGATIVAEADRPTREILSNFAFNLGMAFQVTDDILDIVGDDRYTGKPTFVDIKHDALTLPIIYALRNSNDNDRRAIIDMINGRREINKSLLKDIFLKSGSIDYSFSVAKQYITKSMDYLKKAKKSPDIDLLMELAFIVIDRIEIFQ

SEQ ID NO: 50430 - protein, 175 aa, Saccharomyces cerevisiae
MGAAPSKIVDGLLEDTNFDRDEIERLRKRFMKLDRDSSGSIDKNEFMSIPGVSSNPLAGRIMEVFDADNSGDVDFQEFITGLSIFSGRGSKDEKLRFAFKIYDIDKDGFISNGELFIVLKIMVGSNLDDEQLQQIVDRTIVENDSDGDGRLSFEEFKNAIETTEVAKSLTLQYDV

SEQ ID NO: 50431 - protein, 399 aa, Saccharomyces cerevisiae
MFKKYKNQDLDMAFWWKKNPKTPSDYARLIIEQLNKFSSPSLTQDNKRKVQEECTKYLIGTKHFIVGDTDPHPTPEAIDELYTAMHRADVFYELLLHFVDLEFEARRECMLIFSICLGYSKDNKFVTVDYLVSQPKTISLMLRTAEVALQQKGCQDIFLTVGNMIIECIKYEQLCRIILKDPQLWKFFEFAKLGNFEISTESLQILSAAFTAHPKLVSKEFFSNEINIIRFIKCINKLMAHGSYVTKRQSTKLLASLIVIRSNNALMNIYINSPENLKLIMTLMTDKSKNLQLEAFNVFKVMVANPRKSKPVFDILVKNRDKLLTYFKTFGLDSQDSTFLDEREFIVQEIDSLPRIISSTTEVSNNNASSSNVASITSPSSVMNNQSSILTHSTSPDSR

SEQ ID NO: 50432 - protein, 615 aa, Oryza sativa (japonica cultivar-group)
MIPPLASLPKNFSISLAHINHLPHEANEQKSHFIIIHTNPLGFFRVPGFSFLLLSPPLDPSSSSPRSSALAVARRRPPTMEAAGVEVNGGGGGDVVVVVPQQHEVAAKQAAAAAAAKGKSVESKGVRVVGGRIYDPENGKTCHQCRQKTMDFAASCHKIKKNNKQCTIQYCRKCLFNRYGQEAEKVANDGTWTCPKCKDICNCSFCMKKKGLPPTGILAHAAKASGCASVHHLLKKGKEAVAAAQRSTQKVRSTPVKKSPKRAIQPDAAADEPLAEGDENVCIDFNAAPVKKQKRSRKVGNGVALTKDESPDAPKEQVVLPKGTPVTSVAGAEWEPEDVGLALQFFEFCRTFAEIFQVRKGQPERILRDIAGGRGLRVVSSVIADFHITLLSIIQEGRGIKPITYSRDNDAWIVDTGKCISESIFVPEGLPLDSLSQGVSGYKNLSPSCKLSVLNFLCDESLSTEKLRSCILSETKNPSREKAHSAKEKEEPKEETIKNTDEAVLLKTEGAAVAIEEDKNGISQQKDVKEVKNADTNEKKHGGFLRTNPFMVDKKVIYWKLDDYCNNTTMMLQEVDADDLMGNKDKWFMLNEDEKKIVENYLSTRPKRRGRKAAQ

SEQ ID NO: 50433 - protein, 422 aa, Oceanobacillus iheyensis HTE831
MQEIKIPELAESITEGTIAEWLVKKGDKVEKGDPVVELETDKVNVEVNAEFSGVITEIISEEGDDVTVGDTIAKLDENGEAGSNSDESEPKEEPKQEEKQEDDKKKASETETSKGAETKSESNGEVIASPAARKRARELNIDLSSVQSRDPLGRVRTEDVEAQAQANKQPAEKKQEKKDAPKSEKTEFDKPVERVKMTRRRQTIAKNLVEVQHNTAMLTTFNEVDMTAVMELRKQRKDKFLDKNGVKLGFMSFFTKAVVGALKEFPLLNAEIQGNELVIKKFYDIGIAVSTDDGLVVPVVRDADRKDFAGIEQDINDLGIKARDNKLTLKDLQGGSFTITNGGTFGSMMSTPILNAPQVGILGMHNIVKRAMVMPDDSIEVRPMMYLALSYDHRIVDGKEAVQFLVRIKQMLEDPYDLLLEG

SEQ ID NO: 50434 - protein, 205 aa, Oryza sativa
  misc_feature (78)..(78): Xaa can be any naturally occurring amino acid
MQRAIQAIGSHGSLLKSAVLRHISAPKPSILPAVYSRSMSVSSAQIEESGFETATVADILKSKGKSADGSWLWCTTDXSVYDAVKSMTQHNVGALVVVKPGQDKSIAGIVTERDYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 50435 - protein, 678 aa, Bradyrhizobium sp. BTAi1
MNFHSIYRHGFARVAACVTASSVANPAANAAAILAAARACHDQGAAVAVFPELCLSGYAIDDLVKQDPLLDAVQRGLLTLVEASHDLTPVLIVGAPLRFSHRVYNCAVVIHRGEVLGVVPKIYLPTYREFYEGRHFASGAGIRGEMIEVAETMAPFGTDLLFAAADVAGLVIGVEVCEDMWIPVTPASELALAGATVLANLSGSPITVGRAESRSLLCRSTSARCLAAYIYAAAGVGESTTDLAWDGQTSIFENGVLLAESERFRQTGQTIFADVDLDLLRQERALMGTFDDNARAQTRGEHYRRIGFELQPTKDDIGFMRSIERFPFVPSDAARLDQDCYEAYNIQVAGLTQRLRATGTKRIVIGVSGGLDSTHALIVAAKAMDLLGLPRTNILAYTMPGFATGAQSKSYAHALMKALEVSAAELDIRPAATQMLKDIGHPFGRGEAVYDVTFENVQAGLRTDYLFRLANDRGGLVLGTGDLSELALGWCTYGVGDQMSHYNVNAGVPKTLIQHLIRWVIASHQFSADVDRTLEAVLAAEISPELVPVKEGETPQSTQAAIGPYELQDFNLFYTLRYGMRPSKIAFMAHHAWKDVGDGAWPPGFPADKRHAYALGEIRKWLEVFLKRFFAFSQFKRSAMPNGPKVVAGGSLSPRGDWRAPSDGNATAWLEDLESVPK

SEQ ID NO: 50436 - protein, 397 aa, Zea mays
  misc_feature (251)..(251): Xaa can be any naturally occurring amino acid
  misc_feature (258)..(258): Xaa can be any naturally occurring amino acid
TGRLQSGPEFYKKGTRPRRFPAVYGGKGVLQAVRNINEVPAPKLIGVDVRNQSDVDAVMLDIDGTQNKSKLGANAILGVSLSVCRAGAGAKGVPLYKHIQELAGIKELVMPVPAFNVINGGSHAGNNLAMQEFMILPVGATTFAEALRMGSEVYHVLKSIIKSKYGQDACNVGDEGGFAPNVQDNREGLILLMDAIEKAGYTGKIKIGMDVAASEFLTKDGNYDLNFKNQPNDGAHILSAQHLGDLYRDFXQDFPIVXIEDPFDQDDWSSWASLQSSVDIQIVGDDLLVTNPKRIADAIDKKACNALLLKVNQIGTVTESIQAALDSKAAGWGVMVSHRSGETEDNFIADLAVGLASGQIKTGAPCRSERLAKYNQLLRIEEELGNVRYAGEAFRSP

SEQ ID NO: 50437 - protein, 545 aa, Robiginitalea biformata HTCC2501
MPFPKINPSTTQAWNQLRAHYERTHNRHIKDLFASDPERASRMSLRWNGFFVDYSKNRVDDETLELLLSLAEACDLETAMDAYFDGEAINQTEGRAVLHTALRNGSDSGLEIDGEPVEKEVGRVREHMRAFCEAVISGDKKGYTGKPFTDVVNVGIGGSDLGPVMVTEALQFYSNHLRTHFVSNVDGDHVHETLRKLNPETTLFVIVSKSFTTQETLSNALTIKKWFLEHATQADIAKHFAAVSTNTAKIEEFGIADANVFPMWDWVGGRFSLWSAVGLSIALSIGFDQFEALLSGARSMDRHFREAPWKENIPVILGLLSIWYNNFHGAETEAVIPYSQYLHRLPAYLQQGIMESNGKSVDRNGVPVAYQTGTIIWGEPGTNSQHAFFQLIHQGTKLIPADFIGFRHSLHGDREHHLKLMANFFAQTEALMNGKTPEAVRDELSGQGLGDDALENLLPFKVFEGNKPTNTILIERLSPESLGALVALYEHKIFVQGVIWNIFSYDQWGVELGKQLASTILSELTSGQVGNHDTSTLQLLQYFKS

SEQ ID NO: 50438 - protein, 188 aa, Pseudotsuga menziesii var. menziesii
DDVTVITMDGVPKEGCQHISVLTEADETQCPSVEIHPDDVVALPYSSGTTGLPKGVMLTHKGLVSSVAQQVDGENPNLYFHSEDVILCVLPLFHIYSLNSVLLCALRAGAATLIMQKFNLTTLLELIQRYKVTVAPIVPPIVLDITKNPVVSQYDVSSVRMIISGGAPLGKKLEDALRDRFPKAIFGQ

SEQ ID NO: 50439 - protein, 210 aa, Candida glabrata
MAFVKRVTQETNIQLALDLDGGSVSVRESILGKEYASGDGQTIHVHTGVGFLDHMLTALAKHGGWSLILECIGDLHIDDHHTVEDCGIALGQAFKEALGSVRGIKRFGHGFAPLDEALSRAVVDFSNRPFAVVELGLKRERIGQLSTEMIPHFLESFATEGRITMHVDCLRGTNDHHRSESAFKALAIAIREARTPTGRDDVPSTKGVLA

SEQ ID NO: 50440 - protein, 487 aa, Glycine max
TQQILLFLTKLLSKNSSGDSISTMSNSEHNIITGHAGYVLEDVPHLSDYIPHLTTYPNPLQDNPSYSVVKEHSVDVDDTIAQKAIVHKNSPRETHFRRAGPRQKVYFESEDVYACIVTCGGLCPGVNTVIREIVCGLYHMYGVHKVLGIEGGYRGFYSCNTIPLTPKVVNDIHKRGGTILGTSQGEGGNDTLKIVDSIQDRGINQVYILGGDGTQRGASVIFEEIRRRGLKVSVVGIPESVDNDIPVIDKSFGFDTAVEEAQRAINAAHVEAESTENGIGVVKLMGRHSGFISMYATLASRDVDCCLIPESPFYLEGPGGLFEFIRKRLAENGHMVIVISEGAGHELISESLSATNKQEASGNKLLQDVGLWLSQKIKDHFTKSQKMDITLKYIDPTYMIRAVPSIASDNVHCTLLAQSAVHGAMAGYTGFAVGTVNGKHAYIPFYRINEIEKKVVITDRMWARLLSSTNQPSFLNPKDITTHQTGN

SEQ ID NO: 50441 - protein, 304 aa, Oryza sativa (indica cultivar-group)
MAAPSSLASSHLYRLADLRRAGVAAAAPAHPQQLRLGCSRRRAQRVVAMAGSGKFFVGGNWKCNGTKDSVSKLVTELNAATLEPDVDVVVAPPFIYIDQVKNSLTDRIEVSAQNVWIGKGGAYTGEISAEQLVDIGCQWVILGHSERRHVIGEDDQFIGKKAAYALSQNVKVIACIGELLEEREAGKTFDVCFKQMKAFADSITNWADVVIAYEPVWAIGTGKVATPEQAQEVHAAVRDWLKTNVSPEVASGIRIIYGGSVNAANCAELAKKEDIDGFLVGGASLKGPDFATIINSVTSKKVAA

SEQ ID NO: 50442 - protein, 228 aa, Triticum aestivum
MDQYNYGGGVAYYGSTTGGVGDNGQGGGYATVTSAPPKRPAGRTKFRETRHPVYRGVRRRGAAGRWVCEVREPNKKSRIWLGTFASPEAAARAHDVAALALRGRAACLNFADSATLLAVDPATLRTPDDIRAAAIALAETACPAAPASSSSVAAAVASAPAPPMTMMQFDDYAMQYGGIGDLDQHSYYYDGLSAAGGDWPSGSHMDGADDDCNGSGGYGAGEVALWSY

SEQ ID NO: 50443 - protein, 382 aa, Daucus carota
MRFTRVYTEVFNMTDHSLLCTETNNLCFDDLEARDDQDPRIDCENVVGNESEALICAVPLQRDEDFVFVFESKVNFCPEVIFSTDRSGELDLCVRKEALDWIYKAHAHYNFGALSVCLAVNYLDRFLSLYELPSGKKWTVQLLAVACLSLAAKMEEVNVPLTVDLQVADPKFVFEAKTIKRMELLVLSTLKWRMQACTPCSFIDYFLRKINNADALPSGSLIDRSIQFILKTMKGIDFLEFRPSEISAAVAICVTREAQTLDINKAMSNIIPVEKDRVFKCIEMIQDLTLVTETSNVASGRTRAQVPQSPVGVLDAACLSYKSDERTVGSCPNSSLHTETSPHTKRRKLIEIMKCGFYSITQFQIFSEWEFWCGCLCKRPPL

SEQ ID NO: 50444 - protein, 335 aa, Mannheimia succiniciproducens MBEL55E
MMRSLVCKEPFHLILEERAKPQPKDEEVQLKVAAIGICGTDIHAYAGNQPFFEYPRVLGHEASGVITELGKNVDKFKVGQRVALIPYVSCGKCGACLSGKTNCCENISVIGVHQDGAFSEYLTAPAKNILPIADSVDFTTAALIEPFAISAHAVRRAQITKGDDVLIVGAGPIGLGAAAIAHADGANVVIADTSEERRKHIQANIPVPTVNPINEKVEDYFNGRLPQIVIDATGNQKAMNNAVNLIRHGGRIVFVGLHKGTIEFSDPDFHKKETTLMGSRNATLEDFEKVQHLMSERKISANMMLTHTFKYDELAEIYEEKITKNQSLIKSVVLY

SEQ ID NO: 50445 - protein, 1174 aa, Coccidioides immitis RS
MALSARCGQRAISHLLRQRCLSTVESSAPSALRAFSTQTSSRKLYSRSKLQAFTSWRSTRSFARSARNLAAAQAEAPSAKSFSARGGVQGPDLVDVKKVLVIGSGGLSIGQAGEFDYSGSQALKALKEAGVKSVLINPNIATIQTDHKLADEVYYLPVTPEYVTHVIEKEKPDGIFLSFGGQTALNLGVQMNRLGIFEKYGVKVLGTSIKTLETSEDRDLFAKALNEIDIPIAESIAVSTVDEALEAADKIGYPIIVRSAYALGGLGSGFAANAEELKNLSSRSLTLAPQILVEKSLKGWKEVEYEVVRDAANNCITVCNMENFDPLGIHTGDSIVVAPSQTLSDEEYHMLRTAAIKIVRHLGVVGECNVQYALQPDGLDYRVIEVNARLSRSSALASKATGYPLAYTAAKIGLGHILPELPNAVTKTTTANFEPSLDYIVTKIPRWDLSKFQHVKRDIGSSMKSVGEVMAIGRTFEESFQKAIRQVDPRFVGFQGDKFENLDEVLKNPTDRRWLAVGQAMLHENYSVDKVHELTKIDKWFLYKLQNIVDVDHALRDIGSLFGIKKEMMLKAKKMGFSDKQIALCVGSTEEEVRTRRKSFGIHPWVKKIDTLAAEFPADTNYLYTTYNATSHDVTFDDHGTIILGSGVYRIGSSVEFDWCAVNATLSLRNMDKKTVMINYNPETYSTDFDTADKLYFEELSFERVMDIYELENASGVVVSVGGQLPQNIALKLQETGGAHVLGTDPKDIDRAEDRHKFSQTLDSIGVDQPAWKELTSVAEAEAFADSVGYPVLVRPSYVLSGAAMSVIQSQDELHDKLVSASDVSPDHPVVITKFIEGAQEIDIDAVASGGKLLLHAVSEHVEAAGVHSGDATLVLPPVNLDESIMARVKEIAAKVAKAFSITGPFNMQIIKADNPDGGEPQLKVIECNLRASRSFPFVSKVLGTNFIDVATKALVGRDVPEPNDLMRVKRDYLATKVPQFSWTRLAGADPYLGVEMASTGEIACFGKDLVEAYWASLQSTMNFRMPEPGEGLLFGGDTDVLTELPHIVDFVHPLGYKLYAASPRVKEYLEKATKSEVAIQVIEFPKEDKRALREVFQKYDIRGVFNIAKQRGKTLLDEDYVMRRNAVDFGVPLFMEPKTALLFAQCMNEKLPRKEGIPSEVRSWSNFVGTKSL

SEQ ID NO: 50446 - protein, 135 aa, Brassica napus
TSLRDESWYVGKLRHNRLANLIGYCCDGDERLLVAEFMPNDTLAKHLFHWENQTIEWAMRLRVGYYIAEALDYCSTEGLPLYHDLNAYRVLFDEDGDPRLSCFGLMKNSRDGKSYSTNLAYTPPEYLRNGRVTPE

SEQ ID NO: 50447 - protein, 133 aa, Oryza sativa
  misc_feature (28)..(28): Xaa can be any naturally occurring amino acid
  misc_feature (72)..(72): Xaa can be any naturally occurring amino acid
THPSLQVKTAPSHEITPYMHSGTKSMLXVTLGRVPPSHLVLKDSEVSGKHAQIAWNANKLKWEIVDMGSLNXGTFLNSRSVNHPDVGSRRWGEPAELADGDIITLGSSSKVSVSYNRFCFSVCPFKCTEDFYN

SEQ ID NO: 50448 - protein, 461 aa, Salmonella typhimurium
MAEKKPELQRGLEARHIELIALGGTIGVGLFMGAASTLKWAGPSVLLAYIIAGLFVFFIMRSMGEMLFLEPVTGSFAVYAHRYMSPFFGYLTAWSYWFMWMAVGISEITAIGVYVQFWFPEMAQWIPALIAVGLVALANLAAVRLYGEIEFWFAMIKVTTIIVMIIIGLGVIFFGFGNGGQAIGFGNLTEHGGFFAGGWEGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAVAKVSRHGVPVAGVALSILILLVGSCLNYIIPNPQRVFVYVYSASVLPGMVPWFVILISQLRFRRAHKEAIADHPFRSIMFPWANYLTMAFLVCVLIGMYFNEDTRMSLFVGVIFLLAVTLVYKVFGLNRHGTAHKVGE

SEQ ID NO: 50449 - protein, 513 aa, Solanum tuberosum
MALLHLPPVTQRRLQSFFLPYTDNHVSLVPDDSGDVAMNQILKIGVVLSGGQAPGGHNVISGIFDYLQTHCKGSTMYGFRGGPAGVMKGKYVVLTPEFIYPYRNQGGFDMICSGRDKIETPEQFKQAEETAKKLDLDGLVVIGGDDSNTNACLLAENFRSKNLKTRVIGCPKTIDGDLKSKEVPTSFGFDTACKIYAEMIGNVMIDARSTGKYYHFVRLMGRAASHITLECALQTHPNVTLIGEEVFAKKLTLKNVTDYIADVVCKRAESGYNYGVILIPEGLIDFIPEVQQLIAELNEILAHDVVDEAGVWKKKLTPQCLELFELLPLAIQEQLLLERDPHGNVQVAKIETEKMLIQMVETELDQRKQKGAYNAQFKGQFHFFGYEGRCGLPSNFDSTYCYALGYGAGSLLQSGKTGLISSVGNLAAPVEELTVGGTALTALMDVERRHGKFKPVIKKAMVELEGAPFKKFASKREEWALNNRYINPGPIQFVGPVANKVNHTLLLELGVDA

SEQ ID NO: 50450 - protein, 262 aa, Zea mays
MEALTFKPEDWGMKRGTDNEDFMFLNLGPNHPSAHGAFRIILQLDGEEIVDCVPDIGYHHRGAEKMGERQSWHSYIPYTDRIEYLGGCVNEMPYVLAVEKLAGIVTPDRVNVIRVMLSELFRINSHLLYISTFIQDVGAMTPVFFAFTDRQKIYDLVEAITGFRMHPAWFRIGGVAHDLPRGWDRLLREFLDWMPKRLASYEKAALRNTILKGRSQGVAAYGAKEALEWGTTGAGLRATGIDFDVRKARPYSGYENFDFEVP

SEQ ID NO: 50451 - protein, 354 aa, Oryza sativa (japonica cultivar-group)
MADEPWRLPNIVQELAAGVQEPPSRYLQDLAGGDQLAGAEIPEPIPTIDLGRLSGSDGADEAAKLRSALQNWGLFLVSNHGVETSLIDAVIEAAREFFRQPVEEKKKLSNLIDGKRFQIEGYGNDPVQTKDQILDWSDRLHLKVEPECDRNLAFWPTHPKSFRDILHEYTLKIKTVKNDILLALAKLLELDEDCLLNQFSDRAITTARFNYYSPCPRPDLVLGLKPHSDLCALTVLLTDKEVGGLQVLRDGTWYSVPAVRDYSLLINIGVTLEIMTNGTFRAPLHRVVTNAERERMSVAMFYAVDGEKEIEPVAELLGLKQQSARYRGIKGKDLLIGHYEHFSRGGRVVDSLKI

SEQ ID NO: 50452 - protein, 345 aa, Zea mays
MAGQEVANKRVVLKRYVTGFPGADDMEVVTGTARVAVPPGSTAMVLKNLYVSCDPYMRGRMTKHERPSYVPDFVVGEVLENFGVCKVIASGHQDFKVGDLVWGMTGWEEYTLIHNPESFFKINHPELPLSYYTGVLGMPGLTAWAGFFDVGKPKKGDNVFVSAASGAVGQLVGQFAKLTGCYVVGSAGSDEKVNLLKTKFGFDEAFNYKKEQDLDAALRRYFPEGIDIYFENVGGSTLEAVLPNMRIHGRIPTCGMISQYNLEEPEGVHNLFEIIAKRLRMEGFMVFDYYGQYHKFEQEMVGYLKAGKIAYVEDIAEGLEKAPEALIGLFTGRNVGKQLVAIARE

SEQ ID NO: 50453 - protein, 280 aa, Arabidopsis thaliana
  misc_feature (263)..(263): Xaa can be any naturally occurring amino acid
MEVERDQHKPPLSLQNNKIPSSQNFPVVDLSNTNGELVARKVAKASEEWGIFQVVNHGIPTELIRRLHKVDTQFFELPESKKEAVAKPANSKEIQGYEMDDVQGRRSHIFHNLYPSSSVNYAFWPKNPPEYREVTEEFAKHAKQLAEEILGLLSEGAGYLMKINYYRPCPEPDWVMGIKAHTDFNGLTLLIPNEIFGLQVFKEDRWLDVDYIYPAVIIIIGDQIMKMSNGRYNNVLHRALMDKKKTRMSSVVHIKPPYDMVVXPFPELTSGDNPPKFEPL

SEQ ID NO: 50454 - protein, 176 aa, Gossypium hirsutum
LFSFILILTHFLLKSSIRIQVLGWICVAISVSVFAAPLNIMARVVRTKSVEFMPFTLSFFLTLSAVMWFAYGLFIKDLCVALPNVLGFILGMLQMLLYAIHRHSEKVNIEEKKLPAEQMKSINVVLTTLGASEVHPVVLDIHTDDTKEEDNKNNEPTGEPDKQTDVKMEDANESPV

SEQ ID NO: 50455 - protein, 666 aa, Xylella fastidiosa Dixon
MTKPTRRQLANAIRFLAADAVQAAHSGHPGMPMGMADIAEVLWNDFLRHNPNNPNWFNRDRFVLSNGHGSMLQYALLHLSGYDLPLDELKRFRQLHSKTAGHPERSETPGIETTTGPLGQGFANAVGFALAEKLLAQRYNRPEHLIVDHRTWVFMGDGCLMEGISHEAAALAGTWNLGKLICFWDDNNISIDGNTAGWFTEDTPARFEAYGWHVIRDIDGHDAEKIATAIQAAVAQENKPSLLCCRTVIGFGSPNKAGKESSHGAPLGAEELEATRKMLDWPYGPFEIPSEIYDGWRANGTGMLRQAEWEQAFDNYARQYPKEAAELTRRSHAELPTDFLSQLDAYIAKVHAAGPCIASRKASQMAIEAFAPLLPELIGGSADLAHSNLTLWKGSQTVVGDAPNANYAYYGVREFGMSAIANGLALHGGFIPFDATFLVFSDYARNAVRMSALIPAHVIHVYTHDSIGLGEDGPTHQPVEHLAALRYIPNNDVWRPCDAVESAVAWKAAITRNNGPSCLVFSRQNLPHQPRHDAQLEQIARGGYILADAASSIPDIILIATGSEVSLAIEAKKTLDAMQLKTRVVSMPSTNVFERQHPTYRESVLPSKVHKRVAIEAGVTGFWWQYVGLHGAVIGLDTFGASAPADVLYKHFNITAEHVVEVAKAL

SEQ ID NO: 50456 - protein, 534 aa, Arabidopsis thaliana
MADQYEKRITWTIKNFSSLQSHAIYFDIFVVGDTKWHLLAYPKGYGDSINKCLSLFLGVPDPDDLPSGWKRHIIYRLTVVNQMSEKLSKQEVARGGFYPRSLTFGSQVMLPLTELYGGFLVSGQVKIVAEVGVLEVVGKSDVLEETLLVNGGINVNGFQVLPSQVESVNNLFKNHPDIASNFRLENTHLRTTYLNSLLCLTELLCQSPHKLSNVDLANAHCTLTCVTKAGFKLDWLEKKLKEVGLFSGRLVVTCEESSSRTMEDQYEKKITWTIKNFSFVQSQAIDSDIFVVGDSKWHLVAYPKGNGESTNKCLSLYLNVADFQSLPNGWKRHIKYRLTVVNQMSEKLSEQEVIQGWFYKNFHISGFQTMLPLSKLLDKNGGFLVNGDVKIVVEVGVLEVVGKSDVLEETLLVHESIDINGFQVLPSQVRKVPVESVNNLFEKHPDIVSEFRSKNPLMRTTYLNDLLCLTEILCESSEELSTGDMANAYSTLTCLKKAGFKLDWLEKKLKEVCEARVQEIDEEWKDLTDLKEKF

SEQ ID NO: 50457 - protein, 528 aa, Arabidopsis thaliana
MKIGDFLWKGEKVNGNDHDFLVTPNGLRDIVPLLYWFWVFTRTRLLAYPKGCVDHETKSLSLFLDVADSKSLPDGWKRHTKYRLTVVNQTSEKLSKKIGRQRKTLYGSTCHGLIGRRTCCSEIQCMCCEILVLTEVVSMFCDKTVGQPWFDQQYPNRGSLAMVPLTKLLDKNGGFMVNGEVKIVAEVGVLEVVGKSDVLEETSLVMESMYVNGFQVLPSQVEFVKSLFEKHPDIESKLHLKNPHMRITYLNSLLTLTEILSQSPENISNDDLANAYSTLSYVTKAGFKLDWLEKDLKDVGETRIQEIEEELKDIKQKCVEMKHKCVDMEALLDMLMAHIMWKVVLTNTNDKGAKRRELTPLRNTKRQKYGERQDTNASWLSDDRTIKPKLPSCGFRSMLPLNELLDVNGGFMVNGEVKIVAEVGVLEVVRKSDVLVETSLVMESIDVNGFQVLPSQVESVKSLFEKHPDIASKFRPKNPHLRTTSLNSLLSLTEILCHCQSPEELSIDDLANAYSTLICLTKAGFKLD

SEQ ID NO: 50458 - protein, 514 aa, Debaryomyces hansenii CBS767
MLPNSKVESNIEVDHSLSDLSSDNTVHLKRNLKNRHVSLIALAGIIGPGILIGASLALKNGGPASLIIGFGFIGLVAFSMMQSLGELATIYPTGGAFSTLGNKFVDPAFGGTVGWNYVIVWVAVLANEYNTVGSDGSIMQFWGPEVPLYGYILIFWAAFLAFQFLGVGAFGEAEYWLALFKLLGLVVFYIFSIVYVAGGVKGRPAFGFEYWNNPGAFSDGFKGVASTFVFASTFYSGTESIAIAAAETRNPSTAIPKAIRQTFWRIVIVYMGIAISYGMTVPYNDPSLNDGSKTLQSPMTIALVRAGWAQAGHLINAFILITCVSAINSSIYIGSRTIVNLAAEGFAPKLLRRVNGQGVPYMSVILMNLFGLISLMNISTGAADAYDYIVNLSGVAVFIVWGSVCYIHFRFRKAWKLQGRSIDELPYKALWFPWLAIFGLFFCIFLGLVQGWSYFKPFDAANFVDAYILLPFFVVLFVFFKIVNKTKWVKLDEIDLDDGRRHDIDVKKEVESEE

SEQ ID NO: 50459 - protein, 492 aa, Aspergillus nidulans FGSC A4
MPKVTSARAAAGTRRHNPLAEDIIGTGHLRTAPSKKIKRKSKADGDQEDGERFVDAKTSRKILQIGQELADEDAAEQRAARGVVEEPANRAFDFESRFEDEDVFSDDEGKFNEDQWDDEEDIEEVEVDPNDLDIFHKFVPRGDEDPIFNPSGPETSGQTTNLADLILEKIAEHEAKQAGNTGPIIQGGGLPEDAVQIPAKAVEVYEKVGMILSRYKSGPLPKPFKILPTVPNWQTLLSITRPESWTANAIYAGTRIFISHKPAIAQEFISTVLLERVREEIYEHKKLNVHTYNSMKKALYKPACFFKGLLFPLVSSGTCTLREAHIVSSVIARVSIPVLHSAAALLRMCDLAAEQSMKSLESTGAVNTFIRVFLEKKYALPYKVIDALVFHFLRFRAADPAEDSMTDGPSKAYKLPVLWHQSLLVFAQRYRNDITEDQREALLDLLLVRGHKDIGPEVRRELLAGRGRGIVAPDPERQHALDAGDDTMDTTL

SEQ ID NO: 50460 - protein, 413 aa, Neisseria meningitidis FAM18
MIIDVKVPMLSESVSEGTLLEWKKKVGEAVARDEILIDIETDKVVLEVPSPQAGVLVEIVAQDGETVVADQVLARIDTAATAAAEAPAAATAAAEAPAAATAAAEAPAAAPAEAAPAAAPAAAQNNAAMPAAAKLAAESGVDVNALQGSGRDGRVLKEDVQNAAAKPAAAAAPAVALPAGARPEERVPMSRLRARVAERLLASQQENAILTTFNEVNMKPIMDLRAKYKEKFEKEHGVKLGFMSFFVKAAVAALKKYPVVNASVDGKDIVYHGYFDIGIAIGSPRGLVVPILRDADQMSIADIEQAIVDYAKKAKDGKIAIEDLTGGTFSITNGGTFGSMMSTPIINPPQSAILGMHATKERAVVENGQVVVRPMMYLALSYDHRIIDGREAVLTLVAIKDALEDPARLLLDL

SEQ ID NO: 50461 - protein, 557 aa, Debaryomyces hansenii CBS767
MTTAVGLEDNSKGNIITVMSKDPLVFCIIAFASIGGLLFGYDQGVISGIVTMESFAAKFPRIFSDPDYKGWFVSTFLLCAWFGSLINSPVVDRFGRRDTIRIACVVFVIGSVFQCAGTSVSMLFAGRAVAGIGVGQLTMVVPIYMSELAPPSVRGGLVVIQQFSITIGILISFWINYGTQFIGGTKCAPDQDYKGDTFDPYIDVPQGGCYGQKDASWRIPFGLQIAPAFILGIGMSFFPRSPRWLLSRKREEEAWEALNYLRRRNNPDMIDAEFNEIKSDVLFEQKYNERKFQGKTGMSFFITSYWDLVSTKSNFKRVFIGSAVMFFQQFIGCNAIIYYAPTIFSQLGMDSNTTALLGTGVYGIVNCLSTIPAIFAIDRFGRKTLLMAGAAGTFVSLVIVGAIVGTYGDTLSKHKTAGRAAIAFIFIYDFNFSYSWAPIGWVLPSEIFSIGIRSKAISITTSSTWMNNFIIGLVTPRMLETMKWGTYIFFAAFAIIAFAFTWFVIPETKGVPLEEMDLVFGDLDALQEKQNFSRMNELSKMDSIKATTDISEAHYSD

SEQ ID NO: 50462 - protein, 477 aa, Neisseria meningitidis FAM18
MSQYDVVVIGAGPGGYVAAIRAAQLGFKTACVDAGVNKAGNAPALGGTCLNVGCIPSKALLQSSEHFHAAQHEFAEHGITVGDVKFDVAKMIERKDAIVTKLTGGVKFLFQKNKVTSLFGTASFAGKNGDAYQIEVDNKGEKTVIEAKHVIVATGSVPRPLPQVAIDNVNVLDNEGALNLTEVPAKLGVIGSGVIGLEMGSVWNRVGAEVTILEAAPTFLAAADQQIAKEAFKYFTKEQGLSIELGVKIGDIKSEGKGVSVAYETAAGEAKTEVFDKLIVAIGRIPNTKGLNAEAVGLEKDERGFIKVDGECRTNLPNVWAIGDVVRGPMLAHKASDEGVAVAERIAGQKPHIDFNNVPFVIYTDPEIAWVGKTEEQLKAEGVEYKKGTSGFGANGRALAMGKAKGTVKVLADAKTDRILGVHMIGPVVSELVTEGVTALEFFASSEDIARIIHAHPTLSEVVHEAALAADKRALHG

SEQ ID NO: 50463 - protein, 847 aa, Oryza sativa (japonica cultivar-group)
MQMPFCPKLWSSAAPAPVQPGSVVINGTVVVANHFGLSAPGKSTTLRLFSGTEVDHETRKGRLSAEAALRGGKKTRHGKASTTMYQVTFFVDGEFGTPGAVAVKNGNRNDQFFLRHVRLDLAEDRSIHFDCNSWVYPYKKTTSDRVFFINTSYLPDKTPEALRLLREEELRSLRGNGRGERKDWERIYDFDYYNDLGNPDNDDHVRPVLGGTKTHPYPRRCRTGRPLSKTDGVTETRKHKLINLDYYIPPDERFSPGKLAEVLAMGVQAVTHFVIPEARSIFHGDVVNFKSTEQLRADLYGKPPQPAADARVMDELKSSVPSHKTYKQVSRIVKDNPAKFPTPQVIHYDTEAWRSDEEFAREMLAGLNPVVIKRLEVFPPNKSKITTDDIMTQIGGLTIQQAMEQKRMYILDHHDYLMPYLRRINTEGVCVYASRTLLFLRDDGALRPVAIELSLPDGGVGGSEISRVFLPASQGTDAHLWHLAKTHVAVNDSGYHQLISHWLFTHATVEPFIIATRRQLSAMHPIHKLLDPHFKDNMQINTLARSILLNAGGLLEKTMYPGKYSMEMSSDIYAHWRFTEQSLPNDLIKRGMASRDPKARGGVSLHIEDYPYAVDGIDVWLAIEGWVRSYCDHFYHADAAVAGDAELQAWWDDVRRVGHGDRQGDAACWLDLDTVAGLVETLSTLIWTASALHAAVNFGQYGYAGYPPNRPTRCRRFVPLPGSPEMAQLEADPGRFFLETVPDRFTATLGIALIEVLSNHTSDEVYLGQRATSTWTDDGEVLLLLDRFRDELRRVEKRVEERNKDPRLVNRRGPVRVPYTLLYPDAGDVAGKEKGITGRGIPNSVSI

SEQ ID NO: 50464 - protein, 309 aa, Triticum aestivum
MAEAPAASRRAEEAGSRRRADDEAEAAAAADGDGDSSVYTSEDEGTEDYRRGGYHAVRPGDTFKQGAYVVQSKLGWGHFSTVWLAWDTAHSTYVALKVQKSAQHYTEAAMDEIKILRQIADGDPEDSRCVVKLLDHFKHSGPNGSHVCMVFEFLGDNLLTLIKYTDYRGIPLPMVKEICRHVLIGLDYLHRELSIIHTDLKPENILLVSTIDPSKDPRKSGVPLVPPAARAIEPPPRAPAAPSASSGLTRNQKKKIRKKAKRVAASTSEGNGAVAAVDTDESDDKGDLSTANEGSPSEDGDRKRGGGHR

SEQ ID NO: 50465 - protein, 176 aa, Oryza sativa (japonica cultivar-group)
MASHVDPLVVGRVIGDVVDLFVPTTAMSVRFGTKDLTNGCEIKPSVAAAPPAVQIAGRVNELFALVMTDPDAPSPSEPTMREWLHWLVVNIPGGTDPSQGDVVVPYMGPRPPVGIHRYVMVLFQQKARVAAPPPDEDAARARFSTRAFADRHDLGLPVAALYFNAQKEPANRRRRY

SEQ ID NO: 50466 - protein, 336 aa, Shewanella sp. MR-4
MTIRVAINGYGRIGRNVLRALYESEKAYPIKIVAINDLGDASINAHLTKYDSVHGRFNAKVEHDAEAIYVNGDKILTFQERDPGKLPWGDLQVDVVFECTGIFTSKESVQPHLAAGAKKVIISAPGKNVDATVVYGVNNNVLTADMTVISNASCTTNCLAPFAKPLNDEIGIESGLMTTIHAYTNDQRLSDVYHTDLRRARAAALSMIPTKTGAAAAVGLVVPELQGKFDGLAVRVPTVNVSLVDLSFIAARDTTVEEVNAIIERAAAVAPLSEVLAVNKEPLVSIDFNHNAFSSNFDATQTRVNGRLVKVMAWYDNEWGFSNRMLDNAVALMNAK

SEQ ID NO: 50467 - protein, 335 aa, Novosphingobium aromaticivorans DSM 12444
MRAAVMQGLHKPLAIDTIPDPTPGEGDVVVKVGRCGICGSDLHMTEDPAYGQGAGSVLGHEFAGEVVALGKGVEGLRTGDLVSVIPLQSCGQCHSCRTGEVQWCERFGLQGGGYAEFALTRPNQCVRLPASASMADGAIVEPLAVALHGLALSRMKIGDKVLVLGAGPIGLAVAFWARRFGAGRVVVQDLAEWQRDRALQMGAHDFVVDAADPVGSAGRALGGKADIVFECVGVPGLIAQAVEQVRNDGTITLLGLCTRPDTFNSFAMLSKQVKLVTSAFFTRQEYEAALDALVRGAVEPRLLVTDTISLDATPDVFESLRKRTHQCKVLINPGE

SEQ ID NO: 50468 - protein, 325 aa, Shewanella sp. MR-4
MAEMNMLQAVNEALSIAMQSDERMVVFGEDVGHFGGVFRATSGLQEKFGRSRCFNTPLTEQGIAGFANGLASNGMTAVAEIQFADYIFPAFDQIVNESAKFRYRSGNEFNVGSLVFRTPYGGGIAGGHYHSQSPEAYFTQTPGLKVVVPRNPEQAKGLLLASIRDKNPVVFFEPKRLYRASVGEVPAGDYEIELGKAEVVREGKDITLVAWGAQMEIIEKAADMAAKEGISCEIIDLRTLAPWDVDTVADSVKKTGRLLINHEAPLTGGFAGEIAATIQQECFLYLESPISRVCGLDTPYPLVHEKEYMPDALKTFEAIKASVNF

SEQ ID NO: 50469 - protein, 423 aa, Geobacillus kaustophilus HTA426
MAADKHTEEKEQQYDVLASTQIVIHRALEKLGYPEEVYELLKEPIRVLTVRIPVRMDDGSVKIFTGYRAQHNDAVGPTKGGVRFHPDVTEREVKALSIWMSLKCGIVDLPYGGGKGGIVCDPRTMSFRELERLSRGYVRAISQIVGPTKDIPAPDVFTNSQIMAWMMDEYSRIREFDSPGFITGKPLVLGGSHGRETATAKGVTICIREAAKKRGLSLKGARVVVQGFGNAGSYLAKFMHDAGAKVVGISDVYGALYDPNGLDIDYLLERRDSFGTVTKLFKNTISNQELLELDCDILVPAAIENQITAENAPRIKASIVVEAANGPTTLEATEILTQRGILLVPDVLASAGGVTVSYFEWVQNNQGYYWTEEEVEQRLEKVMVKAFNNVYEMAQTRRVDMRLAAYMVGVRKMAEACRFRGWV

SEQ ID NO: 50470 - protein, 188 aa, Pseudotsuga menziesii var. menziesii
DDVTVITMDGAPKEGCQHISVLTEADETQCPSVEIHPEDVVALPYSSGTTGLPKGVMLTHKGLVSSVAQQVDGENPNLYFHSEDVILCVLPLFHIYSLNSVLLCALRAGAATLIMQKFNLTTLLELIQRYKVTVAPIVPPIVLDITKNPVVSQYDVSSVRMIISGGAPLGKKLEDALRDRFPKAIFGQ

SEQ ID NO: 50471 - protein, 486 aa, Burkholderia mallei ATCC 23344
MPRRPGARTGDAATRAPHEKENAVAKILENVEHIVVVMFENRSFDTMLGWLYSPDAPPAHVLPPQSSPQFDGLRPEMSNPSKAGKTIAVTREALNSVIPDPQETFVNVTSQILGPSDAGNPWPPMQGFVVNYETTQTTDPGHVMQCHSVAQLPTLTALARAYAVSDAWFASVPSQTWPNRAFAHAGTSNGHVNNGAIPDPLEWDVPTIFDVLSSIGASWAVYSDTTVTPSLTHTMFPSLWKDAYAERFRRFPDFVAACGNDALPQYAFIEPSFLFEPNDQHPPHDVRAGDKFLHDIWTAIRTSPGWPRTLLVVTYDEHGGCFDHVLPPANATPPDNASNPGDEAFGFYRFGVRVPAVVVSPYIEAGTVFRSPTNVPYDHTSILATLRDWLDIPPDRMLGSARIANAPTLAQLVTRDTPRTDLPTIAAPSTDFVHPPPDAPLNDVQKSLVTGTSRRDGHDPAAGVAPIATRQHALDFFKRRAAAKTA

SEQ ID NO: 50472 - protein, 546 aa, Oryza sativa (japonica cultivar-group)
MTTSTRACSDDPTFSSSSNNTFFSSSWRPDKDNGIRFSVPGWDGGSEGATSANLTDDQLLGGLLTAAFSPQSCRSRYEFAGYHKRKPPHKPSPYLVAKLRSHEALQKRCGPGTAPYDKALRQLKSGDGAAAADGDDDCRYLVSISYNRGLGNRIIAIVSAFLYAVLTERALLVAPYNGDVAALFCEPFPGTTWLLPDGGRRFPLLHLRDLDGKSKESLGALLKSNGIVSVAAGVNGSTSSSWSGRPPPPYVYLHLDGGADYHDKLFYCDEQQRLLRGVPWLLMKTDSYLVPGLFLVPSLRGELERMFPEKDAVFHHLSRYLLHPANAVWHAITAYHRDHLAGAGHLVGIQIRVYHEETPPVSQVVLDQVLSCARRENLLPAAGNTSSSDQAVLVTSLSSWYYEKIRDELGGGGGGVHQPSHEGLQRMGDTAHDMRALSEMYLLSTCDALLTTGFSTFGYVAQGLAGLRPWIMPRRPWWEKEAATAVPDPPCARVATPEPCFHSPSYYECAARRNYDDIGKVVPYVRRCEDVSWGIQLVNGSSQSQW

SEQ ID NO: 50473 - protein, 600 aa, Polaromonas sp. JS666
MTFSVHGLAVSRGIAIGRAVLVASSRADVAHYFVDPARVVEEITRARVARNAVAEEITRLQQELPPDAPHELAALLDVHLMLLQDEQLISGVKHWITERHYNAEWALATQYEIIARQFDDMEDEYLRERKADLEQVVERILRYMKGVASPVQPVGPAGAGRKLSQGLLLDDTMDVPLVLIAHDISPADMLQFKKSLFAGFATDVGGKTSHTAIVARSMDIPAVVGARSASQLIEQDDWVIIDGDAGVLIVDPSPIILAEYGFKQRQGELERERLNRLKHTPAVTIDGQRVELLANIEMPEDTVGAVNAGAVGVGLFRSEFLFMGRSGDLPDEEEQYQAYRKAVEGMHGLPVTIRTVDVGSDKPLDRIDKAQDSHLNPALGLRAIRWSLADPPMFLTQLRAILRAAAHGQVNLLVPMLAHGTEIRQTMAMIDHARATLDNKGTPYGPVRLGAMIEIPAAALSLKLFLKYFDFLSIGTNDLIQYTLAIDRADESVAHLYDPCHPAVLRLVADTIAECNAQGKGVSVCGEMAGDVSMTRLLLGLGLRSFSMHPSRILAVKQQILRADAGKLSVWAAQVLDAEDPAALINPASAPMPSPVPANA

SEQ ID NO: 50474 - protein, 454 aa, Zea mays
MAAKATGHVGTEAMEVSVEVANGDDDAARLDDDGRPRRRGTMWTASAHIITAVIGAGVLSLAWAMAQLGWAAGTAMMLLFAGISYYTSTLLAECYRCGEPGTGKRNYTYTEAVRAILGGAKFKLCGVIQYANLVGIAVGYTIAASISMLAIKRADCFHDRGHRNPCRSSSNPYMILFGAVEIVFSQIPDFDQIWWLSIVAAAMSFTYATIGLALGIAQTVANGGFKGSLTGVNVGDGITPMQKDTIKAPPPSEVTVMKKATMVSVATTTVFYMLCGCMGYAAFGDDAPDNLLTGFGFYEPFWLLDVANAAIVVHLVGAYQVFCQPLFAFVEKRAAARWPDSRFMTRELRLGPFVLGVFRLTWRTAFVCLTTVVAMMLPFFGDVVGLLGAVSFWPLSVYFPVEMYKAQRRVRRWSTRWLCLQTLSAVCLLVSIAGAVGSTAGVINAVNLHRPFSG

SEQ ID NO: 50475 - protein, 754 aa, Brevibacterium helvolum
MEVWPGNAYPLGATFDGTGTNFALFSERAERVELCLLADDLTETRIELTEVDGYVWHCYLPHIQPGQKYGYRVHGPYDPASGNRFNPNKLLMDPYAKAVAGQIDWVIDPALFSYEFGDPDSRNDADSAPHTMHGVVINPFFEWDGDRQLKIPYHQSVIYEAHVKGLTQLHPEIPEEQRGTYAGVAHPAVIEHLKKVGATAIELMPVHQFVNDGTLVEKGLNNYWGYNTIGFFAPQNTYSATGDVGHQVQEFLVMVRDLHRAGIEVILDVVYNHTAEGNHLGPTLSFKGIDNQAYYRLVDNNCKHYMDYTGTGNSLNVRHPHSLQLLMDSLRYWVTEMHVDGFRFDLASTLAREFYDVDKLSTFFELIQQDPVVSQVKLIAEPWDVGPGGYQVGNFPPQWTEWNGKFRDTVRDFWRGEPSTLGEFASRLTGSADLYESSARRPVASINFVTAHDGFTMRDLVSYNEKHNDANGEGNNDGESHNRSWNCGVEGDTDDEKVLALRARQQRNFIGTLLLSQGVPMLLHGDELGRTQQGNNNTYCQDSELSWIHWEAMDQPLVEFTAFVNKLRHDHPTFRRSRFFDGRPVRRGEGEKLPDIVWLKTDGTEMLPEDWGSGFGRTIGVFYNGDGIQEQDSRGRRITDDSFIMAFNAHDDAVDFCLPAEEYSQYWEVQFDTAAQADDYEPLKAGATLKLDAKSMVVLRAYSGPEEEVDYSAAASVASMAEQEEAQEEMVEAQTKAAEASEARATGADEDAKA

SEQ ID NO: 50476 - protein, 392 aa, Oryza sativa (japonica cultivar-group)
MEASLDQLPDQLSRGLEDAPPSNSNLTGDQLLGDLLSAAFSWQSCRSRHEALQVRCGPGTAPYEKALRQPKSGDGAIAADGDDDDCRYVVSIVYDRGLGNRVIPIISAFLYAVLTERALLVAPYNGDVDALFCEPFPGTTWIHPGGRRFPLRRLRDLDGKSRESLGTLLKSNAVSVDAGGNGTSSWSGRPPPYVYLHLDGGADYHDKLFYCDEQQRLLRGTPWLLMKTDSYLVPGLFLVPSLRGELERMFPEKDAVFHHLSRYLLHPANAVWHAITAYHRDHLAGAGHLVGIQIRVYHEETPPVSQVVLDQVLSCARREKLIPFPTAGTTTNTSSSDQAVLVTSLNSWYSDRIRDELGGGGGVHQPSHEGWQRMGDTAHDMRALSEMYLLST

SEQ ID NO: 50477 - protein, 373 aa, Magnaporthe grisea 70-15
MPSQTSLSSEELNRRKLVGINKETVTNTISTDYPGAHYGEEHAWDVNEFSQHLNIQFHQNDPSLASFSLIGVDASIANAFRRIMIAEIPSLAIERVFITNNTSVIQDEVLAQRLGLVPLKGSKEGLRKFMKPFKRTETGGFDNSFDFNTVNLRLNVKCTRNPDAKPGENDPNKAYIKPNVYASDIEFVPAGQQTDYFSGDGAIVPVNPDILIAKLRPGQGIDLEMHAHIGYGWDHAKFSPVCTASYRLMPIIDIVKPIVGADAEKFRDCFPDGVIRLQPVTAAEAKEKGSGYEGHKGEMKAVVNDPMRDTVSRECLRHAEFEGKVKLGRRRDHFIFSIESAGQWDSDELFLASIAELKSKCKKLEEQVLNMVR

SEQ ID NO: 50478 - protein, 199 aa, Sulfolobus tokodaii str. 7
MIPIFETQYNEELFYSVYFIVFSVDFIIAYRNMWVRRRAEVREREFSTFFIFIGALFFTIFFSFFFGYYSYFSGIGELPEAFIYIGLVFMIAGESFRIWAILTLGKYFSPVVTVYSDQRVISWGPYSLVRHPAYGGAIILLLGVALSLRSLFSLPLVLVDIAVYNYRANLEERLLIQNLGEEYLDYKKRVKKKIIPYVF

SEQ ID NO: 50479 - protein, 364 aa, Aspergillus nidulans FGSC A4
MASLRLFRPAARLLSSRLSATRPTFPQTACTPSILRFRGYATENGTKEVTVRDALNEALAEELERNQKTFILGEEVAQYNGAYKVTRGLLDRFGPKRVIDTPITEAGFCGLAVGAALAGLHPIAIDQIINSAAKTHYMSGGIQPCNITFRGPNGFAAGVAAQHSQDYSAWYGSIPGLKVVAPWSAEDAKGLMKAAIRDPNPVVVLENELLYGQAFPMSEAAQKDDFVLPIGKAKIERPGKDLTIVSLSRCVGQSLNAAAELKQKYGVEAEVINLRSVKPLDVETIIQSLKKTGRLMCVESGFPMFGVSSEILALSMEYGFDYLTAPAVRVTGAEVPTPYAVGLETMSFPQEDTIVGQAAKLLRL

SEQ ID NO: 50480 - protein, 504 aa, Triticum aestivum
MAPSYDKTIATAASLAASLMLVRSLANELLPSEVRDALSSALASIRSRMTWQHTIIIKEIEGWCRNCVYDAVKAYLATRINANLNMQRLRVSSAGESEKMVVSMEAGEEMADVYQGAEFKWCLVTREVKGDPNNGGGGAREIRSYEVSFHKRHKEKALKEYLPFIVATAKAIKDQERSLSIYMNEHGDEWSPIDLQHPSTFDTLAMDHKQKQSIVDDLDRFIKRKDYYRRIGKAWKRGYLLYGPPGTGKSSLIAAIANHLRFDIYDLELTGVDSNSDLRRLLVGMTNRSILVVEDIDCTIELKQREEDDKEHAKSNSTEKKKAEDKVTLSGLLNFVDGLWSTSGEERILIFTTNYKERLDPALLRPGRMDMHIHMGYCTTEAFRILANNYHSIDYHVTYPEIEALIEEVTVTPAEVAEVLMRNDNTDVALHDLVELLKLKKKDAIEIEGKQAEEKKDANEIKTQSMQVDEKKIVDEIKTESVQVEKKDDKKVVVKNDFTENGSG

SEQ ID NO: 50481 - protein, 433 aa, Saccharomyces cerevisiae
MATDTERCIFRAFGQDFILNKHFHLTGKIGRGSHSLICSSTYTESNEETHVAIRKIPNAFGNKLSCKRTLRELKLLRHLRGHPNIVWLFDTDIVFYPNGALNGVYLYEELMECDLSQIIRSEQRLEDAHFQSFIYQILCALKYIHSANVLHCDLKPKNLLVNSDCQLKICNFGLSCSYSENHKVNDGFIKGYITSIWYKAPEILLNYQECTKAVDIWSTGCILAELLGRKPMFEGKDYVDHLNHILQILGTPPEETLQEIASQKVYNYIFQFGNIPGRSFESILPGANPEALELLKKMLEFDPKKRITVEDALEHPYLSMWHDIDEEFSCQKTFRFEFEHIESMAELGNEVIKEVFDFRKVVRKHPISGDSPSSSLSLEDAIPQEVVQVHPSRKVLPSYSPEFSYVSQLPSLTTTQPYQNLMGISSNSFQGVN

SEQ ID NO: 50482 - protein, 444 aa, uncultured archaeon GZfos31B6
MILMTANEDVLGMIAENNIKFIRLQFVDVLGIVKNVAIPAAQMKKALDVGISFDGSSIEGFARIQESDMVLKPDPETFRILPWKADEGKIAGIVCDVCLPDGTPFHGCPRYALTRAITEAEKMGYVMNTGPELEFFLFEKEDGIPTTTPHDSGGYFDFPPVDLAEDIRRDIVIALEEMDFEIEASHHEVACGQHEIDFKYSDALTTADKVVTFKYVTKTIATNKNLHATFMPKPVFGTSGSGMHINTSLFNKNNENVFFSPDDDHGISDTARYFIGGLLAHIKAVTAITNPLVNSYKRLVSGYEAPVYITWSWANRSSLIRVPAARGSGTRIELRSPDPSCNPYLAFAAILASGLDGVKNKIDPGEPIEENIYEMDFHEITDAGIDTLPTSLSLALDYLESDAVVRSALGEHVYTAFMRVAAAEWEEYRVQVHQWELDRYLQLF

SEQ ID NO: 50483 - protein, 217 aa, Zea mays
MAGGGDKVDYVFKVVLIGDSAVGKSQILARFARNEFSLDSKATIGVEFQTRTLVIEHKSVKAQIWDTAGQERYRAVTSAYYRGALGALLVYDITKRQSFDHIPRWLEELRGHADKNIVIMLVGNKSDLEDERAVSTEDAKEFAEKENLFFLETSALQATNVENAFQTVLTEIFKIHSKKNMAADPRANGAAPSLAGKKVIVPGPAQEIPKSKCCSSM

SEQ ID NO: 50484 - protein, 398 aa, Shewanella oneidensis MR-1
MAAAPSGASTGSREALELRDGDKSRYLGKGVLTAVANVNGPIRTALIGKDATAQAELDQIMIDLDGTENKDKLGANAILAVSLAAAKAAAAFKGMPLYAHIAELNGTPGQYAMPVPMMNILNGGEHADNNVDIQEFMVQPVGAKNFREALRMGAEIFHTLKKVLHGKGLSTSVGDEGGFAPNLSSNADALAVIKEAVELAGYKLGTDVTLALDCAASEFYKDGKYDLAGEGKVFDSNGFSDFLKSLTEQYPIVSIEDGLDESDWDGWAYQTQIMGDKIQLVGDDLFVTNTKILTRGIENGIANSILIKFNQIGSLTETLAAIRMAKAAGYTAVISHRSGETEDATIADLAVGTAAGQIKTGSLCRSDRVAKYNQLLRIEEQLGEKAPYRGLKEIKGQA

SEQ ID NO: 50485 - protein, 375 aa, Streptococcus suis 89/1591
MAQNKMLAMILAGGRGTRLEGLTKKVAKPAVAFGGKYRIIDFPLSNCANSGIDIVGVLTQYEPVLLNSYVAQSQRWGLDVQGSGVFVLPPSEKIEGFGLYKGTADAITQNIDFIDLHDPEYVLILSGDHIYKMNYDKLLDTHIQKKADATIAVIEVPIKEASRFGIMNTDEDYRIEEFEEKPENPKSNLASMGIYIFTWKTLKKYLQEDDKLDTSSHDFGHDIIPKYLEDGRTLIAHPFRGYWKDVGTVNSLWESNMDLIDHAGDLDLSDRSWRIYSEDKGSPAQVIGATATVKSAYIDKGAVIDGTVEHSVISTDVQVNQNAVVKNSVVLPGAIIGEGVELDYVIVAENIKIADGVKLTGDIDHILLIDKNVTK

SEQ ID NO: 50486 - protein, 188 aa, Pseudotsuga menziesii var. menziesii
DDVTVITMDGAPKEGCQHISVLTEADETQCPSVEIHPDDVVALPYSSGTTGLPKGVMLTHKGLVSSVAQQVDGENPNLYFHSEDVILCVLPLFHIYSLNSVLLCALRAGAATLIMQKFNLATLLELIQRYKVTVAPIVPPIVLDITKNPVVSQYDVSSVRMIISGGAPLGKKLEDALRDRFPKAIFGQ

SEQ ID NO: 50487 - protein, 371 aa, Streptococcus suis 89/1591
MLRNTLGIVNIEGNNVHFGDVMKHRGVQAFGFLGRYRLIDFALSNMSNSGITEFQVYMPAEMRSTIQHVGTGKHYNINSKRGTLRLLNSATDPNSVYRHDINAFTENIHYIEKSTKDYVLVAPSYFIYSQDFSKVMDDHIATDADITVLYKNVSDAKENFIGCQTLKFGEDRRVVAFEENHGKYKNRPVSLEAYIMKRTTFIDLIKRANKVSSLYWLKDILRDTVDQYKIMGYAHRDYVACINTTASYFNTQIELIDQDTRKLLFKHDWPIHTQTSDSSPCLYGPLAEVKRSLISNGANINGQVENSVIDRDVIIEEGVVIKNSIILNGVTIKSGANIENAIIDKATKIIHPIDIKGSETSPSYLKPHQII

SEQ ID NO: 50488 - protein, 465 aa, Arabidopsis thaliana
MDHVSSLPEGVLCNIFSFLTTKEAALTSILCKRWRNLLAFVPNLVIDDSVFLHPEEGKEERYEIQQSFMEFVDRVLALQGNSPIKKFSLKFRTDFASHRVNAWISNVLARGVSELDVLVILYGAEFLPLSPKCFKSRNLVTLKINSLGIDWLAGDIFLPMLKTLVLHSVKLCVDKFFFRALPALEELVLFAVSWRDRDVTVSNASIKTLTIKFNYYLGTLSLDTPSLVSFCFSDHVAKDYPLAKMEKLSEARISLLVTEYQIERARAPNIYWVEDDVVLRLVNVGKLMKGIRNVQYLNLSPNTLEVLSKCCESMPLFNNLKSLTIESNERRGWQAMPVLLRNCPHLETLVLEGLLHHVTEKCRNACDCVSQEEKGRSLTSCQVKVLEIKGFQGTTKEMHTIKHFLEHFPCLREIKIHMEENGPTQLRVPEVSQYIAEMMEHYEKSSSCNVQLLVGGYLCKKWTTQ

SEQ ID NO: 50489 - protein, 204 aa, Picrophilus torridus DSM 9790
MSDYNINFNDGIVPVVVQDFDTGDVLTLAYMDRNALEMTMKTGYAFYYSRSMKRIHMKGEVSGNTQKVMEIYQDCNDNSLLIKVKKDGPACHTGNNSCFYRKLGEPKVDGNIDYSLEILLRLEDLVRKRMKDPVNGSYTNYLIDSGDENIRKKVGEEAIETILASGRDRIVYETADLLYHLIVFLAFNNVSLFDVMNELNRRSK

SEQ ID NO: 50490 - protein, 174 aa, Picrophilus torridus DSM 9790
MIRNTRETEIYVELYKDGGINTGDPVLDHMVKTMFFYANIPVTVNAKFDLRHHLWEDLGITIGLEINRVKKDNIKRYGYSIIPMDDALIICSIDFSRSYLNMHVDFKDEEGFEISLIHEFLNALSRTSNITMHFIKMSGENAHHISECMFKALGFSLRSALEASDRIESTKGSI

SEQ ID NO: 50491 - protein, 331 aa, Gluconobacter oxydans 621H
MRPTLTLRIFLSWLAWQSRRRGVTPRMIALEEIPPIPAAPPAAPILKQIRRITGRPSFPVALSSLRIRRWREIRVPGADGFRTARLYRPRGKVRGVVLFLHGGGFVHCDMVSHHGICCRLAAASGAMVVSLDYRLAPEHRFPAGLEDAKAALDWIFRTVGEDVPVAVAGDSAGGNMSAALTQWVREKGLRPLSAQLLYYPALSGPFVPPSRQAYAEGYMLSAELLYWYCGQTLRSPEQLFDPAFSPLLAEDFQDLPPAMIVTAGFDPLRGEGELYARCLDEAGVPVRLKNFPRMIHGFLNGYALFRDGRQALREGGMFLREVFAQKNGGAC

SEQ ID NO: 50492 - protein, 488 aa, Magnaporthe grisea 70-15
MASLYRLAGRGASKRLCLRPATSSQIPISASCSSAASTIRSLSSTTRRRYATTPDPAELIKAQATRLVPVDSDFSNPVDPYFVTNRKDDIEANEPGVAERKIRHYTVNFGPQHPAAHGVLRLILELSGEEIVRADPHVGLLHRGTEKLCEYKTYLQALPYFDRLDYVSMMTNEQCFALAVEKLLNIEIPERAKYIRTMFGEITRVLNHLMSVLSHAMDVGALTPFLWGFEEREKLMEFYERVSGARLHAAYVRPGGVHQDIPAGLLDDIYQWATQFGDRIDETEEMLTDNRIWINRLQGVGVVSAKEALDLSFTGVMLRGSGVPWDIRKSSPYDAYDKVEFDIPVGLNGDCYDRYLCRMEEFRQSLRIIHQCLNQMPAGPVRVEDYKVSPPPRAAMKENMEALIHHFLLYTKGYAVPPGDTYSVIEAPKGEMGVYVVSDGSERPYRVHIRAPGFAHLAGFDHVCKGHLLADAVAVIGTMDLVFGEVDR

SEQ ID NO: 50493 - protein, 999 aa, Oryza sativa (japonica cultivar-group)
MASALFLWLSWLVLSLLSIYLLDLLAHSRRRLPPGPRPLPLIGSLHLLGDQPHRSLAGLAKTYGPLMSLRLGAVTTVVVSSPDVAREFLQKHDAVFATRSAPDAAGDHTRNSVPWLPPGPRWRELRKIMATELLATHRLDALHELRQEKVSELVDHVARLARDGAAVDVGRVAFTTSLNLLSRTIFSRDLTSLDDRGASKEFQQVVTDIMGAAGSPNLSDFFPALAAADLQGWRRRLAGLFERLHRVFDAEIEHRRRVAGEEHGKVKDDFLRVLLRLAARDDDTAGLDDDTLRSVFTRVRAAADDRPSPESSRGRCPTPRSGGDGRPPPGSEGGGGLSGMRAAATESGGFSGACAQRRRWWRAGRLGRWGGTGSGYRDGDGDDDDDGDRDGDDDGDREEGPGPKVVTPVGPMVDQAQCDLDGPRLYCNGGFVSLAFMACALSLLSVYLLDLLAQSRRRLPPGPHPLPLIGSLHLLGDQPHRSLAGLAKTYGPLMSLRLGAVTTVVVSSPDVAREFLQKHDAVFATRSAPDASGDHARNSVALLPNSPRWRELRKIMATELFSTSRLDALHELRQEKVVELVDHVARLAREGAAVDVGRVAFTTSLNLLSHTIFSRDLTSLDDHGASKEFQQVVTDIMGAAGSPNLSDFFPALAAADLQGWRRRLAGLFERLRRVFDAEIEHRRRVVGKEHGKVKDDFLRVLLRLAARDDDTAGLHDDALQSIFTDLFAAGSDTSSSTVEWAMAELLRNPLPMAKACDELQRVIGSTRRIEESDIGRLPYLQAVIKETFRLHPPVPFLLPRQATTTIQILGYTIPKGAKVFINVWAMGRDKDIWPEAEKFMPERFLERATDFKGADFELIPFGAGRRICPGLPLAVRMVHVVLASLLINFKWRLPVKVERDGVNMTEKFGLLQSKEKDRSDLAYVINAVKDLMGAAAATTATNLTILPSPRVRKSKCEEAHVMPTTAKLHTPATTKHGLTDYVASCDNEAHIQDNKWPPS

SEQ ID NO: 50494 - protein, 188 aa, Cicer arietinum
STKADASESDLESWIERLLNQLKQVNSQMQAWVSSGGSEMVSHTLNRHQEIFQDLTQEFYRLRSNLRAKQEHASLLDDFKEFDRTRLDLEEGSGSEQQTLLKERASISRSTGQMDTVISQAQATLGALVFQRSTFGGINSKLSNVSSRLPTVNNILSAIKRKKSMDTIILSLVGSVCIFLIFIYWLTK

SEQ ID NO: 50495 - protein, 526 aa, Streptomyces coelicolor A3(2)
MSSATPAAAAPDTVLVVDFGAQYAQLIARRVREARVYSEIVPSSMPVEEILAKNPAAIILSGGPSSVYEAGAPTLDRSLFEAGVPVFGMCYGFQLMAQTLGGTVDNSGAREYGRTELAVSKPSSTLFEGTPAEQSVWMSHGDACSAAPEGFTVTGSTDVVPVAAFENDEKKLYGVQYHPEVMHSTHGQQVLEHFLYRGAGLSPDWTTGNVIEEQVAAIRAQVGDRRAICGLSGGVDSAVAAALVQKAIGSQLTCVYVDHGLMRKGETEQVEKDFVAATGVQLKVVDASERFLGALAGVSDPEQKRKIIGREFIRVFEQAQLEIMREDGPEVAFLVQGTLYPDVVESGGGTGTANIKSHHNVGGLPDDIEFELVEPLRQLFKDEVRMVGQELGLPDEIVQRQPFPGPGLGIRIVGEVTKERLDLLREADAIAREELTAAGLDRDIWQCPVVLLADVRSVGVQGDGRTYGHPIVLRPVSSEDAMTADWSRLPYEVLSKISTRITNEVTDVNRVVLDVTSKPPGTIEWE

SEQ ID NO: 50496 - protein, 112 aa, Cicer arietinum
EVILAQPTVPLYHLAYADVLYTLGGLENLQTAKKYYASTIDLTGGKNTRALFGVCLCTSAIAQLTKGKNKEDKEGSQLHSLAAKALEKDYKQRAPDKLPQLTTALKSLTLSS

SEQ ID NO: 50497 - protein, 363 aa, Zea mays
MAAKGLREVGRRRAAEVGRRCLSGGSAGPPAPAAKRKEGGKAVNLFTAVNQALHIALDTDPRAYVFGEDVGFGGVFRCTTGLADRFGKSRVFNTPLCEQGIAGFAIGLAAMGNRAIAEIQFADYIFPAFDQIVNEAAKFRYRSGNEFNCGGLTIRTPYGAVGHGGHYHSQSPEAFFCHVPGLKVVIPRSPREAKGLLLASIRDPNPVVFFEPKWLYRLAVEEVPEEDYMLPLSEAEVIREGSDITLVGWGAQLAVLKEACEDAAKDGVSCELIDLKTLVPWDKETVEASVKKTGKLLVSHEAPVTGGFGAEIAASIAERCFQRLEAPVARVCGLDTPFPLVYEPFYMPTKNKVLDAIKATVDF

SEQ ID NO: 50498 - protein, 409 aa, Arabidopsis thaliana [sequence omitted]

SEQ ID NO: 50499 - protein, 481 aa, Bacteroides thetaiotaomicron VPI-5482
MEDLNFRKGDAKTDVFGSDRMLQPSPVERIPDGPTTPEVAYQMVKDETFAQTQPRLNLATFVTTYMDDYATKLMNEAININYIDETEYPRIAVMNGKCINIVANLWNSPEKDTWKTGALAIGSSEACMLGGVAAWLRWRKKRQAQGKPFDKPNFVISTGFQVVWEKFAQLWQIEMREVPLTLEKTTLDPEEALKMCDENTICVVPIQGVTWTGLNDDVEALDKALDAYNAKTGYDIPIHVDAASGGFILPFLYPDTKWDFRLKWVLSISVSGHKFGLVYPGLGWVCWKGKEYLPEEMSFSVNYLGANITQVGLNFSRPAAQILGQYYQFIRLGFQGYKEVQYNSLQIAKYIHGEIAKMAPFVNYSENVVNPLFIWYLKPEYAKSAKWTLYDLQDKLSQHGWMVPAYTLPSKLEDYVVMRVVVRQGFSRDMADMLLGDIKNAIAELEKLDFPTPTRMAQEKNLPVEAKMFNHGGRRHKTVKK

SEQ ID NO: 50500 - protein, 321 aa, Bacteroides thetaiotaomicron VPI-5482
MDKKVTLAQLKEVVQEAYDQVKTNTGGKNADYIPYLANVNKDLFGISVCLLNGQTIHVGDTDYRFGIESVSKVHTAILALRQYGAKEILDKIGADATGLPFNSIIAILLENDHPSTPLVNAGAISACSMVQPIGDSAKKWDAIVENVTDLCGSAPQLIDELYKSESDTNFNNRSIAWLLKNYNRIYDDPDMALDLYTRQCSLGVTALQLSVAAGTIANGGVNPVTKKEVFDASLAPKITAMIAAVGFYEHTGDWMYTSGIPAKTGVGGGVMGVLPGQFGIAAFAPPLDGAGNSVKAQLAIQYVMNKLGLNVFSDNHLIVVD

SEQ ID NO: 50501 - protein, 243 aa, Zea mays
MRVAPATRTAAAAHPPSAFLLLLGCASLAIGGAAMAGHVLGGVKENPAAANSAESDGLGRFAVDEHNRRENALLEFVRVVEAKEQVVAGTLHHLTLEAVEAGRKKLYEAKVWVKPWLDFKELQEFSHKGDATAFTNADLGAKEGGHEPGWREVPVEDPVVKDAAHHAVKSIQERSNSLFPYELLEILRAHAQVVEDFAKFDILMKLKRGSKEEKIKAEVHKSLEGAFVLNQHQPAEHAESSSQ

SEQ ID NO: 50502 - protein, 203 aa, Picrophilus torridus DSM 9790
MSFENIIYLIKIQNEMKIYIIDNGGQWTHREWRTVRDLGVDSTIVPNTVDADVLADADGIILSGGPASIESEISKLGNIKEYMHRYNYPVLGICVGAQFIAIDSGGRVSKALHAEYGKKIVNFTSKDGIFYNIPDSINAWENHNDEIKSISDDYIICAYSDTCRVQAFYHKNRDIFGVQFHPEVNNTEHGTTIFKNFIEKCRR

SEQ ID NO: 50503 - protein, 216 aa, Cicer arietinum
RAEFGTSRAKFWYKTDYGMFRFCIADSEHDWREGSEQYKFIEHCLSTVDRKQQPWLIFSAHRPLGYSSNSWYAMEGSFEEPMGRESLQGLWQKYKVDIAFYGHVHNYERVCPIYQNQCVNKEKTHYSGTVNGTIHIVVGGGGSHLSDFTTAPPVWSLYKDRDYGFGKLTAFNHSYLLFEYKKSSDGKVYDSFTISRDYRDVLACVHDGCEKTTLAS

SEQ ID NO: 50504 - protein, 501 aa, Oryza sativa
METRELWVLAAALAVSLLYYLAALMRYAGGGCSRSSRPPLPPGPTPLPLIGNLLSLRGVLHHRLASLARVHGPVMALRLGLTTAVVVSSRDAAAEAFTKHDRRLAARVVPDSNRAHGFSDRSIIWLPSSDPRWKALRGIQATHLFSPRGLAAVRSVRESKVRDIVAYFRSRAGEEVVFGEAIYSGVLNLVSSSFFSVNMAGVGSEEAHGLRELVEDLVEAIAKPNVSDLFPFLRQLDLQGLRRRTEERMARAFGILDGIIDRRLANRTHGDRHGDFLDALLDLVSEGKMARDHVTTMLFEVFVGTRDTMSVSLEWAMAELLRNPGAMRKARAELEDAAAVVEESDAARLPYLQAVVKEAMRLHPVGPILLPHRAVEDGVEIGGYAVPRGAMVIFNAWAIMRDPAAWERPDEFVPERFMETTTAIDFRGKEYEYLPFGSGRRLCPGLPLAERVVPFVLASLLRAFEWRLPDGVSAEDLDVSERFNTANVLAVPLKVVPVIVN

SEQ ID NO: 50505 - protein, 428 aa, Staphylococcus aureus subsp. aureus MW2
MRYTKSEEAMKVAETLMPGGVNSPVRAFKSVDTPAIFMDHGKGSKIYDIDGNEYIDYVLSWGPLILGHRDPQVISHLHEAIDKGTSFGASTLLENKLAQLVIDRVPSIEKVRMVSSGTEATLDTLRLARGYTGRNKIVKFEGCYHGHSDSLLIKAGSGVATLGLPDSPGVPEGIAKNTITVPYNDLDALKIAFEKFGDDIAGVIVEPVAGNMGVVPPIEGFLQGLRNITTEYGALLIFDEVMTGFRVGYHCAQGYFGVTPDLTCLGKVIGGGLPVGAFGGKKEIMDHIAPLGNIYQAGTLSGNPLAMTSGYETLSQLTPETYEYFNMLGDILEDGLKRVFAKHNVPITVNRAGSMIGYFLNEGPVTNFEQANKSDLKLFAEMYREMAKEGVFLPPSQFEGTFLSTAHTKEDIEKTIQAFDTALSRIVK

SEQ ID NO: 50506 - protein, 416 aa, Sulfolobus tokodaii str. 7 [sequence omitted]

SEQ ID NO: 50507 - protein, 196 aa, Staphylococcus aureus subsp. aureus MW2
MKVNPNNIELIISAVKEEQYPKTELSEVALSGRSNVGKSTFINSMIGRKNMARTSQQPGKTQTLNFYNIDEQLIFVDVPGYGYAKVSKTQREKFGKMIEEYITKRENLQLVIQLVDLRHDPTQDDILMYNYLKHFDIPTLVICTKEDKIPKGKVQKHIKNIKTQLDMDPDDTIVSYSSIQNNKQQQIWNLIEPYIS

SEQ ID NO: 50508 - protein, 419 aa, Ralstonia metallidurans CH34
MTDFFSRRDGILAVEQVPLTRIADQFGSPTFVYSRAALTAAYNAYAAACKGRNAHVQYAVKANSNLAVLQVFAQLGAGFDIVSGGELLRVIAAGGDPRKVVFSGVAKNVADMELALSHDVRGFNVESIPELDRLNAVAGRLGKRARVSLRINPDVDAKTHPYISTGLKANKFGVAFEDVLPTYRAAAALPNIEVTGIDCHIGSQITEVAPYLEALDKVLDVVEALEAEGIKLEHIDVGGGLGITYNDETPPDITKFATTLIDRVAARGHGHREVLFEPGRSLVGNAGVLLTRVEFLKPGAAKNFCIVDAAMNDLARPAMYEAFHRIEPVAPRNDAGVMYDVVGPVCESGDWLGRDRTLAVQAGDLLAVMSAGAYGFVMSSNYNTRGRAAEVMVDGDTVHLVRERELPADLFRNERLLKV

SEQ ID NO: 50509 - protein, 788 aa, uncultured archaeon GZfos32E4
MEETEKDRNIRILHSGVFTPLRRWATKWSLWPCHFLTSCCGVELAHTGACGYDMERLGTLNMGISRQANFIMVEGTITRKMARALRIVWEQMPDPKFVNVIGTCGQRGGIFWNSYNITRPSDIVPVDFFIPGCPITPESLLRGVRAVQEKIEGRDNTTIRFKHVELPSGDGEENRAPTTPKIFAPTPLVRVDVPRDVDWAFGKDLVKNLKAQLNGLYTSITVTDKNRIAIKTSPENLVETSRKLSDTMGVDHVKSVNVIDVPHERKFMVEYMVSGYTEELMPVILTIFTEIGREAEPEIPSLTSLWESANYSERELHDFFGVKFKGNEGMKGKFLLAPDTPDTPLRKDFKLEEEQYTIEEGVPLTPTITPPHYMPPSSSLSYSESELEDLKMPAYEDVLKEAEKNDEFVAFIGPHHSGSGHLRWVMRMKGDIIKDVIPDPGYVHRSMEKIAENRLYIQNVPLTERPNISDPINMNLGYVRAIENALGIEVPERAKYIRTIMAELSRIGAFFYDMGIFPLFMGHSTGFMYSFAIREMVLELMVRMTGSRCTPSFIIPGGIRRDIPDDVLDRTRKFTTAIHKRLKKYENIFVYNPVLISRMKEVGVLTREEAIRCGIVGPFLRASGVEYDVRKAEPYEVYDKLDWEATTGDAGDCLGRIFGRLEEMKQSVEIVRQAVDAVQEMPRGGVISEEILGDYKEASDDIRGYLYNVYGDLVLPKGEWTSVTEAARGTVLYSIISDGESNVPYRVRIITPCWMNLRGIIEASKGERVADFWTVYASFGYFPPEADR

SEQ ID NO: 50510 - protein, 495 aa, Mycobacterium sp. MCS
MAVRGDELFIGGTWCAPSTDRRIEVISPHTETTVGHVAAAAPADVDRAVGAAREAFDTGGWPRTSPAGRIDAVRRLAANYERRRSEMAELITSEIGAPISFSQRAQVALPWSMINAFCDLAQTYPWREARPGRYGSDIQVLREPVGVVGAVVPWNMPQFLIVTKLIPALLAGCTVVVKPAPESPLNALLLAEVIAESGLPPGVVSVLPGDGSVGEYLVGHRGVDKVSFTGSTAAGRAVATACAADLRRVSLELGGKSAAIVLDDADPVVVAAGVRSASLSNSGQICNALTRVLVPRSRAGEFTDALAAEVSALVVGDPTDGATQVGPLVARRQQQRVTGYLEQGVRDGARVVTGGTGMPDGLDRGWYVKPTVFDRADNSMTIAREEIFGPVLTVVAYDNEDEAVAIANDSDYGLAGSVFTADTDRGLAVGAAIRTGTFGVNQGYTMDPFAPFGGVKSSGYGRELGREGIDGYVDTKSISVAPKQDLATAAAGKGA

SEQ ID NO: 50511 - protein, 235 aa, Arabidopsis thaliana
MSLEIDAKAVSALLLGQGCANNLKTLLKNHETGSVSTEPLINSILDSFSFALSSQNIPRHVSQRSSKKKMCGIQGMEDSPTPAHIDGFIWRKYGQKTIKTSPHQRWYYRCAYAKDQNCDATKRVQKIQDNPPVYRNTYVGQHACEAPAYAVNNGGTYGSKMIKFDYVIPESVMPQPLSIDSQEITMEDKDTDDHILNYINEHLMEDEAYDVFPDVLGERCCFGLEPFPGLNINKS

SEQ ID NO: 50512 - protein, 471 aa, Zea mays
MESKPHAPASGLATPRFRLGKQSSLAPERGGEGGGAGSADGSAEANGVMSFQLMYLAHEGSAEGIRELLDGGVDPNFRDSDGRTALHIAACEGHAEVVELLLQSGAEAAVEDQWGSTPLADAMHYQNHDVIKIFEKHGSKHKIAPMHVNNVREVPEYEIDPAELDFSNGNDLSKGTFRKATWRGIPVAVKKLDDDLIADGSKVQAFRDELDVLQLIRHPNVVQFLGAVTQSNPMMIVMEFMRKGDLRTHLSKKGALPPSYAVKLALDIARGMNYLHEHKPQAIIHRDLEPSNILRDDTGHLKVADFDLCKMLKWRRKVREDKAVTSPGNACKYVAPEVLRNEEYDTKVDVFSFALILQEMIEGCLPYYDKKNDEIEKAHNSKERPPFRAPPKHYAHGLRELIEQCWSENSADRPDFRVIINRLSAIQNEIAHRNRWKARPLKCFLSIEGMWKKDRNEGSTTRSSRSSRSYF

SEQ ID NO: 50513 - protein, 307 aa, Staphylococcus epidermidis ATCC 12228
MNKNKVIVIGSTNVDKFLNVKRFPKPGETLHINQAQKEFGGGKGANQAIAASRLAADTTFISKVGKDGNANFILEDFKKAGIHTQYILTSESEETGQAFITVDEAGQNTILVYGGANMTLSATDVEMSADAFIGADFVVAQLEVPFEAIEQAFKIARKQNITTVLNPAPAIELPKSLLELTDIIIPNETEAELLTGISINNESDMKETATYFLDLGISAVLITLGEQGTYCAYQEQYKMIPACNVKAIDTTAAGDTFIGAFLSELNKDLSNIESAIRLANQASSLTVQRKGAQASIPTRKEVEAEYN

SEQ ID NO: 50514 - protein, 339 aa, Pseudomonas fluorescens Pf-5
MGNESINWDKLGFDYIKTDKRYLSHWRNGEWDAGTLTEDNVLHISEGSTALHYGQQCFEGLKAYRCKDGSINLFRPDQNAARMQRSCARLLMPQVSTEQFIEACKAVVKANERFIPPYGTGGALYLRPFVIGVGDNIGVRTAPEFIFSIFAIPVGAYFKGGLTPHNFLISSYDRAAPQGTGAAKVGGNYAASLMPGAQAKKASFADCIYLDPLTHSKIEEVGSANFFGITHDDKFVTPNSPSVLPGITRLSLIELAKTRLGLEVVEGDVFIDKLADFKEAGACGTAAVITPIGGIEYQNKLHVFYSEKEVGPITQKLYKELTGVQTGDVEAPAGWIVKV

SEQ ID NO: 50515 - protein, 463 aa, Pseudomonas fluorescens Pf-5
MQQTLNTQLLIIGGGPGGYVAAIRAGQLGISTILVEGQSLGGTCLNIGCIPSKALIHVAEQFHQTRHHSQGSALGIEVAAPTLNIGKSVEWKDGIVDRLTTGVAALLKKNKVQVIQGWARVIDGKTVEIEGADTRIQCEHLLLATGSKSVNLPMLPIGGPIISSTEALAPKTLPKRLTVVGGGYIGLELGIAYRKLGVEVSVVEAQERILPAYDGELTQPVLDSVKQLGIKLYLKHSVLGFDAASSSLQVREPNGDTLNLATDQVLVAVGRKPNTQGWNLESLNLDMNGAAIKIDHRCQTSMRNVWAIGDLSGEPMLAHRAMAQGEMVAELIAGKHREFNPAAIPAVCFTDPELVVVGKTPDEARAAGLDCIVSSFPFAANGRAMTLESKNGFVRVVARSDNHLIVGWQAVGVGVSELSTAFGQSLEMGARLEDIGGTIHAHPTLGEAVQEAALRALGHALHL

SEQ ID NO: 50516 - protein, 188 aa, Pseudotsuga menziesii var. menziesii
DDVIVISIDGAPKEGCQHISVLTEADETQCPSVEIHPDDVVALPYSSGTTGLPKGVMLTHKSLVSSVAQQVDGENPNLYFHSEDVILCVLPLFHIYSLNSVLLCALRAGAATLIMQKFNLTMLLELIQRYKVTVAPIVPPIVLDITKNPIVSKYDVSSVRIIMSGAAPLGKELEDALRERFPKAIFGQ

SEQ ID NO: 50517 - protein, 340 aa, Oryza sativa (japonica cultivar-group)
MTWKRLEPEAGGTINPALRAFTIRHNYLLSLARHLDQEQSKTMFMQMAELSKNIRELKSILYGNGESEPVTEACVQLTQEFFRENTLRLLIICLPKLNLETRKDATQVVANLQRQQVSSKIVASEYLEANKDLLDTLISGYENMDIALHYGSMLRECIRHQSIARYVLESDHMKKFFDYIQLPNFDIASDASATFKELLTRHKATVAEFLSKNYDWFFSEFNTRLLSSTNYITKRQAIKFLGDMLLDRSNSTVMMRYVSSKDNLMILMNLLRDSSKNIQIEAFHVFKLFAANKNKPTEVVNILVTNRSKLLRFFAGFKIDKEDEQFEADKEQVIKEISAL

SEQ ID NO: 50518 - protein, 1162 aa, Mesorhizobium sp. BNC1
MPKRTDIKSILIIGAGPIVIGQACEFDYSGTQACKALRAEGFRVILVNSNPATIMTDPELADATYIEPITPEVVAKIIAKERPDALLPTMGGQTALNTALSLRRMGVLERYGVEMIGANAEAIDKAEDRALFREAMAKIGLETPKSMLANATEVKDADRKKHEVERAELRAKHTGPELDAALDALEAEWQRGEGDRKQRYINHAMAIAAQALDVVGLPAIIRPSFTLGGTGGGIAYNRTEFFDIVSSGLDASPTTEVLIEESVLGWKEYEMEVVRDKADNCIIVCSIENLDPMGVHTGDSITVAPALTLTDKEYQIMRNASIAVLREIGVETGGSNVQFAVNPADGRMVVIEMNPRVSRSSALASKATGFPIAKVAAKLAIGYTLDELENDITGGATPASFEPSIDYVVTKIPRFAFEKFAGSDPVLTTAMKSVGEVMAIGRTFAESLQKALRGLETGLTGLDEIEIPGLGDNGPDDKNAIRAALGTPTPDRLRMVAQAIRMGTSVADVHAMCHIDPWFLEQIAAIVAMEERIREHGLPQDASNLRMLKGMGFSDSRLASLVKKDAEEVRRIRESLGVHPVFKRIDTCAAEFAAPTAYMYSTYETPFAGAPADEARVSDRRKVVILGGGPNRIGQGIEFDYCCCHAAFALADAGFESIMINCNPETVSTDYDTSDRLYFEPLTPEDVLEILRAEQQEGELVGVIVQFGGQTPLKLADALEKAGIPILGTAPDMIDLAEDRDRFQKLLQKLGLKQPKNGIAYSVEQARVVAGELGFPLVVRPSYVLGGRAMQIVWDDARLQTYLLDTVPGLVPEEIRQKYPADKTGQINTLLSKNPLLFDTYLSEAIEVDVDCLSDGKEVFVCGIMEHIEEAGIHSGDSACSLPVHSLSPEIVSELERQTTALAKALNVGGLMNVQYAVKNGDVYVLEVNPRASRTVPFVAKTIGRPIAKIAARVMAGETLEQAFTTYGSLPNANDLGHIAVKEAVFPFARFPGVDILLGPEMKSTGEVMGLDRDYALAFAKAQLGAGVDLPRSGTLFVSVRDEDKARVLPAVKRLSDLGFRILATGGTARFLRENGVEAEKINKVLEGRPHIEDAIRNRQVQLVFNTTDGQKAVSDSKSLRRATLMQKVPYYTTMAGANAVVEAIAALKAGSLEVRPLQGYF

SEQ ID NO: 50519 - protein, 450 aa, Aspergillus oryzae
MPGQVAGSKVLLLGSGFVTKPTVEVLSKADVHVTVACRTLESAQKLAEGFKNTTAIALDVNDADALDKALEQVDLAISLIPYTFHALVIKSAIRTKKHVVTTSYVSPAMLELDEECKKAGITVMNEIGLDPGIDHLYAVKTIDEVHREGGKITSFLSYCGGLPAPECSDNPLGYKFSWSSRGVLLALRNAAKFYKDGQEVSVAGPDLMATAKPYYIYPGFAFVAYPNRDSTPYSERYNIPEAKTIVRGTLRYQGFPEMIKVLVDIGFLSDEPADFLNSPISWKDATKQILGATTAAEKDLEWAIASKTSFANNEERNRLIAGLRWIGIFSDEQVIPRGNPLDTLCATLEKKMQYGPEERDMVMLQHKFEIEHKDGSKETRTSTMCEYGVIGGYSAMAKTVGVPCGVAVQLVLDGTINKKGVIAPMTWDICAPLIKTLKEEYGIEMIEKTL

SEQ ID NO: 50520 - protein, 326 aa, Aspergillus oryzae
MVLHNPNNWHWVNKDASGWAKDYLKEKLCALSVEENGVTAKISNLLSMDGDVDVSQRKGKVITLFDVKVQLEYEGKTKDEESVSGTITIPEVAHDTEEDEYVFEIDIYSESSSKQPVKDLVRSKLLPQLRQELVKLAPALITEHGKDIQHAPGENPSKGFTAPTYHPQTKKDTPAPKTITTSTSGKVAVNTTTVIASDEFRTTAEELYNTFTDPQRIAAFTRGAPRQFEGAQVGGKFAIFDGNVTGEYTKLEKPTQIVQKWRLAQWPEGHFSSLEINFDQNDVDGVTQMRVSWTGVPVGQEDVTKQNWEMYYVRSIKQTFGFGTIL

SEQ ID NO: 50521 - protein, 263 aa, Nostoc sp. PCC 7120
MNTTHKQTALITGAASGIGYELVCIFAENDYNLVLVDRAKEKLEEIAIEFQDKFGISVKPIVRDLSKTTSPEEIFQEVEQANIKVDVLVNNAGFGTYGLFNDTNLTDELEMLQVNVVCTTHLTKLFLKNMVQQGEGKILNVSSAAAFQPGPLMAVYFATKAYVLSFSEALANELDGTGVTVTVLCPGTTQSAFHQRTGMADSKLVKGKRMMDASTVADIGYRGLMQGKTIVIPGLINKIMAKSIRFIPRKLVTKIVRNMQENK

SEQ ID NO: 50522 - protein, 355 aa, Aspergillus oryzae
MSGHENNGAPPVGQEKINTDIVTLTRFLTEEQTKVPEATGDFTLLCHALQFSFKSIAYYIRRASLINLTGLAGSSNTTGDDQKKLDVIGNDIFISAMRGSGKCRILVSEEEEEAIIFDEHPYARYAVVCDPIDGSSNLDAGVSVGTIFGIFKLPDSVLGPENKVSPKDLLLPGTEMVASGFTMYGASAQLVITMRNGGVNGFTLENSLGEFILTHPNMTLPAKRAIYSVNEGNSSYWEEWTNAYFHSLKFPPEGQKPYSARYIGSMVADAYRTLLYGGVFAYPADKKAPKGKLRILYECAPMAMLFENAGGLAVNSRMERLLGVVPEHIHDKSGVFLGSKDEVQKIIDTYNKYKK

SEQ ID NO: 50523 - protein, 324 aa, Arabidopsis thaliana
MFRQSMAFPPPIHGSDAPPPPQPPSVVNGIETSRRQQQQIAAASSSPVKSHPLHNFPLSDLRWAMNHANTHRLRKASSRSPLREANTGKGNLVIEEVNEASGSSFELRPEKKKGNASGVSDSAADRSATKSTTPDGRSKIFIRIRTKNNEETAVSTDIATSVAASVQVTDDSAGPAIDAEGERISDGGGQEADEFGPKTWNLRPRRPPPTKKRSIGHGGGVLKSCNGALPENKSLGTVRTESIRSRNGVDAKMATTERKEKKPRLSISLSKLEIDEDIYALTGSKPSRRPKKRAKNVQKQLDVLFPGLWMGNVSSEAYKVSEHA

SEQ ID NO: 50524 - protein, 497 aa, Staphylococcus aureus subsp. aureus MW2
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVVTVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIIFVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 50525 - protein, 440 aa, Arabidopsis thaliana
MYLDINGVMIKQFSFKASLLPFSSNFRQSSAKIHRPIGATMTTVSTQNESTQKPVQVAKRLEKFKTTIFTQMSILAVKHGAINLGQGFPNFDGPDFVKEAAIQAIKDGKNQYARGYGIPQLNSAIAARFREDTGLVVDPEKEVTVTSGCTEAIAAAMLGLINPGDEVILFAPFYDSYEATLSMAGAKVKGITLRPPDFSIPLEELKAAVTNKTRAILMNTPHNPTGKMFTREELETIASLCIENDVLVFSDEVYDKLAFEMDHISIASLPGMYERTVTMNSLGKTFSLTGWKIGWAIAPPHLTWGVRQAHSYLTFATSTPAQWAAVAALKAPESYFKELKRDYNVKKETLVKGLKEVGFTVFPSSGTYFVVADHTPFGMENDVAFCEYLIEEVGVVAIPTSVFYLNPGEGKNLVRFAFCKDEETLRGAIERMKQKLKRKV

SEQ ID NO: 50526 - protein, 299 aa, Yersinia pseudotuberculosis IP 32953
MFTGSPMFTGSIVALITPMDDNGDVDRASLKSLIDYHVASGTAAIVSVGTTGESATLNHDEHVDVVMQTLELAGGRIPVIAGTGANSTSEAISLTQRFNDTGVVGCLTVTPYYNRPMQEGLYQHFKAIAESTDLPQILYNVPSRTGCDMLPPTIARLAKIKNIVAVKEATGNLSRVSQIQVLVDDEDFILLSGDDASGLDFMQLGGKGVISVTANIAAREMVELCALAAQGNFAEGRRLNQRLMPLHQHLFVEANPIPVKWAAKRLGLMANDTMRLPMTPLTDPAKRIVEDALKSAGLL

SEQ ID NO: 50527 - protein, 250 aa, Ralstonia metallidurans CH34
MATSLPGVVYHPADSSPASTLQRMSLLHQARFFTTVNHLRDLPATAVPEVAFAGRSNAGKSTAINILCNQKRLAFSSRTPGRTQHINFFTVAPVKAPDPVGFLVDLPGYGYAEVSGSAKFHWQGLLSDYVQARTQLSGLILMMDARRPFTDLDCQMVEWFLPTGKPIHVLLTKADKLTTSDNAKALRETRKVLADYAAQMENPPALTAQLFSSLKRRGIEEAQRVVAGWLALPEAQPAVAKSDTPDTPQG

SEQ ID NO: 50528 - protein, 399 aa, Sulfolobus tokodaii str. 7
MPVDDFSLSANSISGESTLVYQDVARQVQKTKGIRIINFGIGQPDLPTFARIREAAKKSLDEGFTGYTSAYGIDELRQKIAEHLSSKYESVRKEEVIVTPGAKTALYLAFLLYINPGDEVIIFDPSFYSYAEVVKMLGGVPVYVKMKFNESTGFSLNLSELESKINKKTKMIVLNNPHNPTGMVFDPIEIEKLMEITKEKKVLLLSDEIYDYFIYEGKMKSVLEDPDWRDYVIYVNGFSKTFSMTGWRLGYVVAKEKVIKKMAEIAANIYTCPTSFAQKGALAAFESFDEVKEMISLFKKRRDIMYEELKKIKGIQVHKSQGAFYMFPFIGEILKKANLSVKDFSLKLIEEKGVTTIPGEVFPLEVGKDFVRLSFAVKEDDIREGIKRMKEFIDMLMTP

SEQ ID NO: 50529 - protein, 401 aa, Synechococcus sp. RS9916
MAKRSLASLTGADLSGKRVLVRVDFNVPLNDAGAITDDTRIRAALPTINDLIGKGAKVILSAHFGRPKGQVNDSMRLTPVAARLSELLGKPVVKTDSCIGPDAEAKVGAMADGDVVLLENVRFFAEEEKNDAGFAEKLAGLAEVYVNDAFGAAHRAHASTEGVTKFLKPSVGGFLMEKELQYLQGAIDAPKRPLAAIVGGSKVSSKIGVLEALMDKCDKILVGGGMIFTFYKARGLAVGKSLVEEDKLELAKELEAKAKAKGVELLLPTDVVLADNFAPDANSQTAPVTAIPDGWMGLDIGPDSVKVFQNALADCQTVIWNGPMGVFEFDKFAAGTNAIATTLADLSGKGCCTIIGGGDSVAAVEKAGLADKMSHISTGGGASLELLEGKVLPGVAALDAA

SEQ ID NO: 50530 - protein, 393 aa, Mycobacterium avium 104
MKAVTWHGKRDVRVDSVPDPKIEQPTDAIIEVTSTNICGSDLHLYEILGAFMKPGDILGHEPMGVVREVGTETGDLRVGDRVVIPFQICCGSCYMCGQQLYTQCETTQVRDQGMGAALFGYSELYGEVPGGQAELLRVPQAQFTHIKVPVGPPDSRFVYLSDVLPTAWQAVAYADIPDGGTVAVLGLGPIGDMASRIADHLGYRVIAVDLVPERLGRAAQRGIHTIDLARLDAGLGDAIRDLTDGRGADSVIDAVGMEAHGSPAAKLAQQVAGVLPDALGKRLMQTAGVDRLSALYSAIDAVRRGGTISLIGVYGGMADPLPMLTLFDKQVTLRMGQANVKRWVDDIMPLLTDDDPLGVDDFATHVLPLERAPHAYEIFQKKQDGAVKVILKP

SEQ ID NO: 50531 - protein, 279 aa, Mycobacterium sp. MCS
MASTRSERHFDGVGGVRIVYDTWTPDAPARGVVVLSHGYAEHARRYDHVAQRFGEAGLIVYALDHRGHGRSDGKRVYLRDIAEYTGDFHTLVGIAAREHPDLPRIVLGHSMGGGVVFAYGAEHPGDYAAMVLSGPAVYAQSAVKPWLVTVAKLLGRIAPGVPVEQLDADAVSRDPEVVAAYKADPLVHHGKLPAGVARGLFTVGETMPQRAGALTAPLLVVHGEKDRLIPVEGSHRLVDRVASQDVHLKVYPELFHEVFNEPERATVLDDVISWIEVRL

SEQ ID NO: 50532 - protein, 188 aa, Pseudotsuga menziesii var. menziesii
DDVIVISIDGAPKEGCKHISVLTEADETQCPSVEIHPDDVVALPYSSGTTGLPKGVMLTHKSLVSSVAQQVDGENPNLYFHSEDVILCVLPLFHIYSLNSVLLCALRAGAATLIMQKFNLTMLLELIQRYKVTVAPIVPPIVLDITKNPIVSQYDVSSVRIIMSGAAPLGKELEDALRERFPKAIFGQ

SEQ ID NO: 50533 - protein, 188 aa, Pseudotsuga menziesii var. menziesii
DDVIVISIDGAPKEGCQHISVLTEADETQCPSVEIHPDDVVALPYSSGTTGLPKGVMLTHKSLVSSVAQQVDGENPNLYFHSEDVILCVLPLFHIYSLNSVLLCALRAGAATLIMQKFNLTMLLELIQRYKVTVAPIVPPIVLDITKNPIVSQYDVSSVRIIMSGAAPLGKELEDALRERFPKAIFGQ

SEQ ID NO: 50534 - protein, 379 aa, Yersinia pestis KIM
MEMIKTRAAVAWGPNQPLSVEEVDLMPPQKGEVLVRIVASGVCHTDAYTLSGADPEGVFPTILGHEGGGIVEAIGEGVTSVAVVDHVIPLYTPECGECKYCRSGKTNLCQAIRSTQGKGLMPDGTTRFSKNGQPIFHYMGTSTFSELTVVPEISLAKINKEAPLEEVCLLGCGVTTGMGAVMNTAKVKPGDTVAIFGLGGIGLSAVIGAQMAGASRIIGIDLNTSKFELARKLGATDLINPKDYDKPIQEVIVELTDGGVDFSFECIGNVNVMRSALECCHKGWGESVIIGVAGAGEEISTRPFQLVTGRVWRGSAFGGVKGRSELPGIVQQYLDGKFALNDFITHTMALDQINEAFDLMHEGKSIRSVIHFNHSSESK

SEQ ID NO: 50535 - protein, 350 aa, Staphylococcus epidermidis ATCC 12228
MKAYEYLKPGHAQLTDKEKPTITSSTDAIIRIVKTTICGTDLHIIKGDTPEVKSHTTLGHEGIGIIEEIGDNVNNFKVGDKVIISCISSCGKCYYCKKGIYAHCENGGGWILGHLVNGTQAEYVKVPFADNSLYHAPSNLKEDALVMLSDILPTGYEIGVLKGKVKPGCTVAIVGAGPVGLAALLTAQFYSPSKIIMIDLDDNRLETAKEIGATHLINSKETETAIKKVKSLNPRGVDVAIEAVGIPQTFDLCQNLIGVDGTIANVGVHGLPVQLDIDKLWIKNINVTTGLVSGNTTEELLEALKSKIIQPEQLVTHYSKLSEIESAYDLFRNATDHKAIKLIIENDITI

SEQ ID NO: 50536 - protein, 211 aa, Aspergillus oryzae
MPDRFTTALQANKEWAARTALEHPDLFPTLANGQSPEILWIGCSDSRCPETVVLGLKPGDVFVHRNIANILHAGDLSSSAVIEYAVRHLRVNHIVLSGHTKCGGIAAALGNKQLGILDPWLLPLRQIREQNLAELQTLSPEDATVRMAELNVREGVKLLKSKAVVLEAMQERGLQVHGLIYDVACGMLRDIDTKDSEEEIKRRLVAFKTEA

SEQ ID NO: 50537 - protein, 362 aa, Xylella fastidiosa Dixon
MSISFDIARSLSTTSDEELSMILQAPGFGVHFTDHMIAIAWDKDNGWHDAQVRAYGPLLLDPAAAVLHYGQEIFEGIKAYRHADGSIWTFRPEANARRLQRSAKRLVLPELPVELFTESLRQLIAVDARWVPSAPETSLYFRPFMIATEAYLGVRAAQHASYYLIASPAGPYFAKGVAPVSIWLSTDCARAALGGTGAVKCGGNYAASLLPQQVAQAQGCSQVLFLDPVEGKYLEELGGMNVFLVYTDGTLVTPALSGSILEGITRESILQLARDRGMCVEERKVAIEEWKEGVVSGAISEVFACGTAAVITPIGELKAEGFSVGNINAPPGEVTLSLRKELTDIQYGRLPDRYGWMTCLKE

SEQ ID NO: 50538 - protein, 1550 aa, Nostoc sp. PCC 7120
MKAQLPDNEVQRIAALLEYKILDTPPEAAFDDITRLASYICGTPIALISLIDQNRQWFKATFGLERRETPRDEAFCAHTILESEAFIVPDATADERFATNPLVISDPKIRFYAGVPLTNPEGYSLGTLCVIDYIPRNLSFEQIEALQILGRQVIKQLELRRNLANLVLVNNQHKQAQKIRHPFFKKIAGGFGLASVFLVLLGLASYQAEIELIHNGNQVQTTQESINNLEQLLSQMKDAETGQRGYILTGKDPYLQTYQTALANIDQKFDELRNATVDPVRQQRLVILKPLITAKITELNQTIKLRQNLGFQAALQVIQSDQGQTLMDDIRKVMREMETENKVRLQQQLQAVKASEQKVIFILAIAIVSGFIILAVVYYLIYCEVIARQSMENILNEERNFISAVLDTVSALVIVLDSQGRIVRFNQACEVITGYSFDEVRGRHFWNLFLLPEDVESSKEFFAKFPADPTVPSVQESENYWVTKDGSRRLIAWSRTILQNHEGSVEYIIGTGIDITERKRADKHLTIQYAITRVLAESTTITEATPQILQAICETLGWNVCEIWMVNQQANFLSFFDLWHHTSLEMQEFRTQSQPITFASGIGLPGRIWASGQPIWLTDIVNDGSFLRNQLAAQVGLRGAFGFPIRSGQKILGVITCFSHQVQPHDPDLAKIMDSIGEQVGQFIHRKQAEEELQRQNLRSQLFTEITLKIRQSLQIEEILQITVKEVQKILQTDRVLIYQLLPDGSGSLIIEAVVAGWAAIKGQNITDFYLQTEYQQQYCLQQYRLRHLEAIANLDLGEIQQSHLELLRKFGVKANLVIPILVKDELCGLLIVHQCATSRQWTSFETHLLRQIADQVGIAVAQAQLLEVETRQRQELEVARSQAELASHAKSAFLANMSHEIRTPMNAVLGMTGLMLETLLNQEQRDFMETIRISGDALLTLINEILDLSKLEAGEMALENLNFNLSTCVEEVLDLLAPQAHSKGLEIAALIYRHVPIQLQGDASRLRQILMNLIGNAIKFTSFGEVVMRVELRSETPTTAIIHFAVTDSGLGITLEDQHKLFTPFTQVDASTTRKYGGTGLGLAICKQLVTLMGGEIGVESQLGKGSKFWFEIPFAKQLQPVSFVEDCGLLNNRRLLVVDDHATNRKIIYHQVSRWGMQVDQADRAVAALSMIVEACQQNKPYDVILIDMQMPEMDGMALGKQIKANSAIPPTPLIMLTSTNQRDEVQQAIKIGFAAYLVKPVKSSRLLDTIMSVLKTPSQLEAEKLEVKSQELEKNNLDHSRNHNFTATQAQNSVSTKTRILLAEDNLVNQKVALKQLQSLGYTADVAANGKEVLQLLKQIPYDLILMDCQMPILDGLEATKEIHRWAESSFASCRRPVIIAMTANAMKEDKQMCLDAGMDDYLSKPVMKEQLATALEYWCQLILNSRQAVEFDLNSLPLDWEHLHQLSENDTEFELHLLQIFVEDVRARLELAKEAIANTDFQQMAQQVHQLKGASTNIGATAMYLAAEKLEQLAQNQERRGSMELITEIEEGVNQIQAFLTRSQIV

SEQ ID NO: 50539 - protein, 400 aa, Mesorhizobium sp. BNC1
MAFLADALSRVKPSATIAVTQKARELKAQGRDVIGLGAGEPDFDTPDNIKQAAIEAIKRGETKYPPVSGIQPLREAIAAKFKRENNLDYDWKQTIVGTGGKQILFNAFMATLNPGDEVVIPTPYWVSYPEMVSICGGTSVFAETRLEDNFKLQPEVLERAITPRTKWLIMNSPSNPSGAAYTREELKAVADVLLKHPHVWVLTDDMYEHLTYGDFTYHTIAEVEPQLYGRTLTMNGVSKAYAMTGWRIGYAAGPIELIKAMDMIQGQQTSGAATVCQFAALEALTGPQDFIHQSKKVFQERRDLVVSMLNQAKGISCPVPEGAFYVYPSCAGTIGKKAPSGKLIESDTDFVSELLETEGVAVVQGSAFGLGPNFRISYATSDALLEEACSRIQRFTANLR

SEQ ID NO: 50540 - protein, 431 aa, Aspergillus oryzae
MSATTARADPFRPAKRVAGQRQDVWYGDKPAAASPVQPIVNMGQGFFGYNPPQFAIDAAKEALDKVECNQYSPTKGRPRLKQAIADAYSPSFGRKLNPDTEVTITTGANEGMLSAFMGFIEPGDEVIIFEPFFDQYISNIEMPGGTIRYVPLHPPKDGATRTSPASEWSIDFEELEKTINPKTRMIQITNGHNSHNPVGKVFSRDELEKIGELCIKHNLIILSDEVYDRLYYVPFTRIATLSPELYERTLTVGSAGKAFYATGWRVGYLIGPEHLIKYVAGAHTRICYSSVSPLQEAAAVAFEQADKAGFWDESRTEMKKKMERFCEVFDELNIPYSDPEGGYFVLANMSSVKLPEGYPFPPHVASRPRDFKLCWFLIHEVGVAAIPPTEFYTDANAHIAEDYLRFAVCKNDDVLETAKERLRGLKKYIVQ

SEQ ID NO: 50541 - protein, 124 aa, Capsicum annuum
MAATSSEEGQVFGCHNVEEWDQHFKKGVETKKLVVVDFTASWCGPCRFIAPILADIAKKMPHVIFLKVDVDELKTVAEEWNVDAMPTFVFFKDGEEVDRVVGAQKEELQAAILKHVGAPATVTA

SEQ ID NO: 50542 - protein, 396 aa, Pseudendoclonium akinetum
MAIQNAIKPTTTRPFTLNFGPQHPAAHGVLRLILSMRGEQVLSTDTHIGLLHRGTEKLIEYKTVLQALPYFDRLDYVSVMSMEHSYCLAVERLTEMEVPRRAQFIRMLFAEITRVLNHLLAVTCFAMDTGALTPFLFAFEEREKLMEFYERVSGARMHSAYFRPGGVATDLPAGLLQDIHVWADQFASRIDEIEELLTGNRIFKQRLVNIGVLKAEDAIAWGVSGVLLRGSGIAYDLRKAQSYDAYDQVQFNVPVGTNSDCYDRYLLRIEEMRESLSIIKQTLDLVPTGPIKPADGPVASRAEFKSDMESLIRHFKASTSGFAVPVGETYCSSEAPKGEFGVLFVSNGANRPYRVKIKSPDYASLQAIDILGKGHYIADVVAIIGSLDVVFGSIDR

SEQ ID NO: 50543 - protein, 764 aa, Sulfolobus tokodaii str. 7
MINIAGGKGANLGELISMGIRVPPGFVITSHAYKYFISYNKLDEKIKEIFEKEKDDEIISSKIRELILSSQIPPDLANQILSAYENLSKLVGKEILVAVRSSATAEDIESASFAGQQETYLNVSKGELLDAVKKVWASLYTARAISYRRFKGIDQITVEMAVVVQKMVNSRSAGVMFTLHPVTGDRNYIMIESSWGLGEAVVSGKVTPDEVVIEKSSLKIVEKKVSHKILKIVYDREKRQNIIINLSNEEADQMSISDEEAIELARLALKIEEHYGRPMDIEWAIDADMKFPDNVFIVQARPETYWTSKQIERKKEEVKVSVGKVLTKGLPASPGIAYGKARVILDVKEAKDFEKGDILVTKMTDPDWVPIMKIASAIVTDEGGMTSHAAIVSRELGIPAVVGTGNATKVIKDGEEITVDAIRGIIYEGKLTFETEEKKEATQPVSVGGISRDVLLSLYPVTATKIYMNLGQPDIIHKYLDLPFDGIGLMRIEFIVSEWIKYHPLYLIKTGKPELFVDKLAEGISMVASAIYPRPVVVRFSDFKTNEYKRLIGGEEFEPEERNPMIGWRGVSRYVSPQYEPAFRLEVRAIRKVREEMGLKNVWVMFPFVRTTWELEKAIKIMEEEGVRRGQDFKVWIMAEVPSVVVLADKFSQLVDGFSIGSNDLAQLTLGVDRDSDLLARMGYYDERDPAVLESIKRLIKVAHKYGRTVSICGQAPSVYPEINEFLVRQGIDSISVNPDAVIQVKRQVASIEQKIMLEKLRKK

SEQ ID NO: 50544 - protein, 477 aa, Haloarcula marismortui ATCC 43049
MVVGDVTTSTDVLVIGAGPGGYVAAIRAAQLALDVTLVEKGEYGGACLNRGCIPSKALIHGSKLASEAGQAEELGIYADPTVALDEMINWKDGVVDQLTSGIEQLCTAAGVNLLKGTAEFADENKVRIIHQGEGQGSESLKFENCIIATGSRPIEIPGFGFEDERIVSSDGALNFDTVPDELVIVGAGYIGMELATVYSRLGSDVSVIEMLEQALPSYEEDIASIVRKRAERLGVDFHFGYTADSWAASDGKAVLTAVPADEAAHDSDIELTADRILVAVGRRPVTDTLSIDDAGVETNAQGFIPTDSTCRTNKEHIFAVGDVAGEPMLAHKGSKEGEVAAEVIAGEPAAVDYQALPAAVFTDPEIGTVGLTENEAANKGMTPVTGEFQFQASGRALTANRAEGFVRIIATKETERVIGAQIVGPEASELIAEIAAMIEMGAKLEDIGSTVHTHPTLSEAIMEAAQNAREKAIHRRN

SEQ ID NO: 50545 - protein, 121 aa, Arabidopsis thaliana
MFKKALELSTLCDIEVCVILYSRDGELIKTWPEDQSKVRDMAERFSKLHERERRKKRTNLSLFLRKKILDNSKLSEKVLEMKDSLESGLRVLQDKLLLLQPEKNQTELGQIPVINNGQNHW

SEQ ID NO: 50546 - protein, 498 aa, Nostoc sp. PCC 7120
MKTPLNCQNYINGQWLNAATETTLNSHNPADKSEIVATFPRSQADDVDRAVAAARQAYGSWRKVPAPARAEYIFRVGELLLQHKEELAQLISREMGKPLTEARGDVQEGVDCAFYSAGEGRRLFGQTTPSEMPNKFAMTMRMPIGVCALITPWNFPVAIPCWKAMPALVCGNTVILKPAEDTPACATKLIEIFAAAGLPPGVINLVHGVGEEVGKALVEHPNIDLVSFTGSSATGAYVGETCGRTHKRVCLEMGGKNAQVVMEDADLELALDGALWGAFGTTGQRCTATSRLILHRDIKEKFTTMLRERTSQLRLGAGTEPETDIGPIINNRQLQRVHEYMNIAREEGAKILIGGEIATEGQLQQGYFFQPTILDNVTPQMRVAREEIFGPVVALIEVSTFEEAIAILNDTKYGLSSSVYTRDINRAFVAMRDIEAGITYINGPTIGAEVHLPFGGVKQTGNGHREAGTTALDVFTEWKSVYVDFSGSLQRAQIDNRS

SEQ ID NO: 50547 - protein, 425 aa, uncultured archaeon GZfos32E4
MKEEKDYFVFGGMDVVELAERYGTPLYVTDENKLRNNFKSYKNAFETTNIDTDIYYAVKANGNLALLKILASEGAGADVFSAGELELTKLAGIPAEKILFNGNSKSDDDLKEAVESGVRVSVDSVDELRALSAVANELGREVEIAIRVNPDVSPDVHAKIATGLKESKFGIPFHDVIPVCEEAEKLPNVLLAGLHCHIGSQILDISVFGEATEKMMALVERMYERGMKLKFVDLGGGLGIGYRQEEKATAPTPEDLAEMILPLFENKIRDLGISLKLVLEPGRSIVGASTILLSRVNAVKRANKNFVAIDAGFNLLIRPVMYDAYHEVVVANKVNERASELYTVVGNVCESGDIMAKDRMLPKVERGDLVAILDTGAYGFSMSSQYNGRPRCAEVLVCNGKADLIRSRESIEDLIRNQEIPARLI

SEQ ID NO: 50548 - protein, 285 aa, Anabaena variabilis ATCC 29413
MAEKQTLQPPQQQKTPGTESKMQPKPQADDARYLGSGKLKDKVALITGGDSGIGRAVAIAYAKEGADVAFVYLSEHGDAEETKNLVEEQGRRAVSIAGDITDEAFCQRAIQQTVDEFGKLDILINNAAEQHPQESIEDITKEQLERTFSTNIFSMFYLTKAALKHLKQGSAIINTTSVTAYKGSSHLLDYSATKGAIVAFTRSLSQNLISKGIRVNAVAPGPIWTPLIPSTFPTEKVETFGKQVPMQRAGQPEEVAPSYVFLASDDSSYMSGQVLHPNGGEVVNG

SEQ ID NO: 50549 - protein, 406 aa, Gluconobacter oxydans 621H
MIRKPVMSFIADRLNRILPSQTIAVTQKARALKAEGRDIISLSAGEPDFDTPDFIKRAAIRAIEAGKTKYTDVAGTLELRKAVAARLNADFDLDYKAEEICVSTGGKQVIYNVMVSTLNAGDEVIIPAPAWVSYPDIVTLADGTPVIVQTDPENGFRLTAEQLRAAITPRTKWLCLNSPCNPTGAAYDTEALKALTDVLLDYPDIWILTDDMYAKLLYDGAVAKTVVQVEPRLRSRTVTMNGVSKAYAMTGWRIGFSAAPVELTRQLVKLQGQSTSNPCSIAQAAAQEAVSGPQDFISEMVAVYQERRNLVIGMLNEAPGLSCALPEGAFYAFPSIAGTLGKTSKGGRLIDGDEAFVTALLEETGVAAVHGTAFLTPGYFRISYATSTELLKEACTRVQNFCRGLS

SEQ ID NO: 50550 - protein, 107 aa, Oryza sativa (japonica cultivar-group)
MASHVDPLVVGRVIGDVVDLFVPTTAMSVRFGTKDLTNGCEIKPSVAAAPPAVQIAGRVNELFALVMTDPDAPSPSEPTMREWLHWLVVNIPGGTDPSQGKQQPEAV

SEQ ID NO: 50551 - protein, 369 aa, Gluconobacter oxydans 621H
MSDAYKLLVLAGDGIGPEVMREVARIVHWMSAHRGLKLEITEELVGAASLAVHGVPIRDEVIELARQSDAVLFGSVGDPAWSHVGFDKRPEVAILKLRKELELFANLRPAKLFDALIDASALKPEVVRGLDLMIVRETVGGIYFGEPRGIETLPDGSRRGINTEVYTTSEIERVARVAFDLARKRDNRVCSVEKCNVMESGLLWKEVVTDVHKREYPDVQLSHMLADNCAMQLVRDPNQFDVIVTGNLFGDILSDLASMLTGSLGMLPSATLGPVRADGKRNALYEPIHGSAPDIAGKGIANPLAQILSFAMLLRYSLNRAEDADLIEMAVSNVLASGLRTGDIMSPGMARVGTEMMGQAVLREMEKLA

SEQ ID NO: 50552 - protein, 338 aa, Haloarcula marismortui ATCC 43049
MSSTASAQTGQKAQSLTLVEAIQDGLYTEMSQDDTVVVLGEDVGKNGGVFRATDQLYEEFGEDRVIDTPLAEAGIIGASIGLAQTGMKPVPEMQFMGFMYPAFDQIVSHAARLRSRSQGQYSVPMVIRAPYGGGIRAPEHHSESKEAFFVHEPGLKVVSPSTPYDAKGLLAASIRDPDPVIFLEPKLIYRAFREDVPTKPYQVSLNEAAIRREGSDISVYTWGAMTRPALIAAENLSQSHGIDVEVIDLRTLSPLDIETITDSFKKTGRAAIVHEAPKTGGLGAEIATTIQEEALVHQEAPIKRIAGFDAPMPLHSLEDYYLPQAVRIQDGIRETVDF

SEQ ID NO: 50553 - protein, 130 aa, Gluconobacter oxydans 621H
MNIIQQYEAREIERLSGVRAVPEFIAGDTVRVGVRVVEGTRERVQSFEGVVIARSNKGLNSNFTVRKISNGEGVERVFPLYAPSIASIEVVRRGKVRRAKLYYLRGRSGKSARIAERPRDLPKADSMAAS

SEQ ID NO: 50554 - protein, 556 aa, Oryza sativa
MTKALQAAGGKPWRPGKMSTVLVAVLMTMPPLVVIFSGRIGDQAMWIKTAVDGIRGGTDDDVSFMKHPTTSHDKLLGGLLVDGFDQESCHSRYQSAAYRRNAGRRPSEHLVSKLRRHEDLQRRCGPGTAAYSAAVEQLKSGKSPAAAEASPEACRYLVSISYRGLGNRILAAASAFLYAMLTDRVLLVDPSNEMGELFCEPFAGTTWLLPPEFPLVGYQGFYLHTAERYGKMREDRVLRPDGGEAAAAAPPPAFAYIHLDYNQTDYDKLFFCDEDQRLLSSIQWLVMRTDSYIVPGLFLVDAFQDELAALFPERDAVFHHLGRYLFHPANHVWGLVTRYYRGHLAWARRRVGIQVRVSSWEWESPEILRTITSCTQDEGLLPRVLDDTDQEPPATAAASARRGLRPSAVVITSLKSWYYEKMKGMYWERATESGEVVVFDQPSHEEQQMYGVRAHERKAWAEMYLLSTTDVLVTTGTSTFGYVAQGLGGLTPWVLPRREVNGTAPPCRRDMSMEPCFHVAPLYDCKRWEDAGKIVPHVRHCHDMPAGLKLVDRTEW

SEQ ID NO: 50555 - protein, 487 aa, Mycobacterium avium 104
MTLLPESVPMVELAASYAAGKWVSGAHAGTLDVTSPATGELLGTVGIAGPDDVGAAVAAARGALQSWGRVAPADRGAALGRLADALSARKGELADLTTAEIGSPRSWSTFGQVITAVGVLRAYASITPHYPFSTTRPSVTGGTVEVRQLPVGVVGAIVPWNTPLFIAALKLGPALAAGCTVVLKPAPDAPLEFGVLMEAIEEAGLPDGVVNVVNGGAETGELLTEHPGVDKVSFTGSTAVGARIAASCGSRIRRCSTELGGKSAAIVLPDAPLETTVPGLVAGVMGNNGQLCAALTRIVLPRSRYDEFVAALTAAVAELIVGDPADRVTDIGPLINEAARDRVEGFLRRARQDGATVLVGGERPNRPGWFLSPAVVAATNDMEIAREEVFGPVAVVIAYDDTGADDVAEAVAIANDSRYGLVGAVWSADAERAAAVAAQLLVGSVAVNSTAVLDFASPFGGFKQSGIGREGGPEGIAGFVEHQAIIR

SEQ ID NO: 50556 - protein, 175 aa, Vitis vinifera
MAGSLESLVVGKVIGDVVNMFTPAAEFTVHYGSRQVANGRMIPPSAAVDKPKVQIHGHRLSSNLYTLVMVDPDAPSPSEPTLREWLHWIVVDIPEGCDATQGREVVPYMGPQPPTGIHRYIFTLFKQKAAAMSGTLPPETRSNFSTRQFAAGNGLGPPVALVYFNSQKERTNRKH

SEQ ID NO: 50557 - protein, 372 aa, Haloarcula marismortui ATCC 43049
MSQYAARVEEMDISGIREVFEAAGEDAINLGLGQPDFPTPEHAREAAMSAIQDGMGDSYTSNKGIPELREAISDRYATDNGQDIPAENIIATAGASEAIHVAIEAHVQPGDEVLCPDPGFLAYEQLVLLAGGEPKRVELRDDLTLDPAAVENAITDNTSLFIVNSPANPTGAVQSKRDMAEFARIADEHEVICLSDEVYEKIVFDGEHHSPAEFANSDRVIQASACSKTYSMTGWRLGWVAASAERIERMLRVHQYVQACASAPSQYAAEAALTGPQEPVREMVSAFEERRNVLLDGLADIGLDTPVPKGAFYAMPHVPDGWTQKMLDNDVIVVPGEAFGPSGKGQARISYATSTAELKEALEVMRTVTNSL

SEQ ID NO: 50558 - protein, 177 aa, Oryza sativa
  misc_feature (64)..(64): Xaa can be any naturally occurring amino acid
RDKGATRWCEVAQTRHEAVVVKSGLSGLRVLKTTQSSFVDFVQDEYTTLPDAAERIFSTVVEAXWTYDNMRSANFDNAWLTVKEAILDKFAGPPDVGVYSPSVQHTLYQAEKVVLEKVPEITWVKMTMPNKHYLNIDLSKFPANVTKGDPRHHIYQPIDKPAGLIYAQLRRRPKSHL

SEQ ID NO: 50559 - protein, 249 aa, Medicago truncatula
MSSSEEFSVVVLASDLAVDARPFLLHEQQEEEENWHDCSQYLSPDEDFSDLEFLQFFTLQGTDKNGTRILRIIGKHYPATVVSAERLKRYVFHKLFSELPDGPFCIVYLHSTVTNEDNSPGMTILRWIYEDLPDEFKDRLQTLYFIHPGLRSRLVMATLGRFFLSGGLYWKIKYVSRLQYLWDDIKKGEIEIPEFVQKHDDILENRPLTDYGIEPDPFHLTGMPSVAYSFGKYEERWAGRDHISEYEYH

SEQ ID NO: 50560 - protein, 617 aa, Oryza sativa (japonica cultivar-group)
MQGTRRPRTRGMPARAAAPPPRALDLIHQRRNATHHDATMASHAVTDALLLPRSEGAVAGAVDFRGRPASRASTGRWSAAMFVLGVEIAERFAYHGVSANLISYLTGPLGESTAGAAAAINLWSGVATMLPLLVACVADAWLGRYRTIVLASLLFVVKKAHAFLQMNFSKSPTYIQFGGESAATRFGKKKSMGMLTLSSALPAFHGDGGGCSYTSKSLSCAPSTAQVAIFYVSLYLVALAEAGHKPCAQAFGADQFDQNDAKESVSRSSFFNWWYFGMCSGTAMTTMVSSYIQDNIGWGLGFGIPCLVMAFALAMFLLGTRNYRYYVSTQSSPFARLARAFVALIRGSKDDALAVVDDDDGGDHREELRGVLRLFPIWATCIIYAVIFSQSSTFFTKQAATLDRRIGESFRVPPAALQTFISVTIIAFIPVYDRAFVPVARRFTRASSGITMLQRIGTGLVLALAAMVVAALVEARRLGVARDAGMVDDPKAALPMSLWWMVPQYVLFGLSDVFAMIGLQEFFYDQVPDALRSLGLAFFLSIFGVGHFFSSFIISAIDGATKKSGASWFANNLNRAHLDYFYWLLAGLCAVELVAFVFVSRVYVYKKRVPHNGCDVM

SEQ ID NO: 50561 - protein, 430 aa, Synechococcus sp. RS9916
MLDSLDLVIDTIVAREVLDSRGNPTVEAEVLLEGGASGRAIVPSGASTGAHEAHELRDGGSRYMGKGVTKAVDHIEDRIAPALCGLSALDQAAVDSTMQELDGSENKSNLGANSILAVSMATARAAANGVGLPLYRYLGGPMASLLPVPLMNVINGGAHAANSLDFQEFMLVPHGAPTFREALRMGTEVFHTLKGLLHDRGLSTSVGDEGGFAPDLGNIEAGDVLVQAIEKAGYKPGEQISLALDVASTEFFKDGRYAFDGGSFDSAEMVGQLEQLVNRFPIVSIEDGLAEDDWSGWKLLTERLGSKVQLVGDDLFVTNSKRLQQGIDQGVANSILIKVNQIGSLTETLQAIDLAGRSGYTSVISHRSGETEDTTIADLSVATRAGQIKTGSLSRSERVAKYNQLLRIEDELGSQAVYAGAAGQGPRGNG

SEQ ID NO: 50562 - protein, 166 aa, Aquilegia formosa
MAASVDPLVVGKVIGDVVDMFIPTINMSVYYGSKHVTNGCDIKPSLATAPPTVHISGFSDELYTLVMSDPDAPSPSEPTKREWLHWIVVNIPGAGYVTRGKEVLPYMGPAPPVGIHRYALLLFRQKNPLSIDNPPLRANFKTRNFAHQFDLGLPVACAYFNAQKEL

SEQ ID NO: 50563 - protein, 1070 aa, Solibacter usitatus Ellin6076
MPRRNDIHRILIIGSGPIIIGQACEFDYSGTQAAKALRADGFEVILVNSNPATIMTDPNLADKTYVEPLTRPYLEEIIRRERPDALLSTVGGQTGLNLSVELAEAGVLDKYGVELIGAKIDAIKKAEDRLLFKDAMRKIGLATPQSQLISTVAAGLEFAEKIGYPNILRPSFTMGGTGGGIAYNKEELVEILERGIALSPVHEVLMEESALGWKEYELEVMRDLADNCIIICSIENFDPMGVHTGDSITVAPAQTLTDREYQMMRDGALRCLREIGVDTGGSNVQFAINPDDGRMVIIEMNPRVSRSSALASKATGFPIAKIAAKLAVGYRLDEIRNDITLKTPACFEPTIDYVVAKIPKWAFEKFPGADTTLGTQMKSVGEVMAIGRTFKEALWKGMRSLETGKAFGSEKYDKNLIAKKLITPTPDRLNYIRFALASGYTVAEIHELTSIDVWFLEQMKDVVDTEIDLAAGSLTSATAEQFRKAKRFGISDSQLAKTWGVPEIDVRARRKELGVVAVFSRVDTCAAEFESFTPYLYSNYESACEADPGSGKKVMILGSGPNRIGQGIEFDYCCCHASFSLQEMKVESIMVNCNPETVSTDYDTSDRLYFEPLTLENVLNIVDTEKPDGVIVQFGGQTPLNLALPLKRLGVPIIGTDPENIDLAEDRKLFGKLLDDLKIPCPANGTATSVEEACAVAARVGYPVLVRPSYVLGGRAMVIAYDEEMVRQYMREAVTFSQERPVLVDRFLEDATEVDVDALGDGTDVLIAGIMEHIEEAGVHSGDSSCVLPAQSLSREILDTIEDYTVRLAKALKVIGLMNVQYAIQNGVVYVLEVNPRASRTVPYVSKATGVPLPKIAVGLMWGKKLKDYGFASGKLSVPQVFVKSPVFPFNKFHGVDPVLGPEMRSTGEVMGVGINFGEAFLKAQISAGSPLPEKGTVFISVNDHHKKEAADVAARFAALGFSLVATRGTAAALRAAGLTCRTVFKVNEGRPNAVDLLKGGNIQLAIYTTAGASAFSDEKSIRRSAVQYRVPCITTMSGARAAADAVAARLRDPIRVWSLQEIHETVRHG

SEQ ID NO: 50564 - protein, 238 aa, Oryza sativa
LCLLSEKKKGEKKSSFPLLASIRDPPPPPPVSGDRRRAITPRRAGLLSAPAGLVDRRSGGVTGAEVVGQIHSGGFLNSWEQRGKSEAAAMSIELILWLFSFASIMVLIGLTAYQLICLSDLEFDYINPYDSSSRINSVVLIEYALQGALCASFLLTLHWFPFLVMAPVAYYHGKLYMDRKHLVDVTEIFRQLNWEKKYRMIKLAFYFSLFIITIYRLVMTAVTLFIDEDANLVDTRTI

SEQ ID NO: 50565 - protein, 213 aa, Coccidioides immitis RS
MQNVNPTIINAADLPRRESVTKTTAPSRKADVFDGTIFASSNLATRPWEDDPFSTYLDKSNSETESVGELEDDSEEPIDEQEIYAWTSIDLISTISDPEHPISLGELAVVSLPDISITPALPSDPSSPLKKVTVLVTPTITHCSLATVIGLGVRVRLEQSLPSRFRVDVRIKEGTHSTAEEVNKQLADKERVAAAAENSTLMSVIEKMLETCK

SEQ ID NO: 50566 - protein, 285 aa, Solibacter usitatus Ellin6076
MKTENVAEIARRQGLNWFTAVVLALLHIGAVAALFMFSWKALAVSVVLYYFATGLGISMGYHRLHTHRSYKVPRWLEYFFAICGTLTLEGGPIFWVATHRVHHQFSDLPGDPHSPRDGAFWSHMGWILWGETNHNNTRMMSKYAPDVAKHKFYTWLNNWHWVPITVLAAILVAWGGLPMFLWAICLRVVFGLHVTWAVNSATHMFGKRRFQTRDDSRNTWWVALFSFGEGWHNNHHAHPTSARHGLAWYEFDPSWLLIKVLKAIGVAKSIKVAHVDSGLAEREAA

SEQ ID NO: 50567 - protein, 514 aa, Staphylococcus epidermidis ATCC 12228
MVVPFKNEPGIDFSVQTNVERFNEELRKVKAQLGQDIPLVINGEKLTKTDTFNSVNPANTSQLIAKVSKATQDDIEKAFESANHAYQSWKKWSHKDRAELLLRVAAIIRRRKEEISAIMVYEAGKPWDEAVGDAAEGIDFIEYYARSMMELADGKPVLDREGEHNRYFYKPIGTGVTIPPWNFPFAIMAGTTLAPVVAGNTVLLKPAEDTVLTAYKLMEILEEAGLPQGVVNFVPGDPKEIGDYLVDHKDTHFVTFTGSRATGTRIYERSAVVQEGQQFLKRVIAEMGGKDAIVVDNNVDTDLAAEAIVTSAFGFSGQKCSACSRAIVHQDVHDEILEKAIQLTQKLTLGNTEENTFMGPVINQKQFDKIKNYIEIGKKEGKLETGGGTDDSTGYFIEPTIFSGLQSADRIMQEEIFGPVVGFIKVKDFDEAIEVANDTDYGLTGAVITNHREHWIKAVNEFDVGNLYLNRGCTAAVVGYHPFGGFKMSGTDAKTGSPDYLLNFLEQKVVSEMF

SEQ ID NO: 50568 - protein, 289 aa, Staphylococcus epidermidis ATCC 12228
MNLLKFHNKIKGYTQNRQPGIEADMEPKPIAELEEYKAAGKLENKVALITGGDSGIGRAIAILYAKEGANVAIGYYDEHQDAEDTVNRLQEMGVKAKAYAHDLKDEKQSQKLIKDVINDFGSLNILVNNGGVQFPRDHFEDITPQQVKETFMTNIFGMMFLSQAAVPYLSEGDTIINTTSVTAYRGSGHLIDYSATKGAIVSFTRSLATTLMEKGIRVNAVAPGPIYSPLIPATFDEEKVEHQGDETPMGRRGQPAELAPSYVFLATHADSSYITGQVIHVNGGDFITS

SEQ ID NO: 50569 - protein, 344 aa, Burkholderia mallei ATCC 23344
MKALVLEKARELALRDIDLPLEVGPADVKIRVHTVGVCGSDVHYYMHGGIGPFRVDAPMVLGHEASGTVVEVGRDVTYLRVGERVCMEPGVPRFDSKATLHGLYNLDPSVRFWATPPVHGCLAPYVVHPAAFTYRLPPNVSFAEGAIVEPLAIGLQAAKKAAMKPGDIAVVVGAGTIGAMTALAALAGGAARVILADVVKEKLALFAANRAVTTVDASTQSLADAVAHATDGWGADVVFEASGNANAYAGIVDLLCPNGCLVLVGMPLAPVPLDVVSLQAKEARIESVFRYANVFPRALALIASGAIDVKPFISRTFPFSDGLRAFEAAASGQPHDVKIQIEMD

SEQ ID NO: 50570 - protein, 301 aa, Picrophilus torridus DSM 9790
MIDPEIKEIIENAGPLNPADIKIDEFRALMDNLAIEMSREKIKVREVTDIKINNIKSRLYNDSDSDGIIIYMHGGGFVFGSIESYDNICRYIAKCSGLKVLSVDYRLAPENKFPAALDDSFEAFKYVYDHYSDLRIKMDRICLAGDSAGGNLAASLSLKIYDELGVKPGLDVLFYPSLAPDTFSRSFSEYNDGPVLTGDLIQWFGSQYYKNFYDVLNPYFSPMLGDLSKMPESIVVTAEYDPLRDQGESYLKMLRKANVRATGIRSLMMVHGFATDFEYVSAARNILFMVYSLAGNIINKL

SEQ ID NO: 50571 - protein, 576 aa, Aspergillus oryzae
MNCPSRTDDTLEHPGWNQNPSDLNADVTTRNDFNGIANSKVHRKHASGVGAAMGEGIATVEPQLHGRDRNDTESEKKMPGEVVSAASGYQTPERNSRSPRRSLKTSITAPFSHMVQSIVKFARFVGPGFLIAVAYIDPGNYATDVAAGAEYRYALLFIVLVSNLFAIFLQSLCIKLGTVTGLNLAENCREHLPRWLVYILYFLSEAAIVATDIAEVVGSAIALNLLLKIPLVAGCAITLADVLFILIFYKPDGSMLGLRLFEFFVMGLVLGVVVCFCIQLSLIRDQSVGDVFRGYLPSSAIVESTGLYQSCGILGATVMPHSMFLGSGVVQSRLKEFDVTEGYVDPSVCLGSTNGEVEYRPSLHAIRGCLKYSIVELALSLFTFALFVNSSILIVAGAALYGNPDVGEADLWGIHDLLSTSIAPAAGLIFGLALLLSGISAGIVCTMAGQMVSEGMLNWSIRPWLRRLITRSVSIIPSIVVAGAVGRKGLDKTLTASQVVLSVILPFVSAPLVYFTCRNRYMTVPSDRVMHGEDQTQTEGVKMKNNLITTVIAIVIWLIIAVMNVALLVLVGLGKA

SEQ ID NO: 50572 - protein, 439 aa, Acinetobacter sp. ADP1
MDLVSRIENLPIGKFHYTLLWVVGLGWMFDALDTGIIAFIMTTLVKDWALTPAESGWIVSIGFIGMALGAVFSGGLADRFGRKTVFATTLLIYSLATAACAFAPNLTWLLAFRFIVGLGLGGQLPVAVTLVSEYIPAHVRGRFIVLLESFWGLGWLVAALVSYFVIPHFGWHIAFLIGGLPAIYVYVIIKKVPESIPYLINRGRIDEAHELVQQIERHAGVPVIDTIVVKPVAQKQQVSFRQLWSGRFARRSLMLWLVWFGIVFSYYGIFTWLPSLLVKQGYSVVQSFEYVLIMILAQLPGYISAAWLVERLGRKATLAGFIGACAISAYFFGQADTVFNIMVWGCLLSFFNLGAWGVLYTYTPEQYPANIRAFGAGWASAVGRMGGIAAPIVVTHMMVAHDGFHQVFMMFTLVLLAVAAVIVILGEETQGKTLESIGL

SEQ ID NO: 50573 - protein, 82 aa, Arabidopsis thaliana
  misc_feature (70)..(70): Xaa can be any naturally occurring amino acid
KSSAAFPVTRKTNKDITSIASNGGRSSCMKVWPPIGKKKVETLSYLPDLSDVELLKKVTTFSANRWIPCXEIRVKARIVYRE

SEQ ID NO: 50574 - protein, 355 aa, Oryza sativa (japonica cultivar-group)
MRPVSSAEEVGALLSRSDSSGRRRRSSPVQSASPRPAGCGCGGPRRQSSFRDDVGHAASETYLVTRLTFSLLQYLGLGYRWMSQLLALTIYAILLMPGFLQVLSWFTVGYYYFFSSQVRRSIVYGEQPRNRLDLYIPKDINRPCPVVAFVTGGAWIIGYKAWGSLLGRRLAERGIIVACIDYRNFPQGTIGDMVSDASQGISYVCNNIASYGGDPNRIYLVGQSAGAHIAACALIEQAVKESSGQSISWSVTQIKAYFGLSGGYIGSCCHVLQTFADVLQQAGAQAKLQLYEGKTHTDIFIQDPLRGGRDPLVEDVLSIIHVDDEITQEKIALAPAPRRLVFEWQLQLARRFSPF

SEQ ID NO: 50575 - protein, 285 aa, Xylella fastidiosa Dixon
MTTKDTWFTEHFQATGSAIGFRVTGKLDEVQSPFQKIEIYNSTDWGKLMVIDGALMLTSRDNFIYHEMISHPALFTHTAPKCVVIIGGGDCGTLREVLKHPDIEQVTQCDIDEQVTRMAEKHFPELCTSNNDPRATLLFSDGVAYMADCPTNSVDVIIVDSTDPIGPAKGLFNRTFYESCFRALKNDGLLIQQSESPLALLELIKEMRHEMSKAGFKAFKTLPFPQPCYPTGWWSVTLSSKQPNANFAFRQTDAQTKPFDTLYYNAHLHHGVLAPPPFIAHALGE

SEQ ID NO: 50576 - protein, 559 aa, Acinetobacter sp. ADP1
MEKIWFAEYQKTGIPETVELPPENTSLVDIFERNFQKFGSRDAFIFMDKALTFNELEEASRKFAAYLQSLNLPKGSRVAVMMPNVLQYPIVALGVFRAGLVLVNVNPLYTARELEHQLNDSGAEVLVIIENFASVYQTILGKTPVKHVVIASVGDMLGTLKGTLVNFVLRKVRKQIPAWNVPGHVKFNSALNKVSPSHYKRPNLTLSDTAVLQYTGGTTGVSKGAELTHRNLVANMLQCDGIFQSKFGSGDSSKDDKMFCALPLYHIFAFMVCAMYGMYKGQANILIPNPRDLPAVIKELRKYQPTFFPAVNTLFNALVHNEEFKQLDHSKLKIAMGGGMAVLPSTAEAWKRITGVTIIEGYGLSETSPVATVNPPASSEFSGTIGIPLPLTDVAILDDDGHPVALGEQGEISIRGPQVMKGYWNRPDETAKVMTSDGFFRTGDIGVMNDRGYVKIVDRKKDMILVSGFNVYPSEIEEVIAKHPKVLEVAAIGVPDEKSGEVPKLFIVKKDPSLTTEEVLSFAKENLTGYKRPRYVEFMDELPKSNVGKILRKDLRKTN

SEQ ID NO: 50577 - protein, 431 aa, Gluconobacter oxydans 621H
MTSFAELKLAEPIQKALAEEGYTTPTPIQAGAIPYLLEGRDLLGLAQTGTGKTAAFALPILNHIFTNRRPAPPKGVRALVLAPTRELASQIGESFAAYARHMKFSYAVVFGGVGQGRQIETTRRGVDVLVAAPGRLLDLIGQKHIDLSTLEILVLDEADRMLDMGFVRDIQRIMALLPKQRQTLLFSATMPPSISDLAHSLLKNPATVQVTPESSTVDRINQAVMFVDSGSKKDAALMLLESPSVARAVVFTLMKHEANKVAEFLNKNGIRAEAIHGNKSQGARERAMAGFRSGAIKALVATDIAARGIDVDEVSHVFNYDLPNVPESYVHRIGRTARAGREGCAVSLCDAEQRAWLKDIEKKIGKPIPVVTDHPFHSEEARLSTQRPPVLGGGRGGGGGGRRRSGPPSGGRPGGGRGGAPGRGGPRPGAR

SEQ ID NO: 50578 - protein, 313 aa, Candidatus Kuenenia stuttgartiensis
MEKLPLNWIDDYFSDYELHKLAFKNIVYEAESKHQKIIVVDTYSFGKCLILDNEFQSAESDEYVYHESLVQPSLIMHPEAQSVLIIGGGEGATLRETLRHKSVKKAVMVDINDEVISCAKKSLPSFHEGAFDDERTSLVIEDGRKYLENTDQQFDVIIIDVNDPVGGSPSAMLFTREFYQIAAGRLKKDGIVVVQSGAVSVTDNDLFSGIFHTLNDVFPHVFPYTTYIPSYACLWGFTIATHNLGDLDITGEEIDFRIGNRVNSALRYYDSITHHSLFNLPKYLREELKKSKHIIRDNAPLIKQYPGVSSEKI

SEQ ID NO: 50579 - protein, 200 aa, Aquilegia formosa
SIIPSERPNHVMMEMWNPLGIVGVITAFNFPCAVLGWNACIALVCGNCVVWKGAPTTPLITIAMTEIVAEVLEKNNLPGAIFTAFCGGAEIGQAIAKDTRIPLVSFTGSTKVGLMVQQTVSERFGKCLLELSGNNAIVIMDDANIPLAVRSVLFAAVGTAGQRCTTCRRLLLHDSIYICTGTNSSEVYKQFKMGGIHYKK

SEQ ID NO: 50580 - protein, 473 aa, Mycobacterium avium 104
MRHYYSVDAIRAAEAPLLASLPDGALMRRAAFGLATEIAAELTARTGGVAGRRVCAVVGSGDNGGDALWAATFLRRRGAAADAILLNPERAHRKGLAAFGKAGGRIVESVSPTTDLVIDGVVGISGSGALRPAAAEVFAAVDDAGIPVVAVDIPSGIDAATGATSGPAVHAVLTVTFGGLKPVHALGDCGRVKLIDIGLDLPQTDVLGFEAADVAARWPVPGPHDDKYTQGVTGVMAGSATYPGAAVLCTGAAVAATSGMVRYAGSAHREVLAHWPEVIASPTPASAGRVQSWVVGPGLGTDDAGAAALWFALETDLPVIVDADGLTMLAAHPELVANRAAPTVLTPHAGEFARLAGSPPGDDRVGATRKLADTLGVTVLLKGNVTVIADPGGPVYLNPAGQSWAATAGSGDVLSGMIGALLASGLPAGEAAAAAAFVHARAAASSAADPGPGEAPTSSSRMVPHIRGALAAL

SEQ ID NO: 50581 - protein, 474 aa, Solanum lycopersicum
MSRYDSRPADPGSYRDRRSDSGFGGGSNYRSSSSSRRDSEGKESPRKVNLDDLPPFEKNFYVESPSIAAMTEGEVEEYRRRREITIEGRDVPKPIKSFHDVGFPDYVLQEIEKAGFTEPTPIQAQGWPMALKGRDLIGIAETGSGKTIAYLLPAIVHVNAQPILDHGDGPIVLVLAPTRELAVQIQQEATKFGASSRIKNTCIYGGVPKGPQVRDLQKGVEIVIATPGRLIDMLESNHTNLRRVTIVLDEADRMLDMGFEPQIRKCISDTPDRQTLYWSATWPKNVNHVSSACGNRLGDQKYNKLVKLLEDIMDGSRILIFRTLKGCDQVTRQLRMDGWPALSIHGDKSQAERDWVLSEFKAGKSPIMTATDVAARGLDVKDVKFVINYDFPGSLEDYVHRIGRTGRAGASGTAYTFFTAANARFAKDLVNILEEAGQKVSPELAKMGRGAPPPPGHGGFRDRGRGYGGNKQWS

SEQ ID NO: 50582 - protein, 388 aa, Photorhabdus luminescens subsp. laumondii TTO1
MSEQNTMTELTTFKPKKSVALSGVSAGNTALCTVGKTGNDLHYRGYDILDLATQCEFEEVAYLLVHEKLPSRAELAAYKAKLTALRGLPGSVKAALETLPAAAHPMDVMRTGVSVLGCTLPEKDDHNLAGARDIADRLLASLSSILLYWYHYSHNGRRIEVETDDVSIGGHFLHLLHGKKTCESWEKAMHTSLILYAEHEFNASTFTSRVIAGTGTDIYSAIIGAIGALRGPKHGGANEVSFEIQQRYENPDEAERDILARLARKEVIIGFGHPVYTISDPRHKVIKDVALQLSKEAGTTKMFNIADRLEAVMWANKKMFPNLDWFSAVSYHMMGVPTAMFTPLFVIARTAGWAAHIIEQRIDNKIIRPSADYTGPENRVFTPIGKRG

SEQ ID NO: 50583 - protein, 391 aa, Staphylococcus epidermidis ATCC 12228
MRRHSMEMSERLASIPDSYFGKTMGRIVEHGPLPLINMAVGIPDGETPKGIINHFSEALCIPENQKYGPFHGKDAFKQAIVNFYQRHYDVELDKEDEVCILYGTKNGLVALPTCVVNPGEIVLLPDPGYTDYLAGVMLADAKPLPLKLSPPNYLPNWNTISAKVLEKTKLIYLTYPNNPTGSTATQDDFDEAIHRFKGTQTKIVHDFAYSAFGFDAKNPSILASKNAKDVAIEIFSLSKGYNMSGFRVGFAVGNKKMIQALKKYQTHTNAGMFGALQDAATYALNHYDEFLEKQNEIFRRRRDNFESQLKHAHLPFVHSKGGIYIWLHTPPGYDSEAFEQLLLKEKSILVAPGKPFGENGNQYVRVSLALDDKQLEEAANRLTQLRYLYER

SEQ ID NO: 50584 - protein, 196 aa, Triticum aestivum
  misc_feature (37)..(37): Xaa can be any naturally occurring amino acid
  misc_feature (56)..(56): Xaa can be any naturally occurring amino acid
  misc_feature (160)..(160): Xaa can be any naturally occurring amino acid
  misc_feature (175)..(175): Xaa can be any naturally occurring amino acid
LLLGTIEQASTAGWYRSVPPGISSTHASAATSVAPFXGLKSTAGLPVSRRSNGASXGSVSNGGRIRCMQVWPIEGIKKFETLSYLPPLSTEALLKQVDYLIRSKWVPCLEFSKVGFIFREHHPSPGYYDGRYWTMWKLPMFGCTDATQVINQVEEVKRDXPDAYVPIIGFDNMRXCSAVTFIAFKPTGLARNPGKA

SEQ ID NO: 50585 - protein, 539 aa, Methanocaldococcus jannaschii
MSDNMICLGLEGTAEKTGVGIVTSDGEVLFNKTIMYKPPKQGINPREAADHHAETFPKLIKEAFEVVDKNEIDLIAFSQGPGLGPSLRVTATVARTLSLTLKKPIIGVNHCIAHIEIGKLTTEAEDPLTLYVSGGNTQVIAYVSKKYRVFGETLDIAVGNCLDQFARYVNLPHPGGPYIEELARKGKKLVDLPYTVKGMDIAFSGLLTAAMRAYDAGERLEDICYSLQEYAFSMLTEITERALAHTNKGEVMLVGGVAANNRLREMLKAMCEGQNVDFYVPPKEFCGDNGAMIAWLGLLMHKNGRWMSLDETKIIPNYRTDMVEVNWIKEIKGKKRKIPEHLIGKGAEADIKRDSYLDFDVIIKERVKKGYRDERLDENIRKSRTAREARYLALVKDFGIPAPYIFDVDLDNKRIMMSYINGKLAKDVIEDNLDIAYKIGEIVGKLHKNDVIHNDLTTSNFIFDKDLYIIDFGLGKISNLDEDKAVDLIVFKKAVLSTHHEKFDEIWERFLEGYKSVYDRWEIILELMKDVERRARYVE

SEQ ID NO: 50586 - protein, 337 aa, Solanum chacoense
MALPHHHLQLHIQQQQPHQQQSKSYRDLYNNMDGQITTPVVYFNGSNLPEQSQHPPYIPPFQVVGLAPGTADDGGLDLQWNYGLEPKKKRPKEQDFMENNNSQISSVDLFQRRSVSTGLGLSLDNGRLASSCDSAFLGLVGDDIERELQRQDAEIDRYIKVQGDRLRQAVLEKVQANQIQAITYVEEKVLQKLRERDTEVDDINKKNMELELRMEQLDLEANAWQQRAKYNENLINTLKVNLQHVYAQSRDSKEGCGDSEVDDTASCCNGRATDLHLLCRDSKEMKELMTCRVCRTNEVCMLLLPCKHLCLCKECESKLSLCPLCQSTKYIGMEVYM

SEQ ID NO: 50587 - protein, 247 aa, Mycobacterium sp. MCS
MLGHMTDSKIILVTGASSGIGAAVATHLARAGHHVIAGARREDRLRELADGAADLERGSLSVRRLDVTDRAEMAAFVDDAVSTHGRLDVLVNNAGIMPLSRLDALLVDQWDAMIDVNVRGLLNGIAAALPHFHRLGGGHFVTVASIGAHEVVPTSAVYSATKYAAWAITEGLRQESDPSIRVTTVSPGVVESELASTITDPGAAAAMQEYRAAAITPDAIARAIAYAISEPEEVDVNEVIVRPARQR

SEQ ID NO: 50588 - protein, 420 aa, Anaplasma phagocytophilum HZ
MPVKVLMPALSPTMKSGTIAKWHKNAGDAVKPGDIVADIETDKAVIEFEYADEPGVMYKILKEEGSKNVAVNQSIAVIKVDGDEEAALLEMVHSAEGASGSVSNEAASAALQATPAKVAGDMVAPSSANKASETAHITSGSDRVKASPLAKKLAAQLSVDISKITGSGPYGRVVKADVLGASVPTSDTTIQEGSRVVEVSTMRKVISERLAESKRNIPHFYLAIDCMVGELLEVRSRINSNAEALGTKITVNDLVIKATALAAREFPEVNALWAGDKIVYHQNVDIAFAVALDDGLLTPVIAGADKMTLSELSKTAKSLVARAKDRKLLPHEFQGGCLTISNLGMFCIKEFYAIINPPQSCIMAVGQSEKRPVVVDNCVVAADVMSVTLSVDHRVIDGALAAKFLNRFKFYIENPLAMLA

SEQ ID NO: 50589 - protein, 1045 aa, Anaplasma phagocytophilum HZ
MMISSLQVPDELRKRMQGLYNTDEKSYIRYLTEKAEVSQDAKVRIYNLAKQIIEKVRFGKGSTLIDAFMQEYGLSSEEGVALMCLAESLLRIPDECTIDEMIRDKIAGTTWKKHIGSSSSIFVNASTLALCVGARVLREVDDSRWYSVLSNLLKNMGEPIIRKAALQAMCILGKHFVMGRDIEDAVARSNDSKQLCSFDILGESARTREDADRYFAAYMHAIEVIGADAGCGDDISSRHGISVKLSALHPRYDFAQIDYVLDDISSKLLEICAAAKKHNIGVLIDAEEARRLEASLIVLEKVFLDKSLDGWEGLGLAVQAYQKRALGVLDIVEDIAIRANRKMVVRLVKGAYWDYEIKNAQELGLDGYPVFTRRAYTDTSYFACVQRILSKPNTFYPCFATHNAYTLASVLESADKDHPGFEFQRLHAMGQGLYSYVTGEVAPSVKCRVYAPVGSYQDLLPYLIRRLLENGTNSSFVNKINDVDVLAEQLLVDPLEKAKSFEYCPHPSIPLPIDMFGKDRVNSIGLNTSDSLAMSVLNEEVQTFTNVTRKATPIINGEDVEGAAPIEFFSPGDFSCKVGEVSYATPEQVKEAFAVAHAAYAEWSALSVEERATILESAADLLEKERGKFVALLMLEGGKVISDVMAEIREAVDFLRYYAMIARKDIAGTIKLPGPSGEENYIYFESRGVFVCISPWNFPLAIFLGPIAAALVTGNTVIAKPSEQTSLIAYEAVKLFFRAGLPGSVLQFLPGEGAALGEVLINNGHVAGVAFTGSTDTANIINRTLAKRNRDIVPIIAETGGINAMIVDSSAVLEQVCDDVITSAFRSAGQRCSALRVLLLQEEIADRQIEIICGALKELRLGNPMLLSSDVGPVIDQQSYDMLCEYVKGMEEKGAKLLCKLDIGSLAEVGHYFPPHIFEVGSVSEVAKEVFGPILHIVRYKKSDLVSILEEINKTGYGLTFSVQSRIQSNIDLIVDKIRTGNVYVNRNQIGAVVGVQPFGGSGLSGTGPKAGGPFYLHRFVTEKTVTVNTTALGGNVALACLEEE

SEQ ID NO: 50590 - protein, 748 aa, Oryza sativa (japonica cultivar-group)
MEVADLENPTSRSSSQKSSRRSGSRRSQKSAGQQSSPTVFPEKKGKSKSSRQKHLVFDNKDSKKAKNNEQKNDVVDEKSNFSGYEIYSGKLFFDKKNRITGDQISANGKADISDVRLTSKALIWGSSLLSLEDVISVSYSSGVQHFIVHAYPSKKYLFGKTHRVRKDLRFIAPTVEEAISWVTCFAEQNIYVNMLPLPPTSSTEQDLDGPLSGALFDHPPIKCRTPPRILVILNPRSGHGRSCKVFHDKAEPIFKLAGFHMEVVKTTHAGHAKSLASTFDFSAFPDGIVCVGGDGIVNEVFNGLLSRSDRAEAVSIPVGIIPAGSDNSLVWTVLGVKDPISASLLIVKGGFTALDILSVEWIQSGLIHFGTTVSYYGFISDVLELSEKYQKKFGPLRYFVAGILKFFCLPSYFYELEYLPSSKEMTGHGKGIGQENFVSDVYTNVMRSRSKREGIPRASSLSSIDSIMTPSRMSLGDVDTSGSTAASTEPSEYVRGLDPKAKRLSLGRSNIVSEPEEVLHPQPHHSSFWPRTRSKTRTERNSVGVTTNDTRLSWAAPSIHDKEDISSTISDPGPIWDSEPKWDNGPKWDTELTWESDHPIELPGPPEDNEIGPSVELVPNLDDKWVVRKGHFLGVLVCNHSCKTVQSLSSQVIAPKANHDDNTLDLLLVGGKGRWKLLKFFILLQFGRHLSLPYVEYVKVKSVKLKPGANTHNGCGIDGELCRVKGHVLCSLLQEQCMLIGRQSRQST

SEQ ID NO: 50591 - protein, 307 aa, Anabaena variabilis ATCC 29413
MRGFDRLDTVDLSTWVALAKTKTNCGRVVERIPRLAVADTAWFAVHICCKSGKFYSEGDTNCVFPLMSVIKPFTFLYLLEHMGMEKVLSWVGVKPSDAPFNSLEQLVADGGYPRNPMINSGAITLADKLLGEDADYSTRSFCEWLNQLAGSQIQLDESMLASVRLSRSPANQAIANYLAEKGYLGNLDVALDTYEQICCLSGTVEDLALLGKLLALESSSISPQHQQLVNSVMLSCGLYQASAEYADKIGLPMKSGIGGGLLAVVPKEGAIACYSPALDRIGNPVGAIAFVEVLSRSLGLCGRFSHL

SEQ ID NO: 50592 - protein, 1418 aa, Burkholderia mallei ATCC 23344
MTSASVKTVCPYCGVGCGMVLHVEDGEVVKVSGDAEHPTNLGRLCTKGSSAHVALRNAGRLERAFVRDARELDPAPVPIADAIAETARRLRATLDAHGPDALAFYVSGQMSLEAQYLVNKLAKGYVRTPHIESNSRLCMASAGSGYKLSLGADGPPGSYQDFERADLFFVIGSNMADCHPILFLRMMERVKAGAKLVVVDPRRTATAQKADLFLKIRPGTDLALLNGLLHLLHANGRTDADFIAAHTEGWDAMPGFLADYTPQRVAALTGLAEADIRLAAQWIGDAREWTSCWTMGLNQSTHGTWNTNAICNLHLATGKICRPGSGPFSLTGQPNAMGGREMGYMGPGLPGQRSALDGDDRRFVEEIWGLPAGTIRPDAGGGTVDLFARMAAGDVKACWIICTNPVATVANRKNVITGLQAADVVIVQDAFLDTETNRYADILLPGALWAEAEGVMINSERNLTLMRQALEPPGDAWPDWRIVAAVARGMGYGDAFDYGSAAEVFDEIRRFANPNTGYDLRGASHAALRATPLQWPCPPEDGRDRHPIRYLNDGASRPRVTLPDGRVPPLAFPTPSGKARFFARSHVAPAEMPTPEFPIVLNTGRLQHQWHTMTKTGKVAMLNKLDARPFVEIHPDDAAALSIAANDAVEIRSARGRAVLPAVVTDRVQPGACFAPMHWNDVYGDDLCVNAVTNDAVDPVSLQPELKFCAVALARVDAPDSADAGAHAGAHAAPLHETGSREAQAQAGPRAHEAACADAAPEEHDMSDIDTFAALLGVPAATSAPQLTDAQRVYVAGFVSGLRSAEGRRAGGVPMLPASAPFDAKARLWLDGLLAGLFSRAPLGATARVDARAAAAAAVPAPSGAADAVSAPSGVRIVRTRPKVVLLWASQTGNVESLTERYATQLMDSGFEIRVACMSDYPAASLAKAQYALLMTSTFGDGDAPDNGQAFWTALAAAGAPRADGLRYAVLAFGDRNYDPFCGHGRRLDARLAELGATRLVERVDCDAEFQPAADAWLERAIARIKEEDAALHAVPADGMIPSGAIPTKTRPAASRLVANLRLNEPGAAKDTRCVSLSTDGAAIEYETGDALGVWPTNCPELVDELLALTRLKPDAPVTVAGMGELRLADALAKHLDITRPHPDALAFVASRSRAGDALARLLGDDRKTDLKHWLWGQQLADVLHEFPLELSAAELVGMLKRLQPRLYSIASSPSAHRGEIHLTVSAVRYGNGRRQRKGVASTFLADRAADAPVPVFVQKSAHFRPPASGDAPIVMVGPGTGIAPFRGFLHERRARGAKGRNWLFFGEQHADTDFYYRDELAQMRADGFLTRLDVAFSRDQTEKVYVQDRMLEQGAALWAWLEEGAHFYVCGDASRMAKDVDAALKTIVARHGGMTDEQAADYVARLTKDKRYARDVY

SEQ ID NO: 50593 - protein, 851 aa, Burkholderia mallei ATCC 23344
MKIVVIGHGMVGHKLLECIAAGAPGALAAPRVAVVCEEPRPAYDRVHLSEFFAGKSADDLSLVEPGFFERHPNFRLLLNTKAVAIDRAARTVALSTGETLAYDKLVLATGSTPFVPNVPGRERAGCFVYRTIEDLEAMRACGARANSGVVVGGGLLGLECAKALRDMGLAAHVVEFAPRLMAVQVDEGGGRMLREKIEALGVQVHTGKNTLEIVDGETGAHRMAFADGTHLDADMIVFSVGIRPRDEIARACGLEIGPRGGVAIDERCRTSDEDIYAIGECAAWNGQTFGLVAPGYDMARVVARQLAGGEGAFAGADLSTKLKLMGVDVASIGDAHGRTPGSRAYQFADERRGVYKKLVVSECGKALLGAVMVGDAADYGTLLQMMLNRIELPRSPEFLILPQADGAAKPALGVDALPDAAQICSCNNVTKAQLREAVAGGATSLGALKGCTGAGTSCGGCVPLVTQVLKAEMKKQGLAVNNHLCEHFPYSRQELYHMVRVERFKTFGALLKKHGRGLGCDVCKPAVAGILASCWNEFVLKKEHAALQDSNDYYLANIQRDGTYSVVPRMPGGEVTPEGLIAVGEVARKYGLYTKITGGQRVDLFGARVEQLPLIWEELIAAGFESGHAYGKSVRTVKSCVGSTWCRYGVGDSVGLAIELENRYKGLRAPHKLKFGVSGCTRECAEAQGKDIGVIATEKGWNLYVCGNGGMKPRHAELLAADLDRATLVRYVDRFLMFYIRTADRLQRTSVWRDNLEGGLDYLIDVVVHDKLGLAAELEAEMQHVVDTYECEWKRAVTDPATRRRFRHFINSDAPDSTIAFVEARGQIRPVTPDERDAEGQADRQPETETA

SEQ ID NO: 50594 - protein, 385 aa, Oryza sativa (indica cultivar-group)
MADKENSTPASAARLTRSSAAAGAQAKRSAAAGVADGGAPPAKRKRVALSDLPTLSNAVVVAPRQPHHPVVIKPSSKQPEPAAEAAAPSGGGGGSPVSSASTSTASPSSGWDPQYASDIYTYLRSMEVEARRQSAADYIESVQVDVTANMRAILVDWLVEVADEYKLVADTLYLAVSYLDRYLSAHPLRRNRLQLLGVGAMLIAAKYEEISPPHVEDFCYITDNTYTRQEVVKMESDILKLLEFEMGNPTIKTFLRRFTRSCQEDKKRSSLLLEFMGSYLAELSLLDYSCLRFLPSVVAASVVFVAKLNIDPYTNPWSKKMQKLTGYKVSELKDCILAIHDLQLRKKCSNLTAIRDKYKQHKFKCVSTLLPPVDIPASYLQDLTE

SEQ ID NO: 50595 - protein, 179 aa, Zea mays
  misc_feature (19)..(19): Xaa can be any naturally occurring amino acid
  misc_feature (166)..(166): Xaa can be any naturally occurring amino acid
PVITRRPRVRAVDDISSRXGSLVESMTADLAGEVTSAAGPVRLEDLQRILSAIQSSADPDAGVGLGDILKPDLVLPLIEDLPIEQLASHLPEGGSWSPGDIVELLQSPPLRQQLDAFTHVLRTGQIDLAQFGVDPDKYKFTVVSFLEALEDSVGRGASEAGDKDAXVERGSGNDAMDES

SEQ ID NO: 50596 - protein, 379 aa, Pennisetum glaucum
MATAGKVIKCKAAVAWEAGKPLSIEEVEVAPPQAMEVRVKILYTSLCHTDVYFWEAKGQTPVFPRIFGHEAGGIIESVGEGVTDVAPGDHVLPVFTGECKECPHSKSAESNMCDLLRINTDRGVMIGDGKSRFSINGKPIYHFVGTSTFSEYTVMHVGCVAKINPEAPLDKVCVLSCGISSGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDGWGVAVLVGVPHKDAEFKTHPMNFLNERTLKGTFFGNFKPRTDLPNVVELYMKKELEVEKFITHSVPFSEINKAFDLMAKGEGIRCIIRMEH

SEQ ID NO: 50597 - protein, 518 aa, Oryza sativa (indica cultivar-group)
MVAGGSNGGAAVLVGITVLLFVVVVVVVVLVRWWSGGEGGAAPSPPALPVLGHLHLLKKPLHRSLAAVAAGVGAPVVSLRLGARRALVVSTHAAAEECFTACDAALAGRPRTLAGEILGYDHTIVLWAPHGDHWRALRRFLAVELLSAPRLAALAADRHAEAASLVDAILRDAAGGAKVTLRPRLFELVLNVMLRAATTRRRHASVDARKLQEIIEETFSVNGTPSVGDFFPALRWVDRLRGKVGSLKKLQARRDAMVTGLIDDHRQWRSGSAGDGDQDKEKKGVIDALLALQETDPDHYTDNVVKGIILSLLFAGTDTSALTIEWAMAQLVTHPETMKKARAEIDANVGTARLVEEADMANLPYIQCVIKETLRLRTAGPVIPAHEAMEDTTVGGFRVARGTMVLVNAWAIHRNGDVWDAPEEFRPERFVDSDAGGAVTAPMMPFGLGRRRCPGEGLAMRVVGVSVAALVQCFDWEVGDDDVVDMTEGGGLTMPMATPLAAVCRPREFVKTILSTSM

SEQ ID NO: 50598 - protein, 829 aa, Solanum lycopersicum
MSGRRSSYTLLNQIPNDNFFQPPAPKFSAGAGVVPYGESSSAEKNRGKVFDLDLMDQRMMQSHNRVGSFRVPGSIGSQRQSSEGSFGGSSLSGENYVGTSFGHKNEGCGSSVARSWAQQTEESYQLQLALAIRLSSEATCADSPNFLDPVTDVLASRDSDSTASAVTMSHRLWINGCMSYFDKVPDGFYWIYGMDPYVWALCSVVQESGRIPSIESLRAVDPSKAPSVEVILIDRCNDLSLKELQNRIHSISPSCITTKEAVDQLAKLVCDHMGGAAPAGEEELVSMSKGCSNDLKDRFGTIVLPIGSLSVGLCRHRALLFKVLADIIDLPCRIAKGCKYCNSSDASSCLVRFEHDREYLVDLIGKPGVLSEPDSLLNGPSSISIPSPLRFPRYRQVEPTTDFRSLAKQYFLDSQSLNLLFDDSSAGAAADGDAGQSDRSCIDRNNVVSSSSNRDEISQLPLPPLNAWKKGRDKESQLSKMYNPRSMLNPVNMDEDQVLVKHVPPFREDAQSPMTRPDTVNDTRFLAGGGHVVSAIPSEELDLDVEEFNIPWNDLILMEKIGAGSFGTVHRGDWHGSDVAVKILMEQDFHAERLKEFLREVAIMKRLRHPNIVLFMGAVIQPPNLSIVTEYLSRGSLYRLLHKPGAREVLDERRRLCMAYDVANGMNYLHKRNPPIVHRDLKSPNLLVDKKYTVKICDFGLSRFKANTFLSSKTAAGTPEWMAPEVIRDEPSNEKSDVYSFGVILWELATLQQPWNKLNPPQVIAAVGFNRKRLDIPSDLNPQVAIIIEACWANEPWKRPSFSTIMDMLRPHLKSPLPPPGHTDMQLLS

SEQ ID NO: 50599 - protein, 463 aa, Oryza sativa (japonica cultivar-group)
MNAAAAAPAPTMNFAAIHSVWHDNFDAESAQLLAVAPRAVHVAVSVQYPGCAVAQAGTSGRKKYGSLTAEKRYDMVKANIDELHPIQVGLAIRANDDDGDSGELVVFEFNLRGFDINNPADLRDPASIAHLRGRGVDFGRLPCAGVEPHRLRLLLLGSGLLQAWPSWATFTGAYHVGYLMKILTGAELPSGLDAFTTMATGTLGEGVYDVKRLAAEVNTACGFSLREIAACIGVVPVAAQHGMVASAGAVSTLQCFKALRERLGQLQGRVRHPTLRRAARPPRRAYINVQYPGCPVPGGEPRPFEQLTAEQRYGVLKGERRRAQGPSRVGLAIRTGDGGGEAFVFESNLNRLERRQPGIAKPEGRQVHREPAMRARGVDFARGCRAAASIGTGYGVAALGLRPDPAGAAVVVGDVRCRLPRGLRRQVAHRKGSSSRPARRLHAAGGLHLRAPRLRRQEDREGA

SEQ ID NO: 50600 - protein, 379 aa, Pennisetum glaucum
MATAGKVIKCKAAVAWEAGKPLSIEEVEVAPPQAMEVRVNILYTSLCHTDVYFWEAKGQTPVFPRIFGHEAGGIIESVGEGVTDVAPGDHVLPVFTGECKECPHCKSAESNMCDLLRINTDRGVMIGDGKSRFSINGKPIYHFVGTSTFSEYTVMHVGCVAKINPEAPLDKVCVLSCGISTGLGASINVAKPPKGSTVAIFGLGAVGLAAAEGARIAGASRIIGVDLNPSRFEEAKKFGCTEFVNPKDHNKPVQEVLADMTNGGVDRSVECTGNINAMIQAFECVHDGWGVAVLVGVPHKDAEFKTHPMNFLNERTLKGTFFGNFKPRTDLPNVVELYMKKELEVEKFITHSVPFSEINKAFDLMAKGEGIRCIIRMEH

SEQ ID NO: 50601 - protein, 570 aa, Oryza sativa (indica cultivar-group)
MAASSRHGPFINWSDGLFLFLSSSSSRNRFLRVFLPFPDPSTMMVGLEVATTAVTGGDASLVVVVGVLFLMVAVVVMTRLGDGGAAPSPPAMPVLGHLHLIKKPLHRSLAEVAARVGAAPVVSLRLGARRALLVSTHAAAEECFTACDAAVAGRPRLLAGDVLGYGHTTVVWASHGDHWRALRRLLGVELFSNARLAALAADRRAEVASLVDAVLRDAAAGGGGGGTVTLRPRLFELVLNVMLRAVTARRHAGDETRRFQEIVEETFAASGAPTVGDFFPALRWVDRLRGVVATLQSLQKRRDAFVAGLVDDHRRTRRAAAAAADKDQKKNGIIDALLTLQETDPDHYTDNVVKGIVLVLLTAGTDTSALTTEWAMAQLVAHPEAMTKVRAEIDANVGAARLVEEADMASLPYLQCVVKETLRLRPVGPVIPAHEAMEDCKVGGYHVRRGTMILVNAWAIHRDGDVWGSPEEFRPERFMDDGAGAGAVTAVTAPMLPFGLGRRRCPGEGLAVRLVGLTVAALVQCFDWEIGEGGAVDMAEGGGLTMPMATPLAAVCRPREFVKTVVSDCF

SEQ ID NO: 50602 - protein, 358 aa, Oryza sativa (indica cultivar-group)
MAARLYSSSSSSSAASAVVVGVKPAAYGFVASVIMTMVAGERMAEEDVLRFKAITEAGLAAAGAANRQDFLPFLRLLDFGRARRRLAGIAKERHDFGQRIVDEYRRRHRRRLAVAADDSSSSPPRRTVIGDLLRQQESSPESYADEVIRTVCLSLLQAGTDTSASTIEWAMALLLNNPDVLRKATDEIDSVVGMSRLLQEPDLANLPYLRCIITETLRLYPLAPHLVPHEASRDCMVAGHVIARGTMVLVDVYSMQRDPRVWEDPDKFIPERFKGFKVDRSGWMMPFGMGRRKCPGEGLALRTVGMALGVMIQCFQWERLGKKKVDMSEGSGLTMPMAVPLMAMCLPRVEMESVLKSL

SEQ ID NO: 50603 - protein, 152 aa, Synechococcus sp. RS9916
MATERTFVAIKPDGVQRGLVGEILGRFERKGFKLVGLKQITPSRALAEEHYGVHKERPFFAGLVDFITSGPVVAMVWEGDGVIASARKLIGATKPLEAEPGTIRGDLAVNIGRNVIHGSDAPETAQFEIGLWFQASELNDWTPSDQSWRVEG

SEQ ID NO: 50604 - protein, 433 aa, Streptomyces atroolivaceus
MRPDMSEVAVEQLKFLATDDVRTVAEEFGTPVFVYDEATVRASSKTMSTLPNAFGLTVRYSLKACPGQAIIRLFDREGFSFDASSVWEARRAVLAGVEPGRISMTAQEAVFDENLRDLIDQGLQFDAGSLHQLEEYGRAYPGGAVAIRINPGFGSGLVGRLNSGGPQSSFGIWHEQLPEVKQIVEQYGLRLVRLQSHIGSGHHWDILVDAVRTMLSFARDFQDVHTLDLGGGYRVSALQSDPVYDHTEWARVVADELKQFAEETGRRLHTEVEPGTYLTALAGSLVTKVIDKADTGAEGNSFLKINSGLTEIARPSYYGVQHPIVSVPATGGAERAADDREEFNVVGHCCIAGDVLTAKQEELAPVPLGRTEIGDYVVIERAGSYCSSMSMKNFNSYPEAAEVLRRTDGSFDLIRSRQSIEQVIVNERIPEGL

SEQ ID NO: 50605 - protein, 253 aa, Arabidopsis thaliana
MTLTSDLPFKEYRRFLDTFFTGVSPSQIDALDHQENKDLSIMKIRLSITIILLSYTVATVAGQQCGRQGGGRTCPGNICCSQYGYCGTTADYCSPTNNCQSNCWGSGPSGPGESASNVRATYHFYNPAQNNWDLRAVSAYCSTWDADKPYAWRSKYGWTAFCGPAGPRGQASCGKCLRVKNTRTNAAVTVRIVDQCSNGGLDLDVAMFNQIDTDGFGYQQGHLIVDYQFVDCGNELIGQPDSRNMLVSAIDRV

SEQ ID NO: 50606 - protein, 262 aa, Mycobacterium sp. MCS
MKLTGYTALVTGASGGIGEEFATRLAADRVNLILVARRTERLEELRSRLLDRHPGIDIDVLSADLGVPGAAAALAQQVDALGRRVDVLINNAGIGLHGSFAEQDPAANAAQIQLNCVTLVELTGCFLPAMIAAKRGVVLNVGSTAGFQPVPSMAVYGATKAFVLSFSEALWQETRGSGVKVLTLCPGATETEFFDRTGKSFMTRGRQSSAQVVDTALKALDRPFPTVVSGLHNRILALGYRIAPRPVLAMVSEQLMKARGQG

SEQ ID NO: 50607 - protein, 166 aa, Triticum aestivum
  misc_feature (109)..(109): Xaa can be any naturally occurring amino acid
  misc_feature (123)..(123): Xaa can be any naturally occurring amino acid
  misc_feature (131)..(131): Xaa can be any naturally occurring amino acid
MAPAVMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDXRYWTMLKLPKFGCXDATQVLNXWRSQEGVPDPMSRIGSQLRKCMRNSLKHGKDPRLT

SEQ ID NO: 50608 - protein, 243 aa, Arabidopsis thaliana
MELIPCGWRRYVEFRMTIVNHISPIHSVDKKGWRWFDENTKNWGFKDMIPAVILNNVNVGFLLNGEITIIAEVEVHEFIDTLNASQVEELSDDSSEDLQNKDNVTIEVNGFQVLDSQVDQVNAIFEKHPDLISNFSLKNQHIRNAYMHALLDLTKTLSKSTKELTVEDMNEADNTITDLIKAGLNLDWLRQKFDQALEKQIAYDTRIGELEKQVKKRKLAVTELEADLEKEKAAASASLMLFD

SEQ ID NO: 50609 - protein, 151 aa, Picrophilus torridus DSM 9790
MVDIIEESQDKFGRKIYKIKKEDLIEFMEQKKRDGYYLSAITGVDMKSYIEVVYHIYNYDKNEYLEIKVDTEDSHVPSLTGLWKAADWDEREQYDLMGIIFDGHENLRRILLPDEWVGHPLRKDYDLKKVQYVSMDREGNEHVSFDPNEGW

SEQ ID NO: 50610 - protein, 367 aa, Picrophilus torridus DSM 9790
MPHWVEVNFGPVHPSAHGIYRFKVLLDGEIVKDVDIQIGYLHRNAEKICELNPYPDAIIYFDRMDYLDAMNMELGYLTAVEKLTGIEPPERAIWIRMIMAELSRLASRLVGLGALGLDFGMLTPFFHCFIEREKIQKIFVEASGGRQEVNYMSIGGVYQDLTDKIIDDIKTFIEQFKKRLEDIYNQFIHSEIFYERNNNIGILERETALDYGVTGPLLRSTGVPYDIRRVEPYLFYDKVNFDVPISNKKDNLARFVLRVEEMRQSIRIIEQCLSKIPAGPYFNPKAKKSLMLRVTGNGEAYSRIESDKGEFGVYIVGNGTTKPYRVHVRSPAFKNLSVLPELARGYMIADLISIIGTIDAVTGEVDR

SEQ ID NO: 50611 - protein, 463 aa, Anabaena variabilis ATCC 29413
MADLTPNSSFSVTLRLQIPNRVGMLASITQAIASSGGNLGQIDLIEQTRQVSLRDLTVDAASTEHAETIVQAVKAIPDIKLVSVYDRTFNLHRGGKISITSRIPLKSVSDLAMAYTPGVGRVCTAIAQDPSQVYNLTIKQNTVAIVTDGSAVLGLGNLGPHAALPVMEGKAMLFKEFAGLDAFPICLATQNTEEIIQAVKNIAPVFGGVNLEDIAAPRCFEIEQRLKQELDIPVFHDDQHGTAIVTLAALFNSLKLVQKSLTDIRIVINGAGAAGVAIARLLRKAGAEKIWMCDSKGIISTTRTDLNEEKQEFAVKAQGTLAGAVQGADVFIGVSAPGVLTPEMVKSMAKDPIVFAMANPIPEIQPELVQNDVAVIATGRSDYPNQINNVLAFPGVFRGALDCRAQTITTTMYLEAASAIASLVNPSDLSREHIIPSVFDERVVTAVAAAVQRAAREEGIARA

SEQ ID NO: 50612 - protein, 170 aa, Picrophilus torridus DSM 9790
MYGDVMTANVKEIEIPKKPLPLIGEIQTMYHVGKFIFKKPVTIQYPEEKGDIPERFRYRIFLSPESCIGCTLCQQICPNHSIKMEVWDLSSQNTGAHAIKTARGVRENAQNKRHLYPDVNFGTCTVCRNCEEICPTNAIYLTHEFETARTRNSFTYSPQELTMQEKDVIK

SEQ ID NO: 50613 - protein, 515 aa, Acinetobacter sp. ADP1
MTDATVAKIPHVLVIMDGIGHREAIKDNAFLAAKTPSLSMMKQKHPHSLISGSGEDVGLPDGQMGNSEVGHMNLGAGRVLYQDFTRITKDIRDGVFFEHEVLVDAVEKAKAVHGAVHIMGLLSEGGVHSHEDHIVAMCELALKRGATVYLHAFLDGRDTPPKSAQPSLEKLDALFAQYPEQGRIVSMIGRYFAMDRDNRWDRVEQAYRLLTESEAVRTAQSAVQGLELAYAAGESDEFVKATRIGDAVAVQDGDSIVFMNFRADRARELTRAFVEHDFSGFTRQRIPHLSKFVMLTRYQATIDAPVAYMPEALHNSIGEYLSNLGKTQLRIAETEKYAHVTFFFSGGREDEYPGEKRILIPSPNVATYDLKPEMSAYEVTDQLVNAIDSGEFDLLVVNYANGDMVGHTGIFDAAVKAVEAVDTCLGRVYQAVMAKHGHMIITADHGNVEQMQDYQSGQVHTQHTTELVPFIYVGPTQAVIAEGGVLADVAPTLLNLMQLPVPAEMQGRNLITLSS

SEQ ID NO: 50614 - protein, 434 aa, Cenarchaeum symbiosum
MDLEREYRAKTRGSAGIFARSRRYHVGGVSHNIRYYEPYPFVTRSARGKHLVDVDGNKYTDYWMGHWSLILGHAPAQVRSAVEGQLRRGWIHGTANEPTMRLSEIIRGAVKAAEKIRYVTSGTEAVMYAARMARARTGKKVIAKVDGGWHGYASGLLKSVNWPYDVPESGGLVDEEHTVSIPYNNLEGSLEALRRAGGDLACVIVEPMLGGGGCIPAEPDYLRGIQEFVHSKGALFILDEIVTGFRFDFGCAYKKMGLDPDVVALGKIVGGGFPIGVVCGKDEVMCISDTGAHARTERAYIGGGTFSANPATMTAGAAALGALRERRGTLYPRINSMGDDARARLSRIFDGRVAVTGRGSLFMTHFTPDGARRISSAADAAACDVHLLHRYHLDMITRDGIFFLPGKLGAISAAHSRADLGAMYSASERFAGGL

SEQ ID NO: 50615 - protein, 140 aa, Solanum lycopersicum
MPHKRSPISLEHSSSLTSLTPKRLKADMLISSKEKKEKFGERIVAPQQLVSPYGKTDTASVLLEAMGYIKFLHEQVKVLSAPYLGTMPMSKTQESQPYNLRSQGLCLVPVSYTVGVATSNGADIWAPIKTSQSSSPENDV

SEQ ID NO: 50616 - protein, 421 aa, Yersinia pestis
MSFDSLGLNADILRAVEEQGYLVPTPIQRQAIPVVLEGRDLMASAQTGTGKTAGFTLPLLQLLSQDQQPIKGRRPVRALILTPTRELAAQIDENVQSYSKYLKLRSLVVFGGVSINPQMMKLRGGVDILVATPGRLLDLEHQNAVDLSKIEILVLDEADRMLDMGFIHDIRRVLAKLPAKRQNLLFSATFSDEIKGLASKLLHNPASVEVARRNTASEQIAQSVHFVDKNRKRELLSQMIGEGNWQQVLVFNRTKHGANHLAEQLNKDGITAAAIHGNKSQGARTRALADFKDGKIRVLVATDIAARGLDIDQLPHVVNYELPNVPEDYVHRIGRTGRAERTGEAISLVCVDEHKLLRDIERLLKREIPRIALDGYEPDPSIKADPIQNGRQGRGAQRPGMGRGSSAGRPQNGGGASGARG

SEQ ID NO: 50617 - protein, 483 aa, Staphylococcus epidermidis ATCC 12228
MGSFFNRMTRKENPTIYQSKDGHLKRTLRVRDFLALGVGTIVSTSIFTLPGVVAAEHAGPAVSLSFLLAAIVAGLVAFTYAEMASTMPFAGSAYSWINVLFGELFGWVAGWALLAEYFIAVAFVASGFSANLRGLIAPLGISLPKSLSNPFGSNGGVIDIIAAVVIILTALLLSRGMNEAARMENVLVILKVLAIILFVIVGLTAINFSNYIPFIPEHKVTETGDFGGWQGIYAGVSMIFLAYIGFDSIAANSAEAINPQKTMPRGILGSLIVAIVLFVAVALVLVGMFHYSQYADNAEPVGWALRESGHGIIAAIVQAISVIGMFTALIGMMLAGSRLLYSFGRDGLLPSWLSQLNHKHLPNRALVILTIIGVVIGSMFPFAFLAQLISAGTLVAFMFVSLAMYRLRKREGKDLPKPEFKLPLYPILPAITFILVLLVFWGLSFEAKLYTLIWFIVGIIIYLIYGIRHSKKNDEEAYQVPRK

SEQ ID NO: 50618 - protein, 445 aa, Staphylococcus epidermidis ATCC 12228
MSKVNHLIDEDERYFAHSGRIKYYPLVIDHGYGATLIDIDGKSYIDLLASASSQNVGHAPKPVVEAIKNQTEKFIHYTPAYMYHEPLVRLSKKLCDIAPGNYEKRVTFGLSGSDANDGIIKFARAYTGRPYIISFTNAYHGSTFGSLSMSSISLNMRKRYGPLLNGFYHIPFPDKYRGMFEQAKPNTVEEYLAPLKEMFTKYVPAEEVACIVVETIQGDGGLLEPVPGYFEALQELCHAHNILIAVDDIQQGLGRTGKWSSVDHYHFTPDLMTFGKSLAGGLPMSAIVGRKEIMESLEAPAHLFTTGANPVSCEAALATIKMIEDEDLLNASWKKGSYVRKRIDPWIERYQYVGDVRGIGLSIGIDIVSNKIEKTRDSEAALKICNYCFENGVIIIAVAGNVLRFQPPLVITYKQLDKALDTIEEALEKLERGELNQYDISGQGW

SEQ ID NO: 50619 - protein, 285 aa, Arabidopsis thaliana
MALLRLPGISLQILGHKSNQKNPNPNVAFTNHSLSLSTPSLCRLHRHATFPDSIPAKSRNLTSYFSTTTQEISKTRLIAQNVPWTSTPEDIRSLFEKYGSVIDIEMSMHKKERNRGLVFIEMASPEEAATALKSLESCEYEGRRLKVDYAKTKKKKTYAPRETPSPVPTFNLFVANLAFEARAKHLKEFFDADTGNVVSTEVIFHENPRRSSGYGFVSFKTKKQAEAALIEFQGKDFLGRPIRLAKSKQFVKLQAKEGLQPPEEEAEEEPSQSETMTQEHETPAA

SEQ ID NO: 50620 - protein, 229 aa, Glycine max
  misc_feature (126)..(126): Xaa can be any naturally occurring amino acid
MEKEKEKEKKSKLKNKIFKILPKAAAMSVTFQNPPFSPGRDHKCKHYGGKGFFSGPMIPDEARRKAKNGHGVETQEPTSPKISCMGQIKHKKGGAKNMSMSMPTPRDPEVKKHASKFQRMMLFHAXKPKQSDADVESERAPAPPLNHMRRFASGRETFSNFDWKAQIAPHDDVDRLDDEIIIPFSAPLTLGGATALNLNVQPRKEINLWKRRTMAPPRPLKLNPLLTAK

SEQ ID NO: 50621 - protein, 513 aa, Anaplasma phagocytophilum HZ
MSSKHFCVTTPIYYVNDVPHIGHFYTTLISDVLARFKRLDGDNVKFTTGTDEHGQKIEETARKRGTPVLQFVDEVSESFRELVHKSGFCADDFIRTTESRHKDAVVALWDRLYSRGQIYKGSYAGFYSVRDETFYQERDLIDGKAPTGAEVTWLEEPGYFFKLSEWQEALLQLYQDNPRFVVPEGKLSEVISFVKSGLRDLSVSRSKAHLSWGIGVPGDPEHLIYVWVDALSNYLALVGFPNEDAEDYNNFWCGENSHVVHVVGKDILKFHAVYWPALLMAAGLPLPKQVVAHGWWLNEGQKISKSLGNVICPLTIINEYGLDNVRYFLLSETPIGNDASFSAKRLKERVNCDLANNIGNLVQRTVTLVHKWCEGKVPSVDMKLMCGDEALPDYQGILEQYRVYVEERRFFEALKFIIGVSSTANEYIAVKAPWKLFKEDTALAEAVLFKLLEYIKCIGLLLQPFLPVTSEKLLEQIAVPVEKRKFEHIAELCTGRVLPKAVPIFSKFDMDDV

SEQ ID NO: 50622 - protein, 172 aa, Anabaena variabilis ATCC 29413
MDLKSLIRDIPDFPKPGILFRDITTLLRDRQGLRYTIDFLAEKCFEANLDIDYVIGMESRGFIFGTPLAYKLGAGFIPVRKKGKLPAAVHSIEYELEYGTDCLEVHRDALHPDSRVLIVDDLIATGGTASATAKLVQQIGCELVGFGFIIELRDLQGRKHLPDVPIISLVEY

SEQ ID NO: 50623 - protein, 271 aa, Arabidopsis thaliana
MTLRLVRSTISSVVVMDSNLVSSSTLDAVTRKAVYFVILSMFKLSEVTYLQVVAFATFTSHRFALAAMNELNGVKFDPQTGSNLHIELARSNSRRKERPGSGPYVVIDNRNKEISKSQDDQSDEGDSDPDEVQEPGNSDSPKENDTTKSEADSEPDSKAPSANGHLEKASEGGSGARACSTLFIANLGPNCTEDELKQLLSRYPGFHILKIRARGGMPVAFADFEEIEQATDAMNHLQGNLLSSSDRGGMHIDYPNVTPWFLVLPDMQDQR

SEQ ID NO: 50624 - protein, 301 aa, Mycobacterium sp. MCS
MPTPHIHAFHPDLRSVARYIPRQVITPVTLPVVRMVTRLQGKRTPKDIEELTLPSGVRVRLFRPTGVPVPAPALLWIHGGGYVIGTAAQDDELCRRFCRKLGITVASVDYRLAPEHPYPTPVEDCYEALTWMARLPAVDPKRVAIGGASAGGGLAASLALLTRDRGEIEPVAQLLVYPMIDDRTVERHGLDHPGHRLWNQASNKFGWSAYLGDADPDVAVPARREDLAGLPPAWVGVGTLDLFHDEDLAYAERLRAAGVPCQVEVVQGAFHGFDGVLPKADVSRAFFRSQCDTLRQAFASG

SEQ ID NO: 50625 - protein, 512 aa, Arabidopsis thaliana
MEISVASVTVSVAVVVVSWWVWRTLQWVWFKPKMLESYLRRQGLAGTPYTPLVGDLKKNFSMRAEARSKPINLTDDITPRIVPYPLQMLKTHGRTFFTWFGAIPTITIMDPEQITEVLNKVYDFQKAHTFPLGRLIATGVLSYDGDKWAKHRRIINPAFHLEKIKNMVPAFHQSCSEIVCKWDKLVSDKESSCEVDVWPGLVSMTADVISRTAFGSSCVEGQRIFELQAELAQLIIQTVRKAFIPGYSYLPTKGNRRMKAKAREIQVILRGIVNKRLRAREAGEAPNDDLLGILLESNLGQTKGNGMSTEDLMEECKLFYFVGQETTSVLLVWTMVLLSQHQDWQARAREEVKQVFGDKEPDAEGLNQLKVMTMILYEVLRLYPPIPQLSRAIHKEMELGDLTLPGGVLINLPILLVQRDTELWGNDAGEFKPDRFKDGLSKATKNQASFFPFAWGSRICIGQNFALLEAKMAMALILQRFSFELSPSYVHAPYTVFTIHPQFGAPLIMHKL

SEQ ID NO: 50626 - protein, 453 aa, Solibacter usitatus Ellin6076
MGNTLERVRTDLPSLTGSVPGPRARAVIERDEKVVSPSYTRCYPLVVEKGEGAMIEDVDGNRFLDFNAGIAVVATGHCHPRVVEAIQKQAARLIHMSGTDFYYEELTALAEKLNEIAPGDVARRVSFGNSGAEAMEGAIKLARYATKRDKIIAFFGSFHGRTMGALSLTSRRAVQRAGFGPLIPGVVHAPYPYCYRCPYGQKPESCAVECVKHIEDTLLKTICPAEETAAIVVEPVQGEGGYIVPPRKFIDELTRVAKENGILLVFDEVQSGMGRTGKMFAADHFDAVPDILSVAKGIASGMPIGATVARADLMTWPPGAHASTFGGNPVACAAALVTIELLQRELVDNAARMGAYLMERLRQWPSRFPIVGDVRGLGLMIGIELVLDQATKEKAPSGLRDRVVELAFRRGLLILGAGDNVLRLCPPLIITRDQCDFALDTLEACLQQVIEKA

SEQ ID NO: 50627 - protein, 249 aa, Vitis vinifera
MPKIAFGRFDDSFSLASFKAYLAEFHSTILFVFAGVGSVMAYNKLTSDAALDPAGLVAVAVAHGFALFVAVAISANISGGHVNPAVTFGLVVGGQITILTGILYWIAQLVGSILACFLLKLVTGGLTTPVHSLGAGVGVIDAIVFEIVITFALVYTVYATAVDPKKGSLGIIAPIAIGLVVGANILAAGPFSGGSMNPARSFGPAVVSGDFKDNWIYWVGPLIGGGMGGSVYAIMYMGSDHQPLASSEF

SEQ ID NO: 50628 - protein, 407 aa, Mycobacterium sp. MCS
MTVRPDTRYPGPTMWSRARWLLNAKPADHMLAMSVASASLPVIGKHLEPLGALAAMGVWGYRQMPELLSASAKSWFDPGNAEVRQRERDMTHEVSHQALRGVVPASDLAIDWPAPEKVPPLWKTFEHRRNVHKSSVRYGPLPSQLLDVWRPKELPTEPAPVLVFVPGGAWVHGSRLLQGYAMMSHLAEMGWVCLSIDYRVAPHNPWPAHLHDVKTAIAWARANVDKFGGDRNFVAIAGASAGGHLAALAGLTINDPEMQCELPEGSDTSVDAVVGIYGRYDWEDRSTAERARFVDFLERVVVRRKISRHPELFRKASPMAQVHSEAPPFLVIHGSGDSVIPVWQARSFVEKLKAKSRSVVSYMELPGAGHGFDMIDGARTGSMATAIGLFLNQIHKNRTLVGAREVI

SEQ ID NO: 50629 - protein, 125 aa, Triticum aestivum
MHPKARIHADPAAPELDRIDCLPDSLVLLILNKLEDVHSLGRCAAVSKRFNDLVPLVHDVYVKIDRVVAVDGDPDDALNLSSAKPRHIFSHLFKLMLFTIAKPFHGMRGPGGAGGRPLFPRLAQH

SEQ ID NO: 50630 - protein, 414 aa, Mycobacterium sp. MCS
MARRRFPLLRAVAELVNAANGVRPLGRDGYITLPVFAFGWPTTEAAPLYLAGSMLDAGRRGLRGDFRGGRGRIALLVTAVAWALLGVIIRRNVTSKRYFDEPLRETLGDDYEMVAARAQPARPRNLIGVPPNELTRRRYVEKAGTVQYGPHPKVNFADIWRRSDLPRDGRAPVLLQVPGGAWAIGMRRPQAYPMLSHMAEQGWIGVSIDYRVSPRHTWPDHIVDVKRALAWIKEHIAEYGGDPDFVAITGGSAGGHLASLVALTPNDPQYQPGFEDADTSVVAAVPIYGRYDWFSVEGPGRREFIAFLQKFVVKKRILEHRQEYLDASPITRVRPDAPPFFVLHGQDDSIIPVGEGREFVDALRAVSRSVVAYAEIPHAQHAFDFFGSPRAHYTANAVDQFLSWVNATRARAVA

SEQ ID NO: 50631 - protein, 453 aa, Staphylococcus epidermidis ATCC 12228
MKYIVVGTSHSGYEVIQTLLKEDENADIQVFESADQPSFLSCGIQSYLEDISSSLDDLHYASVDSYKAQGVNIHTNSTVTDLDTDNKTVVVEHQGQTATYSYDKLFLSPGGKPVTPPVDGIEKYKHVLFMRGRDWANQIKERMKDAKKAVVVGGGYIGIEAAEAFAKADIDTTIVDVADRILNTYLDKEFTDILETNAQQHGLHFKGGETVKSISGNQNGEVTTVVTDKNEYDADTVLFAVGVEPATEWLKDKIDLGKKGIININHQQQTSAKDVYAGGDATLVPFAPVSEDRYIALATNSRRQGVVAAKNMLGKEMTMPRVSGTSGLQLFDYKFGQTGIHGTEIDNYDGNLGQTYVEELIRPQFMQDDTKIHMKIIYDKDTHRILGGQVMSKEDITASINTISVVISAGFTLEQLAVQDFFFQPDYDRPWHYLNVLAQQALGDTFGSDKMLF

SEQ ID NO: 50632 - protein, 296 aa, Staphylococcus epidermidis ATCC 12228
MNKEQLEKMTHGKGFIAALDQSGGSTPKALKEYGVNEDQYSNEDEMFQLVHDMRTRVVTSPSFSPDKILGAILFEQTMDREVEGKYTGDYLADKGVVPFLKVDKGLAEEKNGVQLMKPIDDLDETLDRANERHIFGTKMRSNILELNEQGIKDVVEQQFEFAKKIIAKGLVPIIEPEVNINAKDKSEIEKVLKAEIKKGLDSLNDDQLVMLKLTIPTEANLYKDLADHPNVVRVVVLSGGYSRDEANKLLKDNDELIASFSRALASDLRASQSQEEFDKALGDAVDSIYDASVNKN

SEQ ID NO: 50633 - protein, 120 aa, Taraxacum officinale
SKHQEWQLRAREEVLNVLGDKKMDLDGLNHLKVVNMIFHEVLRLYPPIVGLARKIDKDIKLGEFALPSGIQIGLPIMNIHYDEEAWGPDAKKFGPNRFSEGISKATKNQVIYFPFGWGLR

SEQ ID NO: 50634 - protein, 875 aa, Staphylococcus epidermidis ATCC 12228
MTQFVYAFNEGNIAMKDLLGGKGANLSEMKRLGLPVPDGFTITTEACITYLKQNEELPTEVKTQLIDHLAAFSKRTGKAFSSDDNLLLVSVRSGAKISMPGMMDTILNLGLNDDNVKKLVDKTNDARFAYDCYRRLLQMFGEVVYGIPMTAFDTYFNDFKTKHRYQNDAEIPAEGLQTICEKYKEIYVEEAYKPFPQEPLKQLEEAIEAVFKSWDNDRARVYRDLNDIPHDIGTAVNIQEMVFGNSGENSGTGVAFTRNPVTGENHLFGEYLLNAQGEDVVAGIRTPKDIDTLKQQMPDVHQEFVDVTKQLEKHYKDMQDIEFTIENGKLYLLQTRNGKRTAKAAIKIAVDLVHEQLITREEAVSKVEVKSIDQLLHPNFNEESLKQATVVSKMGLPASPGAATGKVVFSAEEAKLQAENGNKVVLMRPETSPEDIEGMVASEAIVTTHGGMTSHAAVVARGMGKCCVTGCSNVEIDTVNKTVYYPEGELHEGDIVSVDGSAGDLYLGAIETVNAEHSEEFDQFMTWSEEIARLQVRMNAETPQDIKAGYNFGSKGIGLVRTEHMFFGPERLIEMRRFILASNHDERVQALEKIKTYQVEDFETIFRLSQDRPTIVRLLDPPLHEFLPSSEEDINNVSQQLNVSSEFLRKRIVDLNEVNPMLGHRGCRLAVTYPELYEMQVEAIIESVIKLQKEGITCLPEIMIPLVSTVEEFTTLKERLVNTITHLEKESQQDIQYMIGTMIETPRACLIANDLAKHCDFFSFGTNDLTQLTFGFSRDDAGKFINVYTENNILQLDPFQTLDREGVGRLIQLAVEQAKNTNPEIKIGVCGELGGDAKSIRKFNQWEIDYVSCSPFRVPGAILATAQSQAEESER

SEQ ID NO: 50635 - protein, 562 aa, Vibrio sp. Ex25
MNNDKRPLYIPYAGPALLATPLLNKGSAFSAEERSSFNLEGLLPESTETIQEQVERAYQQYKSFESDMDKHIYLRNIQDTNETLYYRLVQNHISEMMPIIYTPTVGAACENFSNIYRRGRGLFISYPNRDRIDDLLNNAANHNVKVIVVTDGERILGLGDQGIGGMGIPIGKLSLYTACGGISPAYTLPIVLDVGTNNPQRLADPMYMGWRHPRITGAEYDAFVEEFIQAVQRRWPDALIQFEDFAQKNAMPLLERYKDRVCCFNDDIQGTAAVTVGSLLAACKAAGTQLSKQRITFLGAGSAGCGIAEAIIAQMVSEGISDEQARSQVYMVDRWGLLQEGMPNLLDFQQRLVQKHTNTKEWENEGNGFSLLDVMRNAKPTVLIGVSGAPGLFSQEVIEEMHKHCKRPIVFPLSNPTSRVEATPNDIIRWTNGEALVATGSPFEPVVHEGRTYPIAQCNNSYIFPGIGLGVLAVNAKRVTDEMLMESSRALATCSPLAINGRGALLPPLEEIHSVSKKIAFAVGKKAIEQGVALEITDEALNVAIEQSFWQPVYRRYKRTAF

SEQ ID NO: 50636 - protein, 631 aa, Acinetobacter sp. ADP1
MNQLTNLSPADLSAQHEQDAKDLTRILPASTKVYIQGSRPDIQVPMRQIALTDTPTGLGGEKNPPVMVYDTSGVYTDPEVAIDLNKGLPHVRQAWIEERQDTDVLDTLSSSFGQERLKDIRTADIRFAHIQKPRRAKTGQNVTQMHYAKKGMITPEMEYIAIRENQRQRDEVDMRQHAGQNFGAKNLTEITPEFVRQEVAAGRAIIPANINHPEIEPMIIGRNFLVKINANIGNSALGSSIDEEVSKMTWATRWGADTIMDLSTGKNIHETREWIIRNSPVPIGTVPIYQALEKVDGVAEDLTWEIFKDTLIEQAEQGVDYFTIHAGVLLRYVPLTANRLTGIVSRGGSIMAQWCLAHHEENFLYTHFDEICEIMKAYDVSFSLGDGLRPGCIQDANDEAQFGELRTLGELTHRAWEHDVQVMIEGPGHVPMHMIKENMDLQLEVCKEAPFYTLGPLTTDIAPGYDHITSAIGAAMIGWYGTAMLCYVTPKEHLGLPNKKDVKDGIITYKIAAHAADLAKGHPGAQVRDNALSKARFEFRWDDQFNLSLDPDTARSMHDETLPKEAHKSAHFCSMCGPKFCSMKITQNVRNYAQNQETAKDFNPSTEEVEQGLKSMKQAYHDNGQKLYQKV

SEQ ID NO: 50637 - protein, 242 aa, Prochlorococcus marinus str. MIT 9303
MTRWRRLGKVWGLWPAQPIALVEMVGGSYLAASPQLSYRRLLEGLADHNLAVHAWGYVPGFDHQAQANEAWKHLRRCRQQLEARVGALPTPLRLGHSLGCKLHLLAPDGGRNSRALVALSFNNFTADRSIPMLRELAPKLGFYTEFSPSPNETLRLIRESYHQPQNLLVSFGDDSLDQSPSLLHSLQQRVEDATQSLHLPGDHLTPASAGLRQNLLGDWADDSARAETLKQLVETISCWASP

SEQ ID NO: 50638 - protein, 634 aa, Hordeum vulgare
MILHLLSSHDELRCISTFCYILALAISSILSLLLSTTEAEGTLGRAVCPLLCDTSRHPASFPLRGDPPSCGVREYELICRDAQAIIHINTGRYFVTSISYSDSVFWVVDAKLDHGSCPIPERNQLPYFYGFDSANMILFLLYSGRWASFVSCSRMIKDNANYRPVACQSTNSSFVYVSTALRWAVDVEPSCRYLAMTPLESSRLRVADVTSYDYEDVVKFMREGFAVRFPFLPPDWTYSWIINTCLNNSRRNNSKSDNSKLYWAVLVVVSAIMFAVLSRLVFAPLSILIFLAHKYWKTKISIDAVERFLQMQLALGPTRFAYTDITAITSHFKEKLGQGGYGSVYKGVLPGDVHVAIKMLVSSMSNGEEFISEVSSIGSIHHVNVVRLVGFCSEEMRRALVYEYMPHGSLEKYIFSPEKSFSWDKLNQIALGIARGIDYLHRGCDMQILHFDIKPHNILLDSDFTPKIADFGLAKLYPRDNSFLPVSCAGTVGYIAPEMVSRSFGAISSKSDVYSFGMLLLEIAGGRRNVDPRASRSQTYYPAWVYNQLQEVGVEISEAVVGIHQVERKLCVVALWCIQMKPDDRPAMSEVLDMLEAGIDGLEMPPEPFFCGDEYAPAADSSILLLSEISTISE

SEQ ID NO: 50639 - protein, 612 aa, Synechococcus sp. WH 8012
  misc_feature (145)..(145): Xaa can be any naturally occurring amino acid
VCIKGATVGETLAPGRLRQPLFRPTLEDDFAPISWDDALNKITGQIQASVAQRGNADGIAMYGSGQFHTEDYYLAQKLLKGALGTNNFDANSRLCMSSAVAGYTRSLGSDGPPCSYEDLDHCTVAFLIGTNTAECHPVLFQRLLXRKRKNPGSVKIVVVDPRRTDTAKAADIHLPIAPGSDLALLHGIAHLVLRENGQDPAFIDDHTENYDAFFDVAARWTPRRVALFCNIPEKRLREVAALFHRREKVLSLWSMGVNQRREGTAVVQGLINLHLLTGQIGKQGAGPFSLTGQPNAMGGREAGGLAHLLPGYRLVANAEHRAEVEQAWQLPAGRINAKPGLAAWQQIEAMEQEALDLWWVAATNPLVSLPDLDRVKSAMQKCPLVVVSEAYADSETSHYAHLLLPAAQWSEKAGAMTNSERRVTYCPAYRRRFGESRPDWEVFAEVGRRLGYSEQFNFESAAEVYTEFTALTQGRLCDVSGLSHELLEGEGPQQWPYPSGSTPTTEAKRLYENHQFATPNKRARFSTDQPLGLAEPPCDTYPLVLTVGRYLGQWHTMTRTGKVERLMKQHPEPLLEIHPGDAQELKLRNGELAAISSRRGHLTATVKVTDRI

SEQ ID NO: 50640 - protein, 170 aa, Glycine max
  misc_feature (28)..(28): Xaa can be any naturally occurring amino acid
KPLPLVGHTQCVSAVVWPQQESIYSASXDHSIRKCPTRPGKNLTDLFCGKVLNCLDIGGEGSTLIAAGGSDPVIRIWDPRKPGTSAPVFQFSSHMSWVSACKWHDQSWFHLLSASYDGKVMLGERRTAWPLSVIESHSDKVLSADWWKSDSVISGGADSKLCISSEIPVQ

SEQ ID NO: 50641 - protein, 410 aa, Arabidopsis thaliana
  misc_feature (350)..(350): Xaa can be any naturally occurring amino acid
MTMEVSKKKGGDFQQCHELIPGLPSELALECLVRVPFQFQSAMRSVCRSWRSLLSDSSFIQERRRCGKTELLLCLVQPLTPPIPASKSVDETLMVDEKKSEDESHPRVFCTPRFGLSVYNAAMSTWHRVAFPEEEQIPLFCECVVLQDAGKILLIGGWDPETLQPTRDVYVLEFAGRKWRRGAPMKESRSFFACASVSPTKVYVAGGHDDQKNALRSAEVYDVEKDEWSSVTPMTEGRDECQGFAVGMGLRFCVLSGYGTESQGRFRSDGEIYDPATDSWSRIDNVWRFPDTSPRGRTAGDFRSSSTLWCFTDTDLQSERRWETNDDSRNLKLDLQSIQLPMTGSSVFAXEGLGGESVVMIGGKRESEGEGEGGVMMKMTTEKKMGKWSHHVHIPCDFSTLPFSHASIYV

SEQ ID NO: 50642 - protein, 294 aa, Escherichia coli O157:H7 EDL933
MSHLKDPTTQYYTGEYPKQKQPTPGIQAKMTPVPDCGEKTYVGSGRLKDRKALVTGGDSGIGRAAAIAYAREGADVAISYLPVEEEDAQDVKKIIEECGRKAVLLPGDLSDEKFARSLVHEAHKALGGLDIMALVAGKQVAIPDIADLTSEQFQKTFAINVFALFWLTQEAIPLLPKGASIITTSSIQAYQPSPHLLDYAATKAAILNYSRGLAKQVAEKGIRVNIVAPGPIWTALQISGGQTQDKIPQFGQQTPMKRAGQPAELAPVYVYLASQESSYVTAEVHGVCGGEHLG

SEQ ID NO: 50643 - protein, 203 aa, Bifidobacterium breve
DVVYNHVYNASDHAFNKTVPGYYFRYDANGNLTNGSDCGNDVASERAMARKYIVDSVKYWATEYNVDGFRFDLMGLIDQTTMNQVRAALDEIDPSILVIGEGWDMTDAIGNQETTQPNASKVKGVAFFNDSLRDAIKGSVFSDEDTVFIAGKADKENLIATNVLGCNNKREGIDENGHCNNGTADTNYGGADQVVQYVEIHDN

SEQ ID NO: 50644 - protein, 320 aa, Solibacter usitatus Ellin6076
METTRRGFLGAVSAATTVAAMPRAAKTSAVKSGPQFYVAAITPCDSKLKFDEGLYRDLMPFLRERGADGVVVLGTTGEFPSFSVAERKRVAETALKHRTGLRMIVQVGTPNLPETLELLAHATANGADGVLCIPPFYFKMPSLEGLTKYYSQVLEASKVPVYLYHIPGTSAVPISLELLHKLEHYPNLAGIKDSTGSAEGYAAFVKEFPKLDMMSGTDNNIPTALAHGMGAILMGGNLFTKQSAAVFAAHRQGKDITEAMAKLREASALLRSPGAGGVPAIKYALGGLGLRESYVRPPYTDLTAEQKAALKPKVAELAKL

SEQ ID NO: 50645 - protein, 535 aa, Salvia miltiorrhiza
MELKQESEHIFRSKLPDINIPTHLPLHTYCFQNLSTHRARPYLINAATGDTFTHAGFELTARRVAAGLHNLGIRKSDVVTLLLHNSPEFAFAFLGASFIGAISTTANPLYTASEIALQARISRPKLIVTHACHVEKVKHYAAEAGAKIATIDPPPSPEIIHFAELRRSDEKLLTPIEIHADDTVALPFSSGTTGLPKGVMLSHKNLVACVSQQVDGENPAVHIDREDRMLCVLPLFHVYSMISVMLCCLRVGAAVVIMPKFEISELMELIEKYRVTIAPFVPPILLAIAKSPAAAKFDFSSVRRVVCGAAPMDRELELALKAKLPNAVIGQGYGMTEAGVLSMSLGFAKRPLKFKAGSCGTVIRNARMKIVDPSSAASLPRNETGEICIKGDAVMKGYYNDPEATRRTIDEEGWLHTGDLGFVDDDEEVYIVDRLKELIKYKGFHIAPAELEALLVAHPSISEAAVVPMADEAAGEVPVAFVVRANAAYITELQIKRYIANQVAPYKRINRVFFTDTIPKAPTGKILRKDLRARL

SEQ ID NO: 50646 - protein, 491 aa, Mycobacterium sp. MCS
MTQTVQEHKTTWDKLFIGGQWVAPSTSDVIEVFSPATGQKVGQVPLAAEADVNAACAAARKAFDEGPWPRMSPDERAAVLGAAVKLMEERGAELKYLLAAETGQPQTIVDMMQYGAAMSSFTYFAGAADKFQWSEIRDGIYGQTLVTREPIGVVGAITAWNVPFFLAANKLGPALLAGCTVVLKPAAETPLSVFAMAQMFAEAGLPEGVLSVVPGGAETGRALTANPEIDKYTFTGSSAVGKEIGKLAAEKLKPCTLELGGKSAAIVLEDADLDSTLPMLAFSGVMNSGQACVAQTRILAPRSRYDEVVEKLANFVSAMPVGLPDDPNAAIGPLISEKQRERVESYIKKGTEEGARIVTGGSRPEGLDSGWFVQPTVFADVDNSMTIAQEEIFGPVLAVIPYDTEDDAIRIANDSVYGLAGSVWTTDNKKALEVASKIRTGTYAVNMYAFDPGAPFGGYKNSGIGRENGPEGIEQYCQAKSTLLPFGYTPE

SEQ ID NO: 50647 - protein, 577 aa, Candida albicans SC5314
MENKVSEISEMTTDLNSNSETKFDHFTTTTKTTTDQIQKKSTETTTTTQSISINSKDEKKAGSKLSRVVKVSRRALTTYASFIGPGLLVSVAYMDPGNYATGITAGASNRYSLLFIVLLADIIAIFLQVLCIKLGCVTGYDLARCCREYLPKKLNWILWILAECAIISTDVAEVIGSATALNILLKIPLPAGVVITIVDVIFVLIAYRTDTSSLKFVKIFEYAVGCLVMIVVICFAVELSQITANVGQVFRGFVPSKEMFDGNGMTVATSVIGSTVMIHSLFLGSGLVQPRMRDYDVKHGYVNLYEIAKEEKVQEEEEEDQTEISPVASNPIQNNIAPTYEQEAKFFRTKYKPSYKSICYCLKYSKIELIVTLATIALFVNAAIVIIAGATLYGTSEAMNADLYTIHSLLSKSLSPAVGTIFMVALLSSGQSAGVVCTIAGQMVGEGHINWTLKPWMRRILTRAISIIPCLTISVFIGKNGLGVALNISQIIISILLPPLTAPLIYFTCCKKIMKVELGEEDEVEGIEEDDGDSGKRYKYMTNSWLTTIIVVIIWLLVAILNVYAIYQMAVSGVTGS

SEQ ID NO: 50648 - protein, 496 aa, Staphylococcus epidermidis ATCC 12228
MELVDKLSNRQYIDGEWVESSNKNTRDIINPYNQETIFTVAEGTKEDVERAILAARRSFEDGEWSLETSEVRGKKVRAVADKIKENREELAKLETLDTGKTLEESYADMDDIHNVFMYFAGLADKDGGEIINSPIPNAESKVVKEPVGVVTQITPWNYPLLQASWKIAPALATGCSLVMKPSEITPLTTIRVFELMEEVGFPKGTINLVLGAGSEVGDVMSGHEEVDLVSFTGGIETGKHIMKQAANHVTDVALELGGKNPNIIFDDADFELAVDQALNAGYFHAGQVCSAGSRILVHNDIKDKFEKALIDRVSKIKLGNGFDQDTEMGPVISTAHRDKIEGYMEVAKKDGATIAIGGKRPEREDLQAGLFFEPTVITDCDTSMRIVQEEVFGPVVTVEGFADEEEAIRLANDSIYGLAGAIFTKDIGKAQRVANKLKLGTVWINDFHPYFAQAPWGGYKQSGVGRELGKEGLEEYLVSKHILTNTNPEPVDWFSK

SEQ ID NO: 50649 - protein, 94 aa, Synechococcus elongatus PCC 6301
MADPLTSAVSDRICRHMNEDHADAVLVYAKVYGGATEATAATLTGITPAAMVLDVVEATGSRSLQVSFDHELQDSEDAHQTLIAMLRSARASKA

SEQ ID NO: 50650 - protein, 319 aa, Clostridium acetobutylicum ATCC 824
MKTIAVLTSGGDAPGMNAAIRAVVRTAIEKGINVKGIQRGYSGLINGEIFDMNRHSVSDIIQRGGTILRTARCPEFLKEEVRQKAANVLRVFGIDGLVVIGGNGSFMGAQKLSKLGVKTVGLPGTIDNDLPYTDYTIGFDTTLNTVLDAINKLRDTSTSHERVSIIEVMGRDCGDIALFSGIAGGAESVIIPEIGYDFNELCKNILEGKLRGKMHNLIILAEGVGGAAELAKKVEEVTGIETRSTILGHIQRGGSPSAFDRMLASRMGVKAVEVLMEGKTSRVIGIKEGKIMDQDIDEALAVPRSFNKELYDIANMLSK

SEQ ID NO: 50651 - protein, 496 aa, Oryza sativa
MARKMLKDEEVEVAVTDGGSYDYDLFVIGAVSGGVRGSRTSASFGAKFAICELPFHPISSDWQGGHGGTCVIRGCVPKKILVYGSSFRGEFEDAKNLGWEINGDINFNWKRLLENKTQEIVRLNGVYQRILGNSGVTMIEGAGSLVDAHTVEVTKPDGSKQRYTAKHILIATGSRAQRVNIPGKELAITSDEALSLEELPKRAVILGGGYIAVEFASIWKGMGAHVDLFYRKELPLRGFDDEMRTVVASNLEGRGIRLHPGTNLSELSKTADGIKVVTDKGEEIIADVVLFATGRTPNSQRLNLEAAGVEVDNIGAIKVDDYSRTSVPNIWAVGDVTNRINLTPVALMEATCFSKTVFGGQPTKPDYRDVPCAVFSIPPLSVVGLSEQQALEEAKSDVLVYTSSFNPMKNSISKRQEKTVMKLVVDSETDKVLGASMCGPDAPEIIQGMAVALKCGATKATFDSTVGIHPSAAEEFVTMRTLTRRVSPSSKPKTNL

SEQ ID NO: 50652 - protein, 298 aa, Cyanidioschyzon merolae strain 10D
MFVTLGVPSRAVSSKAESYAQRLRIVRTARTRLFMSAQSARKFFVGGNWKCNGSKQSVQELCEAFNAGKNIDFNRVEVVVAPPSVYAMLTRSILRPDFGVALQNCWVGKPGAFTGEVAVEMIRDIGLSHVILGHSERRHLPEIRESDDVIGRKTKYAIDKGVHVILCIGELLEEREAGRTREVNERQLSAVRAHLSADDWAKVVIAYEPVWAIGTGKVATAAQAQEAHSEIRSWIRRQVSEACASQMRILYGGSVTPENCLELAAQPDVDGFLVGGASLKPTFLDIVRAYQAKETVSV

SEQ ID NO: 50653 - protein, 426 aa, Bacillus clausii KSM-K16
MPQEWNDLAQTIPYRLAPSMAKDHPNLPVEKEEGCYYYGVDGKTYLDFTSGIAVTNVGHRHPKIVAAIQEEAGRFTHGPIGVIQYESILQLANELAEIMPGDLDCFFFGNSGTEAVEGALKLARHVTKRPYVISFNGCFHGRTLGSLSVSTSKAKYRKYQPAQGMAYQIPYYATGDTEEQAIAKLEDSFASLFAHQVSPDEVAAVIIEPVLGEGGYIVPPASWLQRIRTICDEHGMLLIFDEVQTGFGRTGEWFAAHTFGVVPDIMAIAKGIASGLPLSATVANHKLMQQWPLGSHATTFGGNPIACAAARATIAVIKEEQLLDNAKQVGAYAKQRLNAMQEKWPQIGAVRGIGMMFGIEIVDPKTGEKDGDIAAKILDLALEEGVLFYFCGNAGEVLRMIPPLTVTKAEIDEGLAKLDRAFTRLG

SEQ ID NO: 50654 - protein, 430 aa, Gibberella zeae PH-1
MRATQMAPPTNCLCHESSFANPGELFTAKPLNTLRIVWYYEAELTYYLSLRILWVIAHSDNAFLNPDRNFILNFLLRKSFYAQFCAGETHAQVKSTVKRLRDIGFGGVILTHAKEAVPQDDAKSASILDPSIETSHDITADIIPWVNSIVETINMADPGNYVALKLSGAGRLALYNLSRNKNPSPYLSKSLDDICNLARQRHVSILVDAEHDVQQEGIDSWTMTFARRHNTDTAIIYGTYQAYKKVTPATISRHLAEAQEGGFALGVKLVRGAYLGSDPRECFYDTKFETDNCYNSISESVLTRQWSPVVCGNGNFPDTHLVLATHNAESAYKARTICSRGEAKSSIVFAQLQGMADELGCELIQADFGGSPVALPAYKYLVWGSTSECMKYLLRRAYENRDAVQRTNSGRKALWSELIRRFKSALSLSS

SEQ ID NO: 50655 - protein, 501 aa, Rhodopirellula baltica SH 1
MVLVSCSSAFSASRNGWFDCSSIENSTQKFDSPYTNVADACENAARVGLERAGGFRLFPGNFHLGVKMSDTFNPDTPNIDAPAIDSPTTDPEPAEFEVKLASRVDRLPPYMFGRINNLLYQKRRAGDDVIDLGMGNPSDPPDPIVVQKLNDAAADIGNHGYSKSNGITNLRREVASKYHRKYGVRLDPEGEIIACLGSKEGFSHMCLALMGPGDTAIIPSPYFPVHMYGVILASGNVVALDVADPDKFLSNVAYTCENLTPRPKVLIVNYPHNPSSAVIEGDFFVEVVRLAKKYGLMVIHDFAYADVAFDGYVPPSFLSAPGAKDVGVEFTTMSKGYNMAGWRVGFCAGNADMVRGLGTIKGYYDYGMFQAIQIAAIVALRETEATVAKQSEVYQSRRDVLVSGLRRLGWNVNPPKAGMFVWAEVPEPWKSQMSTMDFAMMLLEDGNVAVSPGSGFGAAGEGYLRMSLVENEHRLRQAVRQIGKCLAAGKADAGPVASSAS

SEQ ID NO: 50656 - protein, 111 aa, Triticum aestivum
MAMASTASAVSFSARPSTVRPRAASAGAGRVPAGTPQGGKWWAPLVGWSGKADYIEAAPPVVAEEEKPGRSFVGGLTEEKARQLRARMSETESFHDAMYHSAIASRLARSS

SEQ ID NO: 50657 - protein, 479 aa, Escherichia coli K12
MSVPVQHPMYIDGQFVTWRGDAWIDVVNPATEAVISRIPDGQAEDARKAIDAAERAQPEWEALPAIERASWLRKISAGIRERASEISALIVEEGGKIQQLAEVEVAFTADYIDYMAEWARRYEGEIIQSDRPGENILLFKRALGVTTGILPWNFPFFLIARKMAPALLTGNTIVIKPSEFTPNNAIAFAKIVDEIGLPRGVFNLVLGRGETVGQELAGNPKVAMVSMTGSVSAGEKIMATAAKNITKVCLELGGKAPAIVMDDADLELAVKAIVDSRVINSGQVCNCAERVYVQKGIYDQFVNRLGEAMQAVQFGNPAERNDIAMGPLINAAALERVEQKVARAVEEGARVAFGGKAVEGKGYYYPPTLLLDVRQEMSIMHEETFGPVLPVVAFDTLEDAISMANDSDYGLTSSIYTQNLNVAMKAIKGLKFGETYINRENFEAMQGFHAGWRKSGIGGADGKHGLHEYLQTQVVYLQS

SEQ ID NO: 50658 - protein, 202 aa, Medicago truncatula
MGMIVEVENIDEDDDVLIPPPNFSMVEDCIYRSSLPKPSSFPFLQTLNLRSIIYLCPEPYPEENLDFLKEQNIRLFQFGIEGKTEVSLPALRDSIMEALKVLVDVRNHPILVHCKQGKHRTGCLVGCFRKLQNWCLSSAFEEYQRFAGVKSRAADLTFIERFDLVSLRQCLYSIIYQYQGASKKRRLMYQDENIQKPRLTSF

SEQ ID NO: 50659 - protein, 206 aa, Brassica napus
MFMDRERRLSARNGMRTPPHYTNGKFRDDNNGFYGGGFLDRSEKSPSRSNILRIPSPTSSPPPPSGSSPERGYIEHRVSKFDTLAGIAIKYGVEVADVKKMNGLVTDLQMFALKSLQIPLPGRHPPSPCLSNGSLNHGEGCSCHELEPPNHSNGDVFDSFQSLRLKSSEKKVSPAMNSLQGYYGLKPANRTVSVGRSLEMGNYQSE

SEQ ID NO: 50660 - protein, 540 aa, Salvia miltiorrhiza
MEVPTMPEEIVFRSKLPDIYIPKHLPLHSYCFENISKFSSRPCIINGATGDVYTYEEVEMTARKVASGLSQVGIQQGETIMLLLPNTPEYIFAFLGASYIGAVSTMANPFFTPAEVIKQAKASAAKLIITQACYVDKVRDYAAEAGAKVVCIDAPPAGCLTFSELTAADEREMPAVKIHPEDAVALPYSSGTTGLPKGVMLTHKGLVTSVAQQVDGENPNLYIHSEDVMLCVLPLFHIYSLNSVLLCGLRVGAAILIMQKFEIVPFLDLMQRYKVTIGPFVPPIVLAIAKSPLVAKYDLSSVRMVMSGAAPLGKELEDSVRTKFPNAKLGQGYGMTEAGPVLSMCLAFAKEPFEIKSGACGTVVRNAEMKIIDPQTGVSLGRNQSGEICIRGDQIMKGYLNDPESTKNTIDEDGWLHTGDIGFIDADDELFIVDRLKEIIKYKGFQVAPAEIEALLLNNPYISDAAVVSMQDEQAGEVPVAFVVRSNGSTITEDEIKQFISKQVIFYKRINRVFFIDAIPKSPSGKILRKDLRARLAAAV

SEQ ID NO: 50661 - protein, 336 aa, Oryza sativa (japonica cultivar-group)
MKGLFKSKPRTPADVVRQTRELLIFLDLHSGSRGGDAKREEKMAELSKNIRELKSILYGNGESEPVTEACVQLTQEFFRENTLRLLIICLPKLNLETRKDATQVVANLQRQQVSSKIVASEYLEANKDLLDTLISGYENMDIALHYGSMLRECIRHQSIARYVLESDHMKKFFDYIQLPNFDIASDASATFKELLTRHKATVAEFLSKNYDWFFSEFNTRLLSSTNYITKRQAIKFLGDMLLDRSNSTVMMRYVSSKDNLMILMNLLRDSSKNIQIEAFHVFKLFAANKNKPTEVVNILVTNRSKLLRFFAGFKIDKEDEQFEADKEQVIKEISAL

SEQ ID NO: 50662 - protein, 572 aa, Staphylococcus epidermidis ATCC 12228
MVNTNNHISEELDKNLDEMEFLKANSDFLRGTIEQSLANPITGSITQDDAKLLKFHGSYMQDDRDLRDERRKQKLEPAYSFMIRVRVPGGKATPEQWIAMDDISNQYANHTIKLTTRQAFQFHGILKRNLKQSMKNINHAVLDSIAACGDVNRNTMCNPNPYQSQVHKEINDYATRISNHLLPRTNAYHEIWLDGEKVLDSSEEKEPIYGNTYLPRKFKIGIAVPPSNDIDVYSQDIGLIAIVEQDELIGFNVTIGGGMGMTHGITETYPQLGRLIGFIPKEKVVDVCEKILTIQRDYGNRENRKNARFKYTVDRLGETWVTEELNRRLGWEIKAPRDFEFEHNGDRLGWIEGINNWNFTLFIQNGRVKDTEDYLLKTALREIAEIHTGDFRLSPNQNLVIANVSPEKKEEIQAIIDKYKLTDGKNYTGLRRNSMACVAFPTCGLAMAESERYLPSLITKIEDLLDESGLKEEEITIRMTGCPNGCARPALAEIAFIGKAPGKYNMYLGGSFKGERLNKIYKENIDENEILESLRPLLLRYSKERLDGEHFGDFVIRDGVIAKVHDGRDFHS

SEQ ID NO: 50663 - protein, 502 aa, Brassica rapa
MARKMLSDGELNKAAAAGEEATTETHYDFDLFVIGAGSGGVRAARFSANNGAKVGICELPFHPISSEEIGGVGGTCVIRGCVPKKILVYGATYGGELEDARNYGWEINGNVDFNWKKLLQKKTDEILRLNNIYKRLLANAAVKLYEGEGRIVGPNEVEVRQIDGTKISYTAKHILIRTGSRAQKPNIPGHELAITSDEALSLEEFPKRAIVLGGGYIAVEFASIWRGMGATVDLFFRKELPLRAFDDEMRELVARNLEGRGINLHPQTSWHELIKTDDGIKVISSHGEEFVADVVLFATGRIPNTKRLNLEAVGVELDQAGAVKVDEYSRTNIPSIWAVGDATNRINLTPVALMEATCFANTVFGGKLRKADYTNVACAVFCIPPLAVVGLSEEEAVEKATGDILVFTSGFNPMKNTISGRQEESLMKLIVDEKTDKVIGASMCGPDAAEIMQGIAIALKCGATKAQFDSTVGIHPSSAEEFVTMRTVTRRIANKAKPQTSL

SEQ ID NO: 50664 - protein, 831 aa, Chromobacterium violaceum ATCC 12472
MTTTLELLAPFSGPAIALDRVPDPVFAGLMMGDGLAIEPLSPTLLAPCSGAVAQLARTGHALTLAADNGAEVLIHIGIDTVKLEGRGFRPLVAVGDKVTAGQPLIEVDLDAVARRAPSLQTMVVIANSEQFRFPRRAEGLLEAGRSHFLTLAAREAVSPRESAGGPERRGEATVRHEGGLHARPSALVQQAAKRREAEVFIEFAGKRANARSVVALMGLGVAEDDRVAVIASGHDADAALADVIEALQTRSEAGHAAVAPAEAREPVAGYLAGVAAAPGLAIGRAVRLDAFEMPLPEQGAGEAAERAALAAALRRVRDAISSGIDAALRRGATAESDIFAAHLALLDDPELLSAAEADIAAGRGAGFGFRRAVRAQCAVLAGLGNPLLAERVADLKDIERQVLVALYGEPEQGPELFDDSILVAEDLAPSELTRLPPGKVAGIVTAAGGASGHVAILARALGIPALVACGPSALALQPGQTLVLDARAGLANPQPTPSDLAAARAEIDKLAARRRAMQASANAPAITVDGVAIEVAVNIANADDAREGVAHGADAVGLLRTEFLFIDRRDAPTEAEQTAAYQAVLDALDGRHAIIRTLDVGGDKEVPYLQLPLEPNPALGLRGIRTGFAYPDMLDAQLRALLAVKPLSRLRILVPMITDVGELIRLRERIEQLAGEMSLSERPQLGVMVEVPSAALLADQLAKHADFLSIGSNDLTQYTLAMDRCNATLAARIDSMHPGLLRLIAITVEGAKKYGKWVGVCGAMASDPQAVPVLIGLGVAELSVSPRLVPEVKSLVRGLSRRHCEEEALRLLALGSPQAVRGRVTELWPGV

SEQ ID NO: 50665 - protein, 332 aa, Chromobacterium violaceum ATCC 12472
MAIKVGINGFGRIGRMVFRAIAKDFPELEVVGINDLLDPEYLAYMLKYDSVHGRFQGDVKVEGGSLVVNGKTIRLTAEKDPANLKWNEVNAEIVIDCTGFFLTKEGCQKHIDAGAKKVVQSAPSKDDTPMFVYGVNHDKYAGETIVSAASCTTNCLAPVAKVLHDNWGIKRGLMSTVHAATATQKTVDGPSSKDWRGGRGILENIIPSSTGAAKAVGKVIPELNKKLTGMAFRVPTSDVSVVDLTVELEKEADYADICKAMKAASEGELKGVLGYTDEKVVSTDFVGNTAPSTFDADAGIALDKTFIKVVAWYDNEYGYTCNMLRFVKHVAG

SEQ ID NO: 50666 - protein, 223 aa, Brassica rapa subsp. pekinensis
MSSGGYGDPSQKIDYVFKLVLIGDSGVGKSQILSRYARNEFSLDSKATIGVEFQTRTLVMDHKSVKAQIWDTAGQERYRAVTSAYYRGAVGAMLVYDVTRRQTFDHIPRWLEELRGHADKNIVIILVGNKSDLEDQRAISTEDAKEFAETEGLFFLETSALNAVNVETAFSTVLTEIFNIVNKKNLVAGEGNGDPGSLAGKKIDIVPGPAQVVPTKSGMCCNS

SEQ ID NO: 50667 - protein, 1328 aa, Yarrowia lipolytica CLIB122
MEKTVTAQVSRTSHNELSFQSVNPVSISVRGLSVTVKAEEQKGGFFSRRKKKTSATEKQTTAESISIDDKSAKKEKNKKSQKKKEKESDDVEPQARDILSNISLDIPAGSIMAILGGSGSGKTSLLNMMASRMSGGNLTVEGETLFDGKSIEHVTHAYVIQQDILSPHLTCRETLNFAAGLRLDKSINKVQRSELVEEVIKELNLKECADTMVGNSIHRGLSGGEKRRLSIGIQMLSNPSVLFLDEPTTGLDANSAFDLVKTMKNLSLSGRTLIMSIHQPRSDIFFLFDHVTILSRGLQVYSGSTKESINWFASLGYDCPRDVNPADYLIDIAAVDTRSEEDEEQSFKRINAFVDKYNELKIETGISDVSGTASKSSSTANLQTRLFRNSFKTALFSSAPLGREIDVQVRRTWLIMYRDKLGIVGLTVEAILMGLICGLVFLRMKPDLAGIRSMEGAAYIAISLQGYLMLLYETYRLCATDLAVFDREHNEGCASVFGFLIARRMAKLFTEDLIVPIIFSVLTYFLFGFRTDGAKYFFIYFAQILLTHHISMNFSMVCAALSRDYTIASLVANLMFTLQSMASGFFANSEHMKVYIRWTKWITYVFYGLSALLNNQFMNFFGDCPYGNKTADDPLCKDFIGENFLESVGFPRNFLVIPTIALLCWLIVFFLLSWLLLTIIRVDVGVGKNLKGDSNKAEKPEAAEKVTTIASVNRNPPLTVAVSDLKLSVTKLRAKEKPILDGINAIFRPGSISAILGPSGSGKSSLLNLMANRLNSTLTQKYTASGDIFLNSTSIGIGNLGALCSFVTQEDDGLLSTLTVRETLYFSAYLRLPDNLTREMKRRRADELILKMGLKDCQDTLIGDDNVKGISGGEKRRVSICVQLLSNPDILLLDEPTSGLDSFTAGSILQVLQTLAQGGKTVICTIHQPRSDLFGQFGSVLLLSKGGHVAYDGQAKNMVQYFSDLGYPCPDLTNPADHVLDLVSVNLQMQWREDEDRERVDKLLSEWHKVEKQLFNAGLLRENSASFDPKTLMPRKPAPFQIAYFILLQRGIIALSRSPQVYIARLTQPVGIGVVLVLFFTPLRSSYIGIFNRFGLVQQLLSLYFVGVLNNMASYPFERDVFYREQDDGLYGVLPFFAVYTTLEIPFEVVSAMVFCIIVVLPPGFPRTADFFFAAFYLSFVVINTGESIGIVFNTLFRHTGFALNVVSVILSVGVFMAGLLSLQMPDFFKGLNYISPLKYACQSLLVMAFKDVPFHCTPDTGGYDAMGNCIFTNGTQVLEAYGFKNHVRVYLGVAAVCLVLYRLVSLVILKLVRLRVGLRSLKSRDNV

SEQ ID NO: 50668 - protein, 321 aa, Brassica napus
MEKQSTSSSSSSSSSWIRGSCIGRGCFGTVSKAVSKIDGGVFAVKSVDLATCLPSQSESLENEIAILRSLKTHPHIVRFLGDDVSNEGTTSFRNLHLEYLPEGDVANGGKIVNDETLLRRYVWCLVSALGHVHANGIVHCDVKSKNVLVANGGSSVKLADFGSAVELENPTAAIAPRGSPLWMAPEAVRGEYQGPESDVWSLGCTVIEMLTGKPAWEDNGFDSLSRIGFSSELPFIPAGVSELGRDFLEKCLRRDRSQRWSCDQLLEHPFLCQDHHSFVTESSPRCVLDWVNSDFEEDEVSDVSRVEPMVSAMASARVFPV

SEQ ID NO: 50669 - protein, 417 aa, Francisella tularensis subsp. tularensis SCHU S4
MSKLSDSKSVFSKLSNKQIETIIQRYASPCFIIDENALLERARLFQQAILNQYQNSIAAYSVKTQSLNTIIQKFYEVGFIPEVVSSDEFEQIQKLQLCDKSIIFNGPYKNDASLIKALQLNAMINCDHFDEILRIAKIAKKLNITAKIGLRVADNKTPQNWSRFGFALTDQQSNSDIFTTIDKIQQIANIQLAGLHCHIGTNIRDISRFTAMAKNIAELAETILTKYKLTLEWIDLGGGLAGISPTLSDKRLQPYNPFDLELYAATIIAPLKEYLNKTNDKTKLIFELGRSLVDYSVALLTTIVGTREQNEDFQSLITDAGIHTIPTISTYRHPIYHLKTDSYHKKTLLLGPSCMQHDFLHDDIFLPKLEYGDKLLIDGVGAYNISRNNEFIHLKPSVILIDKNHQYQVLRVRQTHQ

SEQ ID NO: 50670 - protein, 197 aa, Zea mays
MSPPENPSPAAPAEPSQPPPPAAAAKGKGKKDEKKDDDLSEEDLALKEQLELYVVRAQDADPGVQKLALESMRQEIRSATSSMTSVPKPLKFLRPHFGTLKSYFETMPESELKKYMADILSVLALTMSVEGERESLKYRLLGSEGDIGSWGHEYVRNLAGEIAQEFQKRQDDDLHALMGLVQQIVSFHMKHNAEPEA

SEQ ID NO: 50671 - protein, 203 aa, Volvox carteri
MAVDSHDYTFKVLLVGDSGVGKSCILTRFTSGIFEESTTSTIGVDFKVKYLTADGKRCKLTIWDTAGQERFRTLTSSYYRGAQGIIFVYDVTRRDTFESLEANWMREFDIYSTVESAIKMVVANKVDLSAQRQVSSEEGHDFARRHGCLFVETSARANLAVGQAFEELLLKILDTPLLLETTAVGGIKLGAVPTGQQAGVCSC

SEQ ID NO: 50672 - protein, 213 aa, Volvox carteri
MSYAYLFKYIIIGDTGVGKSCLLLQFTDKRFQPVHDLTIGVEFGARMINIDGKQIKLQIWDTAGQESFRSITRSYYRGAAGALLVYDITRRETFNHLASWLEDARQHANPNMTIMLIGNKCDLTHRRAVTTEEGEQFAKEHGLIFLETSARTAHNVEEAFINTAKEIYKKIQDGVFDVSNESYGIKVGYGAGNAGPQAAKPGEGDARKSSSCC

SEQ ID NO: 50673 - protein, 97 aa, Brassica napus
REAVVWDRETKQVKLNNMLFHTARINSLAWSPNNKMVATGSVDTNVIVYEVDKPASSRITVRHAHLGGVNAVAFVDECTVASSGEDASVRMWHIEPQ

SEQ ID NO: 50674 - protein, 219 aa, Photorhabdus luminescens subsp. laumondii TTO1
MTQDELKKAVGWAALEFVTPGTVVGVGTGSTASHFIDALGSIKDQIEGAVSSSEASTEKLKSLGIPVFDCNEVDSLDIYVDGADEINGNMQMIKGGGAALTREKIIAAIAKKFVCIVDASKKVEVLGKFPLPVEVIPMARAYVARELVKLGGVPKYRQNVVTDNGNVILDVHNLAILDPAELENKINRISGVVTVGLFANRGADIVLMGTLDGVETITQ

SEQ ID NO: 50675 - protein, 445 aa, Musa acuminata
MFGRRTADPKSVASIILGGGAGTQLVPLTSTRATPAVPIGGCYRLIDIPMSNCINSGINKIFIMTQFNSASLNRHISGTYNFGNGINFGDGFVEVLAATQTPGDAGMNWFQGTADAVRQFTWVFEDNKNKNIEHILILSGDQLYRMDYMDLVQKHVDTGADITVSCVPVGHSRASDYGLVKIDEAGRIIQFFEKPKGADLEAMNDNGTFLRLSHQDAMKYPYIASMGVYVFKRDVLLKLLRWNYPKCNDFGSEILPSAVEEHNVQAYAFSDYWEDIGTIRSFFDANLALTEQPPKFQFYDPMTPFFTSPRFLPPTKIEKCRVMDAIISHGCFLRECSVERSIVGVRSRLDFGVELKDTMMMGADIYETEAEISSHLADDKVPIGVGQKTKIRNCVIDMNARIGKNVVIANKDGVQEADRASEGFYVRSGIVVILKNATIKDGTVI

SEQ ID NO: 50676 - protein, 370 aa, Solibacter usitatus Ellin6076
MIDCPESTTVQTIVIGGGQAGLSVGFHLAKLGLPFQILDANERVGDAWRKRWDSLRVFHPARYVGLPGMRFPGRGDAFPTKDQMADYLVEYARRFRLPVRNGIKVNRLWKEADQFVIAAGDQVIRSENVVVAMANYQQPRVPAFAAELDPAIVQLHSHEYRNLSQLREGGVLVVGAGNSGAEIAIEAARSHPTWISGQESGHIPWQNDGFIGRFFLVRLLRFFYHHILTVKTPLGRKLRPKLIAATAPLIRVKPEGLTGCGVTRVPRMAGVRTGLPLLADGSTLDVKNVIWCTGYHRGFGWIELPIFQENGEPEHEEGTVRSVPGMYFVGLHFLYSMTSASLVGVGRDAERVAKAIASRARILKPGLTQR

SEQ ID NO: 50677 - protein, 507 aa, Musa acuminata
MSSGDSLNAELSEKTPVLGLRLWVVIGISVGVLIVFILCILSIWVTSRRKTRRTFDKLPVLQIPNVSKEITVDRVGTHSLAQSLQEHEGPFFSSYDKFSEKDSGKKLAHLTMSKSSDADNMSQCSSVHQNDRVGSSYSGDEGSSGHARKPYSPYSRVSASPLIGLPEFSHLGWGHWFTLRDLENATNRFSKENILGEGGYGVVYRGRLVNGTEVAVKRLLNNLGQAEKEFRVEVEAIGHVRHKNLVRLLGYCIEGTHRMLVYEYVNNGNLEQWLHGALHQHGVLSWENRMKVILGTSKALAYLHEAIEPKVVHRDIKSSNILIDEEYNGKVSDFGLAKLLGSGKSHVTTRVMGTFGYVAPEYANTGLLNEKSDVYSFGVLLLETITGRDPVDHGRPSNEVNLVEWLKLMVGNRRTEEVVDPNLDLKPPTRALKRALLVALKCLDPDSDKRPNMGQVVRMLEADEDRKSRRNRAASMEIESLKESNGSSDLENKVAGSDNWSCERFHA

SEQ ID NO: 50678 - protein, 265 aa, Brassica napus
ILAELLAGRPIMPGRTEVEQLHKIYKLCGSPSEDYWKKGKFTHGAIYKPREPYKRCIRETFKDFPASSLPLIDSLLSIEPENRRTATAALESEFFTSDPYACEPTDLPKYPPSKEMDAKRRDEETRRQRAASKAQGDGARKNRHRERSNRALPAPEANAELQSNVDRRRLITHANAKSKSEKFPPPHQDGGAMGVPLGASQHIDPTFVPPDMASSFTSTSFNFSKDEPPTQVQTWSGPLGHPITGISRRKKDSTKSSKGKRAVVA

SEQ ID NO: 50679 - protein, 1551 aa, Candida albicans SC5314
MSIEKVPILGKETIHVGYGIADHIVREVIANLASSTYVIVTDTNMARTPQYSKLTDDFKTNLSEKRPESRLLTYCVSPGENNKNRATKAAVEDFLLQQGCTRDTVILAVGGGVIGDMIGFVAATFMRGVRVVQVPTTLLAMVDSSVGGKTAIDTPLGKNFIGAFHQPEYVFCDVSFLETLPARQFINGMAEVVKTAAIWNEEEFTRLENFSKKFLSVVTSKKPDLQSIKAELVKTVLESVRVKAGVVSSDEKEAGLRNLLNFGHTIGHAIEAVLTPEALHGECVSIGMIKEAELSRYLGILPPVAVARLSKCLVAYGLPVSIDDKEFLKKVGPKRHYVEIDILLKKMAIDKKNDGSKIRCVLLEKIGKCYQLKAHQVSKQDLSFVLTDEVLVHPFTNPPKENIIVPPGSKSISNRALILAALGNGTVRVKNLLHSDDTKHMLDAVASLKGAEISTEDNGETIVVKGNGGNLVTSGEELYLGNAGTASRFLTTVASLVGKSQASDDVILTGNARMQERPIGPLVDALGSNGSEIEYLNKQGSLPLKISAGNGLKGGRIELAATISSQYVSSILMCAPYAKEPVTLALVGGKPISQLYIDMTCAMMKSFGIEVTKSTTEEYTYHIPKGTYKNPSEYVIESDASSATYPLAFAAMTGTSCTIPNIGSSSLQGDAKFAVDVLKPMGCKVEQTTTSTTVTGPPRGHLKPLPHVDMEPMTDAFLTASVVAAVAKGGSSTSITGIANQRVKECNRIEAMVTELAKFGVPANELPDGIEIHGIDIEDLKTPEISKRGVSSYDDHRVGMSFSLLAGLCKEPVLILERSTTGKTWPGWWDILHSKFKIELDGYEPPFNTDKHVDKSSDKSIIVIGMRGTGKSTLSEWLASFLGFKMLDMDKYLEEKLGTGIKSLIKAKGWEYFRQEEAIVAKECFTKFSKGYVLSTGGGIVEGEDARQQLKSYADNGGIVLHLHRDLDETVTFLAADTTRPAYSSEVQEVWLRREKWYHECSNYHFYSSHCSTEDEFNHLRRSFVNYIKLITGAERPVVPVGRSAAVVLTSPDLNEVVRDLESITIGADAVELRVDLFKDTSAEFVAAQIAVIRKHADLPIIYTVRTMSQGGKFPDENVDELKSLLLLGIRLGVAYVDLQLTAPNELIEEISSKKGFTRVIGTYQDINGELKWNNVEWKNKYNQGVSMNADIVRLVGKANSIQDNLDLENFKKQNTLKPLIAFNLGSQGKLSQVLNGTFTPISHKLLPNDEEFLTIGELNQTYFDIGGFTAKKFWVIGSPIEHSRSPNLHNAGYKALNLPYQFGRFEATDVDVVYDNLINKPDFGGLAITMPLKLDIMKFATKLSDAAETIGAVNTLIPIEGGYFGDNTDWVGISNSFIRAGVPPKSSSNGLVVGAGGTSRAAIYALHQMGCAKIYLVNRTAAKLEELVKSFPKDYNLEIVETEQQADKASKVSLAVSCIPADKPLDGEVLKKIERILSNGSEQSAGFKPTLLEASYKPRVTPIMKLAEEQYKWKVIPGVEMLVNQGDRQFKLHTGFTAPYEIIHRAVVEE

SEQ ID NO: 50680 - protein, 319 aa, Lactobacillus johnsonii NCC 533
MKRIGILTSGGDAPGMNAAIRAVTRTALANGIEVCGIRYGYAGLVAGDIFQMTSETVADKISRGGTFLYSARFPEFKEEEVQLKGIEQLKKHGIDALVVIGGDGSYHGALKLTRHGYNAIGLPGSIDNDIPYTDYTIGFDTACNTAMEAIDKIRDTATSHQRVFVVNVMGRDCGDIAMHVGVATGADAIVIPEEPYDIKEIAENLKQGFANGKKHGIVVLAEGVMDAEKFKDELLKYGDFDARANVLGHMQRGGSPTMRDRVVASEMGAYAVKLLLEGKGGLAVGMENNKLTHHDILDLFDAKHHGNYALYSLNKDLAK

SEQ ID NO: 50681 - protein, 466 aa, Oryza sativa (japonica cultivar-group)
MAASPTGSSSSAPAAAAAAAAEATDGPTLSVVSKRLRALRKKHNRILQMEESLAGGRKLNKEQEGVLRSKPAVVALIDELERMRAPLAAALAEELSSRPAPSSSAAPPPPASSSAAGAADSSVVEDLLALIYFGTLFDLKPQTEFVATMVARAQERDCCITYDYVTEDAADLLHQSDLDKVSALAALAASRPAAAVGVSHRDALQSCAQHARLWLRRADEPIHPESSITYAAVRAKLDKIMASDYYTAQPEMPEMGAAVDLSAAVQESMVVSPEAPAVEESQAEGHKDEKEASEATEIYNDNQPNVADAQNVEDEAPVNPSEEFSAAEVEQEKFEADVEEQERNADQQFTSRRPYQNQRGGGGRGGGRRGYQNGGRGGRGGRGMGGGGYQNGRGGGGGGGYQNGRGGGEGGGYYYNEPGYYQQRGYSNRGRGGRSGGGNSYYNNQGGGSQGGGHAHPGRVELGANA

SEQ ID NO: 50682 - protein, 429 aa, Bacillus clausii KSM-K16
MTIISDVYAREVLDSRGNPTVEVEVHLESGVMGRALVPSGASTGEYEAVELRDGGDRYMGKGVQKAVDNVNEKIAPELIGENALDQIGIDRLMIELDGTENKGNFGANAILGVSMAVAHAAANALDIPLYVYLGGFNAKQLPVPMMNIINGGEHADNNVDIQEFMVMPVGAESFKEALRMGAEIFHNLKSVLKAKGYNTAVGDEGGFAPNLSSNEEALATIIEAIEKAGYKPGEQVKLAMDVASSELYSKEDGKYHLAGEGKVLSSEEMVSFYEELVSKYPIISIEDGLDENDWEGHKLLTERLGDKVQLVGDDLFVTNTKKLAEGIEKGIGNSILIKVNQIGTLTETFDAIEMAKRAGYTAVISHRSGETEDATIADIAVATNAGQIKTGAPSRTDRVAKYNQLLRIEDELADLAQYNGLKSFYNLSK

SEQ ID NO: 50683 - protein, 510 aa, Bacillus clausii KSM-K16
MSKKPVALIILDGFGLREEEKGNAVAHAQKPNFDRYWNEFPHATLRADGENVGLPEGQMGNSEVGHLNIGAGRIVYQSLTRVNLSIREGDFFKNETFIKAMDHVKEKQSALHIYGLLSDGGIHSHIDHIYALLDMAKQQNVERVYVHGFLDGRDVGPTSAEVYLKGLQDKFDEVGLGKLATVHGRYYAMDRDKRWDRVEKSYRAMVYGEGPSYKNGLELLDDSYKNNIVDEFVIPSVITEEDGTPVATVKDDDAVIFCNFRPDRAIQLSQVFTNEDFRGFDRGEKMPKRLHFVCLTKFSETVKGFVAFKPTNLDNTLGEVLSQQNYTQLRIAETEKYPHVTFFFSGGREDEFPGEERILINSPKVATYDLKPEMSAYEVTDALVKEIEGEKHDVIILNFANPDMVGHSGMLEPTVKAIEAVDECLGRVVDALLQKGGAAIITADHGNADEVVTLDGKPMTAHTTNKVPVIVTEKGITLREDGILADLAPTVLDLLGADKPKEMTGKTLKQ

SEQ ID NO: 50684 - protein, 273 aa, Oryza sativa (indica cultivar-group)
MEKYEKLETVGEGTYGKVYKAQDRATGQLVALKKTRLEMDEEGIPPTALREISILRLLSQSLYVVRLLSVEQATKNGKPVLYLVFEFLDTDLKKFVDAYRKGPNPRPLPTNVIKSFLYQLCKGVAHCHGHGVLHRDLKPQNLLVDKEKGILKIADLGLGRAFTVPMKSYTHEIVTLWYRAPEVLLGSTHYSTGVDIWLLGTPTEEQWPGVTDLRDWHEFPQWKPQILERQVPSLEPEGVDLLSKMLQYNPANRISAKAAMEHPYFDSLDKSQF

SEQ ID NO: 50685 - protein, 251 aa, Bacillus clausii KSM-K16
MRKPIIAGNWKMNKTIGEAVDFVEAVKANVPAQATVDSVVCAPALFLDRLLQAVKGTELKIGAQTMHFEDNGAFTGEISPKALSDMGVHYVIIGHSERREMFAETDETVNKKVHAAFAHHLVPIMCCGETAEEREAGKMEAVVKEQVENGLAGLSEEQVKQTVIAYEPIWAIGTGKSATEKDANEACAYVRQTVAANFSEEAAEAIRIQYGGSVKPGNIKDYMAQPDIDGALVGGASLDADSFLELVGAAK

SEQ ID NO: 50686 - protein, 394 aa, Bacillus clausii KSM-K16
MNKKTLYDYDFAGKTVFCRVDFNVPMKDGKITDETRIQAALPTIKYLSEQGARVLLASHLGRPKGEVVESLRLAPVATRLSELLGKEVQAVQEAHGPVAKQAVEGLEDGGVLLLENVRFYPGEEKNDPELAKAFASLADIFVNDAFGAAHRAHASTEGIAHYLPSAAGFLMEKELDVLGKALSNPERPFTAVIGGAKVKDKIGVIDNLLDKVDNLIIGGGLAYTFVKAQGYEVGKSLLEEDKLDLAKQFMEKAEQKGVKFYMPEDVIVADDFSDDANKKEVAISGIPADWEALDIGPKTRKTYEAVLKASKLVIWNGPMGVFELESFAGGTKAVANALAEASDTYSVIGGGDSAAAVEQFGLADKMSHISTGGGASLEFMEGKELPGVVALSEK

SEQ ID NO: 50687 - protein, 335 aa, Bacillus clausii KSM-K16
MATKIGINGFGRIGRNVFRASLKNPNVEVVAINDLTDANMLAHLLKYDSVHGVLDAKVEAKDNSLVVDGREISVSAERNPAEIGWDKYGVEVVVESTGFFTKRADAAKHLEAGAKKVIISAPASDEDITIVMGVNEDKYDPANHHVISNASCTTNCLAPFAKVLNDKFGIRRGMMTTVHSYTNDQQILDLPHKDYRRARAAAENIIPTTTGAAKAVALVLPELKGKLNGGAMRVPTPNVSLVDLVAELDKDVTAEEVNGALKEAAEGDLKGILAYSEEPLVSGDYNGNPHSSTIDALSTMVMEGNMVKVISWYDNESGYSHRVVDLLDYIAGKGL

SEQ ID NO: 50688 - protein, 628 aa, Ustilago maydis 521
MRQLLGLTLATNSCLVIHDSRLLFSAFGLRSFFLTVDISQVLQNLRIFSGECKVALSLCAALPITASTFTLPCRIIDLPAPPQSLTAAKHRTTRFAISLRITKAQLGLLSVAYVMPRIPTAKLASKAGASQRHKPLPQQLQQDQLTSKFGLVSAPGRRSKKSAKPQSASDDEQDQKQYAAPAGMVTGGKSGGANTSKKYIDPKLSRNILRLARQQQEEIEREEMELQHPSSSTAAPTSTSIPMAARPSAAAMPDDSDDEQADLDDLGELDDDEAEMGVNGWNSYDANLEIDPSDRALLDKFEAEHRAHDDDNESDAPIGNGAFGGRGNKTLADLIMEKIEAAEASGDGPSAQELEERRMPPGINPKVIEVYRKVGELLSRYKSGPLPKAFKIVPSLPAWESILYITDPASWTPHATLAAVRIFVSTMKADQMQRFYELVLLDKVRDEIQDDGKVSYQTYEAMKKAIYKPAAFFKGFLFPMCESGTLTLKEAAIVSSVLAKVSIPVLHSAAALLRLAEMEYSGPTSLFIRVLLDKKYALPYKVVDSLVFHYLRFAEPNSGVELDKITRERRMPVLWHQSMLVFAQRYKQDLTPDQKSALLDLLRVQKHDGISPEREAKCWKNPWIKMMI

SEQ ID NO: 50689 - protein, 563 aa, Zea mays
MGEVATMSLEVMKLAAVPKANVDMFVAHRSKRRVVSSAGDSIEKATKLKAARNLDSSFAEVRRGRRDSIRGREGGSSLSQLAMAPAPHNGLNNNHPVAPMDVSVEAGNAGAAEWLDDDGRPRRSGTFWTASAHIITAVIGSGVLSLAWAIAQLGWVAGPAAMLLFAFVTYYTAALLAECYRTGHPETGKRNYTYMDAVRSNLGGVKVVFCGVIQYANLVGVAIGYTIASAISMKAVRRAGCFHAHGHADPCKSSSTPYMVLFGGVQILFSQIPDFDQIWWLSIVAAVMSFTYSSIGLSLGIAQTVSNGGFKGSLTGISIGAGVTSTQKIWHTLQAFGDIAFAYSFSNILIEIQDTIKAPPPSESKVMQKATRLSVATTTVFYMLCGCMGYAAFGDNAPDNLLTGFGFYEPFWLLDVANVAIVVHLVGAYQVFCQPIFAFVERRAAAAWPDSAFVSRELRVGPFSLSVFRLTWRSAFVCVTTVVAMLLPFFGDVVGLLGAVSFWPLTVYFPVEMYIKQLRVPRGSTKWICLQTLSVSCLLVSVAAAAGSIADVIDALKVYKPFS

SEQ ID NO: 50690 - protein, 417 aa, Francisella tularensis subsp. tularensis SCHU S4
MAEYKNYTLNFGPVHPAAHGVLRLILELDGENVVRADPHVGLLHRGTEKLAEFKPYNQSIGYMDRLDYVSMMCNEHAYVMAIEKLLQLEVPERAKYIRVMFAEMTRILNHLLWVAACGIDLGAMTVFLYAFRVREDLFDCYEAVSGARMHAAYFRPGGVARDLPTQMPQYQKTRFTSKRKAKKLNEPRQGSMLDFLDHFVVDFEKSLDEIDTLLTDNRLWKQRTVDIGTVTAERAKELGFTGPMLRGSGVAWDLRKTQPYEVYHKLEFDIPIGANGDCYDRYLVRMAEMRESNKLIKQCVDWLRANPGPVLSDNNKVAPPKRNAMKNNMEELIHHFKLFSEGYCTTEGEVYVGTEHPKGEFGVYIKSDGANKPYRLKMRAPGFAHISAMDELLSGHMLADTPAIISTIDVVFGDVDR

SEQ ID NO: 50691 - protein, 162 aa, Francisella tularensis subsp. tularensis SCHU S4
MRNITNFLKTFLLWELLKGLKVTGKHFFTRKVTVQYPDEKTPISNRFRGLHALRRYENGEERCIACKLCEVVCPALAITINSTEREDGTRRTSSYEMDLFKCIFCGYCEESCPVDSIVETNILEYHFEERGENIMTKAKLLAIGDKYEAQIAADRLQDKDFR

SEQ ID NO: 50692 - protein, 373 aa, Zea mays
MDSSGGGGGGAQIKGMATHGGRYVLYNVYGNLFEVSSKYAPPIRPIGRGAYGIVCAAVNSQSGEEVAIKKVGNAFDNHIDAKRTLREIKLLRHMDHENILALKDVTRPPTRENFNDVYIVTELMDTDLHQIVRSNQPLTDDHCQYFLYQLLRGLKYVHSANILHRDLKPSNLFLNANCDLKIADFGLARTTSETDLMTEYVVTRWYRAPELLLNCSQYTAAIDVWSVGCILGEIVTRQPLFPGRDYIQQLKLITELIGSPDDASLGFLRSDNAKRYMKQLPQFPRQDFRLRFRNMSPGAVDLLERMLVFDPSRRITVDEALHHPYLASLHEINDEPTCPAPFSFDFEQPSFTEAHIKELIWRESLAFNPEPPY

SEQ ID NO: 50693 - protein, 348 aa, Triticum aestivum
  misc_feature (69)..(69): Xaa can be any naturally occurring amino acid
  misc_feature (88)..(88): Xaa can be any naturally occurring amino acid
AYLGDTTEQVCTKKQAGTGPEFPGYRRPTRPDISPLVEKIDDPAMAGDEGLLDVVRMLDDACREAGFFXGKPMGFQSSLMTEVRDVTXKFFQLPREEKLKIKMTPQSGYRGYQGVGEMLPKGKPDMHEAIDCYTPIEPGRYGDLAKPMEGSNLWPDYPSNFDALLENYISLLRDLSRKIMRGIALALGAPLDAFEGGVAGDAFWVLRLIGYPISDDIPQEERTDIGCGAHTDYGLLTLVNQDDGICALEVRNQSGEWIYAKPVPGTFVCNIGDMLKVWSNGIYQPTLHRVVNNSPRYRVSVAFFYESNFDAAVEPVEFCREKTGGVAKYEKVVYGEHLVQKVLTNFVM

SEQ ID NO: 50694 - protein, 362 aa, Desulfitobacterium hafniense Y51
MMDLPYAGIKKGQLYLAGDIGGTKTLLGLYSLEGTELVLVRERNFPSKDWQDLTALIQGFLDEISLTPEGITGGCLSLAGPITQDKCFLTNLNRVIHCPDLRSSLPLRRPLLLVNDLEAMGQGLMDLRGEDLICLNPSAESPSPSLASPPALSLARPSLNRALIAPGTGLGQAMILADGRVCATEGAHGDYAPRTEQEIRLWRFLAQRYGHVSYERVLSGPGLADLYRFLYWEALSPSLPSPASDSIPTPDSSLTPAEITKKALDGICPLCTETLELFVKILGAEAGNLALRTLAYGGIYLGGGIPPKILPKLQEDGFMEAFLAKGRLRELLSQIPIYVILNERTPLLGAARLAAAAGCPPA

SEQ ID NO: 50695 - protein, 476 aa, Photorhabdus luminescens subsp. laumondii TTO1
MMSTEIKAQVVVLGAGPAGYSAAFRCADLGLETVLVERYSTLGGVCLNVGCIPSKALLHVAKVIEEAKALADHGIVFGEPKTDIEKVRVWKEKVINQLTGGLAGMAKGRKVKVVNGFGKFTGANTLVVEGEGGATTINFDNAIIAAGSRPIQLPFIPHDDPRVWDSTDALALTTVPGRLLVMGGGIIGLEMGTVYHALGSQIDVVEMLDQVIPAADKDVVKVFTKRISKQFNLMLETKVTVVEAKEDGIYVTMEGKNAPAEPQRYDAVLVAIGRVPNGKMLDAGKAGVDVDDRGFIHVDKQMRTNVPHIFAIGDIVGQPMLAHKGVHEGHVAAEVISGKKHYFDPKVIPSIAYTEPEVAWVGLTEKEAKEKGISYETATFPWAASGRAIASDCADGMTKLIFDKESNRIIGGAIVGTNGGELLGEIGLAIEMGCDAEDIALTIHAHPTLHESVGLAAEVFEGSITDLPNAKAKKKK

SEQ ID NO: 50696 - protein, 382 aa, Desulfitobacterium hafniense Y51
MSNLRVLVISAAFGAGHIRAAEAVIEAIWAKRPNTEIYHADFGAFLNKAFHLVIKTAYIDMIKYTPKLWGEFYYRTSDIPSDSLFQRFLNGLGRQEFISYIHSVQPDLIVCTYPTIAGVLAQLKEEELLTVPLAAVVTDYAIHNQWVHQGVDLYLVGSQEVADGLAQRGIDPGCLKVTGIPVSPKFEIKLDREELVGRFGLDPGQPTILVMGGAYGVLDNASGICRLIMQNKLPVQLLIVCGRDKRLYSTLEPLVRKAENRVLLFEFVENVEELMTVSDLMITKAGGLTVSEALTKQLPMVIYKPIPGQEKANSEFLRRVGTGKIAATEGELLQILTHLLENPEEIKIMSHAAAKLPRRTAETAADYLLELFRQRNRVRKVG

SEQ ID NO: 50697 - protein, 818 aa, Saccharomyces cerevisiae
MTSVFTDDISTIDDNSILFSEPPQKQSMMMSICVGVFVAVGGFLFGYDTGLINSITSMNYVKSHVAPNHDSFTAQQMSILVSFLSLGTFFGALTAPFISDSYGRKPTIIFSTIFIFSIGNSLQVGAGGITLLIVGRVISGIGIGAISAVVPLYQAEATHKSLRGAIISTYQWAITWGLLVSSAVSQGTHARNDASSYRIPIGLQYVWSSFLAIGMFFLPESPRYYVLKDKLDEAAKSLSFLRGVPVHDSGLLEELVEIKATYDYEASFGSSNFIDCFISSKSRPKQTLRMFTGIALQAFQQFSGINFIFYYGVNFFNKTGVSNSYLVSFITYAVNVVFNVPGLFFVEFFGRRKVLVVGGVIMTIANFIVAIVGCSLKTVAAAKVMIAFICLFIAAFSATWGGVVWVISAELYPLGVRSKCTAICAAANWLVNFICALITPYIVDTGSHTSSLGAKIFFIWGSLNAMGVIVVYLTVYETKGLTLEEIDELYIKSSTGVVSPKFNKDIRERALKFQYDPLQRLEDGKNTFVAKRNNFDDETPRNDFRNTISGEIDHSPNQKEVHSIPERVDIPTSTEILESPNKSSGMTVPVSPSLQDVPIPQTTEPAEIRTKYVDLGNGLGLNTYNRGPPSLSSDSSEDYTEDEIGGPSSQGDQSNRSTMNDINDYMARLIHSTSTASNTTDKFSGNQSTLRYHTASSHSDTTEEDSNLMDLGNGLALNAYNRGPPSILMNSSDEEANGGETSDNLNTAQDLAGMKERMAQFAQSYIDKRGGLEPETQSNILSTSLSVMADTNEHNNEILHSSEENATNQPVNENNDLK

SEQ ID NO: 50698 - protein, 321 aa, Haemophilus somnus 2336
MIKKIAVLTSGGDAPGMNAAIRGVVRSALSEGLEVYGIYEGYYGLYHNKIQQLTRYSVSDIINRGGTFLGSARFPEFKDPAVREKCVEILRSHGIDALVVIGGDGSYMGAKLLTEEHDFPCVGIPGTIDNDVAGTDYTIGYQTALETAVEAIDRLRDTSSSHKRISIVEIMGRHCSDLTISAAIAGGCEYIVASEIEFNREELIKQIERAIIKGKRHAIIAITELLCDVNELAREIEARVKHETRATILGHIQRGGTPCAFDRILGSRMGVYAVDLLLQGKGGYCVGIQNEQLVHHDIIDAINNMRREFKADWLAMSKRLD

SEQ ID NO: 50699 - protein, 434 aa, Chromobacterium violaceum ATCC 12472
MFSLPTTATAPFCPAEVNGSVRIDASASFGQRLRRFAGPGLLVAVGYMDPGNWATDIEAGSRFGYQLLWVVMLSGIAAMMLQMLAARLGLVTGMDLAQASAARYGRFGRVCHWLSAEVSIIACDVAEVLGCALAFKLLFGVPLAWGVALTAFDTLIVLGLKGRGFRQLEAIVLGLIATIALCFLAQLALLDTHWPAVAAGLAPSLPAQGMDKAIVLALGIVGATIMPHNLYLHSSVVQTRRVEGGEGALRQTLLLCRIDTIGSLLLAMLVNGAILVLAGSAFHAAGHIAVADIADAHELIRPLAGSLAALLFGVALLAAGQSATLTGTVAGQVIMDGFLRIRIPCYQRRLITRALALLPAGAGIAWQGEQAVGPLLVWSQVALSLQLPLAMWPLLRMTGDRALMGADAAPRWAIASGWGLFWLILAANCALLLG

SEQ ID NO: 50700 - protein, 523 aa, Zea mays
  misc_feature (471)..(471): Xaa can be any naturally occurring amino acid
RPWDCGAGSISLGHKVLCRFGVPNSSRLRWVGYDRKPRTDQLIARAVSVDRTQLDFSNPDWKKQFQEDFDKRFSLPHLTDVIDVEPRPTTFSLKSRAPLENANGTMQGSWNGYVNDDDRALLKVIKFASPTSAGADCIDPDCSWVEQWVHRAGPRKQIYFEPQYVKAGIVSCGGLCPGLNDVIRQIVLTLEKYGVKNIVGIQHGFRGFFEDHLSEVPLSRHVVQNINLAGGSFLGVSRGGANISDIVDSIQARRLDMLFVLGGNGTHAGANAIHDECRKRKLQVSIVCVPKTIDNDILLMDKTFGFDTAVEAAQRAINSAYIEAHSAFHGIGLVKLMGRSSGFITMHASLSSGQVDICLIPEVPFTLDGPNGVLRHLEHLIETKGFALVCVAEGAGQEYFQKSNATDASGNMVLSDIGVHLQQKIKSHFKDIGVHSDVKYIDPTYMLRAVRANASDAILCTVLGQNAVHGXAFAGFSGITTGVCNTHNVYLPIPEVIKSTRFIDPNSRMWHRCLTSTGQPDFH

SEQ ID NO: 50701 - protein, 757 aa, Sorghum bicolor
MPPPVTAPTHPPPSESTTTTRPPPPPQQQLPPPPPPPPPPPSGVESEVPPKKRKLEEEGFQRSPYYTIRETVANLRGRFLQVCQGTDSEKKDVAAEILNEMKDVIELSKKTRLDLSATAEPVKPFDKHAARAPDDKRADKVLSEEKSLGPTTSLSGNFVHSTGGGVPLKPDNSDTTVHGLPVKTKNRAGPRSRKKPSPMRQKLHGEGYHRGVEDEYGDEYYDQDEYEEEGSGAGDEYVEEEEPTEGQKEILELRERLKEQIRRKAKAAAACTAGRSSSSQIPQARDKFGSFFGPSKPVISRRVIEERKSLKELHSTIAREPRPSGVHKDIPSSSNKVQSKGNGHQHKQKIVNQVKRKVEALKDNRDYSFLLSDDADLSSPSPKEKPAARSSLTQRADREAMQSTVKSKAPTSQPARLSNGYGPKNTVSTQRHAEGRVDSMRKEAFLNRQRVVSRDNERSHSIAKNGSNQASTSKTTLQKLPSRGPIANKQPSKDLNDTTLRKSSVASKHHLSEIDRPKSSQSQRMQSAGQRPQHSSHGQRPHQSMQHRLQQSLQSRRPQQMTQGQKPQQSLQSQRTQQSLQNQRPQQSSHIQKSQSSQTHRPQSLSNRSQPSQGQRPLSSKGQYSEQRRVQANDRVKQAERQIRPPSKSMPSRPVSSNGIRDDHARKKQVAKRRFDEDEDEEDPLAIIRNMFGYDPSRYAGRDEDVSDMEADFATIEMEEKRSARIARQEDEEELRLIEEEERREQERKRRKMARGR

SEQ ID NO: 50702 - protein, 219 aa, Photobacterium sp. SKA34
MTQDEMKKAAGWAALEYVQKGTIVGVGTGSTVNHFIDALATRKEEIKGAVSSSVASTERLEQLGITVFDANEVASLDIYVDGADEINADYDMIKGGGAALTREKIVAAIAKKFICIVDDTKQVDVLGQFPLPVEVIPMGRSFIGRELVKLGGDPAYREGVVTDNGNMILDVYNMKITDPKTMEDKINALPGVVTVGLFAHRGADVLLVGSPDGVKKFEK

SEQ ID NO: 50703 - protein, 118 aa, Arabidopsis thaliana
MARVVKIDSAESWDFYVSQAKNQNCPIVAHFTALWCIPSVFMNSFFEELAFNYKDALFLIVDVDEVKEVASQLEVKAMPTFLFLKDGNAMDKLVGANPDEIKKRVDGFVQSSRVVHIA

SEQ ID NO: 50704 - protein, 532 aa, Oryza sativa (indica cultivar-group)
MADEATTTPLLVSYKAKPAKAPSIDDAIETYIGATGAGQLFKAILLAFAWAFDAQQVFISVFTDAEPRWHCTAGADPSCSPGAASPCALPPGAWAWDRPAETSVVSEWALKCAGPALVSLPASSFFAGCLAGGFLLTTLADSLLGRRKMLLVSLASMSVAGVLTAFSPNVWAYAALRFVCGFGRSMVGTCALVLSTELVGKRWRDTVSVAGFVCFTVGFLSLPALAYTFREASWRSMYLWTSLPSLGYAILLYFLVQESPRWLLVRGRKHDAIETVRQIAALNGGGGITCSFSMLHACATEREDDAAGGAGGGGGGVFATLRSMWERRWALRRLAAIMTASFGVGMVYYGMPLNVGNLGSNLYLSVTYNALAEFPSSVLSWLLMGRINRRSSVVALTAAAGVCSLACVAIPEGTGGRMAAEVLSFFATCTAFNIILMYSIELFPTSVRNSAVGMVRQALVLGGVAAPMLVALGRERSFWSFGVFGLAVGCLGLFAVCLPETRGRSMSDTMEEEEHKEAAAAIGDMDSNADLV

SEQ ID NO: 50705 - protein, 387 aa, Photobacterium sp. SKA34
MSVIKMTDLDLAGKRVFIRADLNVPVKDGKVTSDARIIASLPTIKRCLEAGAKVMVTSHLGRPTEGEYAEEFSLQPVVNYLNDALDCDVKLAKDYLNGLELNAGELVVLENVRFNKGEKKNEDELSKQYAALCDVFVMDAFGTAHRAQASTYGVGMFAPVACAGPLLAGELEALGKAMDNPARPMVAIVGGSKVSTKLTVLESLSKIADQIVVGGGIANTFIAAEGNDVGKSLYEADLIPTAKELMAHTDIPVATDVVCAKEFSDSAEATIKPATEIAADDMVLDLGPDSAQALADIIMNAKTILWNGPVGVFEIEQFGKGTEVVANAIAESAGFSVAGGGDTLAAIDKYGIKDKVSYISTGGGAFLEFVEGKKLPAVEMLESRAKA

SEQ ID NO: 50706 - protein, 959 aa, Oryza sativa
MAATAAALAVTDELALPLRAVGDLAAAAGVSREEVVVITQCASLGGKLPFDDASVGSVLAVIKKVENLGDLFITEISRVLKAGGMVLIQSSPSDQDPNNSIQRKLLLGGFVDVQASAASSQDSEHSVTIKAKKVSWSMGSSFPLKKATKGLPKIQIDDDSELIDEDSLLTEDDLKKPELPVVGDCEVGATRKACKNCTCGRAEAEEKVEKLNLTSEQINNPQSACGNCGLGDAFRCGTCPYRGLPAFKPGEKEIDFGAPVVLGQEIDFASVMTSLPDRGVSSSSSDPLCEGNIAPCSSSSEQKEDCSLKQSKTSILSCVFNSPFNIFEAHQDSSANKSPKSSSGSYDWLRVLRRIVCSGSMWRFLGTSKVLTSSDVWFLGKCYKLSSEESSSDSDSESGHATFLEDFSSRIWITYRRGFDAISDSKYTSDVNWGCMVRSSQMLVAQALIFHHLGRSWRRPSEKPYNPEYIGILHMFGDSEACAFSIHNLLQAGNSYGLAAGSWVGPYAMCRAWQTLVRTNREQHEVVDGNESFPMALYVVSGDEDGERGGAPVVCIDVAAQLCCDFNKGQSTWSPILLLVPLVLGLDKINPRYIPLLKETFTFPQSLGILGGKPGTSTYIAGVQDDRALYLDPHEVQMSATVIIWLFLQYPFYAWNPFCYGSYSGVFSTSQAVDIAADNIEADTSSYHCSTVRDLALDLIDPSLAIGFYCRDKDDFDDFCSRATELVDKANGAPLFTVVQSVQPSKQMYNQDDVLGISGDGNINVEDLDASGTDAGGVGVTYGMRGTNMPPPADVARFLSRDTIFDRVRLLDADPRALRAFAGTGLAVDVTVPNADVPRLAASRASARRWVRASVAPYAEATNVSRVLVGDEVISQANRTLLLSLVPAMRNLHAALAAVLPPSPRRREIIKVSTPHSLWHPGRVHACRRPGVFSTDGYDTAVVKPLLGFLRATGAPFRG

SEQ ID NO: 50707 - protein, 887 aa, Photorhabdus luminescens subsp. laumondii TTO1
MSDILKNDVDPIETRDWLQAIESVIREEGVDRAQFLIDQVLNEARKGGVNVAAGAANRDYINTIAVEDEPAYPGNLDLERRIRSTIRWNAVMTVLRASKKDLELGGHMASFQSSATMYEVCFNHFFRARNENDGGDLVYFQGHISPGVYARAFLEGRLTEEQMNNFRQEIHGNGLSSYPHPKLMPEFWQFPTVSMGLGPIGAIYQAKFLKYLEHRGLKDTSKQTVYAFLGDGEMDEPESKGAITIATREKLDNLVFVINCNLQRLDGPVTGNGKIVNELEGIFDGAGWQVIKVLWGDRWDELLRKDTSGKLIQVMNETLDGDYQTFKSKDGAYVRQHFFGRYPETAELVKDMTDDQIWALNRGGHDPKKVFAALKKAQETTGKPTVILAQTIKGYGMGDTAEGKNIAHQVKKMNMEGVRHFRDRFNVPVADDQLEKLPYVTFDKDSEEYKYLHEHRAALGGYLPSRRTHFEEKLELPTLEDFGALLEEQNKEISTTIAFVRALNVMLKNKSIKDRLVPIIADEARTFGMEGLFRQIGIYSSNGQQYTPQDREQVAYYKEDSKGQILQEGINELGAGSSWLAAATSYSTNNLPMIPFYIYYSMFGFQRIGDLCWAAGDQQARGFLIGGTSGRTTLNGEGLQHEDGHSHIQSLTIPNCISYDPAFAYEVAVIMHDGLERMYGEKQENIYYYITTLNENYHMPAMPQGAEEGIRKGIYKLESLEGSKGKVQLLGSGSILRHVREAAQILANDYGVGSDVYSVTSFTELARDGQDCERWNMLHPTETPRVPYVAQIMNEAPAVASTDYMKLFAEQIRNFIPASEFRVLGTDGFGRSDSRENLRHHFEVDASYVVVAALGELAKRGEIAVSVVEEAINKYNINPEKVNPRLA

SEQ ID NO: 50708 - protein, 534 aa, Oryza sativa (indica cultivar-group)
MADAATTPLLTSHEAKPAKALSIDDAIETYIGATGARQLLTAMLLAFAWAFEAQQVFMSVFTDAEPTWHCTGVAAGDPGSFCSLAAASASASACALPPGTWEWDRPAETSVVSEWALKCGGGGPALVSLPASSFFAGNLAGGFLLTTLADTLLGRRKMLVLSLVTMSVAGVLTVFSPNVWVYAALRFVCGFCRSTAGTSAMVLSTELVGKWWRNTVSVAAFVFFSVGFMSLPALAYTLREASWRNMYVWTSLPSLCYAVLLYFLVQESPRWLLVRGRKQEAIAALRQIASLNGGEGITTSSFTKLETCAGEVGDGVAGGEGMFSTLRSICERRWALRRLAAITTATFGVGVVYYGMPLSVGSLSSDLYLSVAYNAAAELPSSVLSWLLMGRFNRRSSLVALTAASGLCSLACVVIPDPEAGAGGSHLRLAAELASFFASCAAYDVLLMYSIELFPTSVRNSAVGLVRQAGVLGGVVAPMLVALGRERSYWSFGVFGLTVGCLGLFVTFLPETKGRRLSDTMEDEEETAAVLSGG

SEQ ID NO: 50709 - protein, 257 aa, Escherichia coli O157:H7 EDL933
MSVPLILTILAGAATFIGAFLGVLGQKPSNRLLAFSLGFAAGIMLLISLMEMLPAALAAEGMSPVLGYGMFIFGLLGYFGLDRMLPHAHPQDLMQKSVQPLPKSIKRTAILLTLGISLHNFPEGIATFVTASSNLELGFGIALAVALHNIPEGLAVAGPVYAATGSKRTAILWAGISGLAEILGGVLAWLILGSMISPVVMAAIMAAVAGIMVALSVDELMPLAKEIDPNNNPSYGVLCGMSVMGFSLVLLQTAGIG

SEQ ID NO: 50710 - protein, 221 aa, Brassica napus
  misc_feature (197)..(197): Xaa can be any naturally occurring amino acid
MVVLSMMALVKTAYSLNSFVFEAEDIVFGSPWWSVVVSVACLLVLFAGIMSGLTLGLMSLGLVELEILQQSGSSAEKKQAAAILPVVKKQHQLLVTLLLCNAAAMEALPICLDKIFHPFVAVLLSVTFVLAFGEIIPQAICSRYGLAVGANFLWLVRILMIICYPIAYPIGKVLDAVIGHNNTLFRRAQLKALVSIXHSQEAGKGGELTHEETMIISGALD

SEQ ID NO: 50711 - protein, 377 aa, Brucella melitensis 16M
MKIDYYEALGVTRTADDKTLKAAFRKLAMQYHPDRNPDDPEAERKFKEIGEAYETLKDPQKRAAYDRFGHAAFENGGMGGGFGNGFGGAGGFADIFEDIFGEMMGGGRRRSNGGRERGADLRYNMEVTLEEAYAGKTAQIRVPTSITCDECSGSGAKPGSQPTTCTMCSGSGRVRAAQGFFSVERTCPGCNGRGQIIKDPCEKCHGQGRVTQERSLSVNIPAGIEDGTRIRLAGEGEAGLRGGPAGDLYIFLSVKPHEFFQRDGADLYCKVPISMTTAALGGQFEVSTLDGTQTRVKVPEGTQNGKQFRLKGKGMPVLRQSVTGDLYIQIDIETPQNLSKRQRELLEEFEKLSSQENSPKSAGFFSRMKEFFEGIGE

SEQ ID NO: 50712 - protein, 323 aa, Oryza sativa (indica cultivar-group)
  misc_feature (232)..(232): Xaa can be any naturally occurring amino acid
MAEEQSKAQAGAKALSEPVRVGGSAAEATLSGGELAWRPTGGGGGGGEAGRLELESEVLGVRVDGRALRVATFARGDDAAAAAARPATCGGGERRREREREVVVEMESEEAAAAWGDAMRDRLASLGRPKRLFIIVNPYGGKRGGRKIFQTEVLPLIEAAGILYTMQETKHRLHAQEIAHSLDLRKYDGIVCVSGDGVLVEVVNGLLQREDWNTAIKIPLGIIPAAIIKDCXRSALAGLMFQMKDGSYVKSPYVEYFKVKALRIEPGMRVGSTTKGGIIDSDGEVIARGDGSHTGDEIEHLMAYGPPIQLTVDQGLATIFSPR

SEQ ID NO: 50713 - protein, 470 aa, Pseudomonas putida KT2440
MATPSKAFAIAHDPLVEADKAHYMHGYHVFDEHREQGALNIVAGEGAYIRDTHGNRFLDAVGGMWCTNIGLGREEMALAIVDQVRQLAYSNPFSDMANDVAIELCQKLAQLAPGDLNHVFLTTGGSTAVDTAYRLIQYYQNCRGKPHKKHIIARYNAYHGSTTLTMSIGNKAADRVPEFDYHHDLIHHVSNPNPYRAPDDMDEAEFLDFLVAEFEDKILSLGADNVAAFFAEPIMGSGGVIIPPEGYFQRMWQLCQTYDILFVADEVVTSFGRLGTFFASEELFGVTPDIITTAKGLTSAYLPLGACIFSERIWQVIAEPGKGRCFTHGFTYSGHPVCCTAALKNIEIIEREQLLDHVNDVGSYLEQRLQSLRDLPLVGDVRCMKLMACVEFVANKASKALFADEVNIGERIHSKAQEKGLLVRPIMHLNVMSPPLIITHAQVDEIVETLRQCIIETARELTALGLYQGR

SEQ ID NO: 50714 - protein, 251 aa, Vitis riparia
MDSDHEEFSASSSSSSSRTNSNPSDSLLPLQCIGHKRKAGRKKFRETRHPIYRGVRQRNGNKWVCEVREPLKKSRIWLGTFPTPEMAARAHDVAALALRGRFASLNFPDSAWRLPRPKSSSAEDIQVAALEATKAFNPTAPSSSSLASALDNMSGVADSKKVLETSPNVESPKLKSQRMVLEVSPVDTKRSEKVGDGSTPVFMDEEAMFNMQGLINSMAEGLLLTPPAMCKGFSWDDATDSHIDLSLWNDD

SEQ ID NO: 50715 - protein, 1092 aa, Aspergillus nidulans FGSC A4
MPAERRSLRSNNKSDTSSPANGEKTRSGSQSSSSNKDKPTTRTAASKAKSTKVASTNTASDSGMGEQRDQPHTNGSDPTKNGVNGSEDIEMDEDTAGGPTSSFNASKDRKGDQKMTVVVPPTKGPRVTGEKSQEQEGDVSMEGAEDEKPGSEIDPKVKAIQDIKTNFIFLERAVTHFDPRFTLRVLRSISAMRKQITSDVLAEAIVAAYPTSSATASFLLDAIDQPGASENVGSSSNMEVENDKTKPSSKEVLPEIDIYLSILVQIYLYDRKEIQKGAKFSTRLIERLRALNRRTLDSLAARVYFYYSLFFEQIAPLPPSPAAAITSIRQPLLAALRTAVLRKDVDTQATVMTLLLRNYLSTSHISQADLLISHNQFPPSASNNQIARYLYYLGRIRAIQLQYTEAHGHLIGATRKSPASHSARGFYQASHKLLVVVELLMGDIPDRAIFRQAALERALHPYFLLVQAVSVGDLDGFLNIVNTHSSTFRKDGTYTLILRLRQNVIKTGIRMMSLSYSRISLRDICLRLGLDSEESAEYIVAKAIRDGVIEASLDHERGFMKSKDVGDVYATREPGEVFHERIRACLGLHDESVKAMRFPMNQHRLELKSAQEARERERELAKEIQEGDIDDEDAVPAGKLVLASPVTPQTPICWQCLRNDLSLGQSKFQNRKYHPSRRKDASPFGAAVSAAQTLFKGLPKAPPGISVDPLRIVGKELKFLTKNIRQLLGSGHPTLDKVAKYYTRSEGKHMRPLLVLLMSQATALTTPRSNRSTSDAALSSVTVNDPITSPSVLADTNPDLDRLTSQSPTEGQYDFAGDENILPSQRRLAEITELIHTASLLHDDVIDNALTRRSSNSANIEFGNKMAVLAGDFLLGRASVALARLRDPEVTELLATVIANLVEGEFMQLKNTAEDEKNPVFTDDTISYYLQKTYLKTASLISKSCRAAALLGHSTPDVVEAAYSYGRNLGLAFQLVDDMLDYTVSGVELGKPAGADLELGLATAPLLFAWKQHPELGPLVGRKFCREGDVEKARELVYRANGVEQTRALAQEYADKAIAAISPFPDSEAKAGLIEMCRKTMNRRKRTTRDST

SEQ ID NO: 50716 - protein, 328 aa, Myxococcus xanthus DK 1622
MPELMYREALNQALAEEMERDANVYLIGEEVGRYNGAFKVSQGLLDKFGSARIIDAPIAELGFTGLSVGAAMVGLRPVVEMMTWNFAILAMDQIVNNAAKLRHMSGGQLRCPIVFRGPGGAGGRLSSQHSQALEANYAHFPGLKVIAPATPADAKGMLKAAIRDENPVLMFEGERLYAIKGEVPEGEHVVPLGKADVKREGSDVTIITWSRMYYFCMQAAEELAKEGISVEVLDLRTLRPLDEEAILASVRKTNRAVIVEEGWALAGVGASVVDIIQSKAFDDLDAPVERVTGLDVNMSYAANLENATQPDAPKIIAAVKKVLYREGA

SEQ ID NO: 50717 - protein, 111 aa, Taraxacum officinale
KKRGHAHGNRSWIKIEENGNSKVVELDKASVMRQCCLPARDLRLLDPLFIYPSTILGREKAIVVSLEQIRCIITADEVFLMNSLDASVVQYKSELCKRLQEEKCHSDDLPF

SEQ ID NO: 50718 - protein, 323 aa, Synechococcus elongatus PCC 6301
MTSVTSLFAPVEADLQLLTDTLKQLIGARHPILYAAADHLFGAGGKRLRPAVVLLLSRATMPGQEITPRHRRLAEITEMIHTASLVHDDVVDESSLRRGIPTVHSSFSNRVAVLAGDFLFAQASWHLAHLDSLTVVKLLSQVIMDLAEGEILQGLNRFDSSLSIEVYLDKSYYKTASLLANSARAASVLSGSSETVCDALYDYGRSLGLAFQIVDDILDFTGSEEVLGKPAGSDLASGNLTAPALYAIEEHPALVPLIEREFSQAQDFEQAIALVHNSQGLARTRALAAEHAQKAVQALDVLPASDCKETLISLTSYVLSRLS

SEQ ID NO: 50719 - protein, 320 aa, Escherichia coli
MNIWTLGDAVVDLLPLTDMQFRACAGGAPFNVAIGTAQLKCRTGFIGRVGDDDFGHFLRKTLEDSGVSTQCIQMDKYHRTSTVLVSLKDQGERGFTFLTNPSADQFLTQDALPAFSDDILHFCSLALVAADCRTTLTKAVQEVIDHGGLISFDVNLRDQMWRDKEEMFATVSQFAEKADILKLSEEEWYWLMGTHDYTEALEALKTHPARLKVVTFGARGSLVLWQDMVIHFRGFNVKSIDTTGAGDAFMAGLLASIANKGLPMNFPELQLAITQASATGALATTKKGALTALPDTAALETFINHFPLPGYEILGATATV

SEQ ID NO: 50720 - protein, 389 aa, Burkholderia xenovorans LB400
MSEADNSTPNTGAFKPKKSVALSGVTAGNTALCTVGKTGNDLHYRGYDILDIASACEFEEIAYLLVHEKLPTQAELTAYKTKLKALRGLPANVKAALEWIPAAAHPMDVMRTGVSVLGTVLPEKDDHNLPGARDIADRLMASLGSMLLYWYHYSHNGKRIEVETDDDSIGGHFLHLLHGVEPSNAWVDAMHVSLNLYAEHEFNASTFTGRVIAGTGSDIYSALTGAIGALRGPKHGGANEVAFEIQSRYQTPDEAEADIRRRVENKEVVIGFGHPVYTISDPRNKVIKEVAKKLSKEAGNTRLFSIAERLESVMWDAKKMFPNLDWFSAVSYHMMGVPTAMFTPLFVIARTAGWSAHIIEQRIDNKIIRPSANYTGPDDLPFVPLAKRV

SEQ ID NO: 50721 - protein, 289 aa, Bacillus licheniformis ATCC 14580
MNFGNIATAMVTPFDKNENIDFQKLSKLIDYLLNNGTDSLVVAGTTGESPTLSEEEKVALIQYSVKEAAGRAPIIAGTGSNNTKASIKLTKKAEEAGADAVMLVTPYYNKPSQEGMYRHFRAIAEETSLPVMLYNVPGRTAASLAPETTIRLAEIPNIIAIKEASGDLDAITKIVAETPEDFAVYSGDDSLTLPALSVGARGIVSVASHIIGPEMQEMIKHYTEGNTAQAALIHQKLLPLMKGLFAAPNPSPLKTALQLKGLDVGSVRLPLIPLNEDERLRLSSLMNGL

SEQ ID NO: 50722 - protein, 375 aa, Oryza sativa (indica cultivar-group)
MAAAAVSKAYDIHRSSVSSRQRALNVLLVSGDCVLAGLQPILVYMCKVDGKFKFSPVSVNFLTEITKIIFAIIMLCIQARRLKVGEKPFLTVSTFMQAARNNVLLAVPALFYAINNYMKFVMQLYFNPATVKMLGNLKVLVIAVLLKVIMRRRFSTIQWEALALLLIGISVNQLKSLPEGSSTLGLPVAAGAYLYTLFFVTVPALASVYNEKALKSQFDTSIYLQNLFLYGYGAIFNFLGLVITAIIQGPSSFNILEGHSKATMFLICNNAAQGILSSFFFKYADTILKKYSSTIATIFTGVASAVLFGHTLTINFVLAISIVIISMHQYLSNQIKDEVPSSKIEMGDAHEHRSKESVVVNVSDSIATEICYRND

SEQ ID NO: 50723 - protein, 709 aa, Nostoc punctiforme PCC 73102
MYVAVWPGNVYPLGANWDGKGTNFALFSENATGVELCLFDADNHEIRLPLTEKNNFVWHAYLPGVGPGQRYGFRVHGPWAPELGHRFNPNKLLIDPYAKAIDGEISDTAAIFGYSLDAPEQDLAFSDLDNAEIMPKCIVVDQSFDWGDDKLLSIPWHETIIYETHVRGFTKLHPEIPEELRGTYAGLAHPVAIQYLQQLGITSVELMPVHHFLSSPGFLVNKGLKNYWGYDSINYFTPYSGYSANGSVGQQVTEFKQMVKDLHSAGIEVILDVVYNHTGEGNHLGPTLSLRGIDNAVYYRLVKDNSRYYMDFTGCGNSLNVRHAQVLKLIMDSLRYWVTEMHIDGFRFDLASALARELYEVDSLAAFFDIIHQDPVLADVKLIAEPWDLGEGGYQVGNFPLRWSEWNGRYRDTVRDFWRGEDDSLGQFAYCFTGSPDLYQANGRNPSASINFITAHDGFTLNDLVSYNEKHNQDNGEDSRDGESHNRSWNCGVEGETNDPDVIRLRQRQRRNFLATLMLSQGIPMLLGGDEIGCTQKGNNNVYCQDNEIAWRDWSLQKSNSELLDFARELIYFRHQHPVFRRRKWFQGRPIHGFGISDIGWFNDDGSEMTEKQWLVSYAKAMEIFLNGEGIVTPGRRGERIIDESFLLFFNAHYETIEFALPNVFQDREWEIVIDTNEPRFLSPGKLVMGEQTVPVTDRSLIVLRRLAS

SEQ ID NO: 50724 - protein, 432 aa, Glycine max
MATSLCTPSYRVTLKLYGTDSHKLNAKPSVRYRRRFGTTTRICCTSNNYNDNNIQRRPQSEAIQVYSQIERLLTDSVRQSQDGWWGSPDWSEVEGAWILKPKSSEPNYVVHFIGGIFVGAAPQLTYRRFLERLSEKGILIIATPYASGFDHFLIADEVQFKFDRCYRTLQETIQDLPIFGVGHSLGSVVHLLIGSRYAVQRSGNVLMAFNNKEASSAVPLFSPVIVPMAQTIGPLLSDIFSSPTLRAGAEMTLKQLENVSPPIMKQVLPLVEQLPPLYMDLVKGREDFSPKPEETRRLIKSYYGISRNLLIKFQDDLIDETSTLAQVLSSESAISSVLDMSIRKLPGDHGLPLQQALPNVPPAMADAVNRGSELLSNLTVGTPWEIVAKEVGNSLGMDSGVLRAEVSKDMDMLVDVIAAWIASNAGPKLLRP

SEQ ID NO: 50725 - protein, 429 aa, Bacillus cereus G9241
MKKFDKSIAAFEEAQDLMPGGVNSPVRAFKSVGMNPLFMERGKGSKVYDIDGNEYIDYVLSWGPLIHGHANDRVVEALKAVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLEFFAAYYREMVEQGVFLPPSQFEGLFLSTAHSDADIEATIAAAEIAMSKLKA

SEQ ID NO: 50726 - protein, 480 aa, Prochlorococcus marinus str. MIT 9303
MQLANKQLLDPSNQLSDQRNKRRRLRFILQIAISAALGGFLFGYDTAVINGAVGAIGTAFTVSKETLGFAVASALLGSALGAFTAGWLSDRIGRRNSMLVAALMFLVGSLGSALAPTITTLILWRVVGGLAVGFASVLAPAYIAEISPASMRGQLGSLQQLAIVIGIFLALLFDYVIVLLTADQNPVSLIGPLAAWRWMFMSEIIPAALYAVLVIGIPESPRYLVQKGLTQRAKAVIEKTLHEPADQVIARIQSSLVNTHQGKLSELFDRHTILLPIIWTGVMLAIFQQFVGINVIFYYSSVLWQAVGFSAKDSLIVTVITSITNVVTTFIAIAFIDRLGRKPLLLAGSVVMAVNLGVMSWAFAGAPLVNGAPHLAGAGAIVALIAANLFVFAFGFSWGPVMWVMLGEMFNNRIRAVAIGLCAMVNWIANFLISDTFPGLLERSGPALAYGLYATAAAISFFLVLFFVRETKGMELEEMA

SEQ ID NO: 50727 - protein, 224 aa, Arabidopsis thaliana
MGYWNSKVVPKFKKLFEKNSAKKAAAAEATKTFDESKETINKEIEEKKTELQPKVVETYEATSAEVKALVRDPKVAGLKKNSAAVQKYLEELVKIEFPGSKAVSEASSSFGAGYVAGPVTFIFEKVSVFLPEEVKTKEIPVEEVKAEEPAKTEEPAKTEGTSGEKEEIVEETKKDETPETAVVEEKKPEVEEKKEEATPAPAVVETPVKEPETTTAPVAEPPKP

SEQ ID NO: 50728 - protein, 472 aa, Glycine max
MAFFRSVSALSRLRSRVGQQSNLANSVRWLQTPSSSNTDLYSELKELVPEYQERVKKLKKDHGSVELGKITVDMVLGGMRGMTALVWLGSAVDPDEGIRFRGMSIPECQKKLPGAFTGGEPLPEAVLWLLLTGKIPSKAQVDSLSKELRSRATIPDYAYKAIDALPVSAHPMTQFTTGVMALQVQSEFQKAYEGGIAKARYWEPTYEDTMNLIARLPAIAAYIYRRKYKDGKIIPLDDSLDYGANYAHMLGFDDPEMLEFMRLYISIHSDHEGGNVSSHTAHLVASPLSDPYLAFAAALNGLAGPLHGLANQEVLRWIRSIVAEFGTPNISTEQLADYINKTLSRGQVVPGYGHGVLRQTDPRYTCQREFALKHLPNDPYFQLVSKIKEVVPPILTKLGKVKNPWPNVDAHSGVLLNYYGLTEENYYTVLFGVSRSFGVGPQLIWDRALGMPLERPKSVTLEKLEQLVAKSS

SEQ ID NO: 50729 - protein, 198 aa, Bacillus cereus G9241
MKVTKADIVISAVKPEQYPEGDLPEIALAGRSNVGKSSFINKILNRKKLVRISSKPGKTQTLNFFLINEMMHFVDVPGYGYAKVSKTERAAWGKMIETYFTTREQLDAAVLVVDLRHKPTNDDVMMYDFLKHYDIPTIIIATKADKIPKGKWQKHLKVVKETLDIESGDEVVLFSSETGLGKEEAWKAIHKFTKTKNA

SEQ ID NO: 50730 - protein, 363 aa, Prochlorococcus marinus str. MIT 9303
MSQKTSVSSGQTTAKPLAAGRHGERISTLISSKRAKVDRQIGLELFRDMTLGRRFEDKCAEMYYRGKMFGFVHLYNGQEAVSTGVIGAMKRQHDWFCSTYRDHVHALSAGVPAREVMSELFGKETGCSKGRGGSMHLFSQEHHLLGGFAFIGEGIPIALGAAFTSRYKRDALGDASSNAVTAAFFGDGTCNNGQFFECLNMAQLWQLPILFVVENNKWAIGMAHERATSEPEIWQKAAAFGMAGEEVDGMDVLAVRAATQRAIKRARAGEGPTLLECLTYRFRGHSLADPDELRAEEEKQFWAKRDPLKALEKDLTSESLVRADELRAIEKEIDAEVNDCVEFALAAAEPNANELTRYIWAED

SEQ ID NO: 50731 - protein, 251 aa, Vitis riparia
MDSDHEEFSASSSSSSSRTSSNPSDSLLPLQCIGHKRKAGRKKFRETRHPIYRGVRQRNGNKWVCEVREPLKKSRIWLGTFPTPEMAARAHDVAALALRGRFASLNFSDSAWRLPRPKSSSAEDIQVAALEATKAFNPTAPSSSSLASALDNMSGVADSKKVLETSPNVESPKLKSQRMVLEVSPVDTKRSEKVGDGSTPVFMDEEAMFNMQGLINSMAEGLLLTPPAMCKGFSWDDATDSHIDLSLWNDD

SEQ ID NO: 50732 - protein, 177 aa, Zea mays
MSGFAAHLVLLLLVLVSVSLSPSVRCLGKERTLAMIKPDGVSGNYTEEIKRLIVEAGFNIVKERLTQLEKEAASAFYDEHSSRSFFPHLVSYMTSGPVVVMVLEKGDAVSDWRGLIGPTDSQKAKISHPHSIRALCGKDSQRNCVHGSDSTSSAEREINFFFKDVVSGDIASQHDEL

SEQ ID NO: 50733 - protein, 251 aa, Vitis vinifera
MDSDHEEFSASSSSSSSRTNPNSSDSLLPLQCIGHKRKAGRKKFRETRHPIYRGVRQRNGNKWVCEVREPLKKSRIWLGTFPTPKMAARAHDVAALALRGRFASLNFPDSAWRLPRPKSSSAEDIQVAALEATKAFNPTAPSSSSLASALDNMSGVADSKKVLETSPNVESPKLKSQRMVLEVSPVDTKRSEKVGDGSTTVSMDEEAMFNMQGLINSMAEGLLLTPPAMCKGFSWDDATDSHIDLSLWNDD

SEQ ID NO: 50734 - protein, 481 aa, Oryza sativa (indica cultivar-group)
MAGPTIVLLPAWGSGHFMSALEAGKRLLVAGGGAVSLTVLVMQAPTEIEASVVEAHVRREAASGLDVTFRRLPAVEHPTGCEATEEFMSRYVERHAHHVKAAIAGLASPVAAVVVDLFFTPLLDAAHELSLPAYVYFASTTAFLALMLRLPELRDDLTVGFDGMEGTVDVPGLPPVPPSYMPVCLVSKTVKNYDWFEYHGRRFTEAKGIIVNSSVELEGAVLAAIADGRRPAPAIHAIGPVIWFDATPPPEQPHECVRWLDAQPAASVVFLCFGSIGFLDAAQVRELAAGLERSGHRFLWVLRGAPAGGVRYPTDADPGELLPEGFLEATAGRGMVWPRWAPQKDILGHAAVGGFVTHCGWNSVLESLWFGVPMATWPLYGEQHLNAFEAVASMGVAVELRRTTAKDGDAARSLVEAAEVERAVRRLMAPQGGGSSEAREKAAEVSAACRKAVEEGGSSHAALQRLVREIVRLVAGHTRPE

SEQ ID NO: 50735 - protein, 250 aa, Vitis riparia
MDLDRESSASSTSSPSRANLVSSDPRCPSRCIPHKRKTGRKKFRKTRHPIYRGVRQRNENKWVSEVREPSKKSRIWLGTFPTPEMAARAHDVAALALRGHFASLNFPDSAWRLPRARSSSAGDVQFAAIQAAKAFQQPPSSSSSTPFVMDNMSAGSRKILETSSVVDTPQLKSQKKVVGVSSMDSKSWEKAGDGFPTAFVDEEAVFNMPGLIDSMAEGLLLTPPAMCEGFSWDDAVSHIDLSLWNHDFLS

SEQ ID NO: 50736 - protein, 468 aa, Pseudomonas putida KT2440
MTDSVEKIQLTRALKSRHIFMLSLGGVIGTGLFMGSGVTINQGGPVGAILAYLVAGLLMYLVMVCLGELSVQMPVSGSFQAHATKYIGPATGFMIGWVYWMSWATTVGLEFTAAGMLMTRWFPEVPIWYWSALFVVVLFGLNALATRAFGEAEYWFSGIKVATILGFIVIGLLVIFGAIPLSSGAPAPMLNNLVGESLFPHGLSAVFAVMMTVVYAFQGCEIMGVAAGETEHPEKSIPRAVRNVVFRVLIFYVLAIAVLSAIVPHEQAGLMESPFVQVFDMVGIPYAADLMNFVILTAILSVGNSGLYASTRILWAMSKTGMAPKSLSPLSKRGVPLRALSITLCFALISLMTSFVAADTLFMVLMAVSGMSGTVTWIVIALAQYRFRKAWLRDGGQLQDLKYKAPLYPLVPLLCITLCSSLFVFLALDETQRPSLYWGFGFIALCYAAYFFVNRRRQGAFAPSTPGV

SEQ ID NO: 50737 - protein, 239 aa, Vitis riparia
MESERDQSSPSSSSSSSQTKCSISSSPVHKRKAGRKKFRETRHPVYRGVRQRNGNRWVCEMRDPKNKSRIWLGTFPTPEMAARAHDVAALAFRGDFAALNFPDSTSRLPRAKSSSAGDIRVAALAAAMAFRPAAPSSSSSYISHVTACSEELETSCSEDSPQLESRKKVVGVALEDSESSEGSPHGSSTVFMDEEALFNMPGLINSMAEGLLLAPPTMLGGFSWDDTTSYTDLSLWNDD

SEQ ID NO: 50738 - protein, 419 aa, Arabidopsis thaliana
MVSYRATTETISLALEANSSEAITILYQVLEDPSSSPEAIRIKEQAITNLCDRLIEEKRGEDLRKLLTKLRPFFSLIPKAKTAKIVRGIIDAVAKIPGTTDLQITLCKEMVEWTRAEKRTFLRQRVEARLAALLMENKEYVEALALLSTLVKEVRRLDDKLLLVDIDLLESKLHFSLRNLPKAKAALTAARTAANAIYVPPAQQGTIDLQSGILHAEEKDYKTGYSYFFEAFESFNALGDPRAVFSLKYMLLCKIMVSQADDVAGIISSKAGLQYVGPDLDAMKAVADAHSKRSLKLFENALRDYKAQLEDDPIVHRHLSSLYDTLLEQNLCRLIEPFSRVEIAHIAELIGLPLDHVEKKLSQMILDKKFAGTLDQGAGCLIIFEDPKADAIYSATLETIANMGKVVDSLYVRSAKIMS

SEQ ID NO: 50739 - protein, 239 aa, Vitis vinifera
MESERDQSSPSSSSSSSQTKCSISSSPVHKRKAGRKKFRETRHPVYRGVRQRNGNRWVCEVRDPKTKSRIWLGTFSTPEMAARAHDVAALAFRGNFAALNFPDSASRLPRAKSSSAGDIQVAALAAAMAFRPAAPSSSSSYISHVTPCSEELETSCSEDSPQLESRKKVVGVALEDSESSEGAPYGSSTVFMDEEALFNMPGLINSMAEGLLLAPPTMLGGFSWDDTTSYTDLSLWNDD

SEQ ID NO: 50740 - protein, 399 aa, Arabidopsis thaliana
EAITILYQVLEDPSSSPEAIRIKEQAITNLCDRLTEEKRGEDLRKLLTKLRPFFSLIPKAKTAKIVRGIIDAVAKIPGTTDLQITLCKEMVEWTRAEKRTFLRQRVEARLAALLMENKEYVEALALLSTLVKEVRRLDDKLLLVDIDLLESKLHFSLRNLPKAKAALTAARTAANAIYVPPAQQGTIDLQSGILHAEEKDYKTGYSYFFEAFESFNALGDPRAVFSLKYMLLCKIMVSQADDVAGIISSKAGLQYVGPDLDAMKAVADAHSKRSLKLFENALRDYKAQLEDDPIVHRHLSSLYDTLLEQNLCRLIEPFSRVEIAHIAELIGLPLDHVEKKLSQMILDKKFAGTLDQGAGCLIIFEDPKADAIYSATLETIANMGKVVDSLYVRSAKIMS

SEQ ID NO: 50741 - protein, 93 aa, Taraxacum officinale
NTGTFSLTRKITAGLLAGGIGAAVGNPADVAMVRMQADGRLPMAQRRNYKGVGDAISTMVKQEGVTSLWRGSSLTVTRAMIVTASQLASYDQI

SEQ ID NO: 50742 - protein, 1109 aa, Rhodopseudomonas palustris CGA009
MPKRTDISTILIIGAGPIVIGQACEFDYSGTQAVKALKQEGYRVVLVNSNPATIMTDPELADATYIEPITPEIVAKIIEKERYVIPGGFALLPTMGGQTALNCALSLRKLGTLEKFDVEMIGATADAIDKAEDRERFREAMTKIGLETPNSRQVKSLPDALRALDEIGFPALIRPSFTMGGTGGGIAYTKAEFIEIVERGIDASPTNEVLIEESILGWKEYEMEVVRDKHDNCIIVCSIENLDPMGVHTGDSITVAPALTLTDKEYQIMRDASLAVLREIGVETGGSNVQFAVNPDDGRLVVIEMNPRVSRSSALASKATGFPIAKVAAKLAVGYSLDEIANDITGGATPASFEPTIDYVVTKIPRFAFEKFPGASPTLTTAMKSVGEVMAIGRTFQESLQKALRGLESGLTGLDEIEIDGLGRGDDKNAIRAALGTPTPSRLLQVAQAMRLGWSNEEIFNSCKIDPWFLAQLRGIVDMEARVREAGLPDHAFGMRTLKAMGFSDARLAVLADTTEAEVKAKRRALGVRPVFKRIDTCAAEFASPTAYMYSTYESPFAGPASDESRPSDKQKVIILGGGPNRIGQGIEFDYCCCHACFALHDAGYESIMVNCNPETVSTDYDTADRLYFEPLTGEDVLEIIDTERSNGTLRGVIVQFGGQTPLKLARALEAADVPILGTSPDAIDLAEDRDRFKRILDKLRLKQPKNGIAYSVEQARLVAAELGLPLVVRPSYVLGGRAMQIIREDNQLSDYLLGTLPELVPGDVKARYPNDKTGQINTVLGTNPLLFDRYLSDATEVDVDCLSDGKDTFIVGIMEHIEEAGIHSGDSACSLPPHSLSAETIAELERQTRELALGLDVVGLMNVQYAIKDGEIYVLEVNPRASRTVPFVAKVIGMPVAKLAARIMAGEKIADLGLKKRNLDHVGVKESVFPFARFPGVDTVLGPEMRSTGEVMGIDRSFEIAFAKSQLGGGTRVPRKGTVFVSVRESDKARIVDAVKLLHSVGFKVIATSGTQRYLSDHGVPAEKVNKVLEGRPHIVDAIMNGEVQLVFNTTEGPQALADSRSLRRAALLHKVPYYTTLSGAVAAAKGIRAYLDGDLEVRTLQSYFSES

SEQ ID NO: 50743 - protein, 252 aa, Blastopirellula marina DSM 3645
MSQAEDISLVARWLAESESTVLFTGAGISTESGIPDFRSPGGVWTKYRTIYFDEFRQSAEARREYWRQKSEAHVEFSAAAPNAGHQILAAWEAHGVARGLITQNIDGLHQIAGSRQVLELHGTAREATCLDCAARFEIDPLVVQFRETGEVPPCPNCETGRLKHATVSFGQMLPTDVLETAYDWCSDADLILAIGSSLVVTPAADLPVAVRRRGGRVVILNRDETGLDQIADAKLSGGIGATLVAIDAALSR

SEQ ID NO: 50744 - protein, 533 aa, Prochlorococcus marinus str. MIT 9303
MSWPPSNADHLLVTAAQMAALEKEMFSSGLPVAALMEKVGQAMAAWFRQQSELLAEGVVVLVGPGHNGGDGLVVARELHLAGVKVQLWAPLPIRQPLTAQHWTYVKSLGIQQLDQAPDVAGESLWIEALFGLGQSRPLPETLATLLQARQRCQPGKLVSLDVPAGLCSDSGIPFPGGAAVAMTTLTVGLLKQGLIQDAAIDHVGRLVRVDMGVPKILLKQLPKSQPRRLCSADVATVPWQHPAAGAMKYERGRVLVIAGSDDYPGAAFLAIQGAIASGAGSIQAAVPAAVADQLWQVAPEVVLAAALESSAAGGMALATWLASHDLSRFDAVLIGPGLSRGGEPWSVLAEPLQRFAGLLVLDADGLNRLALATDGWQWLQQRQGHTWLTPHAGEFRRLFPQLKARQPLDSALEASRLCGAAVLLKGAHSVVADPSGAAWQLGETASWVARTGLGDLLAGYAAGLGSMDAAKAQACHCQGESLAVVALLHAEAARRCRQGSSARSIAQSLAELTISLQSNECDQGHVKGYECKR

SEQ ID NO: 50745 - protein, 109 aa, Francisella tularensis subsp. tularensis SCHU S4
MYTPEEQKVVERIEKQLKENDIILYMKGSPNLPQCGFSAHAATAIRSCGKPFAFVNILENPDIRAILPKYADWPTFPQLWVKGELIGGCDIIMEMNESGELKKLIDSVK

SEQ ID NO: 50746 - protein, 190 aa, Brassica napus
MAEVMLPMKMEMANDPSKFTSPDLLHVLAVDDSHVDRKFIERLLKVSSCKVTVVDSATRALQYLGLDVNEKPIGCKDLKVNLIMTDYSMPGMTGYELLKKIKESSAFRDVPVVVMSSENILSRIDRCLEEGAEDFLLKPVKLSDVRRIRDSLIKVEDLSFTKSINKRELETENVYSLDSSVPLQLKRTKI

SEQ ID NO: 50747 - protein, 227 aa, Medicago truncatula
MYPTTNSVSSSSSDMSLPNSEGSHWMSICNEEMRLAATTPKKRAGRKKFKETRHPVYRGVRKRNLDKWVCEMREPNKKTKIWLGTFPTAEMAARAHDVAAMALRGRYACLNFADSAWRLPKPATTQAKDIQKAATEAAEAFRPDKTLLTNHNDNDNDNDKENDMAVVATATEEQSMICMEEKEEGVMNMQEMWSNMALMSPTHSLGYYEYQYINEDFQDEEVSLWSF

SEQ ID NO: 50748 - protein, 253 aa, Vitis vinifera
MDLDRESSASSSSSTSSPSRANAASSDSRCSSRCISHKRKTGKKKFRKTRHPIYRGVRQRNENKWVSEVREPSKKSRIWLGTFPTPEMAARAHDVAALALRGHFASLNFPDSAWRLPRARSSSAGDVQFAAIQAAKAFQQPPSSSSSTPFIMDNMSAGSRKILETSSVVDTPQLKSQKKVVGVSPVDSKSWEKAGDGFPTAFVDEEAVFNMPGLIDSMAEGLLLTPPAMCEGFSWDDAVSHIDLSLWNHDFLS

SEQ ID NO: 50749 - protein, 144 aa, Zea mays
  misc_feature (77)..(77): Xaa can be any naturally occurring amino acid
  misc_feature (117)..(117): Xaa can be any naturally occurring amino acid
  misc_feature (124)..(124): Xaa can be any naturally occurring amino acid
GVHACIHTGYWEDGGTIRSFFDANLALTEPSYKFDWYEPKTPFFTARGCLPASLLGKCYINEASISNGCLPREGLVXHSATGACSLANPGCELEYFKMTGAATLETDQEASKLLLFXAGSLVGXYARNTTITNCLIDMTAPIGK

SEQ ID NO: 50750 - protein, 533 aa, Desulfitobacterium hafniense Y51
MVTITSWKRFKEYLYYDQELGLLLDISRMNFSAEFLRSMAEPMREAYHQLQLLEKGALANPDEGRMVGHYWLRNPDLAPTEEIVQDIKETLKEILDFAEQIHSGRLQGEKGNPFRNILLVGVGGSILGPRFVADALASSRDKMKAFFIDNGDPDGIDRVLSRIGEELPATLCLIISKSGGTIETRNGMLEVRRAYKEAGLSFPDHAVAITQRGSQLDKLSQKEGWLRAFPMWDWVGGRTSLLSAVGLLSLALQGIDVAGLLQGAKDCDGRTRRPDTLDNPGALLALMWYYSTQGQGGKQMVVLPYKDRLELFTKYLQQLIMESLGKEKNLQGETVHQGITVYGNKGSSDQHSYLQQLLEGPDNFFVTFIEVLKDRQGPSTYMEENSTSGEYLQAFLLGTREALTQKGRESLTITVKEVNAYTIGVLIALFERAVSIYALLVGINAYHQPAVEMGKKAAGQAIQLKNNIVEFLKSHPGKKFSVSELALAIQEEEHQEMVFKLLLHLTTNPEHGVNMEPGEPWPESRFFVGGPIS

SEQ ID NO: 50751 - protein, 220 aa, Oryza sativa
MAGDWQLYHTIRFWEAPTSMPIRTIQYPDSQVNRIAITPDKCLLAAAGNPHVRFFDINSNNQSAVMSFDGHTTNVTGLGFQREGKWMYTGSEDNTVKIWDLRASGCQRDYDCGSPVNTVAPHPNQAELICGLQNGNIRVWDLAENKCTEYAPEPEVAVRSIHVSPDGTQVVAANNNGQCFVWRIGDESQVRRIPRINAQKLNPQGLIRRSQFWPLSGERP

SEQ ID NO: 50752 - protein, 378 aa, Desulfitobacterium hafniense Y51
MKGGGIMTNAIGMIFGNLNSSALQGLDPNRPIGTVPFGGRYRLLDFALSSMVNSGIHTVGLITPQQYRPMLDHLGAGRDWSLDRKSGGLFFLPGVIHSLNHTVHFSLQDIAVNIDFLEKDCAKNIIISSSDQVFNLDFRPVLEEHEQAQADITLVYNQSVHPPEGSDRIYLRMNAHKKVTAMSKSKEVAGLQSPWNYFIDILIIRRELLLQMLRGYGSIGTIELSEVIAHHLDIINVQGYFCGGYVGRIRSVQDYFLNNMALLQEEVRRDLFINTRPIRTKIRDNPPTKYGKQAQVKNSLISSGCTLEGKVENTILSRGVVIEEGCEVRNCIIMSKCVIGKHSVLENLIMDKFVEINEGSVLKGQPNKLMVIPKKAVI

SEQ ID NO: 50753 - protein, 398 aa, Desulfitobacterium hafniense Y51
MRKKECIAMLLAGGQGSRLGCLTRNIPKPAVSFAGKYRIIDFSLSNCSNSNIDTVGVLTQYKPFALNTYINMGSAWDLNCLNGGIHILPPFVGEAQGSWYKGTANAIYQNMDFINFYNPEYILILSGDHIYQMDYYEMLSYHKQKHAEVTLSAIAVPWEEASRFGVMVTDAGGRIIRFEEKPPRPESNLASMGVYIFKWDVLKEALLEDEQDPQSDHDFGKNVLPRLLQQGRRLYSYLFHGYWRDVGTIESYYNANMEVLQEERVDKFFELKQRVFSNEEILAPQHLGERAKIHNSLIGNGCTILGEVRDSVIASGVYVGEGSLIEQSILLPNSEIYEDVRLHKTILGENAIVRAHCRIGDKREGNPPQEGITVIGDHLHIPEGTVISEGENVRKDTA

SEQ ID NO: 50754 - protein, 677 aa, Aspergillus nidulans FGSC A4
MAAPTQLAYRTVKGVGILDASPVYEPLAGFERYSFASLLQGEHVTNANPDRPEGNLRCSAYSPDGRYFAWASPEKVTIIDPSVGHVVSTIPAENVFELGFSPLGTYLITWQRPTKDPNGDAVKNLKVWQVAELESGENRIVGQYVQKSQTGWNIQYSADEKLCARVVTNEVQFYQSDDLSKVWNKLRVEGVADFALSPGQNLSVAVFIPERKGQPAAVKVFLVPQFGAPVSQKTFFKGDKVQLKWNASGTSLIVLAQTEVDKTGKSYYGETTLYLLSSSGQFDSRVHLDREGPIHDVSWSPTSKEFGVVYGTIPAKTTIFNVRGVPKHSFPLTPRNTILFSPHGRFVLVAGFGNLAGQMDIYDMEKNYNKITTVEAANSSVCAWSPDGQTILTATTSPRLRVDNGIRLWHVSGALLYNEDINELYDVFWRPQSTIQHPLGDPFNPLPAPHASAIAYLSTRKAPVKPAGAYRPPGARGQSTPLAFRREDQGGAAYVPEGTATGGALNGPARPRRRVVPGAEPVEEFLPPGAAPGGGVALPPGADQPEKLSKSAARNKKKREARKLKEGQPEEGANSNPSPPGEKKKEGARKNGQQQQKQPNGTKAAPAAAATPEPVEEGAPTVQDKKIRGLLKKIRAIEDLKMRLAGGEKLEDTQMKKIQTEDSVRKELESLGYTGAA

SEQ ID NO: 50755 - protein, 1079 aa, Desulfitobacterium hafniense Y51
MPLNPAWKKVLVIGSGPIVIGQAAEFDYAGTQACKALREVGIEVILVNSNPATIMTDEQMADRIYLEPLLPQNLEGILAQERPDALLPTLGGQTGLNLAMKLQEEGILERYGVALIGCNAETIYKAEDREAFKETMLEIGEPLAESAIVTSLEEGLAFTARRGYPVIVRPAYTLGGTGGGFAKNEKELLEVLHRGLQASPIHQCLLERSVAGWKEIEYEVMRDAMDNCITVCNMENIDPVGIHTGDSIVVAPSQTLTDGEYQMLRSSSLKIIRALGVNGGCNVQFALDPESREYVVIEVNPRVSRSSALASKATGYPIAKMAALLAVGFTLPELRNPVTGHTSACFEPALDYVVVKFPRWPFDKFPAADNRLGTQMKATGEVMAIDRTLEGALLKAVRSLEIGAVGLRIADSGRWTEMEIEHKLAQADHERFFAIAEAFRRDWTILEVQMLTKIDPFFLNKLKELVLLERRLGSEPLTLELLRSAKSQGFSDQAIGRLRGVTQEEIRQERCRYGLKPVYKTVDTCAAEFYSSTPYYYSTYEEEDEVAVHSGPKVIVLGSGPIRIGQGIEFDYCSVHALWALQELGIESIMINNNPETVSTDFDTGDKLYFEPLTLEDVLHIIEKEKADGVLVQFGGQTAINLASPLQKAGVRILGSQVDAIDKAEDRERFAQLLLELGIPQSEGCAATSVSQARTIAEELGFPVLVRPSYVIGGRAMQVVENFAELESYLTQAITLSPEHPILVDRYLEGKEVEVDAVADGEITVIPGIMEHIERAGVHSGDSLAVYPTQSLTPAEIQQIQDYTCRIAKGMEVRGLLNIQFVVVNGKVYVIEVNPRASRTVPILSKVTGIPLVALAVRVAMGEKLADMGYAHGLAPEIPFVVVKAPVFSFEKLTQVETSLGPEMKSTGEVLGMDVNFGHALAKAFAASHVPLPEKGDILVAVAEKDRPEAIAMTRELSRLGFGVKATGNTAKALLFCGVPLEEVREASTELKEAVRRQEFSFVLSTPSKGDSEERTGYLLRRLAAEHRVPCLTSMDTAQAVVRALKEIRNHTAPQTLPLQAYLAMKRSTVERSTPIPNA

SEQ ID NO: 50756 - protein, 491 aa, Ceratodon purpureus
KSVGQSAESVPAGAVTAYLQRMQREGLIQNFGCMVAVEEPNFCVIAYSENASEFLDLIPQAVPSMGEMDVLGIGTDIRTLFTPSSSAALEKAAATQDISLLNPITVHCRRSGKPLYAIAHRIDIGIVIDFEAVKMIDVPVSAAAGALQSHKLAARAITRLQALPGGDIELLCDTIVEEVRELTGYDRVMAFKFHEDEHGEVVAEIRRMDLEPYMGLHYPATDIPQASRFLLMKNRVRLIADCYASPVKLIQDPDIRQPVSLAGSTLRAPHGCHAQYMGNMGSIASLVMAVIINDNEEYSRGAIQRGRKLWGLVVCQHTSPRTVPFPLRSVCEFLMQVFGMQLNLHVELAAQLREKHILRTQTLLCDMLLRDAPIGIVSQTPNIMDLVKCDGAALYYGKRVWLLGTTPTENQIKEIADWLLEHHNDSTGLSTDSLADANYPGAHLLGDAVCGMAAAKITAKDFLFWFRSHTATEVKWGGAKHDPDEKDDGRK

SEQ ID NO: 50757 - protein, 111 aa, Taraxacum officinale
EVPTGWKFFGNLMDAGLCSVCGEESFGTGSDHIREKDGIWAVLAWMSILAHKNKDNLSSGKLVTVEDIVKQHWATFGRHYYTRYDYENVDAGAAKDLMAHLVKLQSSLSEV

SEQ ID NO: 50758 - protein, 211 aa, Bifidobacterium longum DJO10A
YGVPGILSGAALVFFAFIGFDVVATASEETKNPHKNVPLGIGVGMLLIIVMYMLVAVVTTGMVSYADLAKQDSPSLATAFELVGADWAAKIISFGIVLGLATVVMVLLLGLTRIVFAMSRDGLLPRGLSKTGKHGTPAALQIVVGAVVALVAAFFDIGVLSDMVNIGTLSAFTLVAISIPIMRKKRPDLPRAFKMPGSPWIPILIAVANFW

SEQ ID NO: 50759 - protein, 443 aa, Arabidopsis thaliana
MASGVFEDEAEGTITINEYIERLDAEELAADLVLGGDEGDECTFPKGYMKRQAIFSCITCTPEGNAGICTACCLSCHDGHELLELWTKRNFRCDCGNSKFGTLACKLLPSKDIENSENSYNHNFKGLYCTCDRPYPDPNVEEQVEMIQCCLCEDWFHEEHLGLTPSDSVGSQIPRDEESEPIYEDFICQNCSPACSFLTLYPENLWVVAKVDSTGSANACSETIELDKNHMDSEPGQPENGTDAEKSVVGKCSETISDSEPGQPENGTEAEKSVVQKCSEKIDESEAGQPENSTEAEKFVVRKCSEKIDGSENVPAAGCVIRTDLNSCPEFEKKPLFLTKNWRNILCRCEKCLEMYKQRKVSYLLDAEDTIVEYEKKAKEKRTEKLEKQEGEALDLLNNLDHVSKVELLHGIKDFQDGLQGLMVYIVTIYERNLITILRNHFI

SEQ ID NO: 50760 - protein, 302 aa, Synechococcus elongatus PCC 6301
MQRIGLAAKLIARRLSHAGLVDDALGFTGEINVQGEAVKRMDVYANQVFISVFRQSGLVCRLASEEMEKPYYIPENCPIGRYTLLYDPLDGSANVDVDLNVGSIFAVRRQEFYDESHEAKDLLQPGDRQIAAGYVLYGASTLLVYSMGQGVHVFVLDPSLGEFVLAQSDIQLPNSGQIYSVNEGNFWQWPEGYRQYIREMHRREGYSGRYSGALVADFHRILMQGGVFLYPETVKNPTGKLRLLYEAAPMAFLAEQAGGKASDGQKPILLRQPQALHERCPLIIGSAADVDFVEACLAESVP

SEQ ID NO: 50761 - protein, 455 aa, Prochlorococcus marinus subsp. pastoris str. CCMP1986
MSHEIFMPALSSTMTEGKIVEWLKNPGDKVERGESVLVVESDKADMDVESFQDGYLAAVLMPAGSTAPVGETIGLIVENQDEIASIQEQNKGKQTEVSSDGQLELPNNKPEIKEEKQKEVPQNNEQEVEIKREKVLITSNEIQFNASTSNNSSRVIASPRAKKLASTMGVELAKVHGSGPHGRIQADDVLKANGQPVSIPWIGEGSSPASISSPHVQAESKSETLGNSFGNPGETVQFNTLQKAVNKNMESSLNVPCFRVGYSINTDKLDNFYKKVKQNGVTMTALLVKAVAKTLKKHPQVNSSFSENGISYPENINIAVAVAMEDGGLITPVLKEPCNTDLFELSREWKDLVKRSRAKQLEPDEYSTGTFTLSNLGMFGVDRFDAILPPGTGAILAIASSKPTVVANNDGSISVKKIMQVNLTADHRVIYGADGASFLKDLSSLIENEPETLVA

SEQ ID NO: 50762 - protein, 377 aa, Pisum sativum
MAESEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDGLMKILTERGYTFTTSAEREIVRDMKEKLAYIALDYEQELETAKTSSAVEKTYELPDGQVITIGAERFRCPEVLFQPSMIGMESPGIHETTFNSIMKCDVDIRKDLYGNIVLSGGSTMFPGIADRMSKEITALAPSSMKSKVVAPPERKYSVWIGGSILAALSTFQQMWIAKAEYDESGPSIVHRKCF

SEQ ID NO: 50763 - protein, 197 aa, Chromobacterium violaceum ATCC 12472
MRTATVTRNTLETQITVSLNLDGTGVGRFETGVPFLDHMMDQIARHGLIDLDVKAVGDLHIDAHHTVEDIGITLGQAFAKAIGDKKGIRRYGHAYVPLDEALSRVVIDLSGRPGLVYNVDYTRACIGQFDVDLFSEFFHGFVNHSMVTLHIDNLRGHNSHHQAETIFKAFGRALRMACEHDERMAGITPSTKGTLSV

SEQ ID NO: 50764 - protein, 318 aa, Burkholderia mallei ATCC 23344
MAAIVAAGELLAEFVAAKRGQGFDAPGEFAGPFPSGAPAIFADQAARMGASVAYAGCVGRDAFGDAIVARLASHGVDVAHIRRAARPTGIACVAYRADGGRQFVFSIEGSASALLEPADVVPSMFAGCRYFHVMGSSLTSENAIAAVKRGVIEAARVGAKISFDPNVRAEILAFAPMRAALREMLDACHLFLPSEADLPFFCGPQPAERAIAGLLATHPLLERVVLKRGAAGSAAFDRTGSVAAPAYETAEVDPTGAGDCFGGTFVACAIAGLPVASALARANAAGALAVSRIGPMEGNSMPADIDRFLAERGVRCAA

SEQ ID NO: 50765 - protein, 342 aa, Glycine max
MSSDAVWVLFHLAFFSQCLPSAWAHSAILLPGQLARDSPQSCPAPDPNLYYKPVIGIVSHPGDGASGRLSNATGASYIAASYVKFVEAAGARVVPLIYTEPPEKLLKKLELVNGVLFTGGWAKSGLYFETVTKIFKKILEKNDAGDHFPLFATCLGFELITMIISQDNNILEEFSASNQASTLQFVENANIGESVFQRFPPELLGKMSTDCLVMQNHRYGISPGKLLNNPKLSSFFEILTTCTDEDDKVYVSTVRSQNYPVTGFQWHPEKNAFEWGSPRIPHTEDAIQITQYVANFLVSEARKSLNRPVAQELLDNLIYNYSPTYCGKAGKGYDEVYIFAQA

SEQ ID NO: 50766 - protein, 340 aa, Triticum aestivum
  misc_feature (159)..(159): Xaa can be any naturally occurring amino acid
LLFDVCGIKADWKMQDVLDEEIKTIKSMVGPDEHVICALSGGVDSTVAATLVHNAIGDRLHCVFVDNGLLRYKEKERVMSTFNSDLHLPVTCIDASEKFLTELKGVKDPEMKRKIIGREFIVVFDEFAHMLEQKIGKRPEYLVQGTLYPDVIESCPPPXGSGRTHSHTIKSHHNVGGLPKDMKLKLIEPLKLLFKDEVRKLGSILNVPESFLKRHPFPGPGLAVRVIGDVTAGNALEVLRQVDEIFIQSIKDAGIYDEIWQAFAVFLPVQTVGVQGDQRTHSHVVALRAITSEDGMTANWYDFERPFLVDVVKKICNNVRGVNRVVLDVTSKPPATVEWE

SEQ ID NO: 50767 - protein, 278 aa, Prochlorococcus marinus str. MIT 9303
MLTSLLLCAPNSSRPMHEQSLTTMPIGLICSAVASAQFHPQSVRLPLDCFDFMLISILTGFAAGALHVVGGADHLVAIAPSALRKPATALRNGLAWGIGHSTGVLVLSTIAIVLKDLVHIERMSSWAEFCVGVALLVVGAMAIRTALGLDIHTHQHTHQQNYGHAHDHQHVHLHLRGRHKHGRHAYAASSLGLLHGLAGASHLLAVIPALALPPLWALIYMAAYLLGSIAAMVAVVGAISLATLRVGRRALPLLVGSTGGLSIITGFFWLQKTSPQLL

SEQ ID NO: 50768 - protein, 437 aa, Burkholderia mallei ATCC 23344
MPLPTVPTAPFCPAEVKGSIAIDAGVSRLTKLRRFAGPGLLVAIGYMDPGNWATDIQAGSQFGYALLWVVVFSSVAAIFLQTLAARLGLVAGRDLAQASYDRYGPFGRIVQWITAEVSIIACDIAEVLGCALAFKLLLGVPLAWGIVLTALDTMIVLGLQGKGFRQVEAIVFGLIGTMAFCFVAQVAMVPPDWRAVLHGLAPSVPGHDRKDAIVLALGIVGATIMPHNLYLHSSVVQTRRVVGGAGDAIKETLAMVRIDTWISLVVAMLVNAAILVLAGAAFHATGQTGVADIEQAYRLITPIVGGAAAWLFGIALLASGQSSTLTGTIAGQVIMDGFLHMKMPCYQRRLITRGLALAPALTGVLWLGDGALGQLLVWSQVLLSLQLPFAMWPLIRSVGDRSIMREYAIGRGTKVVAWTLFVLVSITNLVLVTGFVG

SEQ ID NO: 50769 - protein, 273 aa, Triticum aestivum
  misc_feature (140)..(140): Xaa can be any naturally occurring amino acid
  misc_feature (215)..(215): Xaa can be any naturally occurring amino acid
  misc_feature (247)..(247): Xaa can be any naturally occurring amino acid
MATASTMSLLPISHLKQMQQQRRTRLAGALPGKVLVLGRRRRHVVPRARLFGPAIFEASKLKVLFVGVDDEKHPGKLPRTYTLTHSDVTARLTLAVSHTIHAAQLQGWYNRLQRDQVVAEWKKVQGAMSLHVHCHISGGXHFLLDLIAPLRYYIFRKELPVVLKAFVHGDGSLFSQHPELEEATVWVYFHSNNPNFNRVECWGPLRDAAAPYDDXDADAAPCPQGDAGDKKAMDRAAPRGSRGMECXFPPESYPWPKNSNAPTPPGPPITGPN

SEQ ID NO: 50770 - protein, 175 aa, Francisella tularensis subsp. tularensis SCHU S4
MNLDFIKSKIAAVPDFPKPGIMFRDITPLLADPQGLRKTAEAMAQELKNKGIQPTIVAGTESRGFIFGVALAEVLGLGFVPVRKPGKLPRATYSVKYDLEYGSDSLEIHQDAFKVTDEVLVVDDLLATGGTAKATVDLIEKTQAKVAGLIFVMELDGLGGREVLAGYNVSALIKF

SEQ ID NO: 50771 - protein, 345 aa, Blastopirellula marina DSM 3645
MKAMLLSEYKQLDVVEFAEPEIGADDLLIQVKACGICGSDIHGYDGSTGRRIPPLVMGHEAAGVVAKVGSAVTDYQVGDPVTFDSTVSCGVCFYCRQGHINLCDNRMVLGVSCGEYRRHGAFAEFVSVPQHICYRLPADFPYEHAAMIEAVSVAVHAANRAPLVLGDTAIVVGSGMIGLLVVQAIRLAGAAQVIAIDLDEGRLELAKKLGADVGLKADAVDVAAEVKKRTGGRGADVAIEVVGATRTIQTAIDSTRKGGSVTLVGNVSPQVEMPLQAIVSRELTVYGSCASNGEYPACIDLLQRGLIKVDPLITAKISLDQAPEWFARLYQGEPGAMKVIVDPTL

SEQ ID NO: 50772 - protein, 427 aa, Arabidopsis thaliana
MAFAPILRRASAVKNLFSLTRLAVGSALSTRSLQTGASGDDSQSMGGYHVSPGGFMRGAVYREPNKPLTIEEFHIPRPKSNEILIKTKACGVCHSDLHVMKGEIPFASPCVIGHEITGEVVEHGPLTDHKIINRFPIGSRVVGAFIMPCGTCSYCAKGHDDLCEDFFAYNRAKGTLYDGETRLFLQHDDSPVYMYSMGGMAEYCVTPAHGLAPLPESLPYSESAILGCAVFTAYGAMAHAAEIRPGDSIAVIGIGGVGSSCLQIARAFGASDIIAVDVQDDKLQKAKTLGATHIVNAAKEDAVERIREITGGMGVDVAVEALGKPQTFMQCTLSVKDGGKAVMIGLSQAGSVGEIDINRLVRRKIKVIGSYGGRARQDLPKVVKLAESGIFNLTNAVSSKYKFEDAGKAFQDLNEGKIVSRGVVEIL

SEQ ID NO: 50773 - protein, 253 aa, Francisella tularensis subsp. tularensis SCHU S4
MQKLIMGNWKMNGNSTSIKELCSGISQVQYDTSRVAIAVFPSSVYVKEVISQLPEKVGVGLQNITFYDDGAYTGEISARMLEDIGCDYLLIGHSERRSLFAESDEDVFKKLNKIIDTTITPVVCIGESLDDRQSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNEIINQANKICTE

SEQ ID NO: 50774 - protein, 378 aa, Glycine max
  misc_feature (345)..(345): Xaa can be any naturally occurring amino acid
MRTTAEFQGSVLNLRGVQVHSMEGSSMEQELDLFQKHVTERFLELSLAESGELLSLSWVRKLLDSLLCCQEEVRVILHNHRAQVMKHPPLDRMVGEFFERNVKALDVCNAIRDGVEQIRQWQKLLEIVLCALDQKRSIGEGQFRRAKKALVDLAIGMLDDKDTSSSGSIAHRNRSFGRNNASKDHHHNNSFGHFRSLSWSVSRNWSAARQLQALGNNLSPPKANDIVATNGLALPIYTMSCVLVFVMWALVAAIPCQDRGLGLHFSLPRQLPWAAPVVALHDRILEESKKRERKNTCGLLKEIHQIEKCARVINDLADSVQFPLSDEKGEEVRQRVQDGSKVCEXLKDGLDPLERQVREVFHRIVRSRTEGLDSHGRG

SEQ ID NO: 50775 - protein, 267 aa, Arabidopsis thaliana
MDPQLTEVSQQFERFKAAFARKDYNTCSDLLSQLKVLLTKFTSLPPLFENSPNAAKELTIARDIYEHAVVLSVKTEDQDAFERDFFQLKPYYVDARNRIPQSPQENLILGLNLLRLLVQNRIAEFHTELELLSSATLEDPCIKHAVELEQSFMEGAYNRVLSARQTAPDATYVYFMDLLAKPIRDEIAGCSEKAYDYVSISDARQMLLFSSDQELLTYVTDEHPEWEVKEGFVVFQKAKETAPCKEIPSLQLINQTLSYARELERIV

SEQ ID NO: 50776 - protein, 157 aa, Synechococcus elongatus PCC 6301
MAPRYRRLARLGQLWSDSDSFLTLVSSLEKFIAKVLSLAMIVVIIVSTIDLGIFLVKNLFVFDPFFLKSALFEVFGMFLSVLIALEILENITAYLRRNVIQVELVVATSLIAIARKLIILDVNKISTGELFGLGFAVLALAISYWIVRSAPARNSHH

SEQ ID NO: 50777 - protein, 386 aa, Pisum sativum
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPVNMRAPLNPKANREKMTQIMFEAFNTPAMYVAIQAVLSLYASGRTTGIVLDSGDGVSHTVPIYEGYALPHAILRLDLAGRDLTDFLMKILTERGYSFTTSAEREIVRGHSDVKEKLSYIALDYEQELETARTSSSVEKSYELPDGQLITIGDERFRCPEVLYQPSMIGMEAAGIHEATYNSIMKCDVDIRKDLYGNIVLSEGTTMSPGIADRMSKEISALAPSSMKIKVVAPPERKYSVWIGGSILASLSTFQQMWIAKAEYDESGPSIVHRKCF

SEQ ID NO: 50778 - protein, 132 aa, Chromobacterium violaceum ATCC 12472
MSSVSASWLDEVKWDDKGLVTAIAQDAASGRVLMVAWMNRESLQLTADTGIAHYWSRSRRKLWKKGEESGHLQTVRELRLDCDGDVIVMQIEQIGGIACHTGRESCFYRRFENGGWTTVDAVLKDPRAIYHP

SEQ ID NO: 50779 - protein, 108 aa, Chromobacterium violaceum ATCC 12472
MTPDVLKNIADTLEARREAAPQSSYVASLFHKGEDAILKKVAEEAAETLMASKDKDKLHLVREVADLWFHTMVLLTYHGLRPEDVVMELHRREGISGLDEKASRKPTA

SEQ ID NO: 50780 - protein, 107 aa, Chromobacterium violaceum ATCC 12472
MSDCLFCKIVAGQIPANKVYEDDDVLAFHDIRPIAPVHFMIIPKRHVDSLAHCGPEHEAVLGKILTLAPRLAKEQGLASGFKTGINTGRGGGQEVFHLHVHVFGHKG

SEQ ID NO: 50781 - protein, 446 aa, Streptococcus agalactiae 2603V/R
MNQNHSVKRSLSEVNQSVEVPHNSSFWNTLRAFLGPGALVAVGYMDPGNWITSVIGGATYRYLLLFVVLVSSLMAMQLQQMAGKLGIVTRQDLAQATASRLPKPLRYLLFIIIELALIATDLAEVIGSAIALHLLFGWPLLLSIMITILDVFLLLLLMKLGVQKIEAFVSVLILTILIIFTYLVVLSQPDLDAMFKGFLPHHELFNISHEGKNSPLTLALGIIGATVMPHNLYLHSSLSQTRRVDYHNKSSIKKAVRFMTLDSNIQLSLAFVVNSLLLVLGASLFYGHANDISAFSQMYLALSDKTITGAVASSFLSTLFAVALLASGQNSTITGTLTGQIVMEGFLHFKLPQWLIRLCTRLLTLLPIFVIALLVGGEENTLDQLIVYSQVFLSLALPFSIFPLIYFTSQKSIMGEHANAKWNTYLAYLVAIILTLLNLKLIMDLL

SEQ ID NO: 50782 - protein, 464 aa, Solanum tuberosum
MVRSLKNPKKAKRKNKAKKGEGSSDSVPSLPAKVWQPGVDKLEEGEELQCDASAYNSLHAFHIGWPCLSFDVLRDSLGLVRTEFPHSVYCVAGTQAEKSSWNSIGIFKLSNISGKRRDLVPDKTGDENSDMDSNSSDSDEEEEAGSGTPVLQLHKVFHEGCVNRIRAMTQNPHIVASWGDTGHVQNPESDLSHGASAVSNQAPLFKFGGHKDEGYAIDWSPRVPGKLVSDVLHISAGDCRNCIHLWEPTSGATWNVSAKSYIGHTASVEDLQWSPTEDTVFASCSVDRNIIIWDTRMDNPLAATITAHKADVNVISWNKLASCMLASGSDDGTFSIQDLRMVKDGDSVVAHFDYHKHPITSIEWSPHEASTLAVSSSDNQLTIWDLSLERDEEEEAEFKTKMKEQVNAPTDLPPQLLFVHQGQKDLKELHWHSQIPGMVVSTAADGFNILMPSNIENAIPANVA

SEQ ID NO: 50783 - protein, 1323 aa, Yersinia pestis CO92
MANTTMGVKLDEATRDRIKSAAQRIDRTPHWLIKQAIFNYLEKLESNSELPELATTSSLSLQDTEDAIPQLTENTHQPFLDFAEHVLPQSVTRAAITAAYRRPETEAIPMLLEQARLPADLAQATHKLAYSIAEKLRNQKSAHGRAGMVQGLLQEFSLSSQEGVALMCLAEALLRIPDKPTRDALIRDKISNGNWHSHLGRSPSMFVNAATWGLLFTGRLVSTHNEAKLSGSLNRIIGKGGEPLIRKGVDMAMRLMGEQFVTGETISEALANARKLEDKGFRYSYDMLGEAALTEADAQAYLLSYQQAIHAIGKASNGRGIYEGPGISIKLSALHPRYSRAQYERVMDELYPRLLSLTLQARQYDIGINIDAEEADRLEISLDLLERLCFEPQLAGWNGIGFVIQAYQKRCPSTIDAVIDMAQRSRRRLMIRLVKGAYWDSEIKRAQIDGLEGYPVYTRKVYTDVSYLACARKLLAVPNLIYPQFATHNAHTLSAIYHLAGQNYYPGQYEFQCLHGMGEPLYEQVVGKVAEGKLNRPCRIYAPVGTHETLLAYLVRRLLENGANTSFVNRIADATLPLDELVADPVSAVEAMAAAEGQLGLPHPRIPLPRELFGKDRANSSGVDLANEHRLASLSSALLASASQVWRAEPVIDAEQDNGDALPVINPAEPADVVGYVREATEGEVSRALDAAARAGAIWFATPPAERAAILIRAAELMENQMQTLMGILVREAGKTFSNAIAEVREAVDFLHYYAGIVRDNFANDSHRPLGPVVCISPWNFPLAIFTGQVAAALAAGNSVLAKPAEQTPLIAAQAVRILLDAGIPQGVLQLLPGRGDSVGALLVNDARVRAVMFTGSTEVATILQRSIAGRLDPQGRPTPLIAETGGLNAMIVDSSALTEQVVTDVVASAFDSAGQRCSALRILCIQDDVAEHTLQMLRGAMAECRMGNPERLSTDIGPVIDAEAKTGIERHIQAMRAKGRKVYQAARTNSLDEKEWQRGTFIKPTLIELDSFDELQKEVFGPVLHVVRFQRQHLNELVDQINASGYGLTLGIHTRIDETIARVTEKAKVGNLYVNRNMVGAVVGVQPFGGEGLSGTGPKAGGPLYLYRLLSSRPDDALANTLAHQDGEQQQNVAGREALLTAHRAFTQWATEQQHDSLATLCQRYASLAQGGTVRLLPGPTGERNTYALLPRERVLCLADTESDTLTQLAAVLATGSQVLWPENDVQKALLPQLPTEVQSRITLTHDWQTANITFDAVIYHGDADQLRTLCEQVAQIDGPIVSVQGFARGETNILLERLLIEHSLSVNTAAAGGNASLMTIG

SEQ ID NO: 50784 - protein, 418 aa, Prochlorococcus marinus str. MIT 9303
MVDALDSKSSAFGHVGSSPTAPTAVMGTYKRFPVTLLRGKGCWLWDDHGHQYLDAVAGIATCALGHSDRALRRSLGQQLKQLQHVSNLYRIPEQEALAHWLVENSCADSVFFCNSGAEANEAAIKLARKHGHRRRGIDRPIILTANSSFHGRTLAAISATGQPNYHKGFEPMVEGFEFFPFNDLQAFEQQLNRLEAQGPSVAAVLIEPLQGEGGVNPGEASFFRRLRELCSQHQILLIFDEVQVGMGRCGHWWGYQQLGVEPDAFTLAKGLGGGHAIGALLVKQHADLFEPGDHASTFGGNPFACKAALTVAKEIERRGLIAKVQQRGAQLREGLTDLVQRFPRQLKGVRGWGLLQGLVLQDESTFTAPNIAQAALEEKLLVIAAGPKVVRMVPPLIIKPSEIRQLLQRLEATLAHFR

SEQ ID NO: 50785 - protein, 197 aa, Clostridium perfringens str. 13
MKIKSSEFIISAVKREQYPDDNLPEIAFVGRSNVGKSSIINSLTNRRGLAKVSQTPGKTRLINFFLLNKDFYLVDLPGYGYAKVSKKEKASWGATIERYLLNRGPLKKVVLLVDCRHKPTADDVQMYEWIKHYGYEVVVIATKSDKISNNQIGKSEKLIKETLGLPKDHKLKFFSSLNKKGKDELVDYLFDDLVEEV

SEQ ID NO: 50786 - protein, 568 aa, Glycine max
MASSTLICDTQQWKELKAHAEDVEKTHLRDLLSDDERSQSMVVEFDGILLDYSRQQATLETREKLFKLAEVTSLKQKINQMYNGEYINSTENRSVLHVALRAPRDAVIQSDGNNVVPDVWNVLDKIQEFSERVRSGSWVGATGKELKDVVAVGIGGSFLGPLFVHTALQTDPEAIESARGRQLRFLANVDPIDVARNITGLNPETTLVVIVSKTFTTAETMLNARTLREWISNALGPLAVAKHMVAVSTNLTLVEEFGIDPNNVFAFWDWVGGRYSVCSAVGVLPLSLQYGFSVIEKFLKGASSIDQHMYSEPFERNLPVLLGMLSVWNVSFLGYPARAILPYSQALEKFAPHIQQVSMESNGKGVSIDGVPLPFEAGEIDFGEPGTNGQHSFYQLIHQGRVIPCDFIGVVKSQQPVYLSGEVVSNHDELMSNFFAQPDALAYGKTAEQLQKENVPPHLVPHKTFSGNRPSLSLLLPSLNAYNIGQLLAIYEHRVAVEGFIWGINSFDQWGVELGKSLASQVRKQLNASRTKGEPVQGFNFSTTAMLTRYLQASADVPADLPTRLPQI

SEQ ID NO: 50787 - protein, 304 aa, Aquifex aeolicus VF5
MEILKAIEDRLVEELNPKVRLVLETGRYIVESGGKRLRPLFTLLVSGMCGGDPSKALPLGVALEYIHVASLLHDDVVDRAKTRRGRESANLVFGNGVAVLTGDYMYAKSLHLFSTYGNMEMIRLVSGVVMDMAEGQVLEISKVGDIISEEEYFQIIDGKTGVLFGACFGVGAMSGECGDWRELYEAGLRLGRAFQLIDDALDYEGDPKVLGKPVGNDLREGKCTYPLISVLDNLDREEVKRVLRGLEDSEKLRKKVVELGGVEKTKERAKEELKVVKEIISKYPENEYKREILKLIDFVVERKA

SEQ ID NO: 50788 - protein, 291 aa, Clostridium acetobutylicum ATCC 824
MGMDRSDMNKNLAQMLKGGVIMDVINKEQAIIAEKAGACAVMALERVPADIRKQGGVARMSDPKMIKEIRESVTIPVMAKVRIGHFVEAEILQSLGIDFIDESEVLTPADDSYHIDKKAFKVPFVCGARNLGEALRRIGEGASMIRTKGEAGTGNVVEAVKHMRTVMDEIRRVKNAAKEEIMTIAKELGAPYDLVQYVWMNGRLPVVNFAAGGVATPADAALMIRLGAEGVFVGSGIFKSENPEKRARAIVMAAAYYDDPKVLEEVSEDLGEPMYGLEISDIKDRYAERGW

SEQ ID NO: 50789 - protein, 733 aa, Oryza sativa
VEAVVMPERYALGGACRVLAGMPAPLGATALDGGVNFAVYSAGASAASLCLFTPDDLEADEVTEEVPLDPLFNRTGNVWHVFIEGELHNMLYGYRFDGMFAPHCGQYFDVSNVVVDPYAKAVISRGEYGVPGPGGDCWPQMAGMIPLPYSTFDWQGDLPLRYPQKDLVIYEMHLRGFTKHSSSNVEHPGTYIGAISKLDYLKELGVNCVELMPCHEFNELEYFSCSSKMNFWGYSTINFFSPMIRYSSGGIRNCGRDAINEFKTFVREAHKRGIEVIMDVVFNHTAEGNEKGPILSFRGIDNSTYYMLAPKGEFYNYSGCGNTFNCNHPVVREFIVDCLRYWVTEMHVDGFRFDLASIMTRGCSLWDPVNVYGSPVEGDMTTTGTPLATPPLIDMISNDPILGDVKLIAEAWDAGGLYQVGQFPHWKIWSEWNGKYRDIVRQFIKGTDGFAGGFAECLCGSPHLYQAGGRKPWHSINFVCAHDGFTLADLVTYNKKYNSSNGEDNRDGENHNLSWNCGEEGEFAGLSVKRLRKRQMRNFFVSLMVSQGVPMFYMGDEYGHTKGGNNNTYCHDHYVNYFRWDKKEESSDLQRFCSLMTKFRKQCESLGLADFPTAQRLHWHGHQPGKPDWSETSRFVAFSTKDETKGEIYVAFNASHLPAVVGLPERPGYRWEPLVDTGKPAPYDFLTDDLPDRVTPSTCSLISSTPISTPCSATPPSSLNCSLMIERTKYSIV

SEQ ID NO: 50790 - protein, 448 aa, Mycobacterium sp. JLS
MSHSRPRVLIIGGGFGGLFCARRLSRADVDVTVLDRAAGHLFQPLLYQCATGKLSIGQISRPLREEFARHRNIRTLLGEAIELDPVARSVTALRPDETTFTVDYDVLVVAAGMRQSYLGNEQFAEWAPGMKTLDDALDIRQRLFTAFEIAETLPPGPERTSWLTFAVAGGGPTGVELAGQIREVATKTLAKEFHSIDPEEARVLLFDGGDRVLKTFAPALSLKANDTLRELGVELHFGVHVTDVRRDGITVTPKQGVPDQQFGTRTVLWTAGVEAVRFARHVAEVLGADTDRAGRITVGPDLTVAGHPEIFVIGDLAGREGLPGVAENAMQGGLHAASCIRRDLAGRPRRPYRYRDLGSAAYISHGHALLQVGPLRVSGYAGWVAWGLLHIAFLTGVSNRISTVATWLASIARTGRYHRAFMLGAGDRHDQRYTYSSWDLAEPAPEGN

SEQ ID NO: 50791 - protein, 114 aa, Rhodococcus sp. RHA1
MSLDPAIASRLKRNEAGLFSAVAQERSTGDVLMVAWMDDEALARTLDTRKGTYYSRSRQQYWVKGETSGHTQYVHEVRLDCDGDTVLLVVDQEGAACHTGTHTCFDTDVLLAVE

SEQ ID NO: 50792 - protein, 510 aa, Geobacter sulfurreducens PCA
MSRTFYVTTPIYYVNDVPHIGHAYTTLAADVLARYKKLKGYEVFFLTGTDEHGQKVEKAANTAGETPLELADRVVKRFQGLWEKLDIQYTDFIRTTQERHKKGVSHIFTKIMAQGDIYLGEYEDWYCTPCETFWTETQLIDGKCPDCNRPVDKLKEESYFFRMSKYQEQLLAHIEANPDFIQPKSRRNEIISFVKEGLRDLSVSRTSFNWGIPVPGNEKHVIYVWFDALTNYITALGYPDEQSAFKTFWPVDVHLIGKDILRFHAVYWPTFLMAAGLPVPKKVFAHGWWTVEGQKMSKSLQNVVEPNMLVDRYGIDAVRYFLLREVPFGLDGDFSHAALVHRINSDLANDLGNLLNRSTAMVNKYFDGVLPAPGPQTELDTAFREKTEAMVRQLDACMDELAFSKGLQAIWEVISAGNKYIDETAPWALAKDPAKREYLGTVMYTLLEAQRIVHLVLSAFMPRTSAKALGYLGWTEPCREEDLAWGRLAPGTLIVKAEALFPRIEEKEEK

SEQ ID NO: 50793 - protein, 484 aa, Burkholderia xenovorans LB400
MMETETDLRRHDLLIDGKRLPPGTGEYSVDIDPATEEPIALVAQGSAADVDAAVHAARAALKVWNAIRSAERGRILMRLAGLMRANLEELAALESLDAGKPIAAVMRQDIPAAIDTLEYYAGWCDKINGQVVPVRPDALTYTLREPVGVVAAIVPWNFPLMIGMWKIAPALACGCTLIVKPAEITPLSALRIGELALEAGVPPGVLNIVTGKGRVVGDALVAHPGVDKVTFTGSPSVGRGILQGAAGNFKRVTLELGGKSANLIFPDANLDNAVRAAAAGIFFNTGQVCSAGSRILAHRDVYDEVVERLAARARSIKVGDPSSRETSMGPLISAAQMKTVLGYVETGRAEGASLVTGGARVGERGFFVEPTVFADVEHEMRISQEEIFGPVVSVIRFDDEADAIRIANGTLYSLAAGVWSADIGRVHRVARDLRAGTVWINTYGYTDVRLPWGGSGDSGFGREHGDVAIENFTEPKAVWLAIDQ

SEQ ID NO: 50794 - protein, 386 aa, Triticum aestivum
  misc_feature (218)..(218): Xaa can be any naturally occurring amino acid
MLRLHKYVLTQLLPSSSLSTISLPLGPRVPAAAPAVSPNPSSFAVEEYLVATCGLTRPQAAKASTKLSHLKSPSNPDAVLAFLADLGLSGADVAALVAKDPKFLCAKVEKTLAPNVAELTGLGLSRAEIARLVSLAGESFRRTSVASRLSYFLSLFGSYDDLLRVVQKSPNLLGCDLDRVLKPNVAFLLECGLGVCDIAKLCIHSRWLLATNLERLRXMVACAQGIGVPCGSRMFRQALHAVAFLSQEKLTAKVELLKKTFMWSDAEVAIAISKAPTLLTRDKESLQRRSEFLISEVGLEPAYIAYRPAMLTYSLEGRIRPRYYVVKFLKENGLLKRDPSYFTVFKESGKAFNKMFIHPHKEAAQDLEKDYDAACKGEVPTNFRFT

SEQ ID NO: 50795 - protein, 126 aa, Geobacter sulfurreducens PCA
MKEIVATEQAPKAIGPYSQAVRAGGFLFLSGQIPLDPATGEMVDGDITVQTMRVMDNMAAVLAEAGLGFDAIVKTTIFLADLADFAAVNGVYGSRFAAAPPARSTVEVKGLPRGALVEIEAIALCQ

SEQ ID NO: 50796 - protein, 171 aa, Citrus aurantium
HNLLFILGFNAFGGFSIFLPKLINAIASDTTGLQAKLRSEVKEKCGTSALTLESVKSLELVQSVVCETLRLNPPVPLQFARARKDFQLSSYDSVYDIKKGELLCGYQPLVMRDSKVFDDAESFKAERFMGEKGSELLSYLYWSNGPQTGTPNDMNKQCAGKDYVTLVACLT

SEQ ID NO: 50797 - protein, 203 aa, Glycine max
  misc_feature (95)..(95): Xaa can be any naturally occurring amino acid
MKSSDTSPQHDDYLLHKSISVDGYTYTNTDKEITAKGTGKSSNFTHRIHNHVKMGPNLSEILKGKLSLGARIIQEGGRGNIFKSVFGMQEKEQLXKASQCYLYTTAGPIAGILFVSTAKVAFYSERPITFSSVTGELVRAPYKVLIPIGRIKEVNESQNVNKAEQKYIEIVTEDDSEFWFVGFLRYEKALKNLNKAISMANQF

SEQ ID NO: 50798 - protein, 636 aa, Triticum aestivum
MSKLLVIALLLLPLINHGIYLATAWDDQDFFKYCPPSKCSQHGPMIRYPLCLESSNTSSSSSCGCAGRSIWKLACSGQDTILVHPVLGPYSVSAIDYRRSSMKITPLVDPCLVLQQKLIISRSSSSPQVDVINDEKPSFDENFFESSSATIVHCSREFTPAAAHADSIAGPVSCLSNTTHFFYLVNSDEDMSILPLDCKVVPVSDRGGISLPHMLKDQMFYNFTETAKKIPSFAETAVSWDEGDCRECELSGRRCAFSSQRDREFCMPDPHGSHIKVIAATSSVAAFVALLLTVATVLYLSLKTRYNAEIHMKVEMFLKTYGTSKPTRYTFSEVKKMARRFKEKVGQGGFGSVYKGELPNGVPVAVKMLENSTGEGESFINEVATIGLIHHANIVRLLGFCSEGMRRALIYEFMPNESLEKYIFSDDSNIFQNLLVPEKLLDIALGIARGMEYLHQGCNQRILHFDIKPHNILLDYNFNPKISDFGLAKLCARDQSIVTLTAARGTMGYIAPELYSRNFGGVSYKADVYSFGMLVLEMVSGRRNSDPRIGSQDDVYLPEWIYEKVINGEELALTLETTQEEKDKVRQLAMVALWCIQWNPRNRPSMTKVVNMLTGRLQSLQMPPKPFVSSENELMS

SEQ ID NO: 50799 - protein, 338 aa, Solanum tuberosum
MANGKIKIGINGFGRIGRLVARVALQRDDVELVAVNDPFISTDYMTYMFKYDSVHGQWKHHELKVKDEKTLLFGEKAVTVFGIRNPEDIPWGEAGADFVVESTGVFTDKDKAAAHLKGGAKKVVISAPSKDAPMFVVGVNENEYKPELDIVSNASCTTNCLAPLAKVINDRFGIVEGLMTTVHAMTVTQKTVDGPSMKDWRGGRAASFNIIPSSTGAAKAVGKVLPSLNGKLTGMAFRVPTADVSVVDLTVRLEKEASYEDIKAAIKEESEGKLKGILGYTEDDVVSTDFVGDSRSSIFDAKAGIALSKNFVKLVSWYDNEWGYSSRVIDLICHMAKA

SEQ ID NO: 50800 - protein, 314 aa, Arabidopsis thaliana
MAKSEKISLKLLVDEKKNKVVLAEAGQDFVDVLFGLLTFPMGTIARLLEKHQKLPQILGCYKNLSRSVSDMAVDDFKTEACKSMLLSPKSSMEIHCRRLKLHIDDTQATMFYVCSKKHESDSSKYSNFYKSRCSCGSLMIYQIHVPEDEQVVDSLGNAEDVVFVSCRSSFILTDDLKVMLNSIDEIVKVLNGLGYPNINDLKEMLIDVGSEEVLSLLGNLFTSESALTSTFLMKQCMTTMLTLSPPPMFKTGRVEQGSGCHIKVFVGKLDRKILYAECSEDFIDSLLTFLVLPLESASSFFEDNTIIGCVKNLC

SEQ ID NO: 50801 - protein, 379 aa, Solanum tuberosum
MATQGQVITCKAAVAWEPNKPLVIEDVQVAPPQAGEVRVKVLYTALCHTDAYTWSGKDPEGLFPSVLGHEAAGIVESVGEGVTEVQPGDHVIPCYQAECRECKFCKSGKTNLCGKVRAATGVGVMMNDRKSRFSINGKPIYHFMGTSTFSQYTVVHDGSVARIDPAAPLEKVCLLGCWVPTGLGAVWNTAKVEPGSIVAIFGLGTVGLAVAEGAKAAGASRIIGIDIDSKKFDRAKNFGVTEFINPKEHEQPIQQVIVDLTDGGVDYSFECIGNVSVMRAALECCHKGWGTSVIVGVAASGQEISTRPFQLVTGRVWKGTAFGGFKSRSQVPSLVDKYLKKEIKVDEYITHSMTLADINKAFDLMHDGDCLRVVLDMFV

SEQ ID NO: 50802 - protein, 122 aa, Zea mays
  misc_feature (37)..(37): Xaa can be any naturally occurring amino acid
MARLPPEVNRVLYVRNLPFNISSEEMYDIFGKYGAIXRQIRLGNAKDTRGTAYVVYEDIYDAKNAVDHLSGFNVANRYLIVLYYQPAKMSKKSDIKKKEDEITRLQEKYGIGSKTPGPGSSD

SEQ ID NO: 50803 - protein, 487 aa, Ralstonia eutropha JMP134
MNAPQFPDKAVSPQFRAEALRIDGQKVVRERVIEVRNPYDGTLVGTVPKATVEDVRRAYEVAHGYRSTLTRYERAAILNRAAALLRERTEEASDLITLESGLSKKDSIYEIGRVADVLGFAATETLRDDGQMFSCDLTPHGKRRRVMTQREPLLGAICAITPFNHPMNQVAHKVAPSIATNNRMVLKPSEKVPLSAYYLADLLYESGLPPQMLQVITGDPREIADELITHPLVDLITFTGGVAIGKYIANKAGYKRVVLELGGNDPLIVLDDADLDRASDLAVQGSYKNSGQRCTAVKRMLVHEAVAARFTELVVEKTRAWRYGNPMDRSVDMGTVIDAQAAELFEARVNEAVAQGARLLIGNKRNGASYSPTVLDRVDPSMTVVREETFGPVSPIITFRDVDDAIRISNGTAFGLSSGVCTNRMDDFTKIANSLQVGTVNLWEVPGYRIELTPFGGIKDSGLGYKEGVQEAVKSFTNLKTVTLPWG

SEQ ID NO: 50804 - protein, 269 aa, Aquifex aeolicus VF5
MINAQTQLYGVIGFPVKHSLSPVFQNALIRYAGLNAVYLAFEINPEELKKAFEGFKALKVKGINVTVPFKEEIIPLLDYVEDTAKEIGAVNTVKFENGKAYGYNTDWIGFLKSLKSLIPEVKEKSILVLGAGGASRAVIYALVKEGAKVFLWNRTKEKAIKLAQKFPLEVVNSPEEVIDKVQVIVNTTSVGLKDKDPEIFNYDLIKKDHVVVDIIYKETKLLKKAKEKGAKLFDGLPMLLWQGIEAFKIWNGCEVPYSVAERSVRDLRG

SEQ ID NO: 50805 - protein, 571 aa, Arabidopsis thaliana
MTLLSSLGRASRSAPLASKLLLLGTLSGGSIVAYADANAEANKKEEHKKKKVVVLGTGWAGISFLKDLDITSYDVQVVSPQNYFAFTPLLPSVTCGTVEARSIVESVRNITKKKNGEIELWEADCFKIDHVNQKVHCRPVFKDDPEASQEFSLGYDYLIVAVGAQVNTFGTPGVIENCHFLKEVEDAQRIRRGVIDCFEKAILPGLTEEQRRRKLHFVIVGGGPTGVEFAAELHDFIIEDITKIYPSVKELVKITLIQSGDHILNTFDERISSFAEQKFTRDGIDVQTGMRVMSVTDKDITVKVKSSGELVSIPHGLILWSTGVGTRPVISDFMEQVGQGGRRAVATNEWLQVTGCENVYAVGDCASIAQRKILGDIANIFKAADVDNSGTLTMEELEGVVDDIIVRYPQVELYLKSKHMRHINDLLADSEGNARKEVDIEAFKLALSEADSQMKTLPATAQVAAQQGAYLAKCFNRMEQCKELPEGPKRFRTGGHHQFRPFQYKHFGQFAPLGGDQAAAELPGDWVSAGKSAQWLWYSIYASKQVSWRTRALVVSDWTRRYIFGRDSSRI

SEQ ID NO: 50806 - protein, 579 aa, Coccidioides immitis RS
MVNSKVLARPALQLSIAASRRPLPTVSQRQFAQLTRPVIRTRRGVIEHSAPRRTNATAASPSPAPKPKKRAGFFRWSYRLFLLSLVGGVGALGHSIYLLRHPAEQFAPDPEKKTLVILGTGWGSVSLLKKLDTANYNVVVISPRNFFLFTPLLPSCTTGLIEHRSIMEPVRNILRHKSATVKYYEAKATKIDYERKVVQISDESEIKGDTSQTEVPFDMLVVGVGAANATFGIPGVKEHSCFLKEVGDAQKIRTRIMDCVETAIFKDQTPEEVKRLLHMVVVGGGPTGVEFAGELQDFFNEDLKKWIPDIKDNFHVTLVEALPNVLPMFSKQLIDYTESTFKEEAITIRTKTMVKNVTDKYIEAEVTNPDGSKEMEKIPYGLLVWATGNAVRPVVKDLMSQIPAQKISRRGLAVNEYLVVNGTENIWAVGDCAITNYAPTAQVASQEGAFLARLFNTMAKTEAIEKDLKKLSVAQYEAKDDEKRNQLLDEIRALQKQLRRTKQIGPFQYSHQGSLAYIGKERAVADISWLSGNIASGGTLTYLFWRSAYLSMCFSTRNRVLVALDWVKARLFGRDVSRE

SEQ ID NO: 50807 - protein, 438 aa, Alternaria alternata [sequence omitted]

SEQ ID NO: 50808 - protein, 447 aa, Ralstonia eutropha JMP134
MNSPSLDAFLAGVARRDPGQPEFLQAVKEVMMTLWPFVERHPRYADQALLERLVEPERVIQFRVAWTDDQNRVQVNRAFRVQHSSAIGPYKGGMRFHPTVNLSVLKFLGFEQTFKNALTTLPMGGGKGGSDFDPKGKSDAEVMRFCQALVTELYRHLGPDTDIPAGDIGVGAREVGFMAGMMKKLSNQSACVFTGKGLAFGGSLMRPEATGYGTVYFAQEMLHRRGMDFDGLRVLLSGSGNVAQYAAEKAIELGAKVLTLTDSGGVLHYPEGMTTEQLAEVMAFKNEERGRLSDFAARHGMKFEAGRTPWHVPADVALPCATQNELDGNDAETLLGNGVICVAEGANMPSTLEAVDRFVDAKILYAPGKASNAGGVATSGLEMSQNAMRLSWHHAEVDEKLHAIMKDIHQNCIHHGQKDGGYVNYVEGANIAGFVKVADAMLAQGVI

SEQ ID NO: 50809 - protein, 279 aa, Pseudomonas putida KT2440
MTKEPVMPTTPSRDTVLCISLAGRPGTFGVRFHNHLYQQLGLDFYYKAMRTDDLPAAVAGIRALGIRGCGVSMPYKEACMALVDEIDPSAAAIESVNTLVNCNGHLKAYNTDYLAVRQLLAQHQVDPGTAFALRGSGGMAKAVASALRDAGFAEGIIVARNEQAGRQLADVCGYRWVPEPGDICPPMLVNVTPIGMAGGLEAEELAFPEHAIAAAERVFDVVAMPAQTPLIRRAQALGKPVITGLEVIALQALEQFVLYTGVRPTREQVDAAVAYARAT

SEQ ID NO: 50810 - protein, 277 aa, Glycine max
MPLVLAKSDSIQIREVWNDNLEEEFALIREIVDDYPYIAMDTEFPGIVLRPVGNFKNSYDYHYQTLKDNVDMLKLIQLGLTFSDEHGNLPTCGDESGTCCIWQFNFREFNVNEDVFANDSIELLRQSGIDFKRNNENGIDAHRFGELLMSSGIVLNDNVHWVTFHSGYDFGYLLKLLTCQDLPDTQVGFFNLINMYFPTVYDIKHLMKFCNSLHGGLNKLAELLEVERVGICHQAGSDSLLTSCTFRKLKDNFFSGSLEKYAGVLYGLGVENGQGSH

SEQ ID NO: 50811 - protein, 445 aa, Hevea brasiliensis
MAITIVSVRARQIFDSRGNPTVEADVKLSDGYLARAAVPRGASTGIYEALELRDGGSDYLGKGVSKAVENVNIIIGPALVGKDPTDQVGIDNFMVQQLDGTVNEWGWCKQKLGANAILAVSLAVCKAGAHVKGIPLYKHVANLAGNKNLVLPVPAFNVINGGSHAGNKLAMQEFMILPVGASSFKEAMKMGAEVYHHLKSVIKKKYGQDATNVGDEGGFAPNIQENKEGLELLKTAIAKAGYTGKVVIGMDVAASEFYGSDKTYDLNFKEENNNGSQKISGDVLKDLYKSFVTEYPIVSIEDPFDQDDWEHYAKLTSEIGVKVQIVGDDLLVTNPKRVEKAIKEKACNALLLKVNQIGSVTESIEAVKMSKRAGWGVMASHRSGETEDTFIADLSVGLATGQIKTGAPCRSERLAKYNQLLRIEEELGAEAVYAGANFRTPVEPY

SEQ ID NO: 50812 - protein, 445 aa, Hevea brasiliensis [sequence omitted]

SEQ ID NO: 50813 - protein, 499 aa, Lactobacillus johnsonii NCC 533
MEDHSFISYANGKSLVEINSTIPVPRTRNFFRMLLAYTGPGALVAVGYMDPGNWAASINGGQSFNYLLISTILISSLMAMLLQYMAAKLGIVTQMDLAQAIRARTSKRLSFILWIIIELAIMATDVAEVIGAAIALNLLFKIPLVIATFITVFDVLLLLLLSKVGFRKIEALVSCLIMVILLVFTYQVMLANPNWKNIFLSALPSPELVAQHPVVNGLSPLTGSLGIIGATVMPHNFYLHSSICQTRKINHDNLADVQNAVRFTTWDSNIQLIIAFFVNVLLLIMGAAVFKSGAVKDSSFFGLYDALSNTTMLSNPILISVAKTGILSVLFAVALLASGQNSTITGTLTGQVVMEGFIHLKMPLWARRLFTRLLSVIPVIMCVLMTAKDSISQQHFALNMLLENSQVFLAFAVPFSIVPLLIMTDDRRMMGQFKNRKIWSILGWASSIILIFLNLCNLPATFVSFNMMPKRDAVVFAYTIIMLIILLMGWTCWDMRKKK

SEQ ID NO: 50814 - protein, 204 aa, Rhodococcus sp. RHA1
MTDRIARVERTTKESSITVELNLDGTGIVDVSTGVPFFDHMLTALGSHASFDLTVHAKGDIEIEAHHTVEDTSIVLGQALGQALGDKKGIRRFGDAFIPMDETLAHASVDVSGRPYCVHTGEPEHLLHSVIGGYPGVPYATVINRHVFESIALNARIALHVRVLYGRDQHHITEAEFKAVARALREAVEPDPRVTGVPSTKGSL

SEQ ID NO: 50815 - protein, 431 aa, Clostridium acetobutylicum ATCC 824
MKLFGSMHEENNELYIGGISSKELAKKYGTPLYVIDEKLVRQNCKEYYENFKVKEKKNRVAYAGKAFLPIAMCQIIKEEGLSLDVVSGGELYTAYKAGFNMENVLFHGNNKTIDEMEMGVRLNVGRFVADNFYEIEKVNEIAKKMGKVQKVFLRITPGIEAHTHEYIKTGQIDSKFGFTLSNGDALKAVKEVLNFQNVELSGLHCHIGSQIFDIAPYLEETRVMLAFIKEIQKETNYEIKELDLGGGFGIYYTEVDKPRGAEEFCSAILKEAEESSKKLGVKLPKLIIEPGRSIIGNAGSTLYTVGSIKEIQHMRKYVSVDGGMTDNIRPSLYNAEYECEIANKFNASKEKVTISGKCCESGDILINDVNISEVESGDILVVSTTGAYGYSMSNNYNKIPKAAVVLVSDGKERLICKRETYEHMLSNEIMI

SEQ ID NO: 50816 - protein, 419 aa, Oryza sativa (indica cultivar-group)
MGGVIGALFRGGGHRREMHRAPMNQPGYGGGGENHRRAMLTKKYSYIPDNYQSLDQVTAALRDQGLESSNLILGIDFTKSNEWTGKRSFSGQSLHKIGSTPNPYEQAISIIGKTLAPFDDDNLIPCFGFGDATTHDYNVFSFHPDNSPCHGFEEVLSCYKKIVPHLRLSGPTSFAPIVEAAVDIVDRSGGQYHVLVIVADGQVTRSVDTSDNDLSPQERRTVDSVVMASSYPLSIVLVGVGDGPWEDMQKFDDKIPARQFDNFQFVNFTSIMSRSTTQQQKESAFALAALMEVPIQYKATMELGILGRSTGKAKRIMPAPPPLPSAAGRQPSLRREGSAAATAAAAPPSPREDQVCPICLTNAKDLAFGCGHMGMWGEPDQMPNLSTDDSVQAEAVLRMIKCLWTDGMELKSVLNVQNA

SEQ ID NO: 50817 - protein, 252 aa, Streptococcus agalactiae 2603V/R
MSRKPFIAGNWKMNKNPEEAKAFIEAVASKLPSSELVEAGIAAPALTLSTVLEAAKGSELKIAAQNSYFENSGAFTGENSPKVLAEMGTDYVVIGHSERRDYFHETDQDINKKAKAIFANGLTPIICCGESLETYEAGKAVEFVGAQVSAALAGLSEEQVSSLVIAYEPIWAIGTGKSATQDDAQNMCKAVRDVVAADFGQAVADKVRVQYGGSVKPENVAEYMACPDVDGALVGGASLEAESFLALLDFVK

SEQ ID NO: 50818 - protein, 295 aa, Nostoc punctiforme PCC 73102
MANDKLITGKTKLLGVIGHPVEHSLSPAMHNAAIANLGLDYVYLPFPIAPENLEVAIAGFAVIGVVGFSVTIPHKQAIMPLLSEITPLAQMIGAVNTVSRQNNQWVGTNTDIEGFIAPLQTTYKQDWSQKVAVILGNGGAARAVVAGCHQLGFAKIHVVGRNVQRLQEFRDSWSNSPISENLQVHQWEELSKLIPQANLLVNTTPIGMYPKVDESPLSIEEIANLPTGAIAYDLIYIPKPTQFLELAQKQGAIAIDGLEMLVQQGVAALKIWLQQENIPVEVMRQALLNQLGLGK

SEQ ID NO: 50819 - protein, 230 aa, Streptococcus agalactiae 2603V/R
MVKLVFARHGESEWNKANLFTGWADVDLSEKGTQQAIDAGKLIQAAGIEFDLAFTSVLKRAIKTTNLALEAADQLWVPVEKSWRLNERHYGGLTGKNKAEAAEQFGDEQVHIWRRSYDVLPPDMAKDDEHSAHTDRRYASLDDSVIPDAENLKVTLERALPFWEDKIAPALKDGKNVFVGAHGNSIRALVKHIKQLSDDEIMDVEIPNFPPLVFEFDEKLNLVSEYYLGK

SEQ ID NO: 50820 - protein, 435 aa, Capsicum annuum
MAGQTVIVSGLNPAAILQSTIGGAPPSTAAAAAENGDTTRKVVPLSKDALQDFMVSIITQKLQGKKKPFYVLDLGEVVSLMDQWNVALPNVHPFYAVKCNPEPSFLSMLAAMGSNFDCASRAEIEYVLSLGISPERIVFANPCKPESDIIFAEKVGVNLTTYDSEDEVYKIKKHHPKCELLLRIKPMNDGNARCPMGPKYGALPEEIEPLLRIAQASRLTVSGVSFHIGSGDADSNAYLGAIAAAKQVFETAAKFGMSKMNVLDIGGGFTSGHQFTTAATAVKSALQQHFSNEPELTIIAEPGRFFAETAFTLATTIIGKRVRGDLREYWINDGLYGSMNCVLYDHATVTATPLACMSNRVNLNCSGSKMFPSTIFGPTCDALDTVLRDYQLPELQVNDWLIFPNMGAYTKAAGSNFNGFNTSAIVTHLAYAYPS

SEQ ID NO: 50821 - protein, 212 aa, Prochlorococcus marinus subsp. pastoris str. CCMP1986
MKLSQKNEALNIIEPAYLASLSSLLWIALYYLPIGGALLRLILPLPIILLHLRRGTKTAFEGLIIQFLLLLILMGPIRGTLFLFPYGILAFWLGWSWFMKKNWWLSWCGGFILGTLGFFIRVFALSTLVGDNLWIIITRASYGLIDKFIELFNLPLSPSIRIIQLVAILLIIFQEMVYVLTIHILAYSLFPRLNSNIPDPPKIINGFVDLGL

SEQ ID NO: 50822 - protein, 434 aa, Desulfovibrio desulfuricans G20
MSNVRSAVTDELDFYGLSTPMELVETYGSPLYVYNENVLRRRCRELKGLSSHPGFRVNYSAKANANLSLLRIIRSEGLVVDAMSPGEIAMHLAAGFTPDEITYVCNNVSAEELRNAVDHGLLVSVDSLPQLDLLGQVNPGGKVMIRINPGIGAGHHKKVVTGGKETKFGIGPDDGDAVRRILKRHNLTLAGLNQHIGSLFMEPDSYMEAVEFLLREAEQWDSLEVIDFGGGFGIPYRKYEKQPRLDMEATGRMLDDCIGRWAERTGYNGRFMIEPGRYVTAECGVVLGTVHAVKNNGERRFAGTDLGFNVLQRPVMYDAFHDVEIYREDGVPQQETMQQTIVGNICESGDIMAAARELPEIQEGDIIAMLDAGAYGFAMSSSYNQRLRPAEVLVDKDGRDRLIRRRETLDDLLACFPEHAEKTGGSVRVAGGRG

SEQ ID NO: 50823 - protein, 252 aa, Brassica napus
MYPCGYVAEVTNLSPRATEKDVQSFFSHCGIVELVEITGCQGDDALTAYVTFRDAYALDMALLLTGATIVDQTVWISMYGVYLHESNNLTREGDYTLTVTQSHADAFASSPGEAVTIAQQVVKTMISKGYVLSKDAIGKAKALDESQGFSSLVANKLAEIGRYTGLTQNIQSSMEVVRSADDQYHFSDFTKSAVLVTGTAAVAAATITGKVAASAATTVVNSRYFANGALWFSDALGRAAKAAAHMGGGGSS

SEQ ID NO: 50824 - protein, 587 aa, Methylococcus capsulatus str. Bath
MAAPTTEHAETIVPALCRRFGGETFVQQTTADGISTLWLPARILVETIRYLRSEIDRPYALLFDLTAVDERVRKHRDGMPASAYTVVYHLVSLERNADVRLKIALPETDPALPSIVAVCPAANWYEREVWDMFGIRFDGHPNLRRLIMPPTWQGHPLRKDHPARATEMEPFSLPDDVQQQEQEALRFVPEEWGMQRQSEDTDFLFLNLGPNHPSVHGVFRVALQLDGEEIVDAVPDIGYHHRGAEKMGERQSWHSYIPYTDRIDYLGGSMNNLPYVMAVEKLAGIEVPERARVIRVMISEFYRIASHLLFYGTFAQDVGQMSPIFYMFIDRERVFEIIESFTGARMHSSFFRIGGVAMDLPEGWDRLIREFIAYFPRRLAEYDKAVMANKLIQRRTRGIGAYTTTEAIDWSVTGAGLRATGLPWDYRKARPYSGYENFEFDVPTGTNGDCYDRCAVRVEEMRQSLRIIEQCVEHMPSGPYKAEHPLTTPPPKERTMHDIETLIQHFLSVSWGPVIPPGEVCVTIEATKGLNGYYLTSDGGTMSYRTRIRTPSFPHLQMIPLMSRGMMVADLIAILASIDFVMADVDR

SEQ ID NO: 50825 - protein, 255 aa, Magnetospirillum magnetotacticum MS-1
NQLGPARLWLGEHIGLAALTFAIVILLSKVGSGTISRLSILIAIVVGTLIALALGKADFSGVGDGPVAAFPSFLGFGAPTFEIAAIISMLIVILVTLTETTADIIAVGEIVGTKVNRKRIADGLRADMASSIVSPFFGSFTQSAFAQNVGLVAITGVKSRFVVGAGGAILVILGLLPVLGRVVAAVPTPVLGGAGVVLFGSVAASGIRTLAKVDYSRPMNLIIVAASISFGMIPIAKPDFYDQFPTWFGIIFHSG

SEQ ID NO: 50826 - protein, 382 aa, Pseudomonas putida KT2440
MHKSYTAVVVGLGVVGSATLWRLAQQQQDVLGLEAGAPINLQGSSYGGSRIFRQAYWEGSDYLSLLAEADLGWRELQATSHRPLLHYSGGLFIGPIRSGVVSGSAASAKAGGIAHQRLTAAEVEARFSVFRADENMEAVFEQGAFTIAADDARLQMLNQAVAHGAQMRFGSHVQDITRVESEFLLRLSDGQSVLAQKVVLATGAGLAGSLIPDLSGLLRPRSVPIYWCAFKSGAEQLFANFPAFLYELEDGRLLYGTPQIDNAEPGIKIGFHNHQQSALDPRTQLEPASDAQIEEISACVSRVFPDLIARPYASRKCVYTMTPDEAFIIGESKELPSVFYVSACSGHGFKFAPALGSCLARALAGQSLALQVPAFSRERFSH

SEQ ID NO: 50827 - protein, 370 aa, Aspergillus nidulans FGSC A4
MSEKSYNILVLPGDGIGPEVMAEATKILSLFNTSTVRFRTQTELIGGCSIDTHGKSVTQAVLDAAVSSDAVLFAAVGGPKWDHIRRGLDGPEGGLLQVRKAMDIYANLRPCSVDSPSREIARDFSPFRQDVIEGVDFVVVRENCGGAYFGKKVEEDDYAMDEWGYSASEIQRITRLSAELALRHDPPWPVISLDKANVLASSRLWRRVVEKTMSEEYPQVKLVHQLADSASLIMATNPRALNGVILADNTFGDMVSDQAGSLVGTLGVLPSASLDGLPKPGEQRKVHGLYEPTHGSAPTIAGKNIANPTAMILCVALMFRYSFNMEAEARQIEAAVRTVLDKGIRTSDLGGSTGTREFGDAVVAALKGEL

SEQ ID NO: 50828 - protein, 555 aa, Aspergillus nidulans FGSC A4
MAEPEKTELEALEVVRERAQDADAFIDEMEQKLEATGGLETGFFQIQFKDPKHFTWLLVAFASMGGLLSGIDQSTISGANLYLPKDLHLDARQNSLVNSGMPLGAVGGALILSPCNEYLGRKWSIIISLILYTIGAALEAGSINYGMMVAARVILGVGVGLEGGTVPVYVAETVERRIRGNLVSLYQFNIALGEVLGYAISAMFLRVPGNWRYILGSSLVFSTIMFVGMLFLPESPRFLVHQGKTLDAYKVWKRIRGIQTVEARDEFFVMTASVRQEENEVHEGAHNKRFPWMDFFTVPRARRSLIYANIMIILGQMTGINAIMYYMSVLMNQIGFNEENANYMSLVGGGSLLLGTIPAIFLMESFGRRFWAIVTLPGFFIGLVLIGASYQVDLKTDLMTVEALYLTGLIVYQGFFGCYACLTWVVPSEVYPTYLRSYGMTTSDALLFLMSFIVTYNFTAMQEAMGKTGLSLGFYGGIAAVGWVYQVFFMPETKDKTLEEIEEVFSRPTMDIVRENWAGVKETCGNLARGNFRKVFAEQTKRRRSVHETELKGLA

SEQ ID NO: 50829 - protein, 146 aa, Oryza sativa (japonica cultivar-group)
MAGITGSRALMVVALLCAAAAMTAAQEASNVRATYHYYNPQQNNWDLNKVSAYCATWDANKPLSWRQKYGWTAFCGPAGPRGRDSCGKCIQVKNRGTGATIIARIVDQCSNGGLDLDYETIFKKIDTDGRGYQMGHLQVDYKFVNC

SEQ ID NO: 50830 - protein, 325 aa, Coprinopsis cinerea okayama7#130
MTTSLDQLKQTGTVVVSDSGDFESIDIYKPQDATTNPSLILQAANKPQYARVINAAVEYGRSKGKTVDEQANAAMDRLLVEFGKEILNIIPGRVSTEVDARLSFDKEGTKAKAKELIALYESVGISKDRVLIKIASTWEGIQAARELERDDGIHCNLTLLFGFGQAVACAEAGVTLISPFVGRILDWYKKTTGKNYEGDDDPGVKSVKRIFNYYKQHGYKTIVMGASFRNTGEIKALAGVDFLTISPALLEELKNSTDPVPKKLDANFAAKDEPIPKVSYIDNEPEFRWALLEDQMAFDKLHEGIKKFAEDGETLKKLLREKLSA

SEQ ID NO: 50831 - protein, 736 aa, Coprinopsis cinerea okayama7#130
MVVRIMVMVPVYAIASMVSIHSVEAAFVIDAIRDIYEAFVIYCFFELLLSYLGGERSLLIMLHGRPPKEPVFPMNLFKREIDVSDPYTFLFLKRGILQYVQVKPILAAVTLILKACGKYNEGDFRANSGYLYISIIYNASICTSLYCLAMFWVCVNDDLKPFRPVPKFLCVKGILFFSFWQSVAISTLVAANVIKRLGPYTDPEHVSTGLNNIFICVEMPFFAFAHMFAFSYRDYIDPHHTFVARMPVYYAFRDAFGLKDVVEDSKATLRGEGMDYREFEPAEGFMHQGEGRDRRIRAGLRYSKGGQRKYWLPRAVDHDPHTRGERILNKAVKKIAGDSEAESIHAPLLETQEEDVVHLAPDMMQDRDLSVWDTAQVEDGYELPFGDLDEADEELFEHSKRYLFGDYNYPCIDVSSEGARRMMWDEEERVLRDERGAWFSSIRGAKGQEEIRSRDRPVWQGYGAVDSSQPRSRMKEAWISNREDSEAVRPIRQSGTSRVIDFDSDRAAADSPYSKDGVHLRWTKGSQQPSSSKLPSRPAPKQRPDSSASSSSSGSGSKTRLLRSPPTLLSRSNSRQSNSTSPVLPPDAVDLVVEDPEAEEEDLSHERRKGEPAVRPPPGLKKVYRRGFETEELEGDGEKTKVRGEVEVEERTDHNRRRVVAGERIIDSIHRGGSVEEGRRPDVIGERDPYEDRGGSRSPWDDNQPPVVRAETPPLNARINAYHFDDIPGNDDNPWA

SEQ ID NO: 50832 - protein, 270 aa, Rhodococcus sp. RHA1
MSFDVSGTTVLITGASAGLGAEFARRFAERGADLVLVARRADRLEQLATELRAAHHVSVTVLPFDLATHGAGERLRGELTARDIRVDSLINNAGFGTHGDFASADLERLTSEIQLNVTTLVELSHAFLPDLLRGRGALVNVASTAAFQPTPGMAVYGATKAFVLNFTEALWAEARGTGLTVLAVCPGPTRTEFFDVVGSEDAAVGRMQTADQVVTTALRALDRRSTPPSVVSGLMNWVSSVSTRFATRRIGALASGRLLGNMRMRTSVTR

SEQ ID NO: 50833 - protein, 888 aa, Pseudoalteromonas tunicata D2
MSEVNKFDVDALETQEWLQALESVVREEGVERAQFLLEQVLEKARLNGVDMPTGVTTNYINTIPVEQEPAYPGDVNLERRIRSIIRWNAIMIVLRASKKDLDLGGHMASYQSSAAFYEVCFNHFFRAPNEVDGGDLVYYQGHISPGIYARAFVEGRLTADQLDNFRQEVDGNGLPSYPHPKLMPEFWQFPTVSMGLGPIASIYQARFLKYLDGRGLKDTKNQRVYAFLGDGEMDEPESRGAISFAAREKLDNLCYLVNCNLQRLDGPVMGNGKIIQELEGLFKGAGWNVIKVVWGSGWDILLAKDTTGKLLQLMNETIDGDYQTYKAKDGAYVRKHFFGRYPETAALVADMTDDQIFALKRGGHEPSKLYAAFKTAQETKGRPTVILAKTVKGYGMGDAAEGKNIAHQVKKMDMTHVAHLRSRLGLQDLVSDDALVELPYLTLEEGSAEHKYLHARRDALKGYTPKRIANFTQPLVLPEVAEFAPLLEEQKREVSTTMSFVRALNVLLKDKNIGKNIVPIIADEARTFGMEGLFRQIGIYNPHGQNYTPQDRDIVSYYKEATSGQVLQEGINELGAMSSWVAAATSYSTNDLPMIPFYIYYSMFGFQRVGDMAWMAGDQQARGFLLGATAGRTTLNGEGLQHEDGHSHILASTVPNCISYDPTYGYEVAVIIQDGIRRMYGENQENIYYYLTLMNENYHQPAMPAGAEEGIRRGIYKLESYAGAKANVQLLSSGTIMNEVRKAAAILSEEYGIASDVYSVTSFNELARDGQDVERFNMLNPGADAREAYITEVLNENATIAATDYMKNYAEQVRAFIPSANYKVLGTDGYGRSDSRENLRRHFEVNAGYVVVAALTELAKRGEVDKALIVQAIEKFEIDTDKLNPLYA

SEQ ID NO: 50834 - protein, 159 aa, Glycine max
MRVAATRPASSAPVALLAALALLFLVGSASLAIGAMASHVLGGKSENPAAANSLETDGLARFAVDEHNKRENALLEFVRVVEAKEQTVAGTLHHLTLEALEAGRKKVYEAKVWVKPWLDFKELQEFRHTGDATSFHHLRTSAPREGEHDPGMAGCGPVQ

SEQ ID NO: 50835 - protein, 474 aa, Pseudoalteromonas tunicata D2
MSNEIKTQVVVLGGGPGGYSAAFRAADLGLEVTLVESRETLGGVCLNVGCIPSKALLHVAKVIDDAAEMSSHGVTFGAPQIDLDKVRSWKDSVIGQLTGGLAGMAKMRKVKTVFGYGKFTGANTLAVEGADGTTTITFDNAIIAAGSQPVNLPFIPKDDRVIDSTGALELKDVPAKLLVLGGGIIGLEMGTVYRALGSQIDVVEFADQLIPAADKDVIKIYQRYVKDKFNVMLSTKVVAVEAKDDGLYVTFEGKEAPAEPVRYDKVLVAVGRTPNGKLLDADKAGVNVDERGFINVDKQLRTNVNHIFAIGDLVGQPMLAHKAVHEGHVAAEVISGQKHFFDPKCIPSIAYTDPEIAWVGVTEKEAKEKGLNIETAVFPWAASGRAIASARTEGQTKLIFDKDSGRIIGGAMIGINAGEMLGEIGLAVEMGADGEDLALTIHAHPTLNESIGLAAEIFEGSITDLPNKKAVKKK

SEQ ID NO: 50836 - protein, 1889 aa, Oryza sativa (indica cultivar-group)
MAVNMNPLKRSLESSSQEHEAGKQKLQKRECQDFTPRRYQLDVYEVAMRRNTIAMLDTGAGKTMIAVMLIKEFGKINRTKNAGKVIIFLAPTVQLVAQQCEVIEIHTDFEVEQYYGAKGVDQWTGHGHDTTGVPTSFTQCFLNLGHGISSHLDCEGQFCELENLLDAKIYTVSDREEIEFCVPSAKEMCRYYDSKPVCFEDLSEELGVLCSKYDALITELQNKRSDMYKDADDITKESKRRLSKSIAKICYCLDDVGLICASEATKICIERGQEKGWLKEVVDATDQQTDVNGSRLFAENSALHMKFFEEALHLIDKRLQQGIDMLLNSESGCVEAAKTGYISPKLYELIQIFHSFSNSRHARCLIFVDRKITARVIDRMIKKIGHLAHFTVSFLTGGRSSVDALTPKMQKDTLDSFRSGKVNLLFTTDVAEEGIHVPECSCVIRFDLPRTTRSYVQSRGRARQEDSQYILMIERGNVKQNDLISAIVRSETSMVKIASSRESGNLSPGFVPNEEINEYHVGTTGAKVTADSSISIVYRYCEKLPQDKCYSPKPTFEFTHHDDGYVCTLALPPSAVLQILVGPKARNMHKAKQLVCLDACKKLHELGALDDHLCLSVEDPVPEIVSKNKGTGIGTTKRKELHGTTRIHAWSGNWVSKKTALKLQSYKMNFVCDQAGQIYSEFVLLIDATLPDEVATLEIDLYLHDKMVKTSVSSCGLLELDAQQMEQAKLFQGLLFNGLFGKLFTRSKVPNAPREFILNKEDTFVWNTASVYLLLPTNPSFDSNVCINWSVIDAAATAVKLMRRIYSENKRELLGIFDSDQNVGDLIHLANKSCKANSLKDMVVLAVHTGKIYTALDITELSGDSAFDGASDKKECKFRTFAEYFKKKYGIVLRHPSQPLLVLKPSHNPHNLLSSKFRDEGNVVENMSNGTPVVNKTSNRVHMPPELLIPLDLPVEILRSFYLFPALMYRIESLTLASQLRSEIGYSDSNISSFLILEAITTLRCSEDFSMERLELLGDSVLKYADEGQLSSIRCHMICNATLYKLGIERNVQGYVRDAAFDPRRWLAPGQLSIRPSPCECPVKSEVVTDDIHIIDDKAIVLGKACDKGHRWMCSKTIADCFEAIIGAYYAGGGLRAAMAVLKWLGIGAEIEEDLIVQAILSASVQTYLPKDNVFEMLEAKLGYSFSVKGLLVEALTHPSQQELGAKYCYERLEFLGDAVLDILLTRYLFNSHKDTNEGELTDLRSASVNNENFAQVAVKHNFHHFLQHSSGLLLDQITEYVNRLEGSSMDKVELLSDGLPKGPKVLGDIVESIAGAILLDTKLDLDVVWGIFEPLLSPIVTPENLELPPYRELIEWCGKHGYFVGINCRDQGDTVVATLDVQLKEVLLVRQGFSKKRKDAKAHASSLLLKDLEEKGLILPKNASKTEQFEKHCGSTNPFNNLHVDAMDTHTPKPTKEKNAADSRNISDPLLGKPLHVIVKTSKGGPRIALYELCKKLQWPMPTMESEKVQPSFSSVCSSPGGSSQKATPQAFAFASTITLHIPNADVISLTGDGRADKKSSQDSAALFLLYELQRRGIEVKPGKAVSFNVDDECVIHISQVALGETKKAGSENVVVSVKVDGKKTVIGNLSAKNHPQFMCDLFIGNDFELSHSSKTTSVFLCDEDENMSDICDIMGKHLGRPVAEEGKKDNSDDGMDLSSSDDDDDSLDSSSSDDDDDESGDEDDGSDELPAEMESSEEEDGSDGQDESSSSIVSTDEEDESDEEDEIPEKPESSKLTAAGSTLSSGKKSKTATHFGQKTGDSTLANFSHLLKVIRILIQQRKMARRRQSANQIRRLPNPPAPMPASIAARHLVVINHSGLIRRQDIQPSELLVACLTAAAFASKMIL

SEQ ID NO: 50837 - protein, 528 aa, Arabidopsis thaliana
MQFSCDPDQEGDELPQYEHIYQNDFSYRKHKKQKEEDISICECKFDFGDPDSACGERCLNVITNTECTPGYCPCGVYCKNQKFQKCEYAKTKLIKCEGRGWGLVALEEIKAGQFIMEYCGEVISWKEAKKRAQTYETHGVKDAYIISLNASEAIDATKKGSLARFINHSCRPNCETRKWNVLGEVRVGIFAKESISPRTELAYDYNFEWYGGAKVRCLCGAVACSGFLGAKSRGFQASPYVIILIEDTYVWEDGDDRYSVDKIPVYDSAEDELTSEPSKNGESNTNEEKEKDISTENHLESTALNIQQQSDSTPTPMEEDVVTETVKTETSEDMKLLSQNSQEDSSPKTAIVSRVHGNISKIKSESLPKKRGRPFSGGKTKNVAQKHVDIANVVQLLATKEAQDEVLKYEVKQFFKRIGTNSKPSQYQMCLVNCCLQEVKKEAAVRLSSLYDEIRPAIEEHERDSQDSVATSVAEKWIQASCNKLKAEFDLYSSVIKNIASTPIKPQDTKTKVAEAGNEDHIKLLEAK

SEQ ID NO: 50838 - protein, 171 aa, Methylococcus capsulatus str. Bath
MISQLRTLWIVLKHTFSRADTVQYPEQRPKLYPRYRGRIVLTRDPDGEERCVACNLCAAVCPVDCIALQKTEDVDGRWYPEFFRINFSRCILCGLCEEACPTYAIQLTPDFELCEYDRRNLVYEKEHLLIQGTGKYPGYSFYRVAGKAIAGKDKGQAENEAPPIDVHSLLP

SEQ ID NO: 50839 - protein, 188 aa, Triticum aestivum
  misc_feature (124)..(124): Xaa can be any naturally occurring amino acid
  misc_feature (147)..(147): Xaa can be any naturally occurring amino acid
  misc_feature (173)..(173): Xaa can be any naturally occurring amino acid
PSPTAFVCGEAWARAGPPPNGGAGVLFPPWAWLPRFRSTAGGWIRGVHGGGPGTKRMHFMPFMEVTQPPCGERALVLPAQGVFFNAYFVGYLISPKFAHRFVGYSEEEAVGSYTGYLKDLEAGXIENTPAPAIAIDYWRLPRRRQAXKTSSPPCAPDEAHHRDANHYASDIHXQGMTLNQTPAPLGYH

SEQ ID NO: 50840 - protein, 120 aa, Oryza sativa
  misc_feature (93)..(93): Xaa can be any naturally occurring amino acid
MAPTVMAYSATSEAPLQGLKSTAGLPVRRRSTNSGFGSVSNGGRIKCVHAWPIEGIKEFETLSYLAPLTRGDLSEHSRDLLPSKVVPSLAFSXVGFVYRENHRSLVYYDGRYCTMWKLPC

SEQ ID NO: 50841 - protein, 482 aa, Solanum tuberosum
  misc_feature (210)..(210): Xaa can be any naturally occurring amino acid
MASATASHTFCGIPTTSSSSTTNRSTTHSSARFLLKTPLRRLGFAGAVADPLFTNHVATKLRSLKASSNPVRAVVSMAKKSVGDLSSSDLKGKKVFVRADLNVPLDDAQNITDDTRIRAAIPTIKHLIANGAKVILSTHLGRPKGVTPKYSLAPLVPRLSELLGIQVVKADDCIGPEVEKLVDSLPEGGVLLLENVRFYKEEEKNEPEFXKKLASLADLYVNDAFGTAHRAHASTEGVTKFLKPSVAGFLLQKELDYLVGAVSTPKRPFAAIVGGSKVSSKIGVIESLLEKCDILLLGGGMIFTFYKAQGLSVGSSLVEEDKLELATSLLEKAKAKGVSLLLPSDVVIADKFAPDANSKIVPASAIPDGWMGLDIGPDSIKTFNDALDTTKTVIWNGPMGVFEFDKFAAGTEAIAKKLADLSGKGVTTIIGGGDSVAAVEKVGVASVMSHISTGGGASLELLEGKVLPGVIALDEADAPVAV

SEQ ID NO: 50842 - protein, 209 aa, Gloeobacter violaceus PCC 7421
MVKFLEKVGGYARDVLESAKYIGQGMGVVFDHMRRKPVTVQYPYEKLIPSERFRGRIHFERPKCISCEVCVRVCPINLPVVDYEFNKETKKKELNSYSIDFGVCIFCGNCVEYCPTSCLSMTEEYELSVYDRHELNYDDVALGRLPTRVTDDPVVRPIRELAYLPKGVMDGHLEDPGSRRAGELPEEIVARLRPADHSSGTDANKKEGE

SEQ ID NO: 50843 - protein, 502 aa, Oryza sativa
MAAMASLYRRVLPSPPAVEFASEEGKRLFSEALESGTLQGFFNLISVFQTQSEPAFCGLASLSVVLNALAIDPGRQWKGPWRWFDESMLDCCEPLDKVKAEGITFAKLACLAHCAGANVRSFRADQSTIHDFRHHLVRSASSQDCHLIASYHRKPFKQTGTGHFSPIGGYHAGQDMALILDVARFKYPPHWVPLPLLWEAMNTTDDATGLLRGFMLISRHTAAPSLLYTVSCRDESWKSMAKYCMEDVPDLLKDESVDNVPALLSRLVKSLPANAGNLIKWVIEVRRQEEGGSGLSKEEEERLILKEMILQQVRDTELFRLVRELQFTKQPCCSCSYSSDDDSFTRIAASVCCQGAALLTGNLSSKDGFCCRETCFKCVQVDGDGPKTVVTGTAVSGVNEQSVDMLLPISTLETSVCNSNSSNEVVKYPSRTDILTVLLLALHPSTWVGIKDERLKAEFQSLISTDILHDDLKREILHLRRQLHYVRSCKEEEYGDPVPQSH

SEQ ID NO: 50844 - protein, 852 aa, Bacillus anthracis str. Ames
MQITKRLINKTVLLLTLIVMLSSIFSFQSVKAVSNSKTTEVIIHYKEQSGNTKDWNLWIWGENSSGKSYEFTGEDEFGKYAKINIDGDYNRLGFIIRTNEWEKDGGDRWIENIKDGRAEVWILSGDEKVYNSKPSSDLSIQKATIDSFHEITVTTNVPFNIKEKKIEMEGIKIKSISPYDINSGDITNKVKIITEQKIDLKQTYKVKIENLADTNTEIGKVIRSEEFDYLFYYGGNDLGNIYTPQHTKFRVWAPTASEAKLVTYKKWNDKIGTEINMQQGEKGTWKAELKGNQKGLYYTYKVKIGDKWTEAVDPYARAASVNGDKGAVVDLEETNPKKWNTNKKPKLKNPEDAIIYELHVRDLSIQPESGIKQKGKYLGVTEKGTKGPEGVKTGLDHMKDLGVTHVQLLPIFDYASVNEEKVNEPQYNWGYDPKNFNVPEGSYSTNPYEPTVRITELKQMIQTLHDNNLRVVMDVVYNHMYNAAESNFHKLVPGYYYRYNEDGTFANGTGVGNDTASERTMMRKFMIDSVTYWAKEYNLDGFRFDLMGIHDYETMNEIRKAVNQIDPSIILHGEGWDLNTPLAAELKANQKNAEKMKGIAHFNDNIRDGLKGSVFEEKENGFVNGKENMEDRIKKGITAGIDYDTNSSTYQDPEQVLTYVEAHDNHTLWDKLELTNPGDSEEVRKQIHKLSSSILLTSQGIPFLHAGQEFMRTKYGDHNSYKSPDSINQMDWLRRATFNNEVDYMKGLIELRKKYPAFRMTSAEQIKTHVSFIDAPKNTVTYTIEGNKHEYFTVAHNANREAVEITLPSKGPWKVLVDGKQAGSKPLYVVHDNKIKVPALSSIVLKSEKPIK

SEQ ID NO: 50845 - protein, 227 aa, Haemophilus somnus 2336
MELVFIRHGFSEWNAKNLFTGWRDVNLTERGIEEAKAAGKKLLEAGYEFDIAFTSVLTRAIKTCNIVLEESNQLWIPQVKHWRLNERHYGALQGLDKKATAEQYGDEQVHIWRRSYDVSPPDLDPQDPNSAHNDRRYALLPKDVVPNAENLKITLERVLPFWEDQIAPALLSGKRVLVTAHGNSLRALAKHIIGISDEEIMAFEIPTGQPLVLKLDEQLNFVEKFYL

SEQ ID NO: 50846 - protein, 173 aa, Campylobacter jejuni
EACPLQLAPMSSTTATLVMGDALAAALMKVRNFKPDDFALFHPGGSLGRKLLTKVKDLMVSSNLPIVHPDTEFNDLVDVMTSGRLGLCVVLENEKLVGIITDGDLRRALKTSDKPRFDFRAKEIMSTNPKVVDADAMASEAEEIMLKHKIKEIIVGKEERVMGIIQLYAIGRV

SEQ ID NO: 50847 - protein, 261 aa, Triticum aestivum
  misc_feature (229)..(229): Xaa can be any naturally occurring amino acid
  misc_feature (242)..(242): Xaa can be any naturally occurring amino acid
NKFVQKSRLVPVRNSRDIVDPRVRAAANLLSRSLVPSLTPNPGSQPSRSRAASVSLRRRHGPAAPLRASLSTASPSTRVAMGEAPKHCFQRGADGHLYCEGVRVEDAMAAADRTPFYLYSKPQLLRGLGCGAVLVSGNELRLALRAGFDPTRCIFNGNGKTLEDLILAAESGVFVNIDSEFDLENIVAAARVAGRQVPVLLRINPDVDPQVHPYVATGNKTSNLGIAMXKLQWVLDSINHIXNDIKLVGVHCHLGSTLQGR

SEQ ID NO: 50848 - protein, 522 aa, Mycobacterium sp. JLS
MPGLPDPRFLDDRLNHWAHTTPDAEAVVYLDRTWTWAQWDDRVRRLAGALSRFGVGHGDAVAFLDKNHPACVELTFAAASLGAANAVVNFRLAGDELDYVLGDSGAKVLIVGRELRPTIDKIRDRLTHVEHVVEVTPDGQDGDEYEALLAGSAPTGRAEDVAPDDVCVIMYSSGTTGRPKGVELTQANLIAHTVNAHDGWGFDEGDKNMVSMPLFHVGGQSYVQFGIHDGVPTVMTREVDGASLADAILKGANRTFLVPAVLAKVLETGPDAVKLFGALKTFCYGASPMPLPLLRQALKAWPDTDFIQVYGLTEVCGVISHLMPEAHRDAEHPERLVSAGQLIPNAELRVADPDTGDELPTGQQGELWFRTPQLMKGYHNKPEATAEAVTPDGWFRTGDVGRIDADGFIFVEDRLKDMIISGGENVYSIEVERVLAEHSAVTEVAVIGVPDEKWGEAVKAIVVVEGSASEQELTEWCRERLAHYKCPRSIDITEELPRNPTGKILKKELRKPFWEGRDRTTV

SEQ ID NO: 50849 - protein, 323 aa, Pseudoalteromonas tunicata D2
MDIKSIQALTDNDMQRVNQLIYKQLQSDVALVNQLGLYIVSSGGKRVRPMLSILSAKALGYEGDAHITLAAIVEFIHTATLLHDDVVDESDLRRGNATANAEFGNAASVLVGDFIYTRAFQLMVGLEEMRVMKILADATNVIAEGEVLQLMNCNDPDTTEQSYMQVIYSKTAKLFEAATQLAAVITRKDAATEEQLKLYGMHLGTAFQLVDDVLDYSADQAELGKSLGDDLAEGKPTLPLIYAMQHGTKEQVALIRQVIEQGNGRAFLDDVLKALADTDALNFTLNKAKEESQRAIACLALLPDSEYKEALIGLARLAVDRTH

SEQ ID NO: 50850 - protein, 431 aa, Rhodococcus sp. RHA1
MTSPSLSVDDITSLDASLLWHPYGAFPASTTPLVVAEASGTRLTLADGRELVDGMSSWWAAVHGYRHPVLDAAATAQLGRMSHVMFGGLTHEPAARLAQLLVEITPDGLDKVFLADSGSVSVEVAVKMCLQYWRSRGRPERHRLLTWRGGYHGDTFAPMSVCDPDGGMHSLWTDVLARQVFAGPPPREFDPRYVAEFEHLVASHTDELAAVIVEPVVQGAGGMRFHDPRYLSELRRICDEHGLLLVFDEIATGFGRTGELFAADHAGARPDIMCVGKALTGGYMTLAATLCSTDVAETISAGDAGGLMHGPTFMANPLACAVAVASIELLLSRDWRAEVEGVRRELESGLAPARELPGVRDVRVLGAIGVIELAEPVDMRAATDAAVAAGVWLRPFRNLIYAMPPYVCTTGDVRKITAGMLAAARSSTPGR

SEQ ID NO: 50851 - protein, 753 aa, Rhodococcus sp. RHA1
MEASESTGTTPIPVWPGSAYPLGATYDGAGTNFSLFSEVAEAVDLCLIAKDGTETRIRLDEVDGYVWHAYLPTVVPGQRYGYRIHGPWDPSAGHRCDPSKLLLDPYGKAFDGEFDGDRSLFSYDIDAPAEAAPDESEDAALLVDTDDDIEAEDEAGAELAAEPEETSAPGLPGHDSLGHTMTTVVINPFFDWAADRAPKHPYHDTVIYEAHVKGMTATHPGVPEELRGTYAGLAHPVIIDHLVDLGVTAIELMPVHQFMHDQTLLDKGLRNYWGYNTFGFLAPHTGYSSAEKPGAAVSEFKAMVRSFHEAGIEVILDVVYNHTAEGNHLGPTISFRGIDNAAYYRLVDGDAEHYMDYTGTGNSLNARHPHTLQLIMDSLRYWVTEMHVDGFRFDLASTLARELHDVDRLSAFFDLVQQDPIVSQVKLIAEPWDIGEGGYQVGNFPGLWTEWNGKYRDTVRDYWRGEPATLGEFASRLTGSSDLYEATGRRPGASINFVIAHDGFTLHDLVSYNEKHNEANGEGNNDGESHNRSWNCGVEGPTDDPEILDLRGRQSRNILATLLLSQGTPMLAHGDEMGRTQQGNNNVYCQDSELSWMDWSLADANADLVEFTKRVIALRMKNPVFRRRRFFEGTPIRSGDQTRDIAWLTPAGEEMTPEDWDSGFGKSLAVFLNGEGIPEPNHRGERVVGDSFLLCFNAHDEEIEFSTPNSDYADEWAVVLDTAVPTGAKEAVIKAGDPLQVEARSLVVLRRTA

SEQ ID NO: 50852 - protein, 634 aa, Ustilago maydis 521
MLRSSNRHMAATLRYAASTEWYQAAAFTEGLAGPSVARRAGSASRHSSSRHRSSLRKGLTAPFSTSSCTARSSQLADHRIISDPFPNQDTGFSYEKRDQLGLRGLLPPAKQSLNTQVLRVLHQLRSKSTPLEKHVMLASLRQTNTRLYYATILANKEEILPLIYTPTVGEACQKFSHIYRRPEGLSISLEDKGKIASIVENWPVPAGSPRIAVITDGSRILGLGDLGWNGQGISIGKLSLYVAGAGIHPRATLPIVVDLGTNNKKNLEDPLYLGLRRERASTEEYIEFMDEVMHALHTRYPNLIIQFEDFTSENAFRFLERYQGKYPMFNDDIQGTGSVILAGFTNAARIASKESGRPLHDHRILMAGAGSAAVGVGKQLMSFFTRQGLSADEARERIFITDSKGLVTKDRGDKLAEHKVFFARDDNAGKQIKDLGEIIDYVKPTAILGLSTIKGTFDENVIRKMATLNKRPIIFPLSNPTDNSECTFEEAVKYTEGRVLFAAGSPFAEIDAASSPTGKRMIPGQGNNFLVFPGIGLCAALCKAGRVTNEMITESALALSDALTDQERAEGRLYPNTERIREISRDIAVKCIQMANKQGVTRDGGKTAAMDEEQLRDWVQGEMWTPKYDTAEDA

SEQ ID NO: 50853 - protein, 275 aa, Oryza sativa
MGNCASFTPKWGLSDLHCKGMVPIDEDETHEGIKTIRIQKACEFTTSSVLCVCIITWNMNGKMSVEDVTKLVSSNRKFDLLVFGLQEVPKCDVAQVLQETMAETHILLCQKTMQSLQMFLFGAKSSEKYIRELKVDQHAVGGCGDITVWLGDLNYRLQGISSIPARKLIEENRQSKLRGKDQLLQEAEKGEVFNGYCEGTLLFKPTYKYNIGSSNYDTSYKIRVPSWTDRILFKVDHTSGLDAVLNSYEALDCIRSSDHKPVRAHLCLKVHGDSA

SEQ ID NO: 50854 - protein, 478 aa, Ralstonia eutropha JMP134
MTQTPQPSSGLSHGLKQRHMTMIALGGVIGAGLFVGSGVVIKSAGPAAVLSFLITGLLVVLVMRMLGELACAMPGGGSFYEYAREAWSDRPAVGNLASFLTGWMYWYFWVIVVALEAVAGADLVRYWLPDVPNWTISLVLLVMLTLTNLISVKSFGEFEFWFASIKVAAIMVFLFVAGVYVLGLAPGAHGMNVANLTANGGFMPNGIVPVLTGAVAATGFYFGAEIVTIAAAETAEPQKAVARATNSVITRVLVFYVGSVLLVVCLVPWNATGIATPYVSALNVMGIPAAAQIMNAIVLTAVLSALNSGLYASSRMLFALTKRGDAPRSLARVSRNGVPTRAILVATLFGYGAVVMSYVSPDKVFAFLVNSYGTVAIFVYILIAVSQLRLRARLEREAPHLLKVRMWCYPYLTWLAIFGMLAIVVAMAFIPDQRTPLALGVASLGLLVSAYIVRHLFRRGVQQVVPLAEMPRPDLHEY

SEQ ID NO: 50855 - protein, 250 aa, Magnetospirillum magnetotacticum MS-1
MAVPPSNEVDIFAHDLGFIAILDKKNKVTGWNVTVGGGMGMTHGETDTFPRTADVMGFCKPEDALKVAEAVMTVQRDWGNRKNRKNARLKYTIERFGLDAFRAEVEKRIGKTLAEPKPFTFDGNGDRYGWVEGEDGRHHLTLYVPSGRIKDIEGGPQFLSGLRRIAEVHEGDFRLTGNQNVIIANVPAGKRDQIEALVDEYGLTKGASALRRSSLACVALPTCGLALAESERYLPDLLTELEESLARHGL

SEQ ID NO: 50856 - protein, 595 aa, Coprinopsis cinerea okayama7#130
MDPKYEKDSKEVESSSVSSQPQARRVEFYDPSKESKWTRIGLTLESFKRAPGTTGGQVVNGANNVEDLEKIMADAPMLQQKMKPRHLQMIAVGGSIGTGLFVGSGAALYDGGPAALLICWLLIGIMLINVTQALGEMAILYPVSGGFYTLAIRFLDPSFAFAMGWNYVFQWAVVLPLEITVAARTIQYWPETLKVPLAVWITIFWAVIVIFAVFGTIGFAEEEFWSSCLKLLVVVVFVIIGIVCICGGGPSDGEYSSYVGGKHWSDPGGFANGFKGVCAVFVTAAFSFAGTELVGLAASETPNPRKTMPTAVKGTFWRITVIYITSLTIIGLLIPYNEERLVTGEGAAASPFVIALDNAKIPGFNHLVNVTICISVLSIGLSCVYAGSRTLTALAETGYAPKIFTYVDKSSRPLWSLIAILVWAPLAYINVRDVGDAVFRWLLALSGLSTLFTWMAICLCHIRFRRAWKVQGHSTDELPYRALGGVYGSWFGVILVILVLIAQFYVALFPLNYDPDRTPGDVAEGFFASYLALPVMIMFYIIGYAWKRTLPQRAHEINLDSGRKSWLTAEEMNAWRAERRAAPLHIRIFRALFTH

SEQ ID NO: 50857 - protein, 401 aa, Bifidobacterium longum DJO10A
MAQWQTLSDRINTVAPSATLAVDSKAKAMKAAGLDVVGFGAGEPNFPTPANVVKAAADACLDPKNYKYTPTPGLPELREAIAAKMLRDSGYEVNADQVVVTNGGKQAVYESFQILLNDGDEVIIPAPYWTSYPEAVKLAGGVPVEVFAGADMNFEPSLEALEAARTEHTKAIIVNSPNNPTGAVWKPETVEAIGRWAVEHHIWVISDEIYEHLNYDDAHTTYIGAAVPECRGQLLVLNGVAKTYAMPGWRVGWMVAPLEVAKAAAKLQGHMTSNVANISQRAALAAVAGPLDEVHEMRKAFDARRRAIVTALNDIEGVNCPTPTGAFYAFADITALLGKPLGPKGTVSDTSADFAAALLDEAHVAAVPGEAFGAPGYLRFSYALADEDLAEGMRRFKEWAN

SEQ ID NO: 50858 - protein, 1128 aa, Oryza sativa (indica cultivar-group)
MSSSRPTQCSSSSSRTRQSSRARILAQTTLDAELNAEYEEYGDSFDYSKLVEAQRTTGPEQQARSEKVIAYLHHIQRAKLIQPFGCLLALDEKTFNVIALSENAPEMLTTVSHAVPSVDDPPKLRIGTNVRSLFTDPGTTALQKALGFADVSLLNPILVQCKTSGKPFYAIVHRATGCLVVDFEPVKPTEFPATAAGALQSYKLAAKAISKIQSLPGGSMEVLCNTVVKELFDLTGYDRVMAYKFHEDDHGEVFAEITKPGLEPYLGLHYPATDIPQAARFLFMKNKVRMICDCRARSIKIIEDESLHLDISLCGSTLRAPHSCHLQYMENMNSIASLVMAVVVNENEDDDEVGADQPAQQQKRKKLWGLLVCHHESPRYVPFPLRYACEFLAQVFAVHVNKEFELERQVREKSILRMQTMLSDMLLRESSPLSIVSGTPNIMDLVKCDGAALLYGGKVWRLQNAPTESQIRDIAFWLSDVHRDSTGLSTDSLHDAGYPGAAALGDMICGMAVAKINSKDILFWFRSHTAAEIRWGGAKHDPSDKDDSRRMHPRLSFKAFLEVVKMKSLPWNDYEMDAIHSLQLILRGTLNDDIKPTRAASLDNQVGDLKLDGLAELQAVTSEMVRLMETATVPILAVDSNGLVNGWNQKVAELTGLRVDEAIGRHILTVVEESSVPVVQRMLYLALQGKEEKEVKFEVKTHGSKRDDGPVILVVNACASRDLHDHVVGVCFVAQDMTVHKLVMDKFTRVEGDYKAIIHNPSPLIPPIFGADEFGWCSEWNAAMTKLTGWHRDEVINKMLLGEVFDSTNASCLVKNKDAFVSLCILINSALAGDETEKAPFSFFDRNGKYIECLLSVNRKVNADGVITGVFCFIQVPSHELQHALHVQQASQQNALTKLKAYSYMRHAINNPLSGMLYSRKALKNTGLNEEQMKEVNVADSCHRQLNKILSDLDQDSVMNKSSCLDLEMVEFVLQDVFVAAVSQVLITCQGKGIRVSCNLPERYMKQTVYGDGVRLQQILSDFLFVSVKFSPVGGSVEISCSLTKNSIGENLHLIDLELRIKHQGKGVPADLLSQMYEDDNKEQSDEGMSLAVSRNLLRLMNGDVRHMREAGMSTFILSVELASAPAK

SEQ ID NO: 50859 - protein, 138 aa, Geobacter sulfurreducens PCA
MAACSDRETKPAGEAKPASAAGASDAVTTASGLSYVDLAAGSGAAPVAGKPVKVHYTGWLENGTKFDSSVDRGEPFVFTIGAGEVIPGWDEGVMSMKVGGKRRLIVPPQLGYGAAGAGGVIPPNATLIFEVELLDVAT

SEQ ID NO: 50860 - protein, 314 aa, Brassica napus
MAEEKSFKYVIVGGGVAAGYAAREFSKQGLKPGELAIISREPVPPYERPALSKGYINLENKASLPGFYVCAGSGGEKQFPQWYKDNGIELLLDTEIVKADLAAKTLVSGTGQVFKYQTLIAATGSSVTRLSDFGVEGADAKNIFYLRELLDADELVTAMNVKANGKAVVVGGGYIGLELSSALKVNNMEVTMVYPEPWCMPRLFTAGIASFYEGFYANKGINIVKGTVAAGFSTNSDGEVTEVILKDGRTLEADIVIVGVGARPIVSLFKGQVDEEKGGLKTDAFFRTSVPDVYAVGDIATFPMKLYNDMRRVE

SEQ ID NO: 50861 - protein, 429 aa, Corynebacterium glutamicum ATCC 13032
MLVTSTWGWTVHGDGKKIEPGAVVAPKERLSWGRTIGIGMQHVIAMFGATLLVPTLTGFPVNTTLLFSGLGTILFLLITRNRLPSYLGSSFAFIAPLTATQVHGIGVQIGGILVAGLVLVAIGFVVKAAGKRVIDAVMPPAVTGAIVALIGLNLAPTAAGNFSSQPLVATATLFAILIATVAGRGMIARLGILIGVVIGWVFAAITGNLSEGAADTIREAAWFGLPQFHKPEFQLSAILVTLPVIIVLIAENVGHVKAVSEMTGEDLDDLAGDALIADGFGTTLAGAFGGSGTTTYAENIGVMAATRVYSTAAYWVAACTAIALAFIPKFGALIFTIPAGVLGGACLVLYGLIGMLGIRIWQDNKVNFNNPVNLTMAAVALVAGIGNLTLTVFGVTLEGIAWGSVGIIVLYPIMKRLYLSIGEGKNAKF

SEQ ID NO: 50862 - protein, 202 aa, Thermoplasma volcanium GSS1
MIMKIYVVDNGGQWTHREWRVLRELGVETEIVPNDIESRKLDGLDGLVLSGGAPNIDEEMDKLGSIGEYIEDHDYPVFGICVGAQFIALHYGAQVVKAKHPEFGKTLVKISEPANVLAGLPENIIAWENHNDEIKNLTSDFVLTASSETCEVQAFYHKHKPLYAVQFHPEVEHTQFGREIFKNFIAICQQHKEKLINNVNNK

SEQ ID NO: 50863 - protein, 312 aa, Mannheimia succiniciproducens MBEL55E
MKNLTLIGECMIELNGEPFGVMRQTYGGDTLNTATYAARVASPEKLNVGYVSALGTDKLSQGMIERWQADGINTDLVLRDEKRSAGLYLIQLDKQGERTFLYWRNQSAARYLLQHPDYNRVLSALKNTDMIYLSGISLAILPENDRTLLIEQLGELKKSGLEIAFDSNFRPALWDSREQAQNCYKALLPLVDVALVTFDDEAMLWADNDEQATITRLSSFNIPKIIVKQGRLGATVCEKGKQTFVPTIPVEHVVDTTSAGDSFNAGFLVGYLQGKPLNECCKQGNQLAGIVIQHQGAIIEKSATEHLRNAFA

SEQ ID NO: 50864 - protein, 401 aa, Nicotiana tabacum
MESRVLTGATAIRGLPLLRKPVVKLTAASFPTVAKPIGAVSGGANLIWGRQLRPDILLEASPKRESMKPCFTAASSPAEGSDSAGDAKVGFFNKATLITGFFFFMWYFLNVIFNILNKKIYNYFPYPYFVSVIHLAVGVVYCLISWTVGLPKRAPIDSTQLKLLTPVAFCHALGHVTSNVSFAAVAVSFTHTIKALEPFFNASASQFILGQQIPLALWLSLAPVVLGVSMASLTELSFNWLGFISAMISNISFTYRSIYSKKAMTDMDSTNVYAYISIIALIVCIPPAIIIEGPQLLQHGFADAIAKVGLTKFVTDLFWVGMFYHLYNQVATNTLERVAPLTHAVGNVLKRVFVIGFSIIVFGNKISTQTGIGTCIAIAGVALYSFIKAKMEEEKRQKKAA

SEQ ID NO: 50865 - protein, 481 aa, Ralstonia eutropha JMP134
MNVFLNHIDGEWTACQSGRTFDNVNPADTGDIVGRFQASSAVDAQAAVAAAAAAFAGWKKTPVGKRAAVLNRAADHLEANADSIAAELTREEGKALTLARDEVLRSAQTLRFYAVEGQTFTGEVFPNDDPDQLVFSQREPLGVVTVIAPWNFPVSIPARKIAPALVTGNTVVFKPSSEAPLSGYRLAEALIKAGLPKGVLNFITGSAAEIGAAITEAPVVRAISFTGSSRAGEQIHRAVPLTTRTQMELGGKNPLIVMEDADLDRAVDLTIKGGFSLSGQACTGTSRVLVAESVKAAYTERLLAKVATLKVGSGMTAGMDLGPLASQKQMETVLRYIDIGKSEATLLCGGERLTGGEFDKGYYVAPTVFTDVTQQMRIAREEIFGPVIAILGFTDYADAIAKANDTEYGLAAAIVTSNPRYIHHFANDIEAGTVKINRTTTGNLVNAPFGGLKRSSTSTFRESGRTGLEFYTQIKTVYRGA

SEQ ID NO: 50866 - protein, 567 aa, Aquifex aeolicus VF5
MLNLTLAQLNFTVGDVEGNKEKILKVIDEYSEKSHIIAFPELSLSGYPPEDLLLQPHFLKECEKAFDQIIHHTRNYDVIVAVGLPYYEFDLYNALAVIHRGEVLGIYKKHFLPNYSVFDEYRYFRKGEEPLMIEVNGHKVSFSICEDIWYPDGVERQTALSGAELIVNVNASPYHVNKYSFKESFLKSRAEDNLCFVAYVNLVGGQDELVFDGRSIVISPFGKLVARAKAFEEDILTVTLDLGEAKRKRLLDLRWREGSYGREKVNVKRSVSLPDKEFFRGRIEENPKEEEEIYAALKLSLRDYVRKNGFEKVVLGLSGGIDSSFVACLAVDALGRENVKGVYMPSQFSSKESYEDAKALAQNLGIEFHVIPIKEIYRAYFNEFEKEICEITFDVADENIQARIRANILFYFSNKFRYLVLSTSNKSETAVGYTTIYGDMAGGFAPIKDVYKTWVYKLARYRNSISPDIPERVFKKPPSAELRPNQTDQDVLPPYEILDQILMLYIEENLSPEEIIRKGLPRDAVYKTINMIRKNEYKRKQAPIGPKITSRAFGKDWRMPVTNKFFK

SEQ ID NO: 50867 - protein, 482 aa, Clostridium perfringens SM101
MNTKENIFYNFMGGNFYENKSDKLIDIKSPLDGSLVGRIQSLSKEDVDKIIDNAEKAQKSWNEVPLNERAHVLYKTADLLEEHKEELANIMIREVAKDKKSALSEVSRTADYIRFTADAAKSMDGESIPSDNFPGFNRSKISVVTREPLGVVLAISPFNYPVNLSASKIAPAIVAGNSVVLKPATQGSLSALFLAKMFHDAGLPGGVLNTVTGRGNEIGDYCVTHDKIDFINFTGSTEVGIRISEITVMKPLLMELGGKDAAIVLEDADLDLTVNNIIAGGYSYSGQRCTAVKRILVMNSVADKLVEKLKEKISKLKMGNPLKVEDVTIVPLIDNKAADFVMELIDDAKEKGATLVCGGYREGNLIEATLFDNVTTDMRLAWEEPFGPVLPIIRVNDKDEAIKIANASKYGLQSSVFTRDINEAFYIANKLEVGTVHVNNKTERGPDHFPFLGVKSSGMGTQGIRYSIEAMSRPKATVITIR

SEQ ID NO: 50868 - protein, 876 aa, Clostridium perfringens SM101
MEKKQYVYLFNEGNASMKNLLGGKGANLSEMTILGIPVPQGFTVTTEACNKYYEDDKKISQDIIEEIENKMSELEKITGKKFGSLENPLLVSVRSGARVSMPGMMDTILNLGLNDESVEAMAKLTNNPRFAYDSYRRFIQMFADVVMGVEKRLFEDLLDEVKEEKGYKIDTDLTAEDLKDLVVKFKALYKKEKGEDFPSNPKEQLIEAVTAVFRSWNNPRAIVYRRLNDIPGEWGTAVNVQEMVFGNKGETSGTGVAFSRNPANGDNELYGEYLMNAQGEDVVAGIRTPEPISHLEAQNPEIYKQFTDIVNTLEKHYRDMQDMEFTIEDGKLYFLQTRNGKRTAQAALKIAVDLVEEGMLTKEEAILKVEPKQLDTLLHPAFASDGLKEAKIVAKGLPASPGAACGKIAFTAEEAKERKANGEKVVLVRLETSPEDIEGMIAAEGILTVRGGMTSHAAVVARGMGTCCVAGCGELKVNEEARTLEVNGQVLTFDDYISIDGSTGHIYAEQVKTVSPEITGHFATFMGWADEIRKLKVRTNADTPRDTKQAVEFGAEGIGLCRTEHMFFAEDRILAVREMILAKNEDSRRVALEKLLPMQREDFIGMYEALEERPATIRFLDPPLHEFLPNEEEDINALAKEIGVSPAEIKNVVAELHEFNPMMGHRGCRLAVSYPEIAEMQTRAVIEAAIEVKKNKGYNIVPEIMIPLIGEIKELKYVKNVVVETAKTVMEEKGIQLDYKVGTMIEIPRAALTADKIAEEAEFFSFGTNDLTQMTFGFSRDDAAKFLKDYYEKGIYEQDPFAKLDQEGVGELMRIACEKGKATRPDIKLGICGEHGGDPSSVEFCHNLGLNYVSCSPYRVPLARLAAAQAQVKNKR

SEQ ID NO: 50869 - protein, 518 aa, Arabidopsis thaliana
MVKKLTPTKKGSYEEEVAQHTFFPFLLVSLSPQEYLLCRGLSTLFDRGAQEASLLSLSLSSMPSSATSTYLLSLKQVSLTASSPLLLQLKDRFFHQPKLLNMGFSTGKRKSRDEEEDRVSFFASEFPMDDLNDDVLERVLSWLPTSCFFRMSSVCKRWKSSQTSKSFKLACSQIPTRDPWFFMIDNDSNSSSFVFDSTENSWKNLNRRDFLHHHRQDFIPVASSGGLLCYRCSISGDFLLRNPLTGSSRDIPSQDNNNNKPLQAVAMTTTTVTPSSYTLVTISGEIPNLSFKIYESNADSWSKDQELESVKNNDSSLHDDYDTDSGTVYFLSKQGNVVVASNNLQRSPSKQYSSVITVTDEAEIVYFLSSYGTIVACDLTKRCFTELPKLLLPFLEYSIDLVECEGTMYVILLSEFFESASLRIWRLDNNREWVQVGMLPPALSHELYGKKGDINCVGGAGNKILVCFNASPPEVYCRYFVYDLVAEEWNELPKCFKDGEAVDFVSALSFQPRIEATV

SEQ ID NO: 50870 - protein, 357 aa, Arabidopsis thaliana
MVIYHRKVVFTYVRAKRFYHFLNIEMVTDFKSLLPVIDISPLLAKCDDFDMAEDAGVVEVVGKLDRACRDVGFFYVIGHGISDDLINKVKEMTHQFFELPYEEKLKIKITPTAGYRGYQRIGVNFTSGKQDMHEAIDCYREFKQGKHGDIGKVLEGPNQWPGNPQEYKDLMEKYIKLCTDLSRNILRGISLALGGSPYEFEGKMLRDPFWVMRIIGYPGVNQENVIGCGAHTDYGLLTLINQDDDKTALQVKNVDGDWIPAIPIPGSFICNIGDMLTILSNGVYQSTLHKVINNSPKYRVCVAFFYETNFEAEVEPLDIFKEKHPRKETSQVAKRVVYGQHLINKVLTTFANLVENS

SEQ ID NO: 50871 - protein, 250 aa, Geobacter sulfurreducens PCA
MDAGEEEGIINEEENAMIRSIFELRDTIVREIMVPRTDMACVSADAAVANVLNTIISCGHSRIPVYDGTVDNIIGLIYAKDLLKYWGMSEPAIDLKRIMRAPYFIPETKNLEELLQEFKRKRVHIAIVIDEYGGTSGLVTIEDLLEQIVGDIQDEYDLEEEWLEEEPDGSILVDARLPIEDLEEYFGIEVEREKFDTVAGLIFHLTGRIPMVREEVESDTLRMTVLEAGERNIKKVRIARRSDEAGEAQS

SEQ ID NO: 50872 - protein, 428 aa, Geobacter sulfurreducens PCA
MSEITDVYAREILDSRGNPTLEVEVFLESGVMGRAAVPSGASTGEREALELRDGDASRYLGKGVLKAVDNVNDIIAEQLIGMEATDQVGIDRRMLELDGTEYKSTLGANAILGVSLAVAKAAAEEVGLPLYQYIGGCNARELPLPMMNILNGGAHADNNVDIQEFMIMPAGARSFSEALRMGAEVFHALKSVLKGKGYNTAVGDEGGFAPNLKSNEEALEVIMEAIAKAGYKAGEDILLALDVASSELFKDGKYFLENEAKPEKTADELIDFYENLVNKYPIISIEDGMAENDWEGWKKITDRLGKRVQLVGDDLFVTNTKILKEGISKGVANSILIKLNQIGTLTETLDAIETAKRAGYTTVISHRSGETEDTTLADLAVAVNAGQIKTGSLCRTDRVAKYNQLLRIEDELDVTAQFRGKDVFYNLR

SEQ ID NO: 50873 - protein, 108 aa, Pseudomonas syringae pv. phaseolicola 1448A
MDIIETIKEQIANNTILLYMKGAPNAPQCGFSAKASQALMACGEKFAYVDILQNPEIRANLPKYANWPTFPQLWVAGELVGGSDIITEMMADGSLQTLVKEASAAKAE

SEQ ID NO: 50874 - protein, 284 aa, Chenopodium rubrum
PSSSSLCISGTSPLKSITDLNPRVIILSGGPHSVHAPDAPVFCDGFVDYVEKNGVHVLGICYGLQLIVQKLGGLVKVGDRQEYGKMNIEVISENSGFFGNRIKGDKQDVWMSHGDEVSKLPDGFKVVAVSQQGAVAAIENPSRKFYGLQYHPEVTHSPQGMKTLRYFLFDVCGISADWNMEDVLNEEIKVIKETVGPDDHVICALSGGVDSTVAATLVHKAIGDRLHCIFVDNGLLRYKERERVMDTFEEHLHLPVTCVDASEQFLSKLKGVADPEIQREEEEG

SEQ ID NO: 50875 - protein, 376 aa, Oryza sativa (japonica cultivar-group)
MGEEEKKEAAKAKEEEKPKQEEKPKEQEEGKKEEKPKEEGEKGKDGGGGEEKKERRGGSKIGRSTAAAAAGGGGDARLHALRGLRQEGVEDVIADSKAHKVLVKGKKAAADPMKVVERVQKKTGRKVELLSPMPPPPEEKKEEEKKEEPEPPKPEEKKEPPVIAVVLKVHMHCEACAQGIRKRILKMKGVQSAEPDLKASEVTVKGVFEEAKLAEYVHKRTGKHAAIIKSEPVAPPEKVAAEGGDEKKAAEGGDEKKDEKEEKKDGKEEGGNGGGDEKKEEKEKEKEGGNADGEEKDKDKEKDPAAIAAANLYLHYPRFAFPAGYYPPGPGYAYPPPYPPSYPPPYQPSYPPYPSHPSHHPSQIFSDENPNACSVM

SEQ ID NO: 50876 - protein, 758 aa, Lactuca sativa
MSKTLASLGLISLLLVGVLAVDDDGSENGFGGCNCEVEGFFGYRNIMETQRVSDFLIAVAYFSIPIELLYFVSCSNVPFKWVLFQFIAFIVLCGMTHLLNGWTYEPHPFQLMLALTIFKFLTALVSFATAITLVTLIPLLLKVKVREFMLRKKTWDLGVEMGMIKKQKEAGWHVRMLTQEIRKSLDRHTILYTTLDKLSEILDLQNCAIWMPDNTKTVMNLTHQLKGGQSSTIIPIQNPEVQEIKQSEVVKLLDHESELGTLSSGGSEPPGAVAAIRMPMLRVSDFKGGTPEMIQACYAILVLVLPGGQIRSWTGPELEIVKVVADQVAVALSHAAVLEESQLMRDKLAEQNRALQQAKHDAMRASQARNLFQTVMSKSLRKPMHSIVGLLSLIQDDNLMNQQKVLIDSMVKTSNVLSMLIDDVMDDSSKERFPLEMRSFRLHSLIKEAAHLAKCLCVYKGYEFVMDVDKSLPDNVMGDERRVFQVILHMVGYLLNRGNGGGGMVLRILKESGSYGRNDQRWASWRSNSGDGYVSVKFEIGINDHDTKLERSFADERIRSGGVEQSLSFGMCRKLVEMMQGKIWVVPNPVGFDQAMSLILRFQLRPSIVIGISEAGESSDHNPLSNSIFRNLQVLLADEDDMNRAVTRKQLEKLGCIVSTVASGSDCIMALNQPVSSYQIILLDLHMSDVDGFEVAARIRKSRSRNWPLIVALTASGDADVWERCLQMGINGVIQKPVVLQGISDELRRVMVHTNKVH

SEQ ID NO: 50877 - protein, 266 aa, Mannheimia succiniciproducens MBEL55E
MVNTLLIHFLHRRIYMNLFDLTGKVALVTGCNTGLGQGMALGLAQAGCDIVGVNLVEPLDTKEKIEALGRKFVNIEANLMKQEGLTDVVEKAVSVFGKIDILVNNAGIIRREDAIDFSEQNWDDVININLKTVFFLSQLVAKQFIAQGHGGKIINVASMLSFQGGIRVPSYTASKSAIMGITRAMANEWAKYNINVNAVAPGYMATDNTAALRADEARSKEILDRIPAGRWGTPNDLVGPCVFLASAAGDYVNGYTVAVDGGWLAR

SEQ ID NO: 50878 - protein, 598 aa, Coprinopsis cinerea okayama7#130
MGAPPGISYLLRKVPPLLFPGLLAYATTHYVKRFTGISLPGWAVFLCVVLAKPLQFLVSTRYRRYLNEKEAQKLGAKMAPHVQESGLAIVSKLLEMFDRGYPGDTLQEWASKHGNIYETRLPTEGFVSDQTLHELKRLPIIELGTSTAQIWTTEPEHVKAILATEFENFPKESLFIEQMVSLLGDGIFSVNGEKWKFHRAMTRPFFTRDRISDFDIFDTHASKALTLAKERLEAGYPVDFQDLVGRFTLDSASVFLFDEDLESLSAGLAYPFNCSKENASNHQYREHPSNLFADAFLDAITKGTRRTFWGQEWPLAEFWSDVVKPGREVIDRFAEKVINGRLKKGGGAEFEERDTLLEHLLNKTTDTRMIKDELFSMLVAGRDTTSCTLSYAMYNMTQHPEVVARLREEVMEYVGPTKRPTYDDIKGMKYIRAFINEVLRLYPPVPLNWRQPQKSTVFKTKDGPRYYIPAKTTVRYSVWAMHRRKDLWGPDADKFDPDRFLDERLKEYLIPNPFIFVPFNAGPRICLGQQFAYNEVSFFLIRLLQQFSEFELAQDAQDPQFAPPASWAQCEGTKGTDKVMPGANLTLYIKGGLWVRMK

SEQ ID NO: 50879 - protein, 197 aa, Nicotiana tabacum
MSYWKDKVLPKIKKVFEKNGPKKAAAAEACEAFDVAKEQYSKEFDEKKTELQPKVVEIYEAAAAEIKTLVKEPKVAGLKKHSAGVQKFLDELVNIEFPGSKAVSEASSKFGPSYVSGPIIFVLEKVSTFVVTEDKKEEEAATAAAVETTGTVAEEVKEKDIVVEAGDEKKEEAEPATETTKVEEVPAAVATEPPKAA

SEQ ID NO: 50880 - protein, 322 aa, Novosphingobium aromaticivorans DSM 12444
MQVVAVDIGGTHARFAIAEVAEGRVVSLGEAVTLKTAEHGSFQLAWEDFERVRGEPLPKAAAIAVAGPVGGEIIKFTNNPWIIRPALIPEKLGAEQYVVVNDFAAVAHAVAQADQSHFLHLSGPDEPLPASGVTSVVGPGTGLGVAQLWRDGNNYRVQPTEGGHIDFAPLDSIEDAILAGLRKRHRRVSAERVVAGPGIVDIYEALALIEGRPFTPRSDRELWELGTSGADSLAAAAVDRFCLSLGSVAGDLALAHGANGVVMAGGLGLRIKDTLVRSGFSDRFRAKGRFEALMAAIPVKLITHPQPGLFGAAAAFAQAHTS

SEQ ID NO: 50881 - protein, 325 aa, Mycobacterium sp. JLS
MDFGDAAFAADVRAGVARIEDLMSTELGKADELMAEAVQHLFQAGGKRFRPLFTVLSARLGPEPDAWQVTVAGAVIELVHLATLYHDDVMDEAQVRRGAPSANARWGNNIAILAGDYLFATASRLVSRLGPEAVRIIADTFAQLVTGQMRETRGAVEGVDEIEHYLKVVYEKTACLIAASGRFGATFSGADETQIERLARLGGIVGTAFQISDDIIDIDSDPDESGKVPGTDLREGVHTLPVLYALRESGPDTDRLRELLARPVDNDDDLAEALRLLRRSPGMEQAKATVARYAQQARDELAALPDMPGRQALASLVDYTITRHG

SEQ ID NO: 50882 - protein, 469 aa, Shewanella violacea
MSAESVLQQLKELEVKFVDLRFTDTRGKEQHVSIPSHQVDEDFFEDGKMFDGSSINGWKGINESDMVLMPDPASFVLDPFTAETTANIRCDILNPGTMTGYNRDPRSIAKKAEEYLRSTGIADTVLLGPEPEFFLFDDVKYGADMSGCFYKVDAEEAAWNSGTSYEGGNKGHRPSVKGGYFPVAPVDSSQDIRSAMCLVLEEMGQVVEAHHHEVATAGQNEIATRFNTLTLKADEVQVLKYVVHNVAHAYGKTATFMPKPIVGDNGSGMHVHISLAKDGTNLFAGDKYGGLSEMAIYFIGGVIKHARAINAFSNPATNSYKRLIPHFETPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSNDFIDSYITLKSEDVERVNQTTHPVEFELYYSL

SEQ ID NO: 50883 - protein, 459 aa, Zea mays
  misc_feature (70)..(70): Xaa can be any naturally occurring amino acid
  misc_feature (79)..(79): Xaa can be any naturally occurring amino acid
  misc_feature (189)..(189): Xaa can be any naturally occurring amino acid
MEVFYYVVFGALAAVVAGLELGKSGKDRVATTSAFNSFKNNYVLVYSLMMSGDWLQGPYVYYLYSQYGLXKGDIGRLFXRGFSASLNLTDDSSFMSPSPRGRKRACVTYCISYILSCITKHSPEYRVLMIGRILGGIATSLLFSAFESWLVAEHNKRGFDPQWLSITFSKAIFLGNGLIAIVSGLFANXSAENLGFGPVASFDAAACFLAIGMAIIMSSWSENYGDPSESKDLMAQFKVAAKAIASDEKIALLGAIQSLFEGSMYTFVFLWTPALSPNEEDIPHGFIFATFMLSSMLGSSIASRLLARKLKVEGYMQIVFSISAVTLVLPVATNILVPTSSVKGGSVSIGGSLQLLGFCTFEACVGIFWPSIMKMRSQYIPEEARSTIMNFFRIPLNLFVCVVLYNVNAFPITVMFGMCSIFLFMAAILQRRLMVVSDQVHKSSTKAQEMIGEDEPLNP

SEQ ID NO: 50884 - protein, 378 aa, Burkholderia sp. 383
MAKRDYYEVLGVAKNAGDDEIKKAYRKLAMKYHPDRNPDNKDAEEHFKEVKEAYEMLSDGQKRAAYDQYGHAGVDPNMGGAGAQGFGGFADAFGDIFGDIFGQAAGGAARGGRGGPQVYRGADLRYSMEITLEQAAHGYDTQIRVPSWVSCEVCHGSGAKPGTKPETCPTCHGQGTVRMSQGFFSIQQTCPKCHGTGTYIPEPCVHCHGSGKVKETKTLEVKIPAGIDDGMRIRSAGNGEPGINGGPPGDLYVEIHIKPHSVFERDGDDLHCQMPIPFTTAALGGEIEVPTLAGRASFPVPEGTQSGKTFRLRGKGIKGLRSSIAGDLYVHVQVETPVKLTDNQRDLLKQFEKSLAEGGARHSPQSKSWFDRVKSFFE

SEQ ID NO: 50885 - protein, 104 aa, Chenopodium rubrum
PSVCTIVIWVASAPHAAVNFGQYPYAGYLPNRPTVSRRFMPQPGTPEYVELESDPEKAFLKTITAQFQTLLGVSLIEILSRHSSDEVYLGQRDTPQWTSACRRA

SEQ ID NO: 50886 - protein, 326 aa, Oryza sativa (japonica cultivar-group)
METLSMLKLASSALAAASPEEVAGKVVLVKGASSGIGEQVAYRYARKGARLALVARREASLGEVAARARALGSPDVLAVPGDVARPDDCRRFVQATVEHFGRLDHLVNNAGLANVCWFEEVPDVANFKQVLDVNFWGTVHPTHAALPHLKASRGKIFVNSSASAVLAMPRMSFYNASKAAVHNFAETLRMELHGEVGVTVATPGWVDSEMTKGKHLSSHGAMEVDQDTRDAQVGVFPVERGERCAEAIVDAVARGRRRVTSPAWYGALFLWRTMAPEVADACQRVFYHRRSSAAGGGGRARAALEATGAKAVLQPPSLRSSEIKVE

SEQ ID NO: 50887 - protein, 352 aa, Triticum aestivum
MAERRSSYRDGDRQRAAAEAGRYWRPPRSQAHGGGNVSVPLWEKKFCTDACSIPWGKLCEAKKLMSLYTNIVDWDDSAAFEAFKDAKDRFCAAYHGQPCYIPLPDPDMYIDMVNPDEYIDPELVADLERSRRRAPRRDSTAPNGWDSFIFADKPVPATGWGDGETTNTIGQQCSVNWDNHVEQLVEANCKQSSVNWDSYVSQPAETFVQQSSGNWDAYVEQQGQTSGWGAPIIPCTSNWGMNGDPWNHDYGWGSSAIQTDSWGDQKDSYYVPDSQAQGSSDGHWRRRNSQSGRRNSRNRDRGGPISSKAMKSKYQADEHGGANNGWRHCRVRDNMQYSYEQPGYAANQSLAM

SEQ ID NO: 50888 - protein, 642 aa, Arabidopsis thaliana
MSSTFRAPAGAATVFTADQKIRLGRLDALRSSHSVFLGRYGRGGVPVPPSASSSSSSPIQAVSTPAKPETATKRSKVEIIKEKSNFIRYPLNEELLTEAPNVNESAVQLIKFHGSYQQYNREERGGRSYSFMLRTKNPSGKVPNQLYLTMDDLADEFGIGTLRLTTRQTFQLHGVLKQNLKTVMSSIIKNMGSTLGACGDLNRNVLAPAAPYVKKDYLFAQETADNIAALLSPQSGFYYDMWVDGEQFMTAEPPEVVKARNDNSHGTNFVDSPEPIYGTQFLPRKFKVAVTVPTDNSVDLLTNDIGVVVVSDENGEPQGFNIYVGGGMGRTHRMESTFARLAEPIGYVPKEDILYAVKAIVVTQREHGRRDDRKYSRMKYLISSWGIEKFRDVVEQYYGKKFEPSRELPEWEFKSYLGWHEQGDGTWFCGLHVDSGRVGGIMKKTLREVIEKYKIDVRITPNQNIVLCDIKTEWKRPITTVLAQAGLLQPEFVDPLNQTAMACPAFPLCPLAITEAERGIPSILKRVRAMFEKVGLDYDESVVIRVTGCPNGCARPYMAELGLVGDGPNSYQVWLGGTPNLTQIARSFMDKVKVHDLEKVCEPLFYHWKLERQTKESFGEYTTRMGFEKLKELIDTYKGVSQ

SEQ ID NO: 50889 - protein, 314 aa, Mannheimia succiniciproducens MBEL55E
MIMKKIAILGECMIELNGEPFGRMRQTYGGDSLNTATYLARVSRREQFEISYVSALGKDKLSLGMLAHWRNDGINTDCVLLDEKRQPGLYLIQLDEKGERTFLYWRNQSAARYLLQHEGYTEVLARLATADMIYLSGISLAILPENDRTLLIRQLGNLKKAGVKIAFDSNYRPALWDSFQQTQACYQALLPLVDLALVTFDDEQSLWRDENVQQTISRLVQLGVGTVVVKSGEHGAVFYHNGETQQVATEVVQRVVDTTSAGDAFNAGFLNGYLQQKSLVDCCRQGNKLAGIVIQHKGAIIDKTATQHFIREFN

SEQ ID NO: 50890 - protein, 525 aa, Zea mays
MERVLKDDAVEEKGERARMASFVGAMAISDLVKTTLGPKGMDKILQSTGRGRNVTVTNDGATILKSLHIDNPAAKVLVDISKVQDDEVGDGTTSVVVLAGELLKEAEKLINMKIHPMTIIAGYRMALECARDSLLKKTMDNKENTDKFRSDLMNIAMTTLSSKILSQDKEYFAELAVDAVLRLKGSTNLESIQILKKPGGSLKDSFLDEGFILDKKIGIGQPKRIENAKILVANTAMDTDKVKIYGARVRVDSMSKVADIEAAEKQKMREKVQKIIAHGINCFVNRQLIYNFPEELFADAGILAIEHADFEGIERLALVTGGEIASTFDNPESVKLGQCKVIEEIMIGEDRLIHFSGVAMGQACTIVLRGASEHVLDEAERSLHDALCVLSQTVNDTRVLFGGGWPEMVMAKEVVELARKTPGKKSHAIDAFSHALQAIPTIIADNAGLDSADLISQLRAEHHKENSTAGIDVITGTVGDMQKLGIQESFKVKQAILLSATEAAEMILRVDEIITCAPRRREDRM

SEQ ID NO: 50891 - protein, 572 aa, Salmonella typhimurium
MSMSEKHPGPLVVEGKLSDAERMKLESNYLRGTIAEDLNDGLTGGFKGDNFLLIRFHGMYQQDDRDIRAERAAQKLEPRHAMLLRCRLPGGVITTTQWQAIDKFAADNTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGLETFKAEVERRAGIKFEPIRPYEFTGRGDRIGWVKGIDDKWHLTLFIENGRILDYPGRPLKTGLLEIAKIHQGEFRITANQNLIIASVPESQKAKIETLARDHGLMNAVKPQRENSMACVSFPTCPLAMAEAERFLPSFTDKVEAILEKHGIPDEHIVMRVTGCPNGCGRAMLAEIGLVGKAPGRYNLHLGGNRIGSRIPRMYKENIAEPDILASLDELIGRWAKEREAGEGFGDFTVRAGIIRPVLDPARDFWE

SEQ ID NO: 50892 - protein, 333 aa, Oryza sativa (japonica cultivar-group)
MEGQGAPAAPGGKGSAIVVVDSHLHVWASPQQAAERYPYFPGQEPPIRGDVDLLLQCMDEAGVDGALIVQPINHMFDHSLVTSVLKKYPSKFIGCCLANPADDGSGIKQLEHLIVQEKYRAVRFNPNLWPSGQKMTNEVGRSLFAKAGELGAPVGIMVMKFLPADSNICISQALNGTTMITNVKFFCMEGISTYIQEIEELCTDYPKTTVIFDHMAFCKPPMNIEEEKAFTSFLELSRFPQIYVKYSALFRISREAYPYEDTSQLLSRVISSYGANRIMWGSDFPFVVPECGYKGAKEAISHVAGKIPVSSSDLEWILGKTVTQLFQGAWVSA

SEQ ID NO: 50893 - protein, 395 aa, Arabidopsis thaliana
MKENKNCDNKIVQKYILAIEKLSLNQVHFHTKEQTVSIFARVSRLYYPTLNLVSKSFRCLLASPELYKVRSLLGNTESCLYVCSRFQDRHTNTTWFTLCRKPDQTLTNGTIKKSSGYVLARVSNLHSPPLHSSSLVAVGSNIYNIAGSSYLESSSSVSILDCRSHTWREAPSLREGLCSVSSSVLDRKIYVAGSCLDGDSYTYKNSFEVFDTETQFWDPDTITCSKTEGDFYGCGTACIDGEFHVVPVGQKREAVAYNSKEGRWDMVGQQMDHYKFSASCEIQNVLYSCTHGVFRWYDTNAMMWRDLKGLVGLPMFGSGANVKLADYGGKLTVLWEEELPSRGPDSGYKKMIRCAEIALERRKSCEIWGIVEWFGDVLTEPVGYVVLEKVLDVTL

SEQ ID NO: 50894 - protein, 495 aa, Nocardia farcinica IFM 10152
MAISSPRRRSSLLRTKSVEQSIRDTDEPDSKLRKDLTAWDLTIFGVAVVVGAGIFTLTARTAGNVAGPSVSLAFVFAAIACGLTALCYAEFASTVPVAGSAYTFSYATFGELAAWIIGWDLFLEFALAVSVVSKGWSQYLGEVLNITPIVDLGGLDFDWGAVLLIAVLCVLLAMGTKLSSRVSAIAVAIKLAVIALVIAVGLAYFDTDNLSPYIPPSEAGQGGEGIHQSLFSYLTGAGNSTFGWYGLLAAASLVFFAFIGFDVVATTAEETKNPQRNVPRGILGSLAVVTVLYVAVSLVLTGMVSYTELSGENATLATAFGLHGVTWAEKIIAVGALAGLTTVVMVLYLGQTRVLFAMSRDGLLPRPLAHTGRHGTPVRLTIIVGVACAVLAGFVDMGALEEMVNIGTLFAFVLVAIGVIILRRTRPDLPRGFRVPLVPLVPILAVLACLWLMVNLTVETWIRFIIWMALGLIIYFAYSRRNSLLGKEEVSLRKE

SEQ ID NO: 50895 - protein, 307 aa, Gossypium hirsutum
MQPTWLLALSFLGFLSFLTRSISLLNWVFTTFFRSPKNLNNYGSWALITGATDGIGKAFANQLARQGLNLILVSRNLNKLKTVSAEIRAQFPHLKIKVVAQDFSGNISAGAGLIEEAVKGVEVGVLINNVGITYPRAMYFHEVEEEVVKGIIRVNLKGTTWVTRAVLPGMLNRKRGAIVNVGSGASIVVPSHPLYTIYAATKAYIDKLSRSLYVEYKLRGIDVQCQVPLYVATNLASKVASIEKSSMFVPSPEDYAKAAIRQIGYEPRCTPYWSHAVQWCFARLLPDVLLDAWRLSIALRRRAEVLA

SEQ ID NO: 50896 - protein, 459 aa, Bacillus anthracis str. Ames
MSKLVVIGGGPAGYVAAITAAQNGKNVTLIDEADLGGTCLNVGCMPTKSLLESAEVHDIVRKSNHYGVTLNNGSISIDWKQMQVRKSQIVTQLVQGIQYLMKKNKIKVIQGKAKFETDHRVRVTYGDKEIVVDGEQFIIATGSEPTELPFAPFDGKWILNSTHAMSLKNIPKSLLIVGGGVIGCEFASIYSRLGTKVTIVEMAPQLLPGEDEDIAHILRGKLENDGVKIFTGATLKGLNSYKKQALFEYEGGIQEVNPEFVLVSVGRKPRVQQLNLEKAGIQYSNKGISVNEHMQTNVSHIYAAGDVIGGIQLAHVAFHEGTTAALYASGEDVKVNYHAVPRCIYTAPEIASVGLTEKDAKEQYGDIQIGEFPFTANGKALIIGEQTGKVKVIVEPKYQEIVGISIIGPRATELIGQGTVMIHTEVTADIMRDYIAAHPTLSESIHEALLQAVGHAVHA

SEQ ID NO: 50897 - protein, 469 aa, Shewanella benthica
MSAESVLQQLKELEVKFVDLRFTDTRGKEQHVSIPSHQVDEDFFEDGKMFDGSSINGWKGINESDMVLMPDPESFVLDPFTADTTAIIRCDILNPGTMTGYNRDPRSIAKKAEEYLRSTGIADTVLLGPEPEFFLFDDVKYGSDMSGCFYKLDAEEASWNSGTSYEGGNTGHRPSVKGGYFPVPPVDSSQDIRSAMCLILEEMGQVVEAHHHEVATAGQNEIATRFNTLTLKADEVQVLKYVVHNVAHVYGKTATFMPKPIVGDNGSGMHVHISLAKDGTNLFAGDKYGGLSELAIYFIGGVIKHARAINAFSNPATNSYKRLIPHFEAPVMLAYSAANRSASIRIPLVPSPKGRRIELRFGDPMANPYLAFSAMLMAGLDGIQNKIHPGEAMDKDLYDLPPEEAAEIPTVATSLENALECLDADREFLTRGEVFSSDFIDSYITLKTEDVERVNQTTHPVEFELYYSL

SEQ ID NO: 50898 - protein, 398 aa, Bacillus anthracis str. Ames
MAVEVVMPKLGMAMKEGIITSWNIKAGDNVAKGELIASINSEKIETEIEAPADGTILDIAVSEDEGVPPGTVICYIGKPNEKVEVHESTKVEEELTASEVPQNVQHPEPLGKEVTNKQRIKISPVAKKIAKTENLDIRALLGTGPGGRITKVDVLKALEERVAIPEVLEESKVLPVTGMRKAIANRMHASLQNSAQLTLTMKVDVTDLVALHKEIAEVVQKRYDNKLTITDFVSRAVVLALGEHKEMNSAYIDDAIHQFEHVHLGMAVALEKGLVVPAIRFANNLSLVELSKEIKNAAQKARAGNLNSDDMQGTTFTISNLGSFGIEYFTPVLNTPETGILGVGAIEHVPVYKGKKLKKGSMLPLSLTFDHRVLDGAPAAAFLRTIKRYLEEPVTILL

SEQ ID NO: 50899 - protein, 461 aa, Novosphingobium aromaticivorans DSM 12444
MAIELKMPALSPTMEEGTLAKWLVKAGDEVRSGDILAEIETDKATMEFEAVDEGVIAEILVAEGTEGVKVGTVIATIQGEGEDAAPAAATPAVEQKVEMSEAAPSVEARAAPAVAIAPKVDAKPAVDPEIPAGTAMVPTTVREALRDAMAEEMRADDRVFVMGEEVAEYQGAYKVTQGLLDEFGPRRVIDTPITEYGFAGIGAGAAMGGLRPIIEFMTFNFAMQAIDHIINSAAKTNYMSGGQMRCPIVFRGPNGAASRVGAQHSQNYGPWYANVPGLVVIAPYDSADAKGLMKAAIRSEDPVVFLENELVYGRTFDVPQMDDFVLPIGKARIVRQGKDVTIVSYSIGVGLALEAAETLAAEGIDAEVIDLRTLRPLDKDTVLASLAKTNRLVVAEEGFPVCSIASEIMAICMEDGFDHLDAPVLRVCDEDVPLPYAANLEKAALIDAGKIAAAVRKVCYR

SEQ ID NO: 50900 - protein, 1255 aa, Ustilago maydis 521
MKRSTLSSVLALFAAATATLAYEYPHVPADKTTPSQIRLSFKSLNAVSVAWNTYEKINKPCVAYGTSASNLNKRACSSTSETYPTSRTWFNNVILDNLAPSTTYFYSIDSSNSSTQSFKSARRPGDTSPFACNAVIDMGVYGLDGYTTTKKRDIPFIPPSLTHSTIDQLAQSVDLYDFVIHPGDFAYADDWFLRPQNLLNGKDAYAAITELFFNQLSSISSVKPYMAGPGNHEAACQEVLYYQGACPEGQYNFTDFSHRFAPNMPTTFVSQSKVSAAKASATLARSLALPPFWYSFDYGMVHFISIDTETDFPSAPDTPKLGAGPYGRANQQLDFLKADLASVDRKVTPWVVAMGHRPWYSTGGNDNICSECQAAFEDLFYQYGVDLFVAGHVHNLQRHQPIYKGTVDAANLNDPKAPWYIVAGAAGNIEGLEGFNTQPSYTVFADNVHNGYARLTFQDVNHLKVEMIHSTDGGVLDSAILYKKHADQFVRQPLPASTKKRSLLNSLFNIGGSSIRRDSIWCNAFCDAVNAFVLQLTTVCAVAVRLSSRTPLSPTPRAATPARLIASSSTKREQLQACKTHNHQEPPQSAVLSEEPQKLGKRARKALKARERQEQGSIAKAAKESARSEALEMESARLNQQGDTIAVHVKPVLKVKHVMNAAEHTMPETATQDKELELRRVKMETQYHGDPTTRWSGSLFRSHISSLLSGFGTSPSTRPLQENDLPTASSATVPWASLDSTSKDSDTNRSDIDNSSTSSRFRKDMPSSSTSMSKSERMESQARVIFHAIREARERGMVDEDESFFYPYPEGVPPKDLDGKDTVWLNLGPDPEAWGRELPQVKDKWLEVLSLGLAKEINDQASTPSSAPFEDADGGQEGEEQHPREDQIAFNDLVEDYDLEDHERLEQLGDSIVNMSSRLLAYLSYPDVNEGSLTRLSNYPTQNNFLALLFRECGLAARRDELCRELRGQHGHDDDASTTQKQACRKCTRTRQTDEEMAQLPLLIKRDADMFEAYAAAVFLSHGNDFNVVHNWLCHLFRPFQDQAYRFMVQRSEALARMQANRAAAAAASAAEASLALRSRNSIAGSPTNLAADGLGLNSATIDPSSVRFSSLFPDFSRGSEKKSAIPAYALANTDQAFITDEFLTVAARARRQREERLREELRLQDQQELMKMGWFRKGFLNLRTGFRQYVMGKDMVKEQEARLKRKINEQRGMSEKNRQRLRARERSEAGVSVKSTASKMKEKIFEANANQENQ

SEQ ID NO: 50901 - protein, 344 aa, Bacillus anthracis str. Ames
MTRTVSMSTAINEAMKISMRRDENVILIGEDVAGGAQVDHLQDDEAWGGVLGVTKGLVQEFGRNRILDTPISEAGYMGAAMAAAATGLRPIAELMFNDFIGSCLDQVLNQGAKFRYMFGGKAKVPVTVRTMHGAGFSAAAQHSQSLYALFTSIPGIKVVVPSTPYDAKGLLLAAIEDDDPVIFFEDKTLYNMKGEVPEGYYTIPLGKADIKREGSDVTIVAIGKQVHTALAAAEQLAKKGLEVEVIDPRSLSPLDEDTILSSVEKTNRLIVIDEANPRCSIATDIAAIVADRGFDLLDAPIKRITAPHTPVPFSPPLEKLYLPTPEKVIETVSEMIGDQSLLHV

SEQ ID NO: 50902 - protein, 332 aa, Bacillus anthracis str. Ames
MLKTTESKENEITKEQARWMYEKMLEIRKFEDKVHELFAQGVLPGFVHLYAGEEAVAVGVCAHLTDSDSITSTHRGHGHCIAKGCDLNGMMAELFGKATGLCKGKGGSMHIADLDKGMLGANGIVGGGFPLACGSALTAKYKGTKDVSVCFFGDGANNEGTFHEGVNLAAIWKLPVIFIAENNGYGEATTFEYASSCDSIADRAKAYNIPGVQVDGKDLLAVYKAAEEAVERARNGDGPTIIECMTYRNYGHFEGEAQTYKTSEEKEEHLNEKDAIVNFRKHLIHEALLTESELVDMEKAVDEAVQKSIEFSENSPYPEDEELLKDVYVSYK

SEQ ID NO: 50903 - protein, 454 aa, Geobacillus kaustophilus HTA426
MAQLETNTSVESLGYKQELKRSLTFVDLLIYGMVFMVPIAPFGIYGYVAQGSKGMVALAYLIGMVGMIFTALSYARMAEAFPIAGSVYSYAQRGMNEYVGFMAGWVILLDYIFVPALLYLVSAAALADIVPQVPISVWLVLFIAMNTVINILGIEMTAKANKVIVVLELIVLAVFVITGIIAIIKGVNGAQFTFKPLYDPNHFSAETVMGAVSVAVLSFLGFDAVSTLAEETRDGKSSIGKAIIFALLVVGALFIVQTWVAALIWPDYTTFKNADVAFYQIAELAGGPWLKWTTIVATALSWGIANALVAQAAISRILYSMGRDRKLPSVLAKVHPKFQTPYVSTLLVAVISLIVTTVFASQIDKLASLVNFGALTAFLFLHVSVMNYFLRKQKSNDYINHLLFPLIGFVIIGYVWMNLDPLSKKLGLIWIAIGLVYLVFLRLTNKDSRLSGEL

SEQ ID NO: 50904 - protein, 454 aa, Zea mays
MAARKKKPLLIACQATSARITRSQAAANSTRSGLAPSVPVPLKTEHNHPAKKKMKREASDENASADAGASAPLPKRRTVLKNVTNISCAKISKRCTAVTGLKLGPSQKAGQSINKQCTNKISMLLPLAVGGSSLVDDSNNAEETQMVDLLAQKEKQIVLLKEAQPLQNTEQNKGGACDEASVEERNAMNVHETAALKAGVSNGLNIVDIDKNNGDPQMCVTYVAEIYRNLWPAEVSDEYKLVADTLYLTVYLIDQFLSQNCIQTHKLQLLGITSMLIASKYEEYSAPSAEEFCNITAGTYAKAEVLEMEQQVLNDLGFHLSVPTTNTFLRRFLRAAQASRTAHLTTLNYLASYLAELTLISYDFMKFLPSEVAASSIFLAKWTLDQSDHPWNPTLEHYTSYKSFDIRTCVRALQELQHNTSNCPLNAIREKYGQQKFECVANLRSPELLRSLFS

SEQ ID NO: 50905 - protein, 366 aa, Triticum aestivum
MAHRHHLLLLLPLLALAVSFVVAAPEGHGDSAAFIDGASHRYLRDQQDDQATSMSLDEVSAAVSVLLGFAPPAMLPLPSSAKLNKLLLPKPFDRPRAVFLMQIDGSHDSVDSFISDAGSIYKTKIDGANNAATGLTDKDELIVICSDESSGSDVLDNELTDLATWLEGSYQKADGKLNIPLKSGNSLTLLLNKEVDVEFASSLISLLKTIKRGIQVHEDFSGGIVSPAELLVCRFTGIKALEDEYGSAEIVKQGAEVVRTALTKAFDQLQGAYNGKIVGLVISTEEASTSLASIIDGPSSLHISRRLAEASKTNATASIAAIYLVRLSLAWITGIILLVSTLIGICLLMNMPLTRDTLLYSNVKMD

SEQ ID NO: 50906 - protein, 356 aa, Glycine max
MFTLTSPSSRALPMDSLPKLRHPSPFPTPLSSSLSFRSLPPPHFPSSSFRLPSIRASSSPSQNDPAFRTPRNTPSLPPLLQTLTSFLSPLLETTCIVIAAAAFFFMRFHHTPAVIAAPLTSPAAETDTAFTQEEAERLLEERLSTNPRDTEALHALMEVKIKARKMDEAFEVLNRLIELEPEEQEWPLLKANMHIYNDDHASARKLFEEILKKDPLRVEAFHGLVMATAQSNEPLKSLLKRVEEAIEVCKKQKKDSDVRDFRLLIAQIKVMEGDYTEALKAYQELVKEEPRDFRPYLCQGIIYTLLRKKDEADKQFNKFRRLVPKDHPYKDYFEDNMFATKFFSQKLEREGAGARG

SEQ ID NO: 50907 - protein, 577 aa, Streptococcus agalactiae 2603V/R
MTEMLKGIAASDGVAVAKAYLLVQPDLSFETVTVEDTNAEEARLDVALQASQDELSVIREKAVESLGEEAAAVFDAHLMVLSDPEMINQIKETIRAKQVNAETGLKEVTDMFITIFEGMEDNPYMQERAADIRDVAKRVLAHLLGVKLPNPATINEESIVIAHDLTPSDTAQLNKQFVKAFVTNIGGRTSHSAIMARTLEIAAVLGTNDITERVQDGQLIAVNGITGEVIIEPTEAQISAFKAAGEAYAKQKAEWALLKDAQTVTADGKHFELAANIGTPKDVEGVNENGAEAVGLYRTEFLYMDSQDFPTEDEQYEAYKAVLEGMNGKPVVVRTMDIGGDKELPYFDLPKEMNPFLGFRALRISISETGDAMFRTQIRALLRASVHGQLRIMFPMVALLKEFRAAKAIFEEEKANLLADGVAVAEGIEVGIMIEIPAAAMLADQFAKEVDFFSIGTNDLIQYTMAADRMNEQVSYLYQPYNPSILRLINNVIKAAHAEGKWAGMCGEMAGDQTAVPLLVGMGLDEFSMSATSVLRTRSLMKKLDTAKMEEYANRALSECSTMEEVIELQKEYVDFD

SEQ ID NO: 50908 - protein, 475 aa, Streptococcus agalactiae 2603V/R
MTKEYQNYVNGEWKSSVNQIEILSPIDDSSLGFVPAMTREEVDHAMKAGREALPAWAALTVYERAQYLHKAADIIERDKEEIATVLAKEISKAYNASVTEVVRTADLIRYAAEEGIRLSTSADEGGKMDASTGHKLAVIRRQPVGIVLAIAPYNYPVNLSGSKIAPALIGGNVVMFKPPTQGSVSGLVLAKAFAEAGLPAGVFNTITGRGSEIGDYIVEHEEVNFINFTGSTPVGKRIGKLAGMRPIMLELGGKDAGVVLADADLDNAAKQIVAGAYDYSGQRCTAIKRVLVVEEVADELAEKISENVAKLSVGDPFDNATVTPVIDDNSADFIESLVVDARQKGAKELNEFKRDGRLLTPGLFDHVTLDMKLAWEEPFGPILPIIRVKDAEEAVAIANKSDFGLQSSVFTRDFQKAFDIANKLEVGTVHINNKTGRGPDNFPFLGLKGSGAGVQGIRYSIEAMTNVKSIVFDMK

SEQ ID NO: 50909 - protein, 528 aa, Saccharomyces cerevisiae
MSYNNGNTYSKSYSRNNKRPLFGKRSPNPQSLARPPPPKRIRTDSGYQSNMDNISSHRVNSNDQPGHTKSRGNNNLSRYNDTSFQTSSRYQGSRYNNNNTSYENRPKSIKRDETKAEFLSHLPKGPKSVEKSRYNNSSNTSNDIKNGYHASKYYNHKGQEGRSVIAKKVPVSVLTQQRSTSVYLRIMQVGEGTYGKVYKAKNTNTEKLVALKKLRLQGEREGFPITSIREIKLLQSFDHPNVSTIKEIMVESQKTVYMIFEYADNDLSGLLLNKEVQISHSQCKHLFKQLLLGMEYLHDNKILHRDVKGSNILIDNQGNLKITDFGLARKMNSRADYTNRVITLWYRPPELLLGTTNYGTEVDMWGCGCLLVELFNKTAIFQGSNELEQIESIFKIMGTPTINSWPTLYDMPWFFMIMPQQTTKYVNNFSEKFKSVLPSSKCLQLAINLLCYDQTKRFSATEALQSDYFKEEPKPEPLVLDGLVSCHEYEVKLARKQKRPNILSTNTNNKGNGNSNNNNNNNNDDDDK

SEQ ID NO: 50910 - protein, 168 aa, Glycine max
  misc_feature (49)..(49): Xaa can be any naturally occurring amino acid
  misc_feature (145)..(145): Xaa can be any naturally occurring amino acid
MIYSPSVTTVNRAGADMGATFTDLNSMAGFPIIKTNNDITSIDTNNGRXQCIQVWPPIGNKKFETLSYLPYLDDAQLAKEVEYLLKKGWIPCLEFKSEHGFLCREHNKTPGYYYRRYCTMWKLPIEGCTDANNVVEEDKHDKTAXPNWLISIFRNDNEMQVHCISVNY

SEQ ID NO: 50911 - protein, 154 aa, Thermoplasma volcanium GSS1
MGRLPNIRGDIVIEVKEPKRIPFVGMLQGMFTVFKHLFKKPITVQYPEEKAYTPPRFKFRIFLSMDDCVGCTLCEQVCPNLSIRMIVVERNNPHNKRNLYPQVNFGTCTVCRNCEEICPTEAIYLTHELETARTRNNFFYSPQELEKTEEEVKK

SEQ ID NO: 50912 - protein, 223 aa, Chenopodium rubrum
ALLLLLSVSQDPYFEWIHWPQASIPFSEDELAYIESLNPDKDCEMLRTELPMIREACLRILVLCTIFLKEAAAFGLCLAEIGEMMSREFRSGEEEPSELELVCIEARRLVEERELFVPESEAGEDEFLFDIDCEDPEWDCTPKMGNGEDYFIRSPVFGVNGRNPLSKLEESLEEEEESEDGDQDGEVELEGKGLSIPWSQKYPSMSMISMSLKNTSLGEKSQK

SEQ ID NO: 50913 - protein, 367 aa, Thermoplasma volcanium GSS1
MEEWTEVNFGPQHPSMHGVLRLKVKLDGEIVKDVEPIIGYLHRNAEKICELQFYCDNMIYFDRMDYVAAMNMEIGYLEAAEKLLDVEPPGRAKWIRVMMGELNRIASHLVWLGAFGLDLGMLTPFFYCFKEREKILKIFTEVSGSRQQLNYMSIGGVYQDVTDEALDHIKQFITEFPKELNMIANLFVKNDIFLSRTKGVGILSKEMAIDYGVTGPMLRASGVEYDVRKAEPYLVYDKVNFDIPVSFKGDNLARFLVRIEEMRQSVKIIDQTIQKLPAGPYFNQKAKKPLMIRLRGQGEVYARTESPKGEFGVYIVGDGSLRPYRVRVRSPTFKNLSVLPALAKGQMIADLISIGGSIDLVFGEVDR

SEQ ID NO: 50914 - protein, 151 aa, Thermoplasma volcanium GSS1
MVDILGEEKGKDGRRIIKVAKENLLALMRDLKAQGYNLSLTTGVDYVDHIEVVYHLYNLEKNEYIIVKTETTDNHVPSLTPLWNAANWDEREEYDLVGIVFDGHPYLKRLFLPEGWVGHPLRKNYDLSKAQYVNMDEEGNDYVTFDPEGGW

SEQ ID NO: 50915 - protein, 508 aa, Yersinia pestis CO92
MSGKHSAETHHAAKKRWLDSHDTGYHKSMGLRHIQMIAIGGSIGTGLFLGTGARLQMAGPALALVYLVCGIFSFFILRALGELVLHRPTSGSFVSYAREFLGEKASYVAGWMYFLNWAMTGIVDITAVALYMHYWGTFSDVPQWLFALGALSIVATMNMIGVRWFAEMEFWFALIKVAAIALFLIVGVIFLGTGQSVAGHTTGIHLITDNGGFFPHGLLPALIMVQGVIFAFAGIELIGTAAGECKDPEKMLPKAINSVIWRIGLFYVGSVVLLVCLLPWHAYQAGQSPFVTFFSNLGVPYIGTIMNIVVLSAALSSLNSGLYSTGRILRSLSMGGSAPKFMSKMSPQSVPYAGILVTVGIYVLGVLLNYLVPSQVFEIVLNIASLGIISSWAFIIICQMKLRQAIKRGMAKPVSFKMPGAPVTSWLTLIFLAGVLVMMAFDYPNGTWTIASIPVLTLLLIAGWFSLRKRANEVAAAPIDVWSQEILFEEPDAQNVSPKELYEQKSVG

SEQ ID NO: 50916 - protein, 301 aa, Corynebacterium glutamicum ATCC 13032
MSTGLTAKTGVEHFGTVGVAMVTPFTESGDIDIAAGREVAAYLVDKGLDSLVLAGTTGESPTTTAAEKLELLKAVREEVGDRAKLIAGVGTNNTRTSVELAEAAASAGADGLLVVTPYYSKPSQEGLLAHFGAIAAATEVPICLYDIPGRSGIPIESDTMRRLSELPTILAVKDAKGDLVAATSLIKETGLAWYSGDDPLNLVWLALGGSGFISVIGHAAPTALRELYTSFEEGDLVRAREINAKLSPLVAAQGRLGGVSLAKAALRLQGINVGDPRLPIMAPNEQELEALREDMKKAGVL

SEQ ID NO: 50917 - protein, 435 aa, Mannheimia succiniciproducens MBEL55E
MNNNLLYSVEDKPPFGLSLLLAAQHLLAALGGIIAVPLVIGNVLKLPTEDTITLVNAALLISGVVTIIQCRGIGPIGIRLPSVMGTSFTFVAAALAIGFSEYGVAGIMGASLVGSLVMIIGSFFMPYIRKLFPPVVTGTVVMMIGLSLIPVAVDWFAGGQVGDENYATPENLLMATFVLVIVVTLVQWGKGIFSAAAIVIGMMTGYVVALCLGWVSFDGVNNAQTFAVPQPLHFGLAFPISGIIGMSIAYLVTIVESSGNFLALGNATQTEITGKHLRGGVLCDGLGSALAAIMSTTPFSSFSQNIGVISLTGVASRHVVALTGVLLALAGLFPVFGALIVSIPLPVLGGAGLMMFAMIIAAGIQMLDNIPRSKRNGLIIAISIGCGLAVTTRPELLDKLPHFFKEVLGSGITVGSLLALILNLILPEDKIPENH

SEQ ID NO: 50918 - protein, 114 aa, Methylococcus capsulatus str. Bath
MSQCIFCQMVAGTIKPAVVHEDELTLAFRDINPQAPVHVLVIPKAHVANLNELPADAPGLATALFETVKRVAALEGIAESGYRTVVNCLGDAGQAVDHLHLHVLGGRRLHWPPG

SEQ ID NO: 50919 - protein, 340 aa, Yersinia pestis CO92
MEITDMPTDDSNNGIIDYVSTGHLPDPETVVKLVQEAHKRFSTDTAGVVSNVYPALERIPADLFGICMVGTNGKIHSAGDVDYEFTIMSVSKPFVFALVCQAIGAKTAREKLGVNSTGMAFNSVTAIERASDGRTNPMVNSGAIATTSLVPGATSDEQWKFIYDGLCRFAGRELTLNEEVYQSACETNFRNRGIANVLQGYGRLGCDPIIATDLYTRQCSLNVSARDLAVMGATLADGGVNPLTRERVVDNDICHYALAVMVTAGLYETSGDWLYDIGLPGKSGIGGGIVTVSPGKGGLGTFAPLLDSAGNSIKGQLAARFLSRSLGMDMFVSEPYTEKN

SEQ ID NO: 50920 - protein, 223 aa, Arabidopsis thaliana
MATEDVQDPRIAKIASSIRVIPDFPKPGIMFQDITTLLLDTEAFKDTIALFVDRYKDKGISVVAGVEARGFIFGPPIALAIGAKFVPMRKPKKLPVTRNVLSHLETYEQCQIIVAFLVYPWTLISKLPLHLVPLTGKVISEEYSLEYGTDTIEMHVGAVEPGERAIIIDDLIATGGTLAAAIRLLERVGVKIVECACVIELPELKGKEKLGETSLFVLVKSAA

SEQ ID NO: 50921 - protein, 428 aa, Nocardia farcinica IFM 10152
MAIIEQVGAREILDSRGNPTVEVEIALDDGTLTRAAVPSGASTGEHEAVELRDGGDRYNGKGVLKAVEGVLDEIAPAVIGLDAVEQRTVDQVLLDLDGTPDKSRLGANALLGVSLAVARAAAESSGLELFRYLGGPNAHVLPVPMMNILNGGAHADTGVDVQEFMVAPIGAPTFKESLRWGAEVYHALKAVLKSKGLSTGLGDEGGFAPDVAGTREALDLIAQAIAKTGLKLGSDVALALDVAATEFYTSGSGYKFEGTVRSAEEMAQFYSELLGAYPLVSIEDPLSEDDWDGWVALTDQIGDKIQLVGDDLFVTNPERLEDGIAKGAANALLVKVNQIGTLTETLDAVELAHRNGYKTMMSHRSGETEDTTIADLAVAVGSGQIKTGAPARSERVAKYNQLLRIEDALGDSARYAGDVAFPRFVFDG

SEQ ID NO: 50922 - protein, 212 aa, Rickettsia conorii
MTTQKIVPTKSTDGSKLFRHQAKFVAGAMNINQILNFSLPEIAFVGKSNVGKSSLINTICNNKNLAKVSNTPGRTRQINFFNLADKLIIVDLPGYGFANVPISVKEQWGVLISYYLRNSYNLRLVNLLIDSRRGIKENDKKVADLLLANKREFQIIFTKSDKVTDHKNLHDEAQNFLATLNYSCNVMYVSNRSKEGARELKASLAKCIKPQK

SEQ ID NO: 50923 - protein, 489 aa, Nocardia farcinica IFM 10152
MVLFEVDPAAYVPRAADDSVEAPADVAPAPALPDETVPLPIPGWPERPGDDAASIAAVPMPAHLGDWERRVLADPDLLADIAFAVGTPFHLLAPARVRANIAAFQVAFTTAGVDGYVYYGKKANKAACVARACAEQGAGVDVASVGELTAALAQGVRGPELMVTGPAKSDELLWLATRHGAVVAVDAVDELERMVAAGFDTRVLLRVLPPASDSRFGMTDEELDRALTLLAGTRIRLAGFSFHLGGYEASARAELAAVLVERCVRARAEGHAADTISIGGGFGVDYVPAQAWAAFTAAAGPAWFHAGKSFDSYYPYHFPVPGAAMLAEILRHGGLAELLRGNGIRLAIEPGRALLDRAGCTVFGVRGAKTRHAHGRPYRLLTVDGTSLSLSEQWFASEFLPDPLLWPTRPGAPTPTCVGATSCLESDMLSWRRIPLPRAAEPGDLLVYPNTAGYQMDSNESAFHELPIPPKVVLHETDGGRLRWALDTR

SEQ ID NO: 50924 - protein, 273 aa, Glycine max
MSILPKGDSVQIREVWNDNLEEEFALIREIVDEYNYVAMDTEFPGVVLRPVGNFKNINDYNYQTLKDNVDMLKLIQLGLTFSDENGNLPTCGTESTCIWQFNFREFNISEDIFASDSIELLRQCGIDFKKNSEKGIDVNRFGELLMSSGIVLNDAVHWVTFHSGYDFGYLLKLLTCRSLPETQAGFFDLIKMYFPMVYDIKHLMKFCNSLHGGLNKLAELLEVERVGVCHQAGSDSLLTSCTFRKLRDAFFSGSTEKYAGVLYGLGVESGQTN

SEQ ID NO: 50925 - protein, 352 aa, Pseudomonas fluorescens Pf-5
MNDHNNNIQLDTAMTTTTMTMIQALRSAMDVMLERDDNVVVFGQDVGYFGGVFRCTEGLQAKYGTSRVFDAPISESGIVGAAIGMGAYGLRPVAEIQFADYVYPASDQIISEAARLRYRSAGQFTAPMTLRMPCGGGIYGGQTHSQSIEAMFTQVCGLRTVMPSNPYDAKGLLIASIENDDPVIFLEPKRLYNGPFDGHHDRPVTPWSKHPAAQVPDGYYKVPLDVAAIARPGKDVTILTYGTTVYVSQVAAEETGIDAEVIDLRSLWPLDLDTIVKSVKKTGRCVVVHEATRTCGFGAELVSLVQEHCFHHLEAPIERVTGWDTPYPHAQEWAYFPGPSRVGAALQRVMEV

SEQ ID NO: 50926 - protein, 149 aa, Gloeobacter violaceus PCC 7421
MERTFIAIKPDGVQRGLVGEILQRFERRGFKLVGLKLMQVSEALAQKHYAEHKERPFFGGLVAFITSSPVVAVVLEGKGVVATARAMMGVTNPLNSPLGTIRGDYGIDIGRNIIHGSDSLESAEREIALWFAPAELLEWQATLGSWVYE

SEQ ID NO: 50927 - protein, 427 aa, Bradyrhizobium sp. BTAi1
MRSKAHSLIPGGAHTYAKGDDQYPVLAPSFLTRGEGCHVWDIDGNEFIEYGMGLRAVTLGHAYKPVVEAAHRQMLLGENYTRPATIELTCAEEFLGLIEGADMVKFAKNGSDATTAAVRLARAYTGRDLIARCGDQPFFSTDDWFIGNTPMSAGIPKVVQDLTLQFRYNDIESLRSLFAQHPGEIACVIMEAATAVEPQPGFLHAVQALCRKEGAVFILDEMITGFRWNVGGAQREYGITPDLSTFGKGIGNGFSVSALAGKRELMELGGLRDDRERVFLLSTTHGAENHALAAAIATMQVYRNDHVIEHLHRQGERLRAGVNPVIKELGIGDHFELLGRASNMVFATRDTAKQPSQPFRTLFLQEMIKRGIITPSLVVSFSHTDADIDRTIEAIAESLKVYRSALEDGVDHYLVGRPVKPVFRKFS

SEQ ID NO: 50928 - protein, 447 aa, Mycobacterium sp. JLS
MTLPRTRAIAALPPGPRLPPSVQTVLLMRSWSRFVAACRRRYGPVFTLRISSIGTMVYLADPADIKTVFAGDPRVYHAGEANAMLRGLLGDTSVLVIDDDVHRDRRRLMMAPFHREAVARQVEVMTEIAADNVSRWPVGEVFPVAPKMSEITLEVILRTVIGASDPARLAALRAIMPKLLQVTPWTTPALANPGLQRLPLWRSLRERIEEADRLLYAEIAERRADPELRWRTDVLAMLVRSAGEDGRTMTDRELRDQLMTLLVAGHDTTATGLSWALERLTRHPAVLTAAVRAADRSAAGDPSGDEYLDAVVKEALRIRPVVFDVGRVLTEPTEVAGYRLPAGVMVVPGIGLVHDDPAVYPEPDRFDPDRMLGASLTPTTWLPFGGGNRRCLGATFAMVEMRVVLREILRRAELCTTTAPGERRRVKHVIMVPARGARVRVRAMRPT

SEQ ID NO: 50929 - protein, 549 aa, Arabidopsis thaliana
MDLMQMDKRLDSTEQVVEEIMRIHRSLPARPGIDEVEAAKGLIDNVEKEDQACLEAIARQRKSSEVPGELFMVLQEMKKGYVQFRSKEQIREALKLLDLESVHSLFDDFIQRASNCIASPSSNGSVSSRPPLPPATTTAARSDSQSSLNFSERAPVRPKDMVSRDDSFVTKSKPSSLYSDGFAAPPRRPQILDSTLTTGNDGEKLSLIKLASLIEVSAKKATQEINLQNKLTEQLEWLPDSLGKLSSLTSLDLSENHIVVLPNTIGGLSSLTKLDLHSNRIGQLPESIGELLNLVYLNLGSNQLSSLPSAFSRLVRLEELDLSCNNLPILPESIGSLVSLKKLDVETNDIEEIPYSIGGCSSLIELRADYNKLKALPEAIGKITTLEILSVRYNNIRQLPTTMSSLASLKELDVSFNELESVPESLCFATTLVKLNIGNNFADMVSLPRSIGNLEMLEELDISNNQIRVLPDSFKMLTKLRVFRAQENPLHIPPRDIAEKGPQAVVQYMNDLVETRNAKSLMVKPKKSWVQMCFFSKSNKRKQSSMEIV

SEQ ID NO: 50930 - protein, 224 aa, Novosphingobium aromaticivorans DSM 12444
MGPLARPMTQDASPELDRLIAGYRRFREQGWTPKLERWRELRDGQEPQVMIIACSDSRVDPAQIFDVDPGEIFVVRNVAAMVPPFETNPGHHGVSAALEFAVQVLKVKEVVVMGHGMCGGCKAALTQDLKGTEPGEGGFIADWIALLDGVRDEVVDKHGTTGRPAERAMEEAGVRASLANLRTFPCIRRKEATGELKLRGTFFAISDGVLHVLDETTGDFSPVN

SEQ ID NO: 50931 - protein, 435 aa, Exiguobacterium sibiricum 255-15
MKTLSNVKAASLGLQHVLAMYTGAAIVPLIVGSAIGLSGEELAYLVAIDLFMCGVATLLQVFVTKYTGVGLPVVLGCTFTAVGPMIAIGSLQGITAIYGALIASGLIIFVISGWFSRIAILFPPVVLGSVVTIIGISLIPAAINDIGGGQGAKDFGDMRYLALAGLTIVLILVFNRYGTVFSKAAAVLIAVLIGTLVAFGMGMIDFSPVAEASWFQMVTPFYFGVPTFNATAILTMTLVGLVSMVESTGVFLTLGEITDKKLTDKDLARGYRAEGAATIIGGIFNSFPYTTYSQNVGLVQLTGVKTRKVIVFAGFFLIVLGFLPKVATFTTLIPKPVLGGAMLVMFGTVAASGIRILSRVDFAKNDNVITVALALGVGLGISMNPAIVASLPDQVRVLTDSPIVAGSVTALLLNGLFRLTEKKTAMRKTPLAKVE

SEQ ID NO: 50932 - protein, 358 aa, Zea mays
MFPDVSVDFIVHALRLQEFDFDFTVDMLSHLTKIDRQVKKIAVTRMALLALKPNPLPNGFRLCPKRTNASAAAAAARSPSVHPLPDELQLVADIRSPYNHIRVADVSPRAAGHPLAGARLLLLDGPGNIHSLSFPRRGDRPPLTGTYLDAFATLPPLLPRPSLAVLGFSAGAAARALLHFYPDISVHGWELDPAVLAVARDFFGLADLERRHAPRLSVHVGDALEARAPPGGFGGAAVDLFARGSVLPALQEPGTWRRLGAVVAPGGRVMVNCGGAGVEAEDEGRDGAAVKDATLRAMAAAFGEGAVSVLHVDGSWVAMTGPPVTAPEAAAAWRARLPPELRHFVDAWRPYGAGASGE

SEQ ID NO: 50933 - protein, 421 aa, Thermoplasma acidophilum
MGSKDLFQRGSSLFPMGVNSPVRYFKDYPFYVDNASGSRIYDVDGNEYIDYCLAYGPSILGHADPDVVRAVRDQAEKGLIYGAPSEAEIRLGDIIRRSSKNIEMMRFTNSGTEATMHAIRLARAYTGRSIIVKMEGGFHGAHDYSLIRSGSGTLTFGSPSSPGVPEEVARTVVVGRYNDEANIRNIFSQYGSRIAAVITEPIMGNAGVITPEPGFLEFLRDITQKNGSLLIFDEVITGYRFAFSPYQDIIGIRPDLTTMGKIIGGGMPIGLFGGSADIMKKVSPSGDVYQSGTFSGNPVTMAAGFAALKKLQGMDYASLVRRTEKLMNGIDDILAKRKIRHVVNGYRSMFQFFFAESAKNYDEVMKADRDLYFRIFKRLMNHGVYVPPSQFETNFVSFAHSDDDISKTIEAFDLSVGEAAK

SEQ ID NO: 50934 - protein, 570 aa, Saccharomyces cerevisiae
MSLLIDSVPTVAYKDQKPGTSGLRKKTKVFMDEPHYTENFIQATMQSIPNGSEGTTLVVGGDGRFYNDVIMNKIAAVGAANGVRKLVIGQGGLLSTPAASHIIRTYEEKCTGGGIILTASHNPGGPENDLGIKYNLPNGGPAPESVTNAIWEASKKLTHYKIIKNFPKLNLNKLGKNQKYGPLLVDIIDPAKAYVQFLKEIFDFDLIKSFLAKQRKDKGWKLLFDSLNGITGPYGKAIFVDEFGLPAEEVLQNWHPLPDFGGLHPDPNLTYARTLVDRVDREKIAFGAASDGDGDRNMIYGYGPAFVSPGDSVAIIAEYAPEIPYFAKQGIYGLARSFPTSSAIDRVAAKKGLRCYEVPTGWKFFCALFDAKKLSICGEESFGTGSNHIREKDGLWAIIAWLNILAIYHRRNPEKEASIKTIQDEFWNEYGRTFFTRYDYEHIECEQAEKVVALLSEFVSRPNVCGSHFPADESLTVIDCGDFSYRDLDGSISENQGLFVKFSNGTKFVLRLSGTGSSGATIRLYVEKYTDKKENYGQTADVFLKPVINSIVKFLRFKEILGTDEPTVRT

SEQ ID NO: 50935 - protein, 394 aa, Desulfovibrio desulfuricans G20
MYEFPRMHRLPPYVFAVVGELKMQLRRQNVDIVDMGMGNPDMPTPQHIVEKLNEAAAKGVNHRYSVSRGIPNLRKAICEWYMRKFDVYLDPDKEAVVTMGAKEGLSHLALAMLSPGDVVFAPDPTYPIHTYAAIIAGADVRRIPIGKGRDFFEDLLAATRQTWPQPKLLMLSYPHNPTTELATLEFFQKVVDFAKEHKMYVVHDMAYADLAFDGYEPPSFMQADGAKDVGVEFYSMSKSYSMAGWRVGFCVGNREMVHALTRIKSYLDYGIFQPIQIAATVALNGPEDCVKEIVDTYRQRRDVLCEGLNRVGWPIEPPKATMFAWAEIPEPFRQMGSVEFSKLLLREAGVAVSPGLGFGHFGDHHVRFALIENPHRIKQAIKGIKRVLSGSSCG

SEQ ID NO: 50936 - protein, 396 aa, Triticum aestivum
MAPLRGAKRRKRHPEKALPAGVMAPLPPPDAADWWDSFSRRLAAGHYSKDCQNFESVFKMSRKTFDYICTLITGDFSRKTQGFRNFRFGDKMILALEDQVAVALLRLTTGESLLSIGNRFGMNHSAISNITWKFIESLEDHAISHLKWPDPEEMATIKAKFEKLQGLPNCCGAIDTTHILMCSSAQPNSNVWLDCENRNSMVLQAVVDPDMRFRDVVSGWPGSMDDSCILRTSGFYKLCEKGGRLDGQMELPGEPAGSVVREYIIGDTGYPLLPWLMTPYQERDLSPAKAAFNKQHATARMVVQGAMARLKERWQVLKGELWRPDKHRLPRIIYACCLLTNIMIDLGDTHRERAPASHDHDDGYYQQFSNVADDGAVAQRDVLCQYVSRLGGKLPE

SEQ ID NO: 50937 - protein, 321 aa, Kineococcus radiotolerans SRS30216
MSEPVKPVLEGPAQAFADANSTPPFLYQLTPEQGRKIAETVQTDPTPTLPEADVSDLMIDGGPTGTIRVRIVRPKGATGVLPVVLYVHGLGWVFGGPVTHDRLVREIAVGVNAAVVFPDYDLAPEAKYPTQIEQVYAVANWITMNGPEQSLDTTRIAVAGDSVGGNMATVATILAKQRGGVDFKGQLLFYPVTDANFDTGSYEQFSEGYFLAREGMKWFWDQYTTDPAQRAEITASPLRASSEDLAGLPEALVITGEADVLRDEGEAYAAKLRAAGVPVTAVRYGGIIHDFVGLNPLRHTFAAQAAITQGIAFLAGVLGTD

SEQ ID NO: 50938 - protein, 324 aa, Saccharomyces cerevisiae
MSSDNSKQDKQIEKTAAQKISKFGSFVAGGLAACIAVTVTNPIELIKIRMQLQGEMSASAAKVYKNPIQGMAVIFKNEGIKGLQKGLNAAYIYQIGLNGSRLGFYEPIRSSLNQLFFPDQEPHKVQSVGVNVFSGAASGIIGAVIGSPLFLVKTRLQSYSEFIKIGEQTHYTGVWNGLVTIFKTEGVKGLFRGIDAAILRTGAGSSVQLPIYNTAKNILVKNDLMKDGPALHLTASTISGLGVAVVMNPWDVILTRIYNQKGDLYKGPIDCLVKTVRIEGVTALYKGFAAQVFRIAPHTIMCLTFMEQTMKLVYSIESRVLGHN

SEQ ID NO: 50939 - protein, 343 aa, Oryza sativa
MEIQQQKGVGNSKVVKVEKEESWDLFINQASNEGRPVVAHFGASWCVTSLSMNYKFEELAQTHPEILFLYVDVDDIQSVSSKLGVKAMPTFFLIKDKEVVNKIVGANPDEVKKMVDASAESIGVTAPPDIVPRTSAKPTASTTAKNARRVGVGVGAGSLSPLLSLSSLILFPSRALCCECGCGVASHALCELWVRERWPDELAGEEEEEEDDELSFAMCCYVGKATKIFLCLAAALIVVGLVLGFGLAHRTWGERKVQPDCRWPDCQLQPAYGGGGGGGDPLPATSGAGAGGVDTPPGVPLTEPAVAAFPGVASASSAAPPTASMPYLGPPSPFAVGLAPAHG

SEQ ID NO: 50940 - protein, 466 aa, Oryza sativa (japonica cultivar-group)
EYGDHRFRRSDFFLAVEAYLSHACARRARRLKADLGRDARSVQVSVDDHQEVTDSFRGATLWWYPSSMSNKSSVISFYPGEDERRLYRLVFHRRHRDLVLDGYLPHVLAEGRAVTVRNRQRRLFTNNASTSWNPYRRGKGVWSHVPFEHPASFDTLAMDPGDKDAIVVDLVAFRDGKDYYAKVGKPWKRGYLLYGPPGTGKSTMIAAMANFLDYDVYDLELTAVKNNTELRKLYIETTGKSIIVIEDIDCSIDLTGKRKKSSGDNKASDGGGEGSDDKPKLPTEADKDDGGSKVTLSGLLNFIDGLWSACGGERIIIFTTNHKEKLDPALIRRGRMDVHIEMSYCGFEAFKVLASNYLGVEQHELLGDIRRLLEEADMSPADVAENLMPMSKRKKRDPDACLAGLVEALNMAKEEAQANKAAKEDEEAKAAKGIEEMKTKEQATTNGEDEGKDKRTSEENKANGDI

SEQ ID NO: 50941 - protein, 220 aa, Bacillus anthracis str. Ames
MDLKQIAGEYAATFVKDGMKIGLGTGSTAYWTIQKLGQRVKEGLSIQAVPTSKETEALAQQLNIPLISLNDVQSLDLTIDGADEIDSNLQLIKGGGGALLREKIVASSSKELIIIVDESKVVTRLGTFPLPIEIIPFAWKQTESKIQSLGCQTTLRLKNNETFITDNNNMIIDCIFPNHIPTPSDLHKRLKMITGVVETGLFVNMTSKAIIGTKNGIQEL

SEQ ID NO: 50942 - protein, 856 aa, Gloeobacter violaceus PCC 7421
MAVGFSLRVLVVAANGPLVHALEKTLLSGGYDLALRWAAGTASLHQALMSERPEMILAADGPGEIDALLLLRSLTVHNCCELPLVWIGDAPSTPEGGYLNGADLHLLVLTVERALHQAQQRRETGVARAALRRSEQRLDLFFSQSLDGFFFMMLDRPVRWDATVDKERTLDYVFAHQRLTRVNDALLAQYRASGEQLLGRTPADLFAHDLELGRRLWREFFDRGKLHVETDERRFDGSPMWVEGDYSCLYDEQGRITGHFGIQRDVTVRKLAQEALRTSEAALQEQLQRTLLLQRICEQIRSSLESRQIFQATVDQVGQALGVNCVRILVYSPTPKPELHFAAEYLEAGYPPVHHGSVPVAGDPHAQRVLECDRAVCSPDVYADPQLAPVHELCRSVGLKSLLAVRTSYQGKPNGVITVQQRDRFRRWTPEEIALLEAVAAQVGIALNQAKLLEQEKAQSLLLAEQNAALARARQAAEAASRTKNEFLATMSHEIRTPMNGVIGLADVLLADGGLTHRQRDSIETIRASGETLLTIINDILDFSKAESGCIELETKRFDLHALLAGCVDLLRPEATQKHLQLCCTLHGQVPQAVVGDAARLRQILVNLIGNAVKFTTSGAVSVNVTAARPAAEPPQKWELHFAVRDTGIGIPAERMDRLFKPFSQVDASTTRRYGGTGLGLAICKRLAELMDGRIWVESEPGRGSTFSFTIVAAAATDAPAPAPPVEASWSKPLPLRILLAEDNPLNQKVALQLLRRLGYRANVATDGEEVLRALRRQRYDLVLMDVQMPMIDGLEATRRIASEFAAAERPRIIALTAGATLQDEQACLRAGMDGFISKPIRIGELRRALERWGTG

SEQ ID NO: 50943 - protein, 542 aa, Exiguobacterium sibiricum 255-15
MKRWALYRIFIIVTMFARYIWTIYRFTRKNRPGTNNEEFERIMITIARDYKKKALRLEGLLIKLGQFLSIRADLFPPSVLMELTELVDKVPSSKLGESRKIIEEDWGTAIEDIVDDISPRPIASASIGEVYSATLKSNGRKVAIKVQRPNIEQIIKTDFRAMRLVIAMLRRTSLNKSTDLQSLYRQMVFVIGDELNYRTELKNGLYFKKMYETNPVIYIPDYFEEHCTNRVLVMEWIEGTRITDLDYLAEHNIDRDELARNLFLNAGEQLLFGGKFHADPHPGNVLVQSDGRIVLLDFGMIGATTADDMRAIQRILQSFVTLDYDAIVDGLEDLRFLLPNANKQNIRQAIEKAVTFYLESDMENIDTKLIEKVLSDIELLVRNEPIQLPAEFAFFGRAASTILGILQILSPKINLLELAKPMVRRWLDEEGKNQNRYLQIAGSYGARLLAFPRLVNDALSEPTRWRLFEQQKFSRVANMESLKIRQWTSSLVGIVSLPVSYTGYFLAHYDLMGISLAIAIVALWNGRRIGRQIVRIADEPFK

SEQ ID NO: 50944 - protein, 463 aa, Zea mays
MSPNLDSAIKSQVPALLLRHLFGASRRDEANQLQRTPAQVGRRRVFVQKETDCVLGMDLDRGDNAHTVKRRLQLALNMPTGGTSLTFGDRLLENDLINRSCSTPCLCPVSKDFEHKDCSGLVEMLGCSSSCARVKRLVDDVVTAIRSGVDPVPISSGLGGSYYFRNVLGDRVAIVKPTDEEPFAPNNPKGFVGRALGQPGLKRSVRVGETGFREVAAFLLDHDNFANVPATALVKITHSIFNINCPVNGGNLAPAHDQQQQVNSKIASFQQFIAHDFDASDHGTSSFPVAAVHRIGILDIRIFNTDRHAGNVLVRKLNGGTGRFGCQTELFPIDHGMCLPENLEDPYFEWIHWAQASIPFSEEELEYIRNLDPRKDVQMLRRELPMIREACLHVLALCTIFLKEAAAFGLCLAEIGEMMTREFRGMEEEPSQLEELLKEALHESARAAAGQRMKQRLGTSCKF

SEQ ID NO: 50945 - protein, 148 aa, Zea mays
VILGDGCQMEGIANEACSLAGHWGLGKLIAFYDDNHISIDGDTEIAFTEDVSTRFEALGWHTIWVKNGNTGYDDIRAAIKEAKAVTDKPTLIKVTTTIGFGSPNKANSYSVHGSALGAKEVEATRQNLGWPYDTFFVLEDSPMPRSLE

SEQ ID NO: 50946 - protein, 340 aa, Pseudoalteromonas tunicata D2
MKKLSLAITTALSLMMTTSAFAASKAGSPGTEINTQAFLEVLAQDTGLPLHKRSHQDVRKVLEGAQQGAVLPAADVTKKTIKVNGESIDLVIVKPVNAKGDLPAFMYFHGGGWVLGDFPTHERLIRDLVVRSGAAAVYVDYALSPEVKYPTAINQGYAATKWVAENGKKIGIDGSRLAVAGNSAGGNMATVISIKAKEAGTPNIKFQLLLWPVTDSNPNYPSYNEYAQGHFLSSNVMEWMWNNYLETPQQRNEIYAAPLRASVEQLTSLPPALIQVAEKDILRDEAEAYGRKLNAAGVAVTVTRYNGMIHDFGLLNPLSNIPAVQDSLDQAGNALKKHLN

SEQ ID NO: 50947 - protein, 491 aa, Glycine max
  misc_feature (336)..(336): Xaa can be any naturally occurring amino acid
CAGIITIDDWKQKVGLISPLDTSCNGDLSDQTRCSICSDAGLKVTSGLNSNSTRCFYFTILYAAAIVNQFGPTNLGTASCILGMPLSVKGSSNRGLVLKLVIGLLGAFVGVLLAFVLIVVYRKWDKRRKEDMHHREIESGVRNSVLPNTGAKWFHISELERATSKFSQRNMLGQGGDGVVYKGTLSDGTVVAVKEIFGLETKGDEDFTYEVEIISKIKHRNLLALRGCCISSDNVKGKRRFLVYDFMPNGSLSHQLSIAGANRLTWPQRKNIILDVAKGLAYLHYEIKPPIYHRDIKATNILLDSKMKAKVSDFGLAKQGNEGQSHLTTRVAGTYXYLAPEYALYGQLTEKSDVYSFGIVILEIMSGRKVLDTMNSSVVLITDWAWTLAKSGNMEDIFDQSIREEGPEKVMERFVLVGILCAHAMVALRPTIAEALKMLEGDIDIPQLPDRPVPLGHESFPSSLLQGLQSGRSTAYFSSYLSSFSTRMSTV

SEQ ID NO: 50948 - protein, 422 aa, Zea mays
  misc_feature (254)..(254): Xaa can be any naturally occurring amino acid
MAMSASSSSRALLRRIGGALLRRSFSSSSAAAAAGYHVAGGPSYMRGAVFWEPGRPLTLEEFRMPRPKAGELLIKTKACGVCHSDLHVLKGELPFSTPCVVGHEITGEVVDHGTHTPVEIINRFPVGSHVVGAFIMPCGNCFYCVKGQEDLCESFFAYNRAKGTLYDGETRLFLRGNGKPVYMYSMGGLAEYCVVPANALAVLPDSLPYTESAILGCAVFTAYGALRHAAEMRPGDSVAVIGVGGVGSSSLFLXCLQIAKAFGASQVIAVDVLDEKLQNATTLGATHTVNAAKDDAVERIKEITDGRGVDVAIEALGKALTFSQCAKSVRDGGKAVMIGLAATNVMGEVDITRLVRRQVKIIGSYGARARQDLPQIVKLAESGAFNLQNTISRKCKFEEANGAYEDLNQGKIVGRAVVEIME

SEQ ID NO: 50949 - protein, 139 aa, Glycine max
  misc_feature (46)..(46): Xaa can be any naturally occurring amino acid
  misc_feature (82)..(82): Xaa can be any naturally occurring amino acid
  misc_feature (90)..(90): Xaa can be any naturally occurring amino acid
  misc_feature (128)..(128): Xaa can be any naturally occurring amino acid
MFPSNMPNNRVLSFFFLVTFLTCFFLGASNKNHIFLPSNLLDNNSXSSTVSDQSFIYKPVIGILTYPGDGAYGRLTPPPGFXLMAASYVXKFLESGGARVIPLIYNESPENFNKKLDLVNGLLFTERXAVSGPYSDTLG

SEQ ID NO: 50950 - protein, 313 aa, Saccharomyces cerevisiae
MPLVLFTGYPCSGKTTLAKHLVQLLQSKIDATPSLSKYSITYHSDESLGIKHSDYITSQDERKLRSEIISAVKRDLSKNKIVIVDSLNYIKGFRYQLHCEVKNLSTTFCVIQTLCPPETIFEWNKTSNPNPWEPELLNQLIQRYEEPNSSNRWDSPLFAILTPQDNITDYIDDICKVVFQTSKSAKNSGHNDPLSKGLQKPNSATVLKPASQSNFIQVLDIETSKIIKTIMNHIKSLTSIGGVSNGTRVIVSEGITDINDDGCFFVDLPIGNVVTLAQLQRLKRQFINFNKLRDIDQDRIGPLFADYLNKNLN

SEQ ID NO: 50951 - protein, 169 aa, Brassica napus
  misc_feature (72)..(73): Xaa can be any naturally occurring amino acid
  misc_feature (87)..(87): Xaa can be any naturally occurring amino acid
  misc_feature (96)..(96): Xaa can be any naturally occurring amino acid
  misc_feature (103)..(103): Xaa can be any naturally occurring amino acid
  misc_feature (106)..(106): Xaa can be any naturally occurring amino acid
  misc_feature (114)..(114): Xaa can be any naturally occurring amino acid
  misc_feature (116)..(116): Xaa can be any naturally occurring amino acid
  misc_feature (118)..(118): Xaa can be any naturally occurring amino acid
  misc_feature (127)..(127): Xaa can be any naturally occurring amino acid
  misc_feature (141)..(141): Xaa can be any naturally occurring amino acid
  misc_feature (144)..(144): Xaa can be any naturally occurring amino acid
  misc_feature (146)..(147): Xaa can be any naturally occurring amino acid
  misc_feature (151)..(152): Xaa can be any naturally occurring amino acid
  misc_feature (155)..(155): Xaa can be any naturally occurring amino acid
  misc_feature (158)..(161): Xaa can be any naturally occurring amino acid
  misc_feature (164)..(164): Xaa can be any naturally occurring amino acid
VEKVGVIWQALKMTSHNGFPVIDEPPFTEASELCGIALRSHLLVLLQGKRFSKQKTTFGSQILRSCKARDFXXAGLGKGLKIDDLVXSDEEMEHVXLISIPSXHVXYTVLSRLXLXAXAAILFRQLXPRHLCVVPKTPGRXPIXGXXTTHXXLPXHPXXXXPHXDPLTV

SEQ ID NO: 50952 - protein, 358 aa, Mannheimia succiniciproducens MBEL55E
MSTYNVAVLPGDGIGPEVMAEAIKVLDKVQAKFGFKLNFTQYLVGGAAIDAKGEPLPAETLQGCDNADAILFGSVGGPKWTHLPPDQQPERGALLPLRKHFKLFCNLRPATLYKGLEKFCPLRADIAAKGFDMVVVRELTGGIYFGQPKGRDGEGSDTRAFDTEVYYKYEIERIARAAFDAAMKRRKQVTSVDKANVLQSSILWRETVAEIAKEYPEVQVENMYIDNATMQLIKAPESFDVLLCSNIFGDIISDEAAMITGSMGMLPSASLNEEGFGLYEPAGGSAPDIAGKGIANPIAQILSAAMMLRYSFNLNEAATAIENAVQKVLADGHRTGDLADNSTPVSTAEMGTLIANAI

SEQ ID NO: 50953 - protein, 468 aa, Oceanobacillus iheyensis HTE831
MTTNKKVVVVGGGITGLSAAYYLQKEKEAQELPIDITLVEASDRVGGRIHTVKRDGFTIERGPDSLLSRKPAAMELVNSLNIQSKVVRNSTGQSYILVKNKLHKMPKGAYMGVPKEIKPLLNSKAISTRGKLRALMDVVLPKSKGAKDQSLGSFMRHRFGDELVDNQIDPLLSGIHSGDIDQMSLQAIYPIFERMEQEYGSVMKGLQKTMPASKTKKTSKKPSVGMFFSFEGGLQTLVDALSSHLNGIIQCNRAVDHIEKKEDGYHLLLNNGEVLFADVVIMTAPHTKVPEMLSKHEPMKQLNKIPATSTANVILAFDDKQIKRDLDGTGFLITRNSDYRITACTWTHRKWANTTPDGKALLRCYVGKPDDQGVVDLTDEEITEIVLKDLNKVMKIKGKPLFYEVTRFKNARPQYHVGHLDIVHEVRHYIDHYLPGFVLTGSSYDGTGIPDCIEHGKSSAHQAMNLIK

SEQ ID NO: 50954 - protein, 131 aa, Triticum aestivum
  misc_feature (47)..(48): Xaa can be any naturally occurring amino acid
MSYYDRRGESSVLEAFTLSPLPYPVILILMMVTLLLGASWFFSYEEXXEEASEQFSWFLLGVPIALVLLIRWISSVDTFEGYFGFYPTESRWRGYPAAPSEGSSPWGVAMVVLLLLVLASFHSTFQDMWKA

SEQ ID NO: 50955 - protein, 477 aa, Exiguobacterium sibiricum 255-15
MSLTRKKDVSAMIAASQRNSGLARNLGAMDLTFLGIGAIIGTGIFVLTGTGALTAGPGLIVSFILSAIACGLAALAYAEFASTIPVSGSVYTYTYATMGEIFAWIIGWNLILEYGLASSAVAAGWSGYFQSLLGGFGIHLPTALSAAPGAVEGAKTFFNLPAFLILLAITGLLSMGIKETKRVNNIMVIIKLAVVVLFIVVGVGYVEPTNWAPFTPFGWGGVFSGAAIVFFAYIGFDAVTSAAEEVREPQKNLPRGIIGSLAVCTVLYVIVAAIMTGIVPYQKFAGVDHPVSLAIQMAGQNWVAGFIDLGAILGITTVILVMTYGMVRLAFAISRDGMFPKVFSEVHPKYKTPFKATWMIGLGSATVAGLVPLDVIANLVNMGTLAAFVLISVAVLILRKTQPDLPRAFKCPGMPYVPIAAIASCLFLMFNLKLETWIAFFIWLAIGLVLYFAFARKNSNLEPGNMPAAELAASDDK

SEQ ID NO: 50956 - protein, 279 aa, Vibrio fischeri ES114
MKLEAIDYTAENAAELFVKSLRETGFGVLKNHPIQQESVQSIYDNWYAFFNSQEKENFQFNVDTQDGFFPASVSEVAKGHTKKDIKEYYHYYPTGQCPAELKAQIQEYYDNANTLAIELLSWVEEYSPEEVSALYSQSLSSMIEGSEKTLLRVLHYPPLEGDEELGAIRAGAHEDINLLTVLPAANEPGLQVKTKEGDWLDVPCDFGNLIINIGDMLQEASGGYYPSTTHRVINPEGADKTKSRISLPLFLHPKPEVVLSERHTANSYLMERLRELGVI

SEQ ID NO: 50957 - protein, 521 aa, Novosphingobium aromaticivorans DSM 12444
MGEPFYITTAISYPNGKPHIGHAYEAIAADVIARFQRAMGRDVRFQTGTDEHGLKMAQKARELGITPRELSDEMSSYFIKMCDELNVSYDVFIRTTEERHHASTQELWRRMEANGDLYLDRYEGWYSVRDEAFYDESELVAGEGGEKLSPQGTPVDWTVEESWFFRLSKYAEPLLKLYEENPGFIQPDSRRNEVMRFVEGGLRDLSVSRTSFDWGVKVPGCDGHVMYVWVDALTNYITGLGFPDENGDFAKYWPANLHLIGKDIVRFHTVYWPAFLMSADIALPRQVFGHGFLLNRGQKESKSLGNVTDPLDLADRFGVDPLRYFLMREVAFGQDGSYSAEAIVTRCNAELANSYGNLVQRTLSMIFKNMGGNLETFHSNVGDDELLATVFNACREELPREFSALNFSAGIEAWMRAVFACNAYVDEQAPWALRKTDPERMKAVLLTLFIAIRDLTVAISPVVPAAAAKVLDQLGIPREARGFDALTDADWYMARVATGERLAQPMPAFPRLELPEEEGSA

SEQ ID NO: 50958 - protein, 439 aa, Geobacillus kaustophilus HTA426
MFLHGTSRVNEQGHLEIGGVDVVELAKTYGTPLYIYDVALIRARARAFKEAFQRHGVRAQVAYASKAFSAVAIVQLAAEEGLSLDVVSGGELYTALAAGFPPERIHFHGNNKSRDELAMALEHGIGCIVADNFYELELIEELAASCGRTVPVLLRVTPGVEAHTHDYILTGQEDSKFGFDLNNGQADEAFRRVMASAAFQLLGVHCHIGSQIFETAGFVLAAQKVFAKLAEWNKEHGFVPAVVNLGGGFGIRYTEEDDPIPVTAYVDCIVEEVKRQAEACRLPLPEIWIEPGRSLVGDAGTTIYTIGSRKEVPNVRTYIAVDGGMSDNIRPALYGAKYEAALANRVFGEPTEVVSIAGKCCESGDMLIWDIALPEAKPGDYLAVFCTGAYGYSMANNYNRLPRPAVVFVENGDAQLVVKRETYEDLIQYDLPLKTKVKK

SEQ ID NO: 50959 - protein, 543 aa, Exiguobacterium sibiricum 255-15
MTCGELSFTTVEWGASFYYVAFSSSFWKVRALFVFSKSVLSKNLNKREANEMNTLQPQRKLDSTEEGLKRGLQARHMSMIAIGGAIGTGLFIASGASVAAAGPGGALLSYAIVGLMVYFLMTSLGEMAAYMPVAGSFSTYGAKFVDPSFGFALGWNYWYNWAVTIAVELVAAQIVMSYWFPDVPGFYFSALFLLLMIGLNYFSVKGFGEAEYWFAMIKVVTVIIFLIVGVAMIFGVFTSEAPVGFKNFALGDAPFVGGIPAVIGIILVAGFSFQGTELVGIAAGESEDPKKNVPKAVKQVFWRILLFYVFAIFVIGMLIPYTSPNLVSNDITDVAVSPFTLVFEKAGLAFSAALMNAVILTSVLSAGNSGMYASTRMLYTLARQGDAPKLFAQVSKNGVPRNALLATGAIGALCFLTSMFGGQVYLWLLNASGMTGFIAWLGIAISHYRFRKGFLAQGHSLSDLPYVAPAFPFGPLFAFGLCFLVIVGQNYAAFLADQIDWVGIAATYVGIPLFLAFWLGHKFKNRTSVVPYEEMEFPEHPRP

SEQ ID NO: 50960 - protein, 289 aa, Triticum aestivum
  misc_feature (193)..(193): Xaa can be any naturally occurring amino acid
NKFVQKSRLVPVRNSRDIGDPRVRGRVGGVKMLEGHSNCNGEDLISEVSTIGRIHHVNVVHLLGFCSEDMRRALVYEYMPRGSLDKYIFSAEKSFSWDKLIEIALGIARGINYLHQGCEMQILHFDIKPHNILLDSNFVPKVADFGLAKLYPRDKSFVPSRALRGTVGYIAPEMMSRSFGVISSKSDVYSFGXMLLLEMAGGRRNADPNTANSSQAYYPSWVYDRLTAQEVCEITPVDDMHELERKLCIVGLWCIQMKSHDRPTMSEVIEMLEGGFDGLPMPPAILLCC

SEQ ID NO: 50961 - protein, 255 aa, Brassica napus
MYADTGLGFRFMQGCSPEIHQFEDLFKPYKLSDQTISLVEACEYGFGEESDLLKAPEPIIEEPMLAVDPLSQEIVELSDLGSLQSDQQLIEKAFYECEQELLVKSAMESPLLSEVLDRKNVSQAAEMDSSSVVVSDVPVPKSVSSGSLTSMDIAQHEEAVIQRFFPPVDNGMRRAFSESDIQTLGTRNAGQVQSQLDRIIVSCTSEDRREKLSRYRDKKSRRNFGRKIKYACRKTLADSQPRIRGRFAKTEEMQK

SEQ ID NO: 50962 - protein, 223 aa, Mycobacterium tuberculosis CDC1551
MCHGGTWAGDYVLNVIATGLSLKARGKRRRQRWVDDGRVLALGESRRSSAISVADVVASLTRDVADFPVPGVEFKDLTPLFADRRGLAAVTEALADRASGADLVAGVDARGFLVAAAVATRLEVGVLAVRKGGKLPRPVLSEEYYREYGAATLEILAEGIEVAGRRVVIIDDVLATGGTIGATRRLLERGGANVAGAAVVVELAGLSGRAALAPLPVHSLSRL

SEQ ID NO: 50963 - protein, 437 aa, Yersinia pseudotuberculosis IP 32953
MAYRQERIMSHRELEQRRKEATPRGIGVLCDFYAVRAENATLWDEQGREYIDFTAGIATLNIGHRHPKVMAAVRQQLDQFTHTAYQVVPYASYVTLAEKINSLAPISDSNMTAAGNSKTAFFTTGVEAIENAVKIARAATGRPGVIAFSGAFHGRTLLAMALTGRAVPYKVGFGPFPASIFHALYPNELYGVSVEEAISSVERLFRCDISPTQVAAILFEPIQGEGGFNIAPPEFVSALRTLCDEHGILLIADEVQTGFARTGKLFAMEYYPDTKVDVITMAKSLGGGMPISAVTGRADIMDAPLPGSLGGTYAGNPLAVAASLVVLDIIAEEKLCERALILGAKLVDVLEKAQMSNAAIVGIRARGSMVAVEFNDPVSGKPSPELTRAYQRQALEEGLLLLSCGVHSNVIRFLYPLTIPDKQFKQAMNILTRLLAS

SEQ ID NO: 50964 - protein, 448 aa, Clostridium aminovalericum
MKIVVIGCTHAGTAAVKTILKENPEAEITIFERNDNISFLSCGIALYVGGVVKDPAGLFYSNPEELSKMGANVKIKHNVKSIDTKSKKVIAEDMNTGEEIEVSYDKLVNTTGSWPIIPPIPGIESKNILLCKNYDQANVIIRQTKDAKKIVIVGGGYIGIELVEAFQKSGKQVTLIDGLDRILNKYLDKEFTDILEDDLKKNGINLALDQCVKSFKANENGEVTSVETTKGEYEADMVILCVGFRPNNELLKGKVDMLPNDAIIVDEYMRTSDPDIFAAGDSCAVHYNPNGNYAYIPLATNAVRMGMLIGKNISTPKVKYRGTQSTSGLNLFGYNIGSTGVTVSGAPQIGLNVRSVIVKDNYRPEFMPTNEEIIMQLVYEVGTNRIVGGQVMSKYDITQSANTLSLAIQNKMTIEDLAYVDFFFQPHFDRPWNYLNILGLAALEQEGL

SEQ ID NO: 50965 - protein, 87 aa, Glycine max
MCPLRFILIFFSTMLAAYIAWTTMTSSPEIDFTTQDRENKASSNKDHFNFIKMIQNGFWVFVDMASGGYLWRNLKSRNDGVREVKSS

SEQ ID NO: 50966 - protein, 841 aa, Oryza sativa (japonica cultivar-group)
MIHPSLLTTIQWVALSTLILITIAADNYSSSSSPIFLNCGASTMQLDINNRSWEGDTRSKFASAMNGIAASATYQDPSLPSLVPYMTSRIFISNYTYSFPISPGRIFVRLYFYPVAYGYYASEDAYFGVKTNNLILLDNFNASQTAQAANYAYILREFSLNVTLGSLDLTFFPSTQNGSYAFVNGIEIVPTPDIFTTRTPTHNTEGNLDPSDIDSMTSFQTMYRLNVGGQAIIPQGDSRFYRSWEDDSPYIYGAAFGVTFGKDSNVTITYPGTMPNYTAPADVYATARSMGPNWQINLNYNLTWILSVDAGFYYLLRFHFCEIQYPITKMNQRSFFIYINNQTVQDQMDVIRWSGGIGMATYADYLIVTVGSGQMDLWVALHPDLSSRPQYYDAILNGLEVFKLWDIGKKNLAGLNPPLPPQPKTDVNPKGVSGGGKLKAAVPAAICAVVVLITACFCVCIICRRKKVAKHSGKTDKKCLTYQTELYKSPSNLCRNFTFHEMQIATSSFDETLLLGRGGFGDVYRGEIDNGTTVAIKRSNPLSLQGVHEFQTEIETLSKVRHGHLVSLIGYCQEKNEMILVYEYMARGTLREHLYSTKRPPLPWKERLKICIGAARGLYYLHTGPKETIIHRDVKTANILLDDKWVAKVSDFGLSKVNPDIDATHVSTVVKGTFGYFDPEYFRLKQLTQRSDVFSFGVVLFEILCARPPVNTELPEEQVSLREWALSCKKIGTLGEIIDPYLQGEIAPDCLKKFADCAEQCVADRSIDRPEMGDVLRNLEVALKMQECAENNSKFSEETTSSKTTPDMMTIMDTDKQSTYSTMSITGQRTIFSDMMDPQAR

SEQ ID NO: 50967 - protein, 192 aa, Oryza sativa (indica cultivar-group)
MGEIHALRNMDDDEVFAYAKRIAAPYNLVMQTKQLGRLPVVQYMVMEAFIDTAGKDQSDPLILTQLNSTKAIRDSIQINFGECGLAACLGSLQGIYELYSSIVKYVNPITKLCVIRVSREDHQKVWAAITMVRSIGKIPVSFNLRDVSGSIRACKKAALECEEAKFEYYKLAAGDRITPKFVETMESCFNKD

SEQ ID NO: 50968 - protein, 756 aa, Idiomarina baltica OS145
MLVTLQRIVESVNKAADFQLALRTMVSQVRSALETDSCSVFLADAQAHQYVMAASDGLADASGEPIRVDFGDGIISLAAQREEPLNIADISNHPANKELLDSNESQYRALLAAPIIHRRKVLGILVVHQSEARHFTREEEAFVVTLAAQLSVVIAHANTKGLLTDEHSPWVHSIQALPGSPGVAIGDAYVARPEVSLKEVSPQKTDRPLHEVRKFRQAVARTRAELKQLAERVYGQVPDDTLAIFDVYQGMLDAASLGNAVEAMIGQGWRAQTALKHVVEEFVDQFEALEDSYLRERATDVRDIGQRVLMHLQQRQRKRRAFPEQGILVADEVTASMLAELPRTQIAGIISLRGSSNSHAAIMARSMGIPAVLGVDDIELHYFSEKILIVDGYTGEVYINPPPQVREQYQHLADEEEELKSIVAEHAHLPAQTQDGQRVSLHLNLGLDIHQEHLKHLNIDGVGLYRSEIPFMMREQLPTEDEQVEMYKEVLDCFPDQPVIMRTLDVGGDKPLPYLQLQEDNPFLGWRGIRLTLDHPEIFLVQIRAMLRASIGRSNLRILLPMITSVSEVEEASRLLKQAYFEVAEEQGCAVGVNLFQPQLGVMIEVPAAIYQLPMLASKVDFFSVGSNDLTQYLLAVDRNNRRVASLYDAYHPAVLASLDEIARRCEELGKPVSVCGELAGDPGGALLLVAMGYRQLSMNSYNVDRVRWILRNVRSSTLQVMLAKALQARRPEQVRSMISEKMESMGLGGFVRAGK

SEQ ID NO: 50969 - protein, 515 aa, Oceanobacillus iheyensis HTE831
MNITDKLALTARENPTKTAYIFTDKETTYGELEGMVQKFADGLQKLGFRQGDHIALVLGNSPYYVIGLHGALRLGLTVIPMNPLYTPTEMAFMLKDGDVKGIITMDILIDKFIPIVDDLPALEYIINCESGNEVPESIKKDHLPTNILRFQEVITNGQFPFNGPKLVGEDLAVILYTSGTTGKPKGAMLTHKNLYSNAQDVANYLHINQDDRVIAALPMFHVFCLTVSLNAPLLNGGTIIILPQFSPTEVFRVARAYQATVFAGVPTMYNYLLQSVKGNVDSFSSLRLCISGGAAMPVSLLESFEQAFNVKVSEGYGLSEAAPVTCFNPLDRPRKAGSIGQNIVNVINKVVDEIGNELPPGEVGELVVQGPNVMKGYYKMEEETAAAIRDGWLYTGDMARMDEDGYFYIVDRKKDMILVGGYNVYPREVEEVFYSHPSVVEVAVIGVPDPQTGEAVIAYVVVDNSDVKEIDLIEFSKQHLAKYKVPQSISFLEELPKNTTGKILRKSLKDQVTNS

SEQ ID NO: 50970 - protein, 392 aa, Nitrosomonas europaea ATCC 19718
MSVIKLVDLDLKNKRVFIRADLNVPVKDGKVTSDARITASMATINHCLKQGAKVMVTSHLGRPEEGVWTEENSLQPVADDIARRLGKPVRLIKDWVEGGFEVASGELVVLENCRINKGEKKNLEETAKKYASLCDVFVMDAFGTAHRAEASTHGIAKYAPIACAGILLTEELDALTKALHQPAHPLVAIVGGSKVSTKLTVLESLAEKVDQLVVGGGIANTFLKAAGNNIGKSLCEDELVPVAKSLMDKMNKRNATIPIAVDVVVGKKFAEDEAAVLKAANAVSDDDMIFDIGPESAQELVDIIMKAGTVVWNGPVGVFEFDQFGEGTRAIAKAIAETDAFTLAGGGDTIAAIQKYDIYDKVSYISTAGGAFLEFLEGKKLPAVEILELRAK

SEQ ID NO: 50971 - protein, 333 aa, Nitrosomonas europaea ATCC 19718
MTIRIGINGFGRIGRMVFRCSIEEFDDIEVVAINDLLEPDYLAYMLTHDSVHGRFRGDVSVSGNNLIVNGKQIRLTAIKDPTELKWDEVGADIVVESTGLFLTKELAQKHIQAGAKKVVLSAPSKDDTPMYVYGVNDKAYGGEAIISNASCTTNCLAPIAKVLNDTWGIKRGLMTTVHAATATQKTVDGPSNKDWRGGRGILENIIPSSTGAAKAVGVVIPELNKKLTGMAFRVPTSDVSVVDLTVELEKDASYEDICNAMKEASAGSMKGILGYTDQKVVSTDFRGETCTSVFDAEAGIQLDKNFVKVVSWYDNEWGYSCKLLEMVRVIASK

SEQ ID NO: 50972 - protein, 672 aa, Nitrosomonas europaea ATCC 19718
MKEAFKDFSAPVFKNLTSAIRALAMDAVQKANSGHPGMPMGMAEIAEVLWNHHMRHNPTNPDWVDRDRFVLSNGHGSMLIYALLHLTGYDLSIEDIKNFRQLHSKTPGHPEYGYTPGVETTTGPLGQGITNAVGMALAEKILAEEFNRPYFPIVDHYTYVFLGDGCMMEGISHEACSLAGTLKLGKLVCFYDDNGISIDGHVEGWFTDNTPKRFESYGWHVVPDVNGHDPVAIQAAIEAAKKVQDKPTLICCKTVIGMGSPNKANTSHVHGAALGNDEIAAARPHIGWNYLPFEIPQEVYDAWDARAKGQALESAWNSMFAEYGKKYPAEAAEFTRRMADELPVGWADHVEGTISQINAREETIATRKASQNSIEALAPVLPELIGGSADLAGSNLTMWSGSKGISTESTGNYVFYGVREFGMSAIMNGLSLHGGIIPYGGTFLMFSEYARNALRMAALMKIRNIFVFTHDSIGLGEDGPTHQPVEQTATLRMIPNMDVWRPCDTVESIVSWVSAIERREGPSSLIFSRQNLPFQKRDAVTISLIRKGGYILSEAANRKPQAIIIATGSEIGLAMAAQKTLAESGIAVRVVSMPCTNIFDRQDQAYRDSVLPKGIARVAVEAGVTDYWRKYVGLEGDVIGIDRFGESAPAEKLFEYFGFTVENVVNAVKRVI

SEQ ID NO: 50973 - protein, 125 aa, Oryza sativa (indica cultivar-group)
MAKITVFLFLLVALVVVSAAEASPEPLPARRSRFLLTSSSFYSCSKKSAAAVCLAVGSPGATCCGGRCVDTGASGEHCGGCNKACKHGRSCCGGRCVDLLSDRDNCGSCSNQCSNKCTYGFCDYA

SEQ ID NO: 50974 - protein, 470 aa, Novosphingobium aromaticivorans DSM 12444
MAEQYDVIVLGSGPGGYVAAIRCAQLGLKTAIVERENLGGICLNWGCIPTKALLRSAEVLNHMKHAAAYGLAADNIRADLDAVVKRSRGVAKQLNQGVTHLMKKNKITVHMGNGILKSATSVEVTGDKGSETISAKHVIVATGARARDLPFAKADGERVWTYRHAMTPKEMPTKLLVIGSGAIGIEFASFYNDMGAEVTVVEMMDRVVPVEDADVSAFLEKALTKQGMKIMTGAGVESLAVSASGVKAKIKGKDGKVAEGDYSHVIVAVGIVPNTEHIGLEALGVKAERGIIAIDGYGRTNVKGLWAIGDVTPGPWLAHKASHEGVIAAEAIAAELGNKEVHPHPMDRGNIPGCTYCHPQIASVGLTEAKAKEAGYAVKVGTFPFIGNGKAIALGEPEGFVKTVFDAKTGELLGAHMIGAEVTEMIQGYVVGKTLETTEAELMHTVFPHPTISESMHESVLAAYGRAIHI

SEQ ID NO: 50975 - protein, 135 aa, Oryza sativa (indica cultivar-group)
MAKATILLFLVLAAATAAMAATSASTAPVGIRKSRFLMTQQGQGADPYYYYSCSKKSAAAVCLAAGSPGATCCGGRCVDTGASGEHCGGCNKACKHGRSCCGGRCVDLLSDRDNCGSCSNQCSNKCTYGFCDYAI

SEQ ID NO: 50976 - protein, 427 aa, Novosphingobium aromaticivorans DSM 12444
MPIAIKMPALSPTMEEGTLAKWLVKVGDKVSSGDIMAEIETDKATMEFEAVDEGTIVSIDVAEGSEGVKVGTVIATLAGEDEDASAPAPKAVAPAAAPVPVPAPKAEPAPAAVSTPAPAAASASKGDRVIATPLAKRIAADKGIDLKGVAGSGPNGRIIRADVEGAKPAAAAPVSTVAPAVASAAAPARAPAAVPDFGIPYEAQKLNNVRKTIARRLTEAKQTIPHIYLTVDIRLDALLKLRGDLNKALEAQGVKLSVNDLIIKALAKALMQVPKCNVSFAGDELRSFKRADISVAVAAPSGLITPIIVDAGSKSVSAIATEMKALANKAREGKLQPHEYQGGTASLSNLGMFGIKNFDAVINPPQAMIMAVGAGEQRPYVIDGALGIATVMSATGSFDHRAIDGADGAELMQAFKNLIENPLGLVA

SEQ ID NO: 50977 - protein, 326 aa, Bradyrhizobium sp. BTAi1
MSLHPDIAALLDMIQLGTESGARIPFPQLTPAQARADFDASSPLLDVDPPPLVHERQLMLPARDGTAIAARLYADRTPDCAEPLPVLLYMHGGGFVVGSLDSHQPLCRGLAIDSGVAVLSIDYRLAPEHRFPTAFEDCVDALAWLGREGPAAGLDPRRVAVGGDSAGGTLAAALAIAARDDRALPQPLFQVLAYPGLSPQQSSESYAAFGSGFLLERETVDWFFNHYLRQEADRHDWRFAPLAAPDLAGVAPAMLLLPEFDPLIAEGRDYAARLRAAGVAVDLKIYPGMIHEFLRMGNVVPDALQARAEIGARLAEVFARQTGVGR

SEQ ID NO: 50978 - protein, 289 aa, Arabidopsis thaliana
MDSSMSTKKKTKLSVRNQTCFKKSSLSSSSTAKKTTNLSMREQTMFKKALELSTLCNIDVCVIYYGRDGKLIKTWPDDQSKVRDMAERFSRLHERERCKKRTNLSLFLRKKILDDTKLSEKVLEMEDSLESGLRVLQDKLLLLQPEKNQTEFGQTRAVSSTTNPLSPPPSLIEDHRHQQRTEPLMSGVSNTEQDLSTSSLSQNQSKFSVFLYNHDNCSFYQVPDSVSSFDSLTSTGLLGEQGSGLGSSFDLPMVFPPQMQTQTPLVPFDQFAPWNQAPSFADPMMFPYN

SEQ ID NO: 50979 - protein, 343 aa, Oryza sativa (indica cultivar-group)
MEKIAENRTIIQYLPYVTRWDYLATMFTEAITVNAPEFLENIQIPQRASYIRVIMLELSRIASHLLWLGPFMADLGAQTPFFYIFRERELIYDLFEAATGMRMMHNYFRIGGVAADLPYGWIDKCLDFCDYFLRGVIEYQQLITQNPIFLERVEGVGFISGEEAVNWGLSGPMLRASGIQWDLRKVDLYESYNQFDWKVQWQKEGDSLARYLVRIGEMRESIKIIQQAVEKIPGGPYENLEVRRFKKAKNSEWNDFEYRFLGKKPSPNFELSKQELYARVEAPKGELGIYLVGDDSLFPWRWKIRPPGFINLQILPQLVKKMKLADIMTILGSIDIIMGEVDR

SEQ ID NO: 50980 - protein, 457 aa, Robiginitalea biformata HTCC2501
MSKQILVVGAGKSSSYLLHYLLGKSGEKDLRLVIADKHPDQLPKAVSDHPRTEIVSLDIARAEARRKAVGASDIVISMLPAALHIDIARDCLEFGKHLVTASYISPQMRELDSEVRKKGLVFMNEIGLDPGIDHMSAMQVIDRIKSRGGKILLFESFTGGLVSPQSDTNLWNYKFTWNPRNVVVAGQGGAAKFKQEGTYKYIPYHKLFRRTEFLEIEGYGTFEAYANRDSLSYREDYGLQDALTLYRGTMRRVGFSRAWNIFVQLGMTDDSYRIENSRGMSYRDFTNLFLPYSPTDSVELKLRHYLKIDQDDIIWGKLLEIHLFDRDRTITLENATPAQILQEILEASWTLGPDDRDMIVMYHKFGYQLDGRKHQLDSNMVVLGENKRLTAMSKTVGLPVAMATLLILEGTYDTPGVQIPKDPGIYEPVLAELAANGIAFREYDVPYLGYNPDSVAS

SEQ ID NO: 50981 - protein, 372 aa, Bacillus methanolicus
MTVTRGLEGVVATTSSISSIIDDTLTYVGYNIDDLADNASFEEVIFLLWHRKLPTKSELEELKILLAENAELPKEILDHFKMYPIDKVHPMAALRSAVSLLGLYDEEADLMDEEANYRKAIRLQAKIPSIVAAFARVRKGLEPVAPRKDLSFAANFLYMLKGKEPEDIAVEAFNKVLVLHADHELNASTFTARVCVATLSDIYSGVTAAIGALKGPLHGGANEAVMKMLTEIGSLENVEPYIREKLAKKEKIMGFGHRVYRKGDPRAKHLREMSKKLTELTGEPHWYEMSTKIEAIVTGEKGLPPNVDFYSASIYHSLGIDHDLFTPIFAVSRISGWLAHILEQYENNRLIRPRADYIGPGMQKFIPIEQRG

SEQ ID NO: 50982 - protein, 846 aa, Oryza sativa (japonica cultivar-group)
MMHPSLLATTQWVTLSTLLSIAIAADNYFSSSSPIFLNCGASAMQLDSNNRSWDGDTSSTFAPSVKGLAARASYQDPSLPSLVPYMTSRIFISNYTYSFPVIPGRMFVRLHFYPVAYGNYASRDAYFGVTTNNLTLLDNFNASQTALAAKYAYILREFSLNVTSGSLDLTFFPSTQNGSYAFVNGIEIVPTPDIFTTLSPIPPTNGNPDPSDIDSMISFQTMYRLNVGGMTISPQGDSMFYRSWENDSPYIYGSAFGVTFSKDSNVTITYPSTMPNYIAPADVYGTARSMGPIAQINLHYSLTWILPVDAGFYYLLRFHFCEIEYPITKVNQRSFFIYINNQTVQEQMDVIVWSGGIGITTYTDYVIVTVGSGQMDLWVALHPDLSSGPEYYDAILNGLEVFKLQDIGKKSLAGLNPPLPPQPKSDVNPKGVSGGGKSKGAVPASIRGAMGSTATMLIACFSVCIICRLKKVAKHSFMTDKKCMTYRTEFYHSPSNLCRNFTFDEIQVATRNFDESLLLGRGGFGDVYRGEIDNNGENVAIKRSNPLSVQGVHEFQTEIELLSKLRYCHLVSLIGYCKEKNEMILVYEYMAQGTLREHLYNSNKPSLPWKQRLKICIGAARGLHYLHMGANQTIIHRDVKTANILLDDKWVAKVSDFGLSKANPDIDSTHVSTVVKGTFGYLDPEYYRRKQLTQKSDVYSFGVVLFEILCARPAVNIELPEEQASLRDWALSCQKKGMLGKIIDPHLHGEISPPCLRMFADCAKQCVADRSIDRPLMSDVLWSLEAALKLQENAENNKKFSEATTSSKRTPDLITIMGTDKPSTYSTMSITGQKIIFSDMMHPQGR

SEQ ID NO: 50983 - protein, 313 aa, Saccharomyces cerevisiae
MAPYPYKVQTTVPELQYENFDGAKFGYMFWPVQNGTNEVRGRVLLIHGFGEYTKIQFRLMDHLSLNGYESFTFDQRGAGVTSPGRSKGVTDEYHVFNDLEHFVEKNLSECKAKGIPLFMWGHSMGGGICLNYACQGKHKNEISGYIGSGPLIILHPHTMYNKPTQIIAPLLAKFLPRVRIDTGLDLKGITSDKAYRAFLGSDPMSVPLYGSFRQIHDFMQRGAKLYKNENNYIQKNFAKDKPVIIMHGQDDTINDPKGSEKFIQDCPSADKELKLYPGARHSIFSLETDKVFNTVFNDMKQWLDKHTTTEAKP

SEQ ID NO: 50984 - protein, 170 aa, Glycine max
LSEHGCNDGEASLGSPLAGRLFVLVGAGGAGKALAFGAKSRGARLVIFDIDFDRAKSLACAVFGEAQPFKELVNFQPEKGAILANATPVGMHPNTDRIPVAEATLEDYRLVFDAVYTPRRTRLLNEADAAGAITVAGVEMFLRQAIGQFNLFTGLEAPEEFMREIVLSKF

SEQ ID NO: 50985 - protein, 754 aa, Arabidopsis thaliana
MASTSSLALSQALLARAISHHGSDQRGSLPAFSGLKSTGSRASASSRRRIAQSMTKNRSLRPLVRAAAVETVEPTTDSSIVDKSVNSIRFLAIDAVEKAKSGHPGLPMGCAPMAHILYDEVMRYNPKNPYWFNRDRFVLSAGHGCMLLYALLHLAGYDSVQEEDLKQFRQWGSKTPGHPENFETPGIEVTTGPLGQGIANAVGLALAEKHLAARFNKPDAEVVDHYTYAILGDGCQMEGISNEACSLAGHWGLGKLIAFYDDNHISIDGDTEIAFTENVDQRFEALGWHVIWVKNGNTGYDEIRAAIKEAKTVTDKPTLIKVTTTIGYGSPNKANSYSVHGAALGEKEVEATRNNLGWPYEPFQVPDDVKSCLDDLLFDLHFSSHWSRHTPEGATLESDWSAKFAAYEKKYPEEASELKSIITGELPAGWEKALPTYTPESPGDATRNLSQQCLNALAKVVPGFLGGSADLASSNMTLLKAFGDFQKATPEERNLRFGVREHGMGAICNGIALHSPGLIPYCATFFVFTDYMRGAMRISALSEAGVIYVMTHDSIGLGEDGPTHQPIEHIASFRAMPNTLMFRPADGNETAGAYKIAVTKRKTPSILALSRQKLPHLPGTSIEGVEKGGYTISDDSSGNKPDVILIGTGSELEIAAQAAEVLRKDGKTVRVVSFVCWELFDEQSDEYKESVLPSDVSARVSIEAASTFGWGKIVGGKGKSIGINSFGASAPAPLLYKEFGITVEAVVDAAKSFF

SEQ ID NO: 50986 - protein, 798 aa, Oryza sativa (japonica cultivar-group)
MMHPSLLATIQWLTLSALLSIAMAADNNSTASAPIFLNCGASGVQPDSYNRSWDGDASSKFAPSVKGNVARASYQDPSLPSPVPYMTARFFTSNYTYSFPVSPGRMFVRLHFYPTNYNGNLDSANAYFGVTTNNLILLDNFNASQTALATSSAYFFREFSVNVTSSSLKLTFAPSTRNGSYAFVNGIEIVPTPDIFTTPTPTSANGGDNVQYGIDPVMGLQTMYRLNVGGQPISPQGDSGFYRSWDNDSPYIYGAAYGVTFSKDGNVTIKYPNTEPNYTAPVAVYATARSMGPTAQINLNYNLTWILPVDAGFTYLLRFHFCEIQYPITKVNQRSFFIYINNQTAQNQMDVIVWSGGIGRTTYTNYVVTTVGSGQTDLWVALHPDLSSKPEYFDAILNGLEVFKLQDLGRNNLAGLNPPLPPKPGVNPNGGSSRGKSKSVAPAAIGGAVGGLAVLLIACVGLCIICRRKKKVAKDTGKSDEGRWTPLTDFTKSQSATSGKTTNTGSHSMLPANLCRHFSFAEIQAATNNFDKSFLLGKGGFGNVYLGEIDSGTRVAIKRGNPLSEQGVHEFQNEIEMLSKLRHRHLVSLIGYCEDRNEMILVYDYMAHGTLREHLYNTKNPPLSWKQRLEICIGAARGLYYLHTGAKQTIIHRDVKTTNILLDDKWVAKVSDFGLSKAGPNVDNTHVSTVVKGSFGYLDPEYFRRQQLTEKSDVYSFGVVLFEVLCARNALSPSLPKEQVSLADWALRCQKKGVLGEIIDPLLKGKIAPQCFLKFAETAEKCVADRSVDRPSMGDVLW

SEQ ID NO: 50987 - protein, 290 aa, Oceanobacillus iheyensis HTE831
MKMEKKNGKITPPAQVQSKQPGVESKMTPTPQFIHESYEGSNKLKGKVAVITGGDSGIGKSVSVHYAKEGADIAILYLDEHEDAEETKRLVEQEGRKCILINGDIGNQSFCEAAATEVLDNFGKVDILVNNAAEQHPQQTLMDISSEQLEKTFQTNVFSMFYLTKAILPNLKKGSAIINTTSVTAYEGNPVLIDYSSTKGAIVSFTRALSNDLAEKGIRVNAVAPGPIWTPLIPASFNKQQVDEFGGNTPMKRPGQPSELGPAYVYLASEDSSYMSGQTLHINGGKVVNG

SEQ ID NO: 50988 - protein, 353 aa, Catharanthus roseus
MMSRGATRISRSLICQISPRYFSSAAVRGHEPSLGILTSGGTTTFLHGNPGNGSERTALTWIKLPMMRARSASTVATVDQKDKDEKREDKNGVADGENGNKAVVSYWGVEAPKLTKEDGTVWRWTCFRPWETYKPDTDIELKKHHVPVTLLDKVAFFTVKALRWPTDLFFQRRYGCRAMMLETVAAVPGMVGGMLLHCKSLRRFEHSGGWIKALLEEAENERMHLMTFMEVSKPRWYERALVFAVQGVFFNAYFLTYLASPKLAHRIVGYLEEEAIHSYSEFLNELDKGNIENVPAPAIAIDYWQMPPDSTLRDVVMVVRADEALHRDVNHYASDIHYKGLELKEAAAPLDYH

SEQ ID NO: 50989 - protein, 582 aa, Oryza sativa
  misc_feature (373)..(373): Xaa can be any naturally occurring amino acid
MAAASPPASPPHPKRRKMSSSSDPDQEPTSPSAAGADGAQPRAPRYKRRKVAILLGYCGAGYQGMQKNPGARTIEGDLEEALYRAGAVPEADRAAPRRYDWARAARTDKGVSAAAQVVSGRFYVDPPVFTDRLNAQLAPQIRAFGYVRVTNSFNAKKFCDRRRYVYLLPVFALDPSAHPDREAVMASVGSGSELTKCLECSERGRKVPGVMGREGKVPDPALQEEKSVEASREEAAVGSNEDANCDPASTGDRSVDLPIPDNETNTQITEMRSNGAEKCDVQLSGGTLCSEAVPASNSETVCPILNSDSNTNSDSVDVDPSFVAEKKGSIETVVTEDGKKQAMDVVTEDEKKQDVDYEGSSLEEMPLRSAFSXYTHEVKERFNRILKKYVGTHNFHNFTTRTKAEDPAAKRFIISFAADRVVNLDGIDFIRCEVVGQSFMLHQIRKMIGLAVAVMRNCAPESIYDVAFRKDVNLNVPTAPEVGLYLDECMFTSYNKKWKDSHEAVSMEPYSEEAEEFKLKYIFPHIAAMEHKEGAVALWLHSLNSRNYPDFRYMDNAGTEASIAAAVESVDEGTVPSDNISE

SEQ ID NO: 50990 - protein, 136 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFDTDLCTVSTVTHPDTMMDGTGQCGSFPCSVAPTPLKC

SEQ ID NO: 50991 - protein, 474 aa, Oryza sativa (japonica cultivar-group)
MGKKGKWFGAVKKVFSPESKEKKEERLRRKLAASNPNPPDLTPSASLEVNVSVPPPPPPPPVQQIEEVKVPEVEQEQSKHVTVEAVPEAVPVPAQTSSLPPGVSREEQATIKIQTAFRGYLARRALRALRGLVRLKSLVEGNSVKRQAASTLRCMQTLARVQSQIRSRRLKMSEENQALQRQLLLKQELESLRMGEQWDDSTQSKEQIEASLISRQEAAVRRERALAYAFSHQWKSTSRSVNPMFVDPNNPQWGWSWLERWMAAKPWEGRAGTDKESNLDRASAKSASLNLGEGEITKAFNRRGSKPDKSSPTTPKLTRPASRQSPSTPSAKVSPIFAKKKSATPKNGLSQVDDDAKSVFSVQSERPRRHSIATSTVRDDESLASSPSVPSYMAPTKSARAKLRLQGSAVTDGAETPPEKVASVGSVKKKLSFQAGMAPPSPMRRHSGPPKVEVVKDIAEPPQPEALVINGGSK

SEQ ID NO: 50992 - protein, 523 aa, Mycobacterium tuberculosis CDC1551
MTSTRQAGEATEASVRWRAVLLAAVAACAACGLVYELALLTLAASLNGGGIVATSLIVAGYIAALGAGALLIKPLLAHAAIAFIAVEAVLGIIGGLSAAALYAAFAFLDELDGSTLVLAVGTALIGGLVGAEVPLLMTLLQRGRVAGAADAGRTLANLNAADYLGALVGGLAWPFLLLPQLGMIRGAAVTGIVNLAAAGVVSIFLLRHVVSGRQLVTALCALAAALGLIATLLVHSHDIETTGRQQLYADPIIAYRHSAYQEIVVTRRGDDLRLYLDGGLQFCTRDEYRYTESLVYPAVSDGARSVLVLGGGDGLAARELLRQPGIEQIVQVELDPAVIELARTTLRDVNAGSLDNPRVHVVIDDAMSWLRGAAVPPAGFDAVIVDLRDPDTPVLGRLYSTEFYALAARALAPGGLMVVQAGSPYSTPTAFWRIISTIRSAGYAVTPYHVHVPTFGDWGFALARLTDIAPTPAVPSTAPALRFLDQQVLEAATVFSGDIRPRTLDPSTLDNPHIVEDMRHGWD

SEQ ID NO: 50993 - protein, 563 aa, Xylella fastidiosa Dixon
MCSIFGIFNLQPSDNLQILRHQALECSQRQRHRGPDWSGVYVDVGAILVHERLAIVDPAGGAQPLLSEDGTLALAVNGEIYNHAVLKGTLQQPYAFQTHSDCEVINALYREETPTSFLNRLNGIFAFVLWDKTTGRGLIARDPMGVVPLYWGHDQDGRLRVASEMKALVEHCSDVAQFPPGHWYDTTTGTLVKYYERPWKNYSAVEGVQVSLQELREAFERAVHRQLMTDVPYGVLLSGGLDSSLVAAVAARYARHRIETNDQSEAWWPRLHSFAIGLKDSPDLSAANVAAEALNTVHHRFEYTFQEGLDVLPEVIRHIETYDVTTIRASTPMFLLARRIKAMGVKMVLSGEGSDEIFGGYLYFHKAPNAREFHEELVRKLNALYYYDCLRANKAMMAWGVEPRVPFLDREFLDVAMRMDAQHKMVDKTSNGPQRMEKGILRAAFDGYLPPSILWRQKEQFSDGVGYGWIDGLKAHAETQVSDHALATAETRFQVNPPQTKEAYYYRSIFERFFPSPAAAETVPGGKSIACSSPAAIAWDASFATMADPSGRAVSGVHQQALL

SEQ ID NO: 50994 - protein, 236 aa, Sulfolobus tokodaii str. 7
MKFMSELVKISKTQFENVFQCEFNDGTVRLCTKNLAPGFSVYGERLFKVEGVEYREWNAFRSKLGGAILKGLKQNPIVKGTKVLYLGAASGTTPSHVSDIVELEGKVYGVEFSPRVVREFLLVAQHRPNLFPILADARFPQYYRTLVEDVDVLYVDIAQPDETDIAIYNAKFFLKNGGYMMMAIKARSIDVTKEPTEIYEMEVNKLKENNFDVIQVIQLDPYDKDHAMVLAKYKGK

SEQ ID NO: 50995 - protein, 555 aa, Staphylococcus aureus subsp. aureus MW2
MTHLSDLDIANQSTLQPIKDIAASVGISEDALEPYGHYKAKIDINKITPRENKGKVVLVTAMSPTPAGEGKSTVTVGLADAFHELNKNVMVALREPALGPTFGIKGGATGGGYAQVLPMEDINLHFNGDFHAITTANNALSAFIDNHIHQGNELGIDQRRIEWKRVLDMNDRALRHVNVGLGGPTNGVPREDGFNITVASEIMAILCLSRSIKDLKDKISRITIGYTRDRKPVTVADLKVQGALAMILKDAIKPNLVQSIEGTPALVHGGPFANIAHGCNSILATETARDLADIVVTEAGFGSDLGAEKFMDIKAREAGFDPAAVVVVATIRALKMHGGVAKDNLKEENVEAVKAGIVNLERHVNNIKKFGVEPVVAINAFIHDTDAEVEYVKSWAKENNVRIALTEVWEKGGKGGVDLANEVLEVIDQPNSFKPLYELELPLEQKIEKIVTEIYGGSKVTFSSKAQKQLKQFKENGWDNYPVCMAKTQYSFSDDQTLLGAPSGFEITIRELEAKTGAGFIVALTGAIMTMPGLPKKPAALNMDVTDDGHAIGLF

SEQ ID NO: 50996 - protein, 306 aa, Mycobacterium tuberculosis CDC1551
MGTRGGTMDPAGNPATGTARVKRGMAEMLKGGVIMDVVTPEQARIAEGAGAVAVMALERVPADIRAQGGVSRMSDPDMIEGIIAAVTIPVMAKVRIGHFVEAQILQTLGVDYIDESEVLTPADYAHHIDKWNFTVPFVCGATNLGEALRRISEGAAMIRSKGEAGTGDVSNATTHMRAIGGEIRRLTSMSEDELFVAAKELQAPYELVAEVARAGKLPVTLFTAGGIATPADAAMMMQLGAEGVFVGSGIFKSGAPEHRAAAIVKATTFFDDPDVLAKVSRGLGEAMVGINVDEIAVGHRLAQRGW

SEQ ID NO: 50997 - protein, 525 aa, Yersinia pseudotuberculosis IP 32953
MTKNIHKHRILILDFGSQYTQLLARRVREIGVYCELWAWDVTEAQIREFNPSGIILSGSPESTIENGSPRAPDYVFTAGVPVLGVCYGMQTMAIQLGGKVESSNQREFGYAQVEIKADSALIRDIKDAINPAGEAVLDVWMSHGDKVAEIPADFVTVASTDTCPFAIMANEEKRFYGVQFHPEVTHTKQGLRLLERFVLGICGCEALWTSATIIEDAIVRLREQIGDDHVILGLSGGVDSSVTAMLLHRAIGKRLTCVFVDNGLLRLNEADQVLEMFGDKFGLNIVHVAAEDRFLSALAGVDEPEAKRKIIGRVFVELFDEEACKQEQVKWLAQGTIYPDVIESAASATGKAHVIKSHHNVGGLPKEMKLGLVEPLKELFKDEVRKIGLELGLPYDMLYRHPFPGPGLGVRVLGEVKKEYCDLLRRADAIFIEELHKADLYNKVSQAFTVFLPVRSVGVMGDGRKYDWVVSLRAVETVDFMTAHWAHLPYDFLGRVSNRIINEVNGISRVVYDISGKPPATIEWE

SEQ ID NO: 50998 - protein, 175 aa, Triticum aestivum
MAPPVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 50999 - protein, 414 aa, Shewanella sp. ANA-3
MSDIRQQALDYHEFPVPGKTAVCLTKPAETSHDLALAYSPGVAEPVREIAANPDNAYRYTNKGNTVAVITNGTAILGLGNLGPLASKPVMEGKALLFKHFANIDSTDIEVTHNTPEEFINTVAAIAGTFGGINLEDIKAPECFVIERELIERCNVPVFHDDQHGTAIVTAAGMINALEIQGKLISDATFVCMGAGAAAIACMTMLVKCGANRANIYMLDTKGVIHTGRTDLNEYKALFANDTDKRTLQDVIKGADVFLGLSGPNVIGAEEVAMMADKPVIFACSNPDPEIKPELAHATRSDLIMGTGRSDYPNQVNNVLCFPFIFRGALDVRASCINDEMKVAAVHAIAGLAKEEVPASVLKAYPKVSSLSFGPEYVLPKPMDPRLLPRVARAVAQAAIDSGVAAITALPHYAD

SEQ ID NO: 51000 - protein, 518 aa, Nocardia farcinica IFM 10152
MSADAPAFYVTTAIAYPNGAPHIGHAYEYISADAIARFKRLDGYDVFFMTGTDEHGQKMQQAAAAEGIPVQDLAARNSDVFERLDKALDVSYDRFIRTTDADHRAASVAIWERMLANGDIYLDNYAGWYSVRDEAFYTEEETTLLEDGSRISTETKTPVTWTEESNFFFRLSKYQDRLLAHYEEHPEFIAPATRRNEIVSYVKAGLKDLSISRTTFDWGVPVPGHPDHVMYVWVDALTNYLTGVGFPDTDSPAFRKFWPADVHIIGKDITRFHTVYWPAFLMSAGVPLPKRVFVHGFLYNKGEKMSKSVGNVVDPLELVDEYGLDAVRFFLLREISYGQDGSYSHDAIVARINADLANEFGNLVQRSLTMVHKNCDAAVPTPGEFTAEDRALLDRAAGLLERCRAEFDAQQMHLALEAIWLTLGETNRYFSAQQPWALRKSGTEADLARMATVLYVTLEVVRIVAILVQPVMPGSAGRILDLLAQQGRTFADLATPLTPGTPLPAPEPVFPRYVEPKE

SEQ ID NO: 51001 - protein, 145 aa, Zea mays
MMRGVGGPLLTIGDLLSDLAVDDPLVGVGDASVPSSPSAAQQAGKANPSDLSRLFEEHYDDLMKALQEKDPSWPSLMLKLCATLKTADRLMSCADTNAEQLLEKVKALEGVLDRSGHAVAEIVEALQRSGLANDGHGSQSKSASK

SEQ ID NO: 51002 - protein, 325 aa, Nitrosomonas europaea ATCC 19718
MSTSERPPSPSSMAEDFAVEPLSPDFGFYLRTTELLAERHSPVQHIEIVQTPLFGRAMRIDGCFMTSEQDEFFYHEPMVHLPAITHGDPRQALVVGGGDGGTAYNLLRYPNMERVVLAELDRDVIDMARTWLPKVHRGAFEDPRLELHLGDGRAFTGNCKNQFDQIVLDLTDPFGPAISLYTRDFYRACRRALKPGGVLSLHIQSPIYRSPIMARLLASLRDVFGVVRPYLQYVPLYGTLWAMAMASDSADPLSLSATEIDARLTQNGLIDLKLYSGGTHHALLNLPPFVQTLLSEPAYPIDDGNSLDDINLDPREAGKLKLIQT

SEQ ID NO: 51003 - protein, 109 aa, Oryza sativa
DLGETESFAQRQLRTTMDVDCPAWMDFVHGGLQFQAVHHLFPRVPRHNLRKVQFMIREFCNDTGVPYSILNFTDGNRKVLGRLKDVSDQLDIMIKCQQHMARTGESGLH

SEQ ID NO: 51004 - protein, 395 aa, Novosphingobium aromaticivorans DSM 12444
MSFKTLDDIGDLTGKTVLVREDLNVPMQDGAVTDDTRLRATIATLNELSDKGAKVLVLAHFGRPKGQPSEEFSLKKLAAPLAHVLGRPVSYIDWESDKAAVAALTPGAIAVLENTRFFDGEEKNDPAVIERFASLGDIYVNDAFSAAHRAHASTEGLAHVLPAYAGRAMEAELKALQKALGEPERPVAAVVGGAKVSTKLDVLKHLVSKVDHLIIGGGMANTFLAARGVNVGKSLCEHDLTGTAEEILDNADKSGCTVHLPYDVVVSKEFTANPPSLRTCNVHEVAADEMILDVGPAAVEALADVLKTCKTLVWNGPMGAFETEPFDAATVALARTAAALTKEGSLVSVAGGGDTVAALNHAGVVGDFSYISTAGGAFLEWMEGKELPGVAALEG

SEQ ID NO: 51005 - protein, 335 aa, Novosphingobium aromaticivorans DSM 12444
MAIKVAINGFGRIGRNVARAILERPDCGLELVSINDLADAKANALLFKRDSVHGAFSGEVSVDGNDLIVNGKRIQVTAERDPANLPHGANGIDIALECTGFFTNRDGGQKHLDAGAKRVLISAPAKNVDLTVVYGVNHDKLTGDHKIVSNASCTTNCLAPMAKVLHESIGIERGLMTTIHSYTNDQKILDQIHSDPRRARAAAMNMIPTSTGAAVAVGEVLPDLKGKLDGSSIRVPTPNVSVVDLTFTPKRDTSVEEVNGLLKAAAEGALKGVLGYTDEPLVSIDFNHDPHSSTIDSLETAVLEGKLVRVLSWYDNEWGFSNRMLDTAGAMAKFL

SEQ ID NO: 51006 - protein, 78 aa, Triticum aestivum
MDASALNDPRFQALLEEEKKKAMMNEMIAKLTDTCWDKCITGSIGSSFSNSETSCLSNCAKRFIDVKMLTMQRANSSS

SEQ ID NO: 51007 - protein, 224 aa, Streptococcus suis 89/1591
  misc_feature (188)..(188): Xaa can be any naturally occurring amino acid
MTNLKEQVGIKAAEFVTDGMIVGLGTGSTAYYFVQEIGRRVAEEGLQITGVTTSHATAEHAASLGIPLKNIDEVEYVDLTVDGADEVDGDFNGIKGGGAALLMEKVVAVNSKDCIWIVDESKVVQTLGAFKLPVEVVQYGAENLFRLFEKKGYRPSFRMRNGEKHITDMQNFIIDLDLRRIEDTYALXEELDRTVGVVEHGLFIGLISKVIVGTPEGPNIIEKK

SEQ ID NO: 51008 - protein, 646 aa, Pseudomonas fluorescens Pf-5
MGQTRFASGRQLDLICLGRLGVDLYAQQVGARLEDVASFAKYLGGSSANIAFGTARLGLKSAMLSRVGDDHMGRFLLESLVREGCDVSAVKVDPQRLTALVLLGLKDRETFPLVFYRENCADMALCAADIDEAFIASSKALLITGTHFSTDGVYRASLQALDYAQKHGVKRVLDIDYRPVLWGLAGKADGETRFVADPQVSQHVQGILGRFDLIVGTEEEFLIAGGSDDLLTALRTVRSLSAATLVVKLGPQGCTVIHGEIPERLEDGAIYPGVRVEVLNVLGAGDAFMSGFLSGWLEEASDERCCQLANACGGLVVSRHACAPAMPTRAELDYLFSSPVPITRPDQDPVLQRLHQVSVPRKAWKPLFVFAFDHRGQLVELAQQGGRELKAIGQLKQLFIEAVQRVEADLRRQGIEADVGLLADQRFGQEALNAATGRGWWVARPVEVQGSRPLAFEHGRSVGSNLIAWPQEQIIKCLVQFHPDDEPLLRLEQEAQIRGLYQASQVSGHELLLEIIPPRDLPGAHPEVLYRSLKRLYNLGIYPAWWKIEAQSAEEWKKLDELIQERDPYCRGVVLLGLNASAEALAEGFRQAADSRTCRGFAVGRTIFQEPSRAWLAGEIDDDTLIRQVQGTFEQLINAWRSARPV

SEQ ID NO: 51009 - protein, 655 aa, Novosphingobium aromaticivorans DSM 12444
MTRETTALAPMANAIRALAMDAVQAANSGHPGMPMGMADVATVLWTQFLKHDPAAPKWSDRDRFILSAGHGSMLIYALLHLSGYESPTMDDIRKFRQLDSVCAGHPENFLIPGVECTTGPLGQGLAMAVGFAMAERHLNAQFGSDLVDHKTWVIAGDGCLMEGINHEAVGLAGTLKLGRLNVLWDDNKITIDGDTSLSTSEDILGRYAASGWHVTSCDGHDFADIARALAEAQADPRPSLVACRTVIGKGAPNKQGGHNVHGAPLGADEIAAAREYLGWTAAPFEVPADILANWRSSAEAGKTARAEWEKRAAANPNAAELARRMAGELPAQTGFDAYIQSLIASPPKVATRKSSEMALEAFTANVPEMVGGSADLTGSNNTKTKSTAPFTPESYDGRYVYYGIREFGMAAAMNGMALHGGIIPYGGTFLVFSDYCRNAVRMSALQHVRAIYVFTHDSIGLGEDGPTHQPVEHVMSLRMIPNLLVFRPADAIETAEAWAIALANKDRPSVLALTRQNLPPVRFDAEMKSAKGAYRLVAAQADRKVVLLATGSEVEVAIKVAAELEAKGLGADVVSVPCWELFDEQDAAYKADLLPADALKVSVEAGVTLGWQKYIGDGLAIGIDTFGASAPAEVLFDHFGLTAEKIVPQILARVS

SEQ ID NO: 51010 - protein, 181 aa, Vibrio fischeri ES114
MSTETLTLIKNSIKSIPDYPKAGIMFRDVTSLMEDPKAYQATIQSLVEKYKQGGFTKIVGTEARGFLFGAPLALELGVGFVPVRKPGKLPRPTIAQTYDLEYGTDTLEIHTDAIVEGDKVLVVDDLLATGGTIEATVKLIRQLGGEVEHAAFVINLPEIGGETRLEGLGLNVYSICEFAGH

SEQ ID NO: 51011 - protein, 445 aa, Glycine max
LQRRMGKRKERIQNPEPFDPYGADPAKTKKRSKAPKRHQQEEQFIAPKLSSKIMKQALIQQKEEEKEEAPENNAANLFEEVPDVEEDGGDDIDDFAGFSETQSQFAEYDEEINEEDERLMEAFALKEPGQQKTLADLIVQRIKEKDASVASENRPVPKLDNSIIDIYKGVGTHLSRYTIGKIPKAFKHIPSMQLWEEVLYITEPENWSPNALYQATRIFASNFGAKKAERFYKLVLLPRVREDIRKNKRLHFALYQTLKKALYKPAAFFKGILFSLCESRTCTLREAVIIGSIIEKVSIPPLHSSVALLKLSGMEYCGTTSYFIKLLLEKKYALPYRVVDAVVAHFTRFLNETRIMPVIWHQSLLAFVQRYKNELQKEDKDRLRNLLEKQKHKLVTPEISRELDHSRNRGEKEEDLMSISSPVYVINKTIEEDRFDIPDVPMEED

SEQ ID NO: 51012 - protein, 120 aa, Arabidopsis thaliana
MFKKALELSTLCNIEVCVIYYGRDGELFKTWPEDESKVRDMAERFTKLNERERRKKRTNLSLFLRKKILDDNKLSGKVLEMKDSLERGLRVLQDKLLLLQPENQTKSLTRSVSSLDYVFV

SEQ ID NO: 51013 - protein, 1104 aa, Nostoc sp. PCC 7120
MPRRQDIQKILLLGSGPIVIGQACEFDYSGTQACKALREEGYEVVLVNSNPATIMTDPETADRTYIEPLTPELVEKVIARERPDALLPTMGGQTALNIAVALAKNGVLDQYNVELIGAKLPAIEKAEDRKLFNEAMDKIGVKVCPSGTASSLDESKAIARRIGTYPLIIRPAFTMGGTGGGIAYNQEEFEEMAQVGIDASPVSQILIDQSLLGWKEYELEVMRDLADNVVIICSIENIDPMGIHTGDSITVAPAQTLTDKEYQRLRDMAIKIIREIGVETGGSNIQFAVNPVNGDVVVIEMNPRVSRSSALSSKATGFPIAKMAAKLAVGYTLDEIRNDITKKTPASFEPTIDYVVTKVPRFAFEKFPGSEPVLTTQMKSVGEAMAIGRTFNESFQKALRSLETGRAGWGCDKAEKLPSGEQIRAQLRTPNPDRIFAVRHALQLGMSPEEIYELTAIDPWFLDKMQQLLEVEKFLKRTPLKQLTREQMYAVKRDGYSDRQIAFATKTTEDEVRAYRKELGVTPVYKTVDTCAAEFEAFTPYYYSTYEEETEVIPASKPKVMILGGGPNRIGQGIEFDYCCCHAAYALKGAGYETIMVNSNPETVSTDYDTSDRLYFEPLTKEDVLNIIEAENPVGIIVQFGGQTPLKLALPLQDYLRQVGNGSLVIGNGNEETAITDDQLPITKIWGTSPDSIDSAEDRERFEKILQKLNISQPPNGIARSYEDALIVAKRIGYPVVVRPSYVLGGRAMEIVYSDTELERYMTFAVQVEPEHPILIDKFLENAIEVDVDAIADHTGRVVIGGIMEHIEQAGIHSGDSACSLPSISLPPAVLNQIRTWTVQLAQELSVVGLMNIQFAVIGASSYSPQVYILEANPRASRTVPFVSKATGVPLAKLASLIMSGKTLEELNFTQEVIPSHIAVKEAVLPFNKFPGTDTILGPEMRSTGEVMGIDSDFGRAFAKAELGAGERLPLTGTVFVSMSDRDKSAAVPVVREFIDLGFKVMATFGTRRVLLENGLNVELVLKLHEGRPHVIDAIKNQKIQLIINTPSGEEAQTDARLIRRTGLAYKIPIITTIAGAKATVAAIRSMQNTTLDVKTIQEYCPNF

SEQ ID NO: 51014 - protein, 400 aa, Candidatus Kuenenia stuttgartiensis
MFREGVFFFMVLSRVAREIQASATLAITAKAKQLAAEGKDVIGFGAGEPDFDTPENIKNAAIKAIKNGFTKYTPTSGVPKLKEAICEKLFNDNHLKYASSQILVSAGAKQSICNIALVLCDTGDEAIIPSPYWVSYPEMVTLAGAKPVFLETTDKDSFKITKESLAKVITPKSKLLFLNSPSNPTGMVYTEEELREIVMFAVEKGLYVISDEIYEKILYDGAAHFSPAAINDDCYNKVVTVNGFSKVYSMTGWRLGYAAGPEKIIKAATNIQDHTTSGANSITQLAGLEALRGSQESVTVMVKEFDRRRKYIVERLNTIKGISCLLPQGAFYAFPNVSRLCENLSLKGSFDLVSLLLEKAHIAFVPGAPFGADAHIRISYATSMENIEKGMDRFEKFLNT

SEQ ID NO: 51015 - protein, 287 aa, Arabidopsis thaliana
MDSSMSTKKKTKLSVRNQTCFKKSSLSSSSTAKKTTNLSMREQTMFKKALELSTLCNIDVCVIYYGRDGKLIKTWPEDQSKVRDMAERFSRLHERERCKKRTNLSLFLRKKILDDTKLSEKVLEMEDSLESGLRVLQDKLLLLQPEKNQTEFGQTRAVSSTTNPLSPPPSLIEDHRHQQWTEPLMSGVSNTEQDLSTSSLSQNQSRISVFLYNHDNRSFYQVPDSVSSFDQSALLGEQGSGLGSNFDLPPMVFPPQMQTQTPLVPFDQFAAWNQAPSFADPMMFPYN

SEQ ID NO: 51016 - protein, 281 aa, Francisella tularensis subsp. holarctica
MNILSVDYYADDAAELFTRSLKETGFAVLRTHPIDWNLIQTVYKEWQEFLKSGAADKYIFDVENQDGYFPIDVSEVAKGETVKDIKHFYHLYFPNGRYPTEVSSAAREMFEKMIRLGETLLQWIDDYMDPAVASKLPQRLRDTASYENTLLRILHYPAIQGDEEPGAVRAAAHEDINLITLLPIASSPGLQVLSPFNNQWYDVSCDSESIIVNIGDMLQEMTNGEYIATKHRVVKPQDEKENLDRISTPCFIHPKSDVYLSDKYPRAEIFLNERLKELGLK

SEQ ID NO: 51017 - protein, 115 aa, Francisella tularensis subsp. holarctica
MKNKFVELVEKSQLRNDLPEFNPGDSITVNLWIKEGDKQRIQAFKGFVLRKRNRGLHSAFTVRKMSSGMGVERTFQTHSPLIDSIIVEKRADVRRAKLYYMRGLTGKAARIKEKV

SEQ ID NO: 51018 - protein, 152 aa, Nostoc sp. PCC 7120
MPKTVADVMSHNPVVVKPETPLQEAIKILAERRISGLPVVDNDGKLLGIISETDLMWQETGVTPPAYIMFLDSVIYLQNPAVYERDLHKALGQTVGEVMSKNPVTVSPEKSVKQAAQLMHDRNVHRLPVLDDAGQVIGILTRGDIIRAMATS

SEQ ID NO: 51019 - protein, 491 aa, Candida albicans SC5314
MQEGVQFAAATNLKSRNKQGNGTAAESPSLSPQISDHSNDAGNKSNNHYKERLSPFRYKLRSLILPLIRQETIYLAKMQSFLRCSVFDFYFAWTANLASHTFYVLMLPPPIWFGGSYLTRDLVYVLGLGIYLTGFLKDFFCLPRPRSPPLHRITMSSYTTQEYGFPSSHSANATGVSLLLLIKILSLENVSNTTYYSLIVGLSLYYISLIFGRLYCGMHGFLDIIIGGLVGSFVFLFRHYFGLQWDKLLFDNGLGLVASTVIIIAVFVSLIHFHSEPVDDCPCFDDSVAFVGVLIGLDLAHLVAYQTKYFAKMNLTGNPYLIPFDVNRGVLNSVSRFLLGVALVVTWKTLAKPIVFTILPPIYKAVGVYLPRRSYISTAHTQTSTRKIRSTSMSNDSNMGIGDINNFIKGVTDHNKKDEVGPETEIDYYEMLSYSQNQNSDNTTIQTPPKYNSGVFKYRYDVEIVGRLIIYAGISITAVWTFAFASDYLNL

SEQ ID NO: 51020 - protein, 254 aa, Sulfolobus tokodaii str. 7
MPTLKLIGLGLSAKFVTREAIDEISKCNVVLFESYTSLSCDINLDFIKFLNKNVIIVDRKFIENNIKEIIKLLKEKEDVCIVTIGDPMIATTHVSLIVEVKDKGYNFKVIPGISVHCYIISKSMLSSYKFGKSVTITYPYNNKIDTTPYDVIYDNFIRGLHTILYLDLKEDKIMTAKEAVELLIEMEKIKKQGLVSDDRIIIVGQRLGCDDEEVVALRLKEVFNYKFKEPPHIIVFPTDKLHFMEVEALKCLMK

SEQ ID NO: 51021 - protein, 110 aa, Triticum aestivum
MEPASASLVSLRASAATSHSCFSCRQRATPKTRMLPAMASKSGAKLVASGCKTCRGKGAVECEGCKGTGRNKKNGNIFERWKCFDCQGFGMRKCPTCGKGGLTPEQRGER

SEQ ID NO: 51022 - protein, 388 aa, Francisella tularensis subsp. holarctica
MNNNEIIHQTIEKQGSIVWKSVFGLLLLPLVALIAIPWYAMTYGFSTSDYVCLVVFYMLTGVGITMGYHRLWSHKTYKANKIVSYALLLFGTAALQNSVIQWSSDHRKHHKDVDDPIKDPYAATRGFWFSHFGWLLRHSSPDVQEIRGVNDLLKDKALVFQHNHYTVLAILSCFGLPVLLGFIFGFLSGHTLTAAWHSALGFLLLGGLLRVILVHHATFCINSLAHTIGKRPYSTKNTARDSWITAIVTGGEGYHNYHHAFAGDYRNGIRWFDLDPSKWFIAGLAKIGWCYDLKTTPKHLIEIAKAKVKLEEALTKKNKTFHLGIEEKYAKLVANVKNMYNAKQEYLKAKKDNVLSKADIKEIKSKYKDLKIEFIQAKKKYNKASTIA

SEQ ID NO: 51023 - protein, 391 aa, Shewanella sp. ANA-3
MSQFQSIDVADYYDAQTFKRIEEFAKDKATPFVVIDTSIIAKQYDDMVNSFPYADVYYAVKANPAAEILTLLKNKGSNFDIASIYELDMVTNVGVTPDRVSYGNTIKKRQDVRAFYERGVRMYASDSEADLRMIAEEAPGSRIYVRILTEGTDTADWPLSRKFGCQNEMAYELLVLANELGLEPFGISFHVGSQQRDIGAWDSAIGKVKSIFDRLRDEHNIVLKMINMGGGFPANYIDKTNQLGVYAEQITHFLKEDFGDDLPQIILEPGRSLISNAGVLVSEVVLISKKSYTALERWVFTDVGKFSGLIETMDEAIKFPIFTHKQGELDKCVIAGPTCDSADIMYEHYSYGLPNDLAIGDRMYWLTAGAYTTTYSAVCFNGFPPLKDYYL

SEQ ID NO: 51024 - protein, 155 aa, Glycine max
  misc_feature (64)..(64): Xaa can be any naturally occurring amino acid
IGGYHVGRDMALILDVARFKYPPHWIPLKLLWEGMNYIDEDTGQSRGFMLVSRPHREPGLLYTXEDVKDILQVVSIIAASLPSNFEEFIKWIAEIRRREDGGPSLSAEEKARLAIKEEVLKQVQETGLFKHVASFLSSSCSRQHVLGDGDTLPII

SEQ ID NO: 51025 - protein, 268 aa, Triticum aestivum
MEDERSTQSYQGGEAAEQVEVTDRGLLGNLLGKKKAEEDKEKKEEELVTGMEKVSVEEPEVKKEEHVDGEKKETLFSKLHRSSSSSSSSSDEEEEEVIDDNGEVIKRKKKKGLKEKLQEKLPGHKDTEGEHVTALPAPAAPASVQTHHDTDVVVEKIDGDVKTEATPAVPEEEKKGFLEKIKEKLPGGHKKPEDAAAVPVTHAAPAPVTHAAPAPVHAPAPAAEEVSSPDAKEKKGLLGKIMDKLPGYHKTGEEDKAAAATGEHKPSA

SEQ ID NO: 51026 - protein, 885 aa, Nitrosomonas europaea ATCC 19718
MDPMDIDPQETQEWLDALETVLMNEGTERAHFLLEKLVEKARRSGAYLPYSANTAYINTIPPGKEERSPGDHALEHRIRSYIRWNAMAMVLRANRHTNVGGHIASFASAATLYDVGYNHFWRAANEHQGGDLVYVQGHSAPGIYARAFLLDELTSDQLDNFRQEVGNNGLSSYPHPWLMPDFWQFPTVSMGLGPLMAIYQARFMKYLGARGLAQTEGRKVWAFMGDGEMDEPESLGAISLGAREKLDNLIFVINCNLQRLDGPVRGNGKIIQEMESTFRGAGWNVIKVIWGSYWDPLLAKDTKGLLQQRMMECVDGEYQTFKSRDGAYVRQHFFGKYPELLEMVANMSDDDIWRLNRGGHDPHKVYAAYSTAMKHTGQPTVILAKTIKGYGMGEAGEAQNITHQQKKMGTISLKAFRNRFGLPVPDDKIDEIPYLKLEEGSPEYNYMRARQQAMGGFIHHRRRKAAALQIPPLSAFETLLKASGEGRESSTTMAFVRILNVLVKDKNIGKHVVPIVADESRTFGMEGMFRQLGIWSSVGQLYTPEDADQLMYYKEDRNGQILQEGINEAGAMASWMAAATAYSTHGVQMIPFYIFYSMFGFQRIGDLAWAAGDMRCRGFLLGGTAGRTTLNGEGLQHEDGHSHLAASTIPNCVSYDPAFAYELAVIMQDGLRRMYQEQEDVYYYITVMNENYPHPEMPKGAEQGILQGMYLFRSGGKQRSKSHVQLLGSGTILREVIAAAEILEKDYKVSADIWSVTSFNQLRREALAVSRHNLLHPDEPARLSYVETCLKDREGPVIASTDYMKIVADQIREFIPGRYFVLGTDGFGRSDTREKLRQFFEVDRHYVVIAALKALADEGKIPSSQVTKAIRTFAIDPDKPEPVKI

SEQ ID NO: 51027 - protein, 351 aa, Novosphingobium aromaticivorans DSM 12444
MTYEESPVSLAEAPTRRLNMIEAINDALDIMMERDPNVVVMGEDVGYFGGVFRATAGLQKKYGKTRVFDTPISECGIIGVAVGMGAYGLRPVPEIQFADYIYPGLDQLVSEAARLRYRSAGEFIAPMTVRSPFGGGIFGGQTHSQSPEALFTHVAGLKTVVPSTPHDAKGLLIAAIEDNDPVIFFEPKRIYNGPFNGYYDKPVEPWSKHADSAVPEGYYSIPLGKARVVRPGQAFTVLAYGTMVHVAAAVCAEKGVDAEIIDLRTLVPLDIETVEKSVEKTGKCLIVHEATRTSGFGAELSALVQERCFYHLEAPIERVTGFDTPYPHSLEWAYFPGPVRIGEAVDRLMKA

SEQ ID NO: 51028 - protein, 259 aa, Triticum aestivum
MEDERSTQSYQGGEAAEQVEVTDRGLLGNLLGKKKAEEDKEKQEELVTGMEKVSVEEPEVKKEEHEDGEKKETLFSKLHRSSSSSSSSSDEEEEEVIDDNGEVIKRKKKKGLKEKLKEKLPGHKDTEGEHVTGLPAPAAPASVQTHHDTDVVVEKIDGDVKTEAAPAVPEEEKKGFLEKIKEKLPGGHKKPEDAAPVPVTHAAPAPVHAPAPAAEEVSSPDAKEKKGLLGKIMDKLPGYHKTGEEDKAAAAAGEHKPSA

SEQ ID NO: 51029 - protein, 543 aa, Hypocrea lixii
MAIGNIYVIAGVSVVGGALFGFDISSVSAQLAEQSYLCYFNQDENPPTTADGKCGGPRSLVQGGITASMAAGSWLGALISGPLSDRLGRKYSIMVGCIIWVIGSTLSCASQNIGMLIVARIINGISVGIESAQVPVYIAEISPPSKRGRFIGMQQWAITWGILIMYYISYGCSFIGEDNPVSYNTAAWRIPWGLQMIPAFFLFFMMMPLPESPRWLARKDRWEDCRAVLTLVHGKGDPNHPFVAYELQDIKDMCEFERQHADVTYLDLFKPRMINRTFIGLFTQIWSQLTGMNVMMYYIANIFSMAGYSGNANLLASSIQYIINVLMTIPALLWVDKWGRRPTLLIGSVLMALWMYANAGILATYGEVVPGGIDHVAAQSMRVTGAPAKGLIACTYRFVASFAPTWGPVSWTYPPELFPLRLRGKGVAMATSGNWAFNTALGLFTPVAFANIKWKSYLIFAVFNTVAFFHVFFVFPETAGKTLEETEAMFEDPNGIPYMGTPAWKTKVATSLTVRAEQGDLEAKIAHDTEKPPIHTHEEETTQ

SEQ ID NO: 51030 - protein, 186 aa, Brassica napus
PAVLLMGGGEEMGPIEATARALGDALYDENLGEAVGQVLIICGRNKKLQTRLSSIDWKIPVQVKGFVTKMEECMGACNCIITKAGPGTIAEAMIRGLPIILNGYIAGQEAGNVPYVVENGCGKFSKSPKEISKIVADWFGPGSKQLEIMSQNALRLARPEAVFKIVQDMHELVRQRNYLPQLSCTA

SEQ ID NO: 51031 - protein, 1066 aa, marine gamma proteobacterium HTCC2143
MSQIPEPKGKLPGIGHTHLIDAAEPVQSLLALSKNMGEIYQLQLPGGKLLVVSSQRLVDELCDESRFDKKVSGPLSNIRDIALDGLFTAKTTEPNWQKAHNILMPAFSMGAMSNYFPMMLEIAEQMMTRWGQLNAHDEIDVPADMVRLTLDTIGLCGFDYRFNSFSRDEPHPFIESMLVALQEAIDRAVALPFVHAMNIGRRQRYEKHVQNLKNIVDSVIAERKADDGTTDAKDLLSLMLTGSDPATGEKLSDENIRYQIITFLIAGHETTSGLLSFALQYLIKHPAVLKRAYAEVDEVLGSDITTPPTLAQLGRLPYIRQVLNEALRLYPTAPAFTVMPLEDTTLAGVYPLKAGQPILILIGGLHRDEKAWGDNPDLFDPDRFAPDVAALRLPNAFKPFGNGQRACIGSQFALQESILAIGMALQRFKFIDHTNYQLDVKETLTLKPDDFRLRLKKRTDQDRKLNVQTGPEIDDRPKVKDVANLTSDHATPLLILHGSNMGSAQQIAARLAEEGESVGFVVSSGSLDEYTNRLPSDGAVLLITGSYNGTPTDDAKTFMAWLESTEQSLGHVRYGVFGVGNRDWATTYQRVPRLIEQRLETLGAECVVARGEADARGDFFGDIDSYAKTVWPELAVSLGLTVAAPVDRGDRFTVDLLTDNDRDTVFLQHHSLTPMTVTVNDEMVDTRVDYGLSKRHISVNLPEGVNYKTGDHLLVMPRNPAVNVERAAVRFGLGIQQRLRLSLKHGSAGAIPINSDITVNTLLSRYVELCDPATVRQIKLLAEHASCPPDVTALNNLAHSDHYKSEVLDKRVSMLDLLDCYSSIDLPFATYVDQLAELQPRYYSIASSHLTSAGSVDIAVSRVAGAALGGNGNYLGACSSTLSDTEVGESIWARIRSVDSEFLPPQDLQQPIIMIGPGTGVAPFRGFIQDRMLHLKQGKTLGEAILFFGCRHPDVDEIYGDEFAEAQAAGAVSCIKAYSRAPAHPHRYVQDAIAANANRIWELWTRGARIYVCGDAQYMLPGVRHALQHIYQDAYKKEGETISDKQAQVWLQEMEVAGRFLVDAWA

SEQ ID NO: 51032 - protein, 709 aa, Oryza sativa (japonica cultivar-group)
MGCVASKNAVSVTPAADSSGAPAGEEPAAGARRPRTTVVRSEKKRDEAAVAAAGEEPSEKAVIAAATASRSFRLRSLRRSLEGEQVAAGWPPWLSAVAGEAIQGWIPLKADSFEKLEKVGQGTYSSVFRARELDTGKIVALKKVRFDNFEPESVRFMAREIQILRRLDHPNVMKLEGLITSRLSCSLYLVFEYMEHDLAGLSSSPDIKFSEAQVKCYMNQLLSGLEHCHSRRIVHRDIKGANLLVNNEGVLKIADFGLANYFDPNKNHPLTSRVVTLWYRPPELLLGSTHYDAAVDLWSAGCVFAEMFRGKPILQGRTEVEQLHKIFKLCGSPADEYWKKSKLPHATIFKPHCPYQSTLQDVFKEMPANALRLLETLLSVEPYKRGTASAALTSEFFKTKPYACDPSSLPKYAPNKEMDAKLREDSHRRKASRGHGPEASRKSRLSRAARETTTVNKQTDGKEESKTKANGTKDNSILDRTKVNGDARLFSDIQPVSVAQVKERSRHVKNDSREEIPFSGPLIVSSSSGFAWAKKPPEDRSFARSRTKSSSRGQFTAELDQDNKMPAKENQNLGLKEQPNRDMHIARANSKVREPHDAAKRAVLKKWSQLGRPDSFDSYDTYHSQNFSNAMYLGDTLSSKNSIKGDHDQGERVEYSGPLLSQSHKVDELLEKHERHIRQVVRKSWFSREYAGKQFYLAILLALTTSGIM

SEQ ID NO: 51033 - protein, 181 aa, Mesorhizobium sp. BNC1
MKQSLEDTLLAAIRTIPDYPRPGILFRDITTLLGDARAFRRAVDELVHPYAGAKIDKIAGIEARGFILGGAIAHQLSSGFIPIRKKGKLPHETVRVAYSLEYGLDEMEMHIDAVSPGEKVILVDDLIATGGTAEAAVRLLRQMGAEIVAACFVIDLPDLGGRAKLEAEGVDVRTLVSFEGH

SEQ ID NO: 51034 - protein, 572 aa, Aspergillus oryzae
MASSVLPVALQNKLLGYSRAPNAQLAALNLDILKNIVFLFFILRYVRKTFYSLRGYGVLGSLRNVYAAIRLFCYSVFLRFPGVRGQVDKQVSSAIENLETKLVATGPGVTRYLNLPKEGWTPEQIRAELEKLANMEHTRWEDGRVSGAVYHGGQDLLKLQAEAFGQFGVANPIHPDVFPGVRKMEAEIVAMVLALFNAPSDGAGVTTAGGTESILMACLAARQKAYAERRVTEPEMIIPDTAHAAFYKASEYFGIKLHRVPCPAPEYKVDIPSVRRLINPNTVLLVGSAPNFPHGIVDDIPALSRLATAYKIPLHVDCCLGSFVVAFLKKAGFPSPYEEEGGFDFRLPGVTSISVDTHKYGFAPKGNSVLLYRNRTYRSYQYFVYPDWSGGVYASPSVAGSRPGALIAGCWASLMSVGESGYIKSCLDIVGAAKKFEASIREHPLLSKNLDVVGKPMISVVAFQSKNGAVDIYDMADALSAKGWHLNALQSPAAIHVAFTIPTASALDKLTADLVEVVEKELDKAEERKRQGKSYIIKRGDTAALYGVAGSMPDKSIVSRLAEGFLDTLYKA

SEQ ID NO: 51035 - protein, 328 aa, Solanum habrochaites
MAVNGASSSGLIVSFGEMLIDFVPTVSGVSLAEAPGFLKAPGGAPANVAIAVTRLGGRSAFVGKLGDDEFGHMLAGILKTNGVQADGINFDKGARTALAFVTLRADGEREFMFYRNPSADMLLTPAELNLDLIRSAKVFHYGSISLIVEPCRAAHMKAMEVAKEAGALLSYDPNLRLPLWPSAEEAKKQIKSIWDSADVIKVSDVELEFLTGSNKIDDESAMSLWHPNLKLLLVTLGEKGCNYYTKKFHGTVGGFHVKTVDTTGAGDSFVGALLTKIVDDQTILADEARLKEVLRFSCACGAITTTKKGAIPALPTASEALTLLKGGA

SEQ ID NO: 51036 - protein, 180 aa, Capsicum annuum
MASSVMSTATVATGANAAQASMIASFNGLKSAASFPVTRKQDLDITSIASNGGRVQCMLVWPPINKKKYETLSYLPDLSDEQLLKEIEYLLQKGWVPCLEFETEHGFVYREHHRSPGYYDGRYWTMWKLPMFGCTDATQVLNEVQEAKKAYPQAWIRIIGFDNVRQVQCISFIAYKPEGY

SEQ ID NO: 51037 - protein, 142 aa, Yersinia pseudotuberculosis IP 32953
MALERTFSIIKPNAVANNNIGAIYARFESAGFKIIAAKMLHLTKEQAEGFYAEHKGRPFFDGLVEFMTSGPIIVQVLEGENAVQRHRDIMGATNPDNALAGTLRADFADSFTANAVHGSDAVESAQREIAYFFAADEIFPRS

SEQ ID NO: 51038 - protein, 153 aa, Saccharomyces cerevisiae
MSSQTERTFIAVKPDGVQRGLVSQILSRFEKKGYKLVAIKLVKADDKLLEQHYAEHVGKPFFPKMVSFMKSGPILATVWEGKDVVRQGRTILGATNPLGSAPGTIRGDFGIDLGRNVCHGSDSVDSAEREINLWFKKEELVDWESNQAKWIYE

SEQ ID NO: 51039 - protein, 432 aa, Oryza sativa (japonica cultivar-group)
MAMPLTPPAPIPRVFDVVIFGGSGFTASYVIREALKFLPPSSSPLGSLALAGGSRDRVAAALAWAGGPGGAAPDLPILVADASDPGQVAAACAAAGADCLDISGEPEFMERVEAEFHEAAAKNGSLIISACGFDSIPAELGFLFHSRQWAPPSVPVTVQAYLSLESDKRIVGNFGTYESAVLGVANAGELQALRRSRPRRPRPNIPGPPPPKGSLVEHDKALGLWTIKLPSADTVVVKRTLSTVTQHPEGLPGVEESTDFAEHRKSFWSSVKPAHFGVKLTSKSLLGIAQFIFTGLCIGLLGGFSFGRSLLLKFPSFFSAGWFRKSGPTEEQVSSASFKMWFVGRGYSDAARASDRGSKPDKEIITRVSGPEIGYITTPIVLVQCALVLLSQRGNLPKGGVYTPGAVFGPTDIQQRLQENGLSFDLVSTRTL

SEQ ID NO: 51040 - protein, 989 aa, Polaromonas sp. JS666
MRLPFPYRPEGQVVASLLKSLAGALDWAAAVQPAQPWVQAVRDNPPPFWAMESLLKEYPISSAEGLALMRLAEALLRVPDAETAIALTADQLGRADFETAGDGVMARLSASAIAMSKKFLPEGGQPNLMSKLGARTVVAATLRAVQLLGRQFVLGQNIGEAMNEADDARRKMPNLRFSYDMLGEGARTDADALRYLASYTNAIESIAAGASNASPTEQNDGISIKLSALHPRYEDAQRERVMAELVPRVWGLCELAARANINLTVDAEEVDRLELSLDMFEALAARVAQHYPQWQGFGLAMQAYQTRSLALIEQVIAIGRRYKLRLMCRLVKGAYWDSEIKRAQELGLPHYPVFTHKHHTDVSYLACAQALLSAPDAIYPQFAGHNAGTIAAILQMASRNGVPFELQRLHGMGEGIFREVLKNPLISCRVYAPVGAHRDLLAYLVRRLLENGANSSFVHQLADESVNMGELLTSPLRLEPEPSLPLPPTLYGPGRPNSLGLDLTVDSMRAPLFAAFESVRVPTVPEFDARLATSAVAMGVSSYQKWSKVEVAERAAILRRAADALQQQMPKFCALLVKEAFKTWGDAVSEVREAVDFLRYYANEAERIMAPVALPGPTGETNELRLTARGAWVCISPWNFPLAIFTGQVAAALATGNAVLAKPAEQTPGVAWEAVKLLHAAGVPEGALQLLHGPGETVGAALVAAPQVAGVVFTGSTQVAKIINRALAAKDGPIVPLIAETGGINAMLVDSTALPEQVADAVVQSAFRSAGQRCSALRLLCVHEGIADGVIDMIQGAAQELVLGNPAELATDVGPVIDREAFDNIQRHLKRLGTDSKVLVARRENGAEAADLMANSIAPAAFEVSSLAEVKDEIFGPVLQIVRWGSGELKSPEAVIEQINALGYGLTLGLQTRIDSRAQALAAAAHVGNIYVNRNMIGAVVGVQPFGGEGLSGTGPKAGGPHYLYRFCAEQTVTVNTTAAGGNAALLAG

SEQ ID NO: 51041 - protein, 133 aa, Zea mays
MSYYGDRRAESSIVEAFTLSPLPYPVILVLLMVTLLLGASWFFTYDDFIEEASQQLSWALLGVPIALVLLIRWISSVDSFEGYLGFYPRESRWKGRYERGPAEGSSPWGVALLVLLLLVLASFHSTIHDMWGP

SEQ ID NO: 51042 - protein, 321 aa, Glycine max
MMMMMSRSGGNRVANTAMFVAKGLSGEVGGLRALYGGGVRSESTLALSEKEKIEKKVGLSSAGGNKEEKVIVSYWGIQPSKITKKDGTEWKWNCFRAWGTYKADLSIDLEKHMPPTTFLDKMAFWTVKVLRYPTDVFFQRRYGCRAMMLETVAAVPGMVAGMQLHCKSLRRFEHSGGWFKALLEEAENERMHLMTFMEVAKPKWYERALVITVQGVFFNAYFLGYLLSPKFAHRMVGYLEEEAIHSYTEFLKELDKGNIENVPAPAIAIDYWQLPPGSTLRDVVMVVRADEAHHRDVNHFASDIHYQGRELREAAAPIGYH

SEQ ID NO: 51043 - protein, 407 aa, Gluconobacter oxydans 621H
MTAVIHPDIRPRINSVASDDLNAAERERIRAKSALFAPPEARLADGRRDLVGLSREELAALMTEIGEKPFRAKQLWHWIYHQGATDFSAMTTIAKPMQAKLAEHFVVSRPTTATEQTSVDETRKFLFRFRDGQEAETVYIPDRREDRGAVCISSQVGCTLSCTFCHTGTQKLVRNLGPAEIVGQFMAARDSYGEWPSPSADMPRYLSTIVLMGMGEPLYNYENVAKAMRIIMDGEGIALSRRRITLSTSGVVPMMDRCGDELGINLAISLHAVTNELRDQIVPLNRKYPIEELIAACRRYPAASNSRRITFEYIMLRGVNDSEADARELVRLIRDLPAKVNLIPFNPWPGSDFQPSTRQQLTKFANIVMDAGFASPIRTPRGQDILAACGQLKTESERQRRSATPEA

SEQ ID NO: 51044 - protein, 187 aa, Oryza sativa (japonica cultivar-group)
MAGSEEKKEMQDPRTQAIASTIRVVPNFPKPGIMFQDITTLLLNPPVFKDTIDLFVERYTGKGISVVAGVEARGFIFGPPIALAIGAKFIPLRKPNKLPGEVMSKEYELEYGADCLEMHVGAVQPGERALVVDDLVATGGTLCAAIVLLERAGAEVVECACVIELPELKGRERLNGKPLYVLVESHS

SEQ ID NO: 51045 - protein, 284 aa, Zea mays
MAAGRAFLGAPCSSLAAGARCLAFASPLPRNLTPALRCGVRGRCIASASSSPDSPPLPEPYVLTTPLYYVNAPPHMGSAYTTIAADAIARFQRLLEKNVIFITGTDEHGEKISASAEASGRNPKEHCDAISSSYRTLWADLDIEYDKFIRTTDRKHEAVVNEFYSRVLNNGDIYRADYEGLYCVSCEEYKDEKELLENNCCPVHLKPCVERKEDNYFFALSKYQHKLEELLTRNPDFVRPSYRLNEVQGWIKSGLRDFSISRASVEWGIPVPNDTKQTIYVWVD

SEQ ID NO: 51046 - protein, 129 aa, Brassica napus
SCKQRWSRINHEVSRFTGCYNQALREQRSGQNDDDVIKAAYDIFFTKYDTKFTLDHCWRELRHEQKWASTYMAKDGGKEKRRPVVDLDGPEENVVGEDEDRPVGVKAAKGASKKKKSGRDEELSKLQGV

SEQ ID NO: 51047 - protein, 554 aa, Oryza sativa (japonica cultivar-group)
MARPLPSQGKEVMVGSKGVIKRDEFVRIITKALYSLGYEKSGAVLEEESGITLHSPTVNLFRRQVLDGNWDSAVVTLKKVGLLDENIVKSAIFLILEQKFLELLRNDNVMGAIRTLQSEITPLGVNKKRVHELSGCIISSPQHVLLGFSKLGIESSNSRLKLLEELQKVLPPTVMVPERRLENLLEQALTVQREACYFHNSIDGLSLYTDHHCGKDQLPSCTVQVLRAHRDEVWFLQFSNNGKYLASASNDKSAIIWKVDEDGELLLKHTLTGHDKPVMMVAWSPDDCQLLTCGMEEVIRCWDVESGKCLHVYEKSGIGLISCGWFPDGKHILSGLTDHNFCLWDLDGKEVDCWKGQRSSKTSDFAVSNDGKLIISMNRESTIRLFDRETKQERLIEEDNTITSFSLSEDGDFLLVNLISEAIHLWNIRNCPIRVNRYAGHKRSRFVIRSCFGGSEQAFIASGSEDSQIYIWHRATGDLIETLPGHTGTVNCVSWNPANPHMLASASDDHTIRIWGLKKANLKRKDVGSSNGIYANGNTPSNGVVHQCNGNSSK

SEQ ID NO: 51048 - protein, 100 aa, Triticum aestivum
  misc_feature (82)..(82): Xaa can be any naturally occurring amino acid
PEWELCFQKQGLDPRPVPEWYKGEGGPHFLFEYGKQPTALGPPPPFVPWVVVDGNPLYNDYGNFKAYVSKGSKGYPPPQGCXNLGLEATPNVSGPLCSCR

SEQ ID NO: 51049 - protein, 345 aa, Burkholderia mallei ATCC 23344
MPQTKTTNRRIVLHSRPKGAPTPENFRTETAAVPVPAPGEVLLRTIWLSLDPYMRGRMSDAPSYAAPVELGGVMVGGTVSRVVSSSVPAFRDGDLVLSNAGWQDYAVSDGTDLMPLADVAHPSYALGVLGMPGFTAYFGLLHIGEPKAGETVAVAAASGAVGAVVGQIAKLKGCRVVGIAGGADKCRYVAGTLGFDACVDHHDPDFAKQLAAACPDGIDVYFENVGGAVFDAVLPLLNDHARVPVCGLIAHYNDSELPGGPNRLPLLTSSVLRKRIRMQGFIILDHYADVYPAFLKDMSEWVAQGKVKPREDVVDGLDAAPRALIGLLGGKNFGKVVVRVGPDTL

SEQ ID NO: 51050 - protein, 142 aa, Triticum aestivum
  misc_feature (22)..(22): Xaa can be any naturally occurring amino acid
TKVLLMARTKQTARKSTGGKAXPRKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 51051 - protein, 478 aa, Pseudomonas fluorescens Pf-5
MSLQEQQTDLRGGFKQEMQTRHIVMLALGGVIGTGLFLTSGYTVNQAGPLGAVIAYIIGALMVYLVMMCLGELAVQMPETGSFSTYATRFLGPGTGYTVAWLYWLTWTVAIGSEFTAAGILMARWFPETPVWIWSALFAMVVFLSNVVSVRLFAETEFWLSLVKVITVLAFLVVGGGAILGLLHIDQAHSIGLSNFTREGLFPTGFMPIAMTLLAVAFAFSGTELIGIAAGETRDPQRNVPRAIRTTVLRLAIFFVGTIFVLATLLPREQAGLVESPFVTVFTYIGIPYSADIMNFVIISALLSAANSGLYAASRMLWTLSDQGHLPKQFSALTRMGTPLNAIIVSMAGGAASLLSSVFAPDTIYLALVSISGLAVVVVWMSIAASQIAFRRHFVANGGDVRDLKFRVRGYPWVPLGALLCCALACVGIGFDPEQRVALYFGLPFIAWCYLVYYITRSSRQRRLSLAALARPSDALQG

SEQ ID NO: 51052 - protein, 1049 aa, Zea mays
  misc_feature (616)..(616): Xaa can be any naturally occurring amino acid
MLRRPPPLRLGTRNRATTCHMRHTAAHQSRSPLSLSALAPAGTKATCRRALHRRRHHLVPAQVTCCRCHAIKREEGPVAAAISADRVALLAHLAGPLDASLHPCSLPTPKQVPPLLPTSTTTSMRTALVRGRGAGSTLTPALESACIDNLHAAAALQVVANAAWHPPLRCGCGWEGRAEELLAAAFLVPAAAGTGTQQQFSVGNYYGNFSRQMVLVRERSASRRRHFGPTKAALVCFCLLSFYLDTTAMPSTSFIVITTTISGAAELTMLCPRSGCSSRSRRHSSPPPPPPPAVRMRWLLLLAFAAAPAAGEMGYAHCGCDGSGGAGGGSGFWSLDNIFKWQKVSDLLIAAAYFSIPLEILYFVAGLRHLLPFRWVLVQFGAFIVLCGLTHLLAAFTYEPHPFMVVLLLTAAKFLTALVSFLTAITLLTLIPQLLRVKVRESLLWIKARELDREVVLMKRQEEASWHVRMLTQEIRRSLDRHTVLYTTLIELSRVLALDNCAVWMPSEDKSGMCLTHELRRGSDDGEAVVGADDADVLEVKGADGVKLLPPGSVLGSASGGGKEGTGTVAAIRMPMLRVADFKGGTPQVIKASYAVLVLVPPSGRKWAPHELEIVXVVADQVAVALSHASLLEESQAMRDRLAEQNRELLQARRDALIANEARDAFQRVMSQGMRRPIHSVQGLVSVVQEEEGLASEQRLVVDAVARTATVVSTLINDVMEMSAAASQERFPLETRPFRLRSMVRDAACVARCLCDLSGRFGFAVHVENVLPDLVIGDERRIFHVLLHMVGNLIGRVDEGDVTFRVRADDEATEDQRWDPWRPSYSGGHSSVRFVVGVKRQQNAGDSLPRFLRRPRTHDGLDLRLSFSMCRKLVQTMQGNIWAVLDGQGLPESMTLVLRFQLQPSLASSNLLGGSFDQEHYSSLPSNQIAGLKVLLIDDDEINLVVARKLLERLGCTVSSGSGLMDSSSACASFQLVMVNLEMSAIDPLDAASRIRQQYRSSHWPLVMAMTSEQNVWEKCAQSGINGVLKKPLVLLEVKEELERILQNT

SEQ ID NO: 51053 - protein, 437 aa, Picrophilus torridus DSM 9790
MKYLNMHRHYHAMSYSIKVLSSYRKRLIRLTPMLFFLYVVNFLDRVNLSYAIDAGMFQDIGAPANLASLIAGIASAMFFVAYAIPQVFTNLKINTIGIRKIFALAFGLWGIITILTGFVTDVPEMYALRFFLGLAEAPFYAGTMFFLGIWFSREERGLANGFFNAAIPVAGIFGGLIAGSIFTVYHDYPGWRYLFIIEGILALISIPLLYVVLSDFPDDAKWLSKSEKEELDSSILNEEKNKPTKVSWRAALRDRDVILYVLIYFFGVTALYGYTIWLPSIISSFSHVSAAESSFLSDIPYIVAAIALIFILRYSDRSGNRKILTFYIFFIAFAGLALSAFTERIPDLSFVLFTISAIGIFTFLPVFWTMPQEALTREGASAAIGLINALGNLGGVAGPIIVGGLESLTHSFVSGVYSMAAFALIAGLITLMIKKAR

SEQ ID NO: 51054 - protein, 432 aa, Synechococcus elongatus PCC 6301
VTSSPFKTIKSDEIFAAAQKLMPGGVSSPVRAFKSVGGQPIVFDRVKDAYAWDVDGNRYIDYVGTWGPAICGHAHPEVIEALKVAMEKGTSFGAPCALENVLAEMVNDAVPSIEMVRFVNSGTEACMAVLRIMRAYTGRDKIIKFEGCYHGHADMFLVKAGSGVATLGLPSSPGVPKKTTANTLTTPYNDLEAVKALFAENPGEIAGVILEPIVGNSGFIVPDAGFLEGLREITLEHDALLVFDEVMTGFRIAYGGVQEKFGVTPDLTTLGKIIGGGLPVGAYGGKREIMQLVAPAGPMYQAGTLSGNPLAMTAGIKTLELLRQPGTYEYLDQITKRLSDGLLAIAQETGHAACGGQVSGMFGFFFTEGPVHNYEDAKKSDLQKFSRFHRGMLEQGIYLAPSQFEAGFTSLAHTEEDIDATLAAARTVMSAL

SEQ ID NO: 51055 - protein, 186 aa, Oryza sativa (indica cultivar-group)
MAAAAAGGGGFEARVARIASTIRVIPDFPKPGIMFQDITTMLLKPDAFRDTIELFVERYKDKGITVIAGVEARGFIFGPPIALALGAKFVPLRKPKKLPGEVISEEYSLEYGTDKIEMHVGAVEPNDRAVVVDDLIATGGTLSAAVKLIERAGAEVVECACVIELPELKGRDKLGNKPVFVLVKAD

SEQ ID NO: 51056 - protein, 521 aa, Haloarcula marismortui ATCC 43049
MSGLFRRYLVVLVRFFPFALAFLRDRRRFILFGSRRQVPDEAHRQRAEQIRDTMLELGPAFIKVGQVLSTRPDIVPPVYADVFGTLQDEVPEGAGGDPKHVIAQELGDELDQSTLEPVAGGSLAYVYTATYRGERIALKVRRPELKPMITRDLRVVRGLVPLIRPFATERQQYSIENAADDFEDIILDELDFDREATVMADIRENFHGDERVVIPAVYEDLCSERVLAMEYLTGQKVTDGNAFDGIDMTPHEMATRIINVYLEMGLVDGVFHADPHPGNLAVTDDGRLLLFDFGMNERLPPTVQEDIVALYRALVRRDVDDLVDVLVALDVLEPHVNRAEVGRVLALVIENLEGRSEITWRMIITELTTNLRAFPFRIPPDVMLLIRVGTVGEGVCRQLDPEFDFLAAVRSFLVEQGLIENELNALIEETRADIRRSLPALARVPSRVDRTLSRLERGELVVRTDPVEGRGTGAQKLGYAVVAGALIVAAAILTFHERPYEIPVGAAAAGFLLFYLVDIGS

SEQ ID NO: 51057 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPAGNGQRACIGQQFALHEATLVLGMMLKHFDFEDHTNYELDIKETLTLKPEGFVVKAKSKKIPL

SEQ ID NO: 51058 - protein, 321 aa, Synechococcus sp. RS9916
MASRFHAVPNQVRSVEISLVTTTPASTTSERELRMRAAVMAPRDPLPRKQRKLKGGTTSFMVAMHVLATVALLPRFWSWQGAVAFGVLYWATVLGVTLGLHRLVAHRSFEVPRWLERVLVVMGTLAAQSGPIDWVALHRHHHKFSDQPNDHHDAGRGLWWSHSEWMLHEIPALEHKERFGGDLLSDRFYVWLDRWFLLLQIPLGLGLYWYGNAAQVHGGGLGLVLWAIPLRLVVVYHVTWLVNSATHAFGYRNFDCPDLSRNCWWVAVLSFGEGWHNNHHAFPASARHGLRWFEFDITWMHIRLLQRLGLTRRVRQARYPA

SEQ ID NO: 51059 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPWGNGQRACIGQQFALHEATLVLGMMLKHFDFEDHTNYELDIKETLTLKPEGFVVKAKSKKIPL

SEQ ID NO: 51060 - protein, 470 aa, Anchusa officinalis
MVLIPKTKNLIIFVSLILAFNAATLCNGGITSRFVRKLAAATDMPLNSDVFRVPPGYNAPQQVHITQGDLEGEAMIISWVRMDEPGSSKVLYWIDGSNQKHSANGKITKYKYYNYTSGFIHHCTIRRLKHNTKYHYEVGIGHTVRSFWFMTPPEVGPDVPYTFGLIGDLGQSYDSNSTLTHYEFNPTKGQAVLFVGDLSYADTYPNHDNVRWDTWGRFVERSVAYQPWIWTVGNHELDFEPDIGETKPFKPFSNRYRTPYKASNSTSPFFYSIKRGPAHIIVLASYSAYGKYTPQFKWLEDELPKVNRTESPWLIVLMHAPWYNSYNYHYMEGETMRVMYEAHGFVKYKVDLVFAGHVHAYERTERISNIVYNVVNGICTPVNDSSAPIYITIGDGGNLEGLAKNMTEPQPKYSAFREASFGHATLDIKNRTHAYYAWHRNQDGYAVEADTLWIFNRYWNPVDESTSATA

SEQ ID NO: 51061 - protein, 175 aa, Triticum aestivum
  misc_feature (88)..(88): Xaa can be any naturally occurring amino acid
MAPTGMASSATSVAPIQGLKSTVGLPVRRRSNGARLGSVTNGGRIRCMQVWPINGVKKFDILSYLAPCIMDALLRHVYYLIRSKWVPXLELSKVGYSSRDHKSSPGYCNGRVWTTCRRSMSGCTYATQASRHAQEVHKDVPYAFSRDVGIHEYRQVTCRQLIKLKTPGLEGCSQA

SEQ ID NO: 51062 - protein, 310 aa, Synechococcus sp. RS9916
MTTSVITAPSPPSRPAASHEALKLAALLHQPRKGHMAVQPDQAKRWGTIGFMITIHILSIVALLPQFWSWQAVSALTILYWVTACLGVTIGYHRLLSHRSFRVPTWLERFFATCGALSCQHGPIDWVGLHRHHHKFSDTDADHHNSHRGFWWSHMGWMFQPIPAMQAVPRLSGDLVSDPYYRWLNTNFLLLQLPLGLLLFWIGSATGVGGWAMVLWGIPLRLVLVYHVTWLVNSATHCWGTVAYDSGDASRNNKWVAALTFGEGWHNNHHAFPHSARHGLQPGQIDLTWQHIRLMRALGLASQIRLPVAS

SEQ ID NO: 51063 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPYGNGQRACIGQQFALHEATLVLGMMLKHFDFEDHTNYELDIKETLTLKPEGFVVKAKSKKIPL

SEQ ID NO: 51064 - protein, 214 aa, Brassica rapa subsp. pekinensis
MTSVSAFSETLGSEYESPTLSGEYCPTLAASCPKKPAGRKKFRETRHPIYRGVRLRNSGKWVCEVREPNKKSRIWLGTFLTAEIAARAHDVAAIALRGKSACLNFADSAWRLRIPETTCPKDIQKAAAEAAVAFQAEINDTTKDHGLDVEETIVEAIFTEEDSDGFYMDEEESMFGMPTLLASMAEGMLLPPPSVQFEYNYDFDGDTDISLWSY

SEQ ID NO: 51065 - protein, 257 aa, Brassica rapa subsp. pekinensis
MNSVSTLSEVLGSQNESPVGGDYCPMLAASCPKKPAGRKKFRETRHPIYRGVRLRKSGKWVCEVREPNKKSRIWLGTFKTAEIAARAHDVAALALRGRGACLNFADSAWRLRIPETTCAKDIQKAAAEAALAFEAEKSDTTTNDRGMNMEETSAVASPAELNDTTADHGLDMEETMVEAVFRDEQREGFYMAEETTVEGVVPEEQMSKGFYMDEEWTFEMPRLLADMAEGMLLPPPSVQWGHNDDFEGDVDMNLWSY

SEQ ID NO: 51066 - protein, 236 aa, Haloarcula marismortui ATCC 43049
MNQTIAIVDASVGETPAERNLTRSLDAETTVYKVSDGHLPPVPAGGDWRYDGVVISGSQTSVYDDHGWIHDLTSWVRDVHRADVPTLGICWGHQFLAQSLGGRVVDMGEHELGYRTVHRRGEDPLFADMSPSFTAFQTHSDRVAELPAGAVELARNQYGIQAFRLGTRYGVQFHPEYDRETAEWVIGNKDLTDERRETVTATITDESVAAAREATTVFENFLGLVATHQRRPGRLD

SEQ ID NO: 51067 - protein, 248 aa, Zea mays
MVKLAFGSFRDSLSAASLKAYVAEFIATLLFVFAGVGSAIAYSQLTKGGALDPAGLVAIAIAHAFALFVGVSMAANISGGHLNPAVTFGLAVGGHITILTGILYWVAQLLGASVACFLLQYVTHGQAIPTHGVSGISEIEGVVMEIVITFALVYTVYATAADPKKGSLGTIAPMAIGFIVGANILAAGPFSGGSMNPARSFGPAVAAGNFAGNWVYWVGPLVGGGLAGLVYGDVFIASYQPVGQQEYP

SEQ ID NO: 51068 - protein, 281 aa, Glycine max; identical to SEQ ID NO: 1321

SEQ ID NO: 51069 - protein, 136 aa, Xylella fastidiosa Temecula1
MSKLNKSIIAEFESAQITRQVPQFSQGDTIVVNVKVKEGNRERLQAYEGVVIATKNAGLNSAFTVRKISHGYGVERVFQTHSPIIESIEIKRRGKVRAAKLYYLRGLEGKAARIKEDLAATAHEKLARKTVTAKAG

SEQ ID NO: 51070 - protein, 1143 aa, Glycine max
MSNNLVSEPIPSMQMAQLEPLMNKVDSSGRQIEMGLLGPVSSDIVAQSQGTSNEHVGLLRAVPGEPMSQGLPLLSMHSERVEVQASNPGMHQILSANKQSMQMGMLLKSSGPQQQTTTPKRKAPMELSSSISFNKRVAAMGNRPWLQQVPNASNKGSLQMQSPSNASRTQHLAASSKRKTQLDNTPSKSGTPRAMSSKSQNTQMKQSSKVQTESSDSVRSKMRESLAAALALVSQQGKPQPPNNNTPNDAANTRVKLENSSQCAGSAPASIDASLEQRQDISQSVNSSFAVADSVGHAAGEHMQSTTYEDFPEKYKDFEAGSTNASDNENILSSMHVLNCDKQDFQSSYTLTTDDVPFSDGFFMKDDLLQGNGLSWVLSDMVDVGNQRESQPNIEQRSEPEETGGGCREEVPLPELLASRIEAELFKLFQGVNKKYKEKGRSLLFNLKDRNNPELRERVMFGKIPPEQLCSMTAEELASKELSQWRIAKAEELAQMVVLPDSDGDFRRLVKKTHKGEFQVEVEHEDNVPVEEVSGGTTSVARSQTIKKDVEDASPSKPDVKTDAEKGNLQKDDTFSITISSNDGADPMQGLITDDALKDSDFLEPIVSLDDFMYSLTYAPPFENLPVESGKVVPTSDKDDSGVGTKSKPADLTPNEQADITGDNKSEKFQSTHVNSDSLKEKKVNAESGAISSDVGYSGSQADMKSTDGRTKERSTDDVKSASSDAELRGNLFRAEERYDNDNRYSKDAIPTKGECLWEGMLQPNISSTHSVISIFKSGEKTAAKDWPGFLEIKGRVRLDAFEKFLQDLRQSRSRAIMVSHFVSKESDDQSTLREVADSYILDERVGFAEPVPGVELYFCPPHKKTVEMLSNILPKEQIEPVNSIDNGLIGIIVWRKTNLTSSISPTTASHHKHSSKRQYFSRRQQDINVNANSTHKAVPSMGVKTTENDDDDVPPGFGPPAARVEDDLPEFNFSGSSNPSHLGQKSMGPPNMVPLHSANPAPPRPAEQMRELVHKYGQNKPNVPSVNWQDKFGGTIQPWNDDDDDIPEWQPQNSQNQFPPQQTMHNFHLRPHILNQSFPGSQQQPIMTPQYLQPPMNVTHGQRNFDPQWVPSPQGSNLQPGGGPPYAQGTTWPQDASRSRGY

SEQ ID NO: 51071 - protein, 563 aa, Xylella fastidiosa Temecula1
MCSIFGIFNLQPSDNLQILRHQALECSQRQRHRGPDWSGVYVDVGAILVHERLAIVDPAGGAQPLFSEDGTLALAVNGEIYNHAVLKGTLQQPYAFQTHSDCEVINALYREETPTSFLNRLNGIFAFALWDKTTGRGLIARDPMGVVPLYWGHDQDGRLRVASEMKALVEHCPDVAQFPPGHWYDTTTGTLVKYYERPWKNYSAVEGVQVSLQELREAFERAVHRQLMTDVPYGVLLSGGLDSSLVAAVAARYARHRIETNDQSEAWWPRLHSFAIGLKDSPDLSAANVAAEALNTVHHGFEYTFQEGLDVLPEVIRHIETYDVTTIRASTPMFLLARRIKAMGVKMVLSGEGSDEIFGGYLYFHKAPNAREFHEELVRKLNALYYYDCLRANKAMMAWGVEPRVPFLDREFLDVAMRMDAQHKMVDKTSNGPQRMEKGILRAAFDGYLPPSILWRQKEQFSDGVGYGWIDGLKAHAETQVSDHALATAETRFQVNPPQTKEAYYYRSIFERFFPSPAAAETVPGGKSIACSSPAAIAWDASFATMADPSGRAVSGVHQQALL

SEQ ID NO: 51072 - protein, 456 aa, Polaromonas sp. JS666
MNAFTHAENAAHDIAAHLHPFTNLATHPQVGPLVIQRGDGIFVEDDQGRRYLEAMSGLWCASLGFSNARLAKAGCDALHALPYYHTFNHRSNPAAIELAQRLLDIAPVPMSKVFFANSGSEANDTAVKLVWYYHNAIGKPDKKKIIARKNAYHGVTVAAASLSGLAPNHRDFDLPIARILHVDCPHHYRYGLPGETEEAFATRLAEALEQRILAEGPDTVAAFFAEPVMGAGGVIVPPASYFEKIQAVLRKYEVLLVADEVICGFCRTGEMFGSTTFGMQPDILTSAKALSSGYMPISAVMVSGKVHAAVAANSGKIGTFGHGFTYSGHPVAAAVALETLKVYEDEQLLAHVQSLAPQFQRGLQRHASRPLVGEVRGVGLIGAIELVADPASRTPFDPAKKVGARLAELALEQGLIVRAMGDAVAFCPPLIITAAQVDEMFARFDRAMVRLEQEQP

SEQ ID NO: 51073 - protein, 219 aa, Sulfolobus tokodaii str. 7
MDPKEVVARFIVDKLKEHKLIGLGTGKTVKKLIEVLSEEGLLKEKIFVASSIDTELEISKREGIVITLYSGLRPQVYIDSFDFVTSDKIMIKGGGAALLREKMLYTFSKEKVFIGEELKLKDLKEYSVPVEVVPVGVAYVISALKERGYEAKIREGNGKIGPIISDNGNIILDVIVKRENLCDFERLVKEIPAIIESGIFCKKDYEIYLANENGRISIL

SEQ ID NO: 51074 - protein, 218 aa, Robiginitalea biformata HTCC2501
MRGFIFDLDGVIVDTAKYHYLAWKHLADELGITFTEEDNERFKGVSRKRCLEILLEMGGMEVSGEQFNRWLHEKNEDYLSHISKMDASEILPDVPRVLDYLRDRNIPMALGSASKNARPILEKVGLLSYFNTIVDGNEVVKAKPDPQVFLLAAERLGVSPNQCVVFEDALAGIEAANKAGMQSIGIGDPDILTEADAVFRDFTEIDVDYLRGLLAGSQ

SEQ ID NO: 51075 - protein, 320 aa, Triticum aestivum
  misc_feature (15)..(15): Xaa can be any naturally occurring amino acid
  misc_feature (262)..(262): Xaa can be any naturally occurring amino acid
CRFGTREHLNTGWPXWLVTVAPEAVQGWAPLQADSFERLSKIGQGTYSSVYKARDPAPAKIVALKKVRFVNTDPESVRFMAREICVLRKLNHPNVIKLEGIVTSPVSQNLYLVFEYMEHDLVGLAATPELKFTESQVKCLMQQILSGLDHCHSKGILHRDIKGSNLLIDGHGVLKIADFGLATFYDPESQQPLTSRVATLWYRPPELLLGATRYSAAVDMWSTGCIFGELLTAKPVMPGRTEVEQIHKIFKLCGSPSDEYWXNWEVPPTGMFKPLCQYKRCIAENFKDLPPSALVLLDNLLALEPEARGTAASSLQSDFF

SEQ ID NO: 51076 - protein, 589 aa, Neisseria meningitidis FAM18
MTVQTKTKGLAWQEKPLSDNERLKTESNFLRGTILDDLKDPLTGGFKGDNFQLIRFHGMYEQDDRDIRAERAEAKLEPLKFMLLRCRLPGGIIKPSQWIELDKFARENSHYRSIRLTNRQTFQFHGVPKAKLQTMHRLLHKLGLDSIATAADMNRNVLCTSNPIESELHRQAYEYAKKISEHLLPRTRGYLDVWVDGKKVQSSDDFLQEDEPILGKTYLPRKFKTAVVIPPLNDVDCYGNDLDFVAVSDGNGQLAGFNVLAGGGLSMEHGNTKTYPNISLELGFVPPEHALKAAEAVVTTQRDFGNRSDRKNARTRYTIQNMGLDNFRAEVERRMGMPFEPIRPFKFTGRGDRIGWVKGIDGNWHLTLFIESGRLVDEGGKQLLTGVLEIAKIHKGDFRITANQNLIVANVAEADKAKIEELARTYGLIRNDVSKLRENAMSCVSFPTCPLAMAEAERVLPDFIGELDKIMAKHGTSDDYIVTRITGCPNGCGRAMLAEIGLVGKAVGRYNLHIGGDREGVRIPRLYKENITLPEILSELDDLIGKWAAGRDTDEGFGDFAIRTGIVKPVLDAPVDFWDASKAVPIARA

SEQ ID NO: 51077 - protein, 407 aa, Halobacterium salinarum
MVMTDTVEDVELPYDDSASQQDKLEALEEQLSTLEEENEERDRLLDANAENNKYQQKLERLSHENKKLKQSPLFIATVQELTDEGAVIKQHGNNQEALTEVTDELRATLEPGSRVAVNNSLSVVRQLDDEADVRARVMEVDDSPDVGYEDIGGLDDQLREVRETVELPMKDPGLFETVGINPPSGVLLHGPPGTGKTLMAKAVASQTDASFIKMAGSELVHKFIGEGAKLVRDLFQVARDHEPAVVFIDEIDAIASKRTDSKTSGDAEVQRTMMQLLSEMDGFDERGDIRIIAATNRFDMLDRAILRPGRFDRLIEVPHPNVGGREKIFRIHTRAMNVADSVDFGELAADTGDLSGADVKAICTEAGMFAIRDDRTEVRMQDFQSAREKLDQDSEPAAATDVSRTFA

SEQ ID NO: 51078 - protein, 492 aa, Mycobacterium avium 104
MTATISTPQYLLDQARRRFTPTLNTIPGMGAIEKRLLAHEWQTKVLAEPPAGSGLKPVLGDAGLPILGHIIELFRGGPDYALFLYRNHGPLIYLDSPIMPAVTALGPDATQAVFSNRNKDYSQKGWHPVIGPFFNRGLMMLDFDEHMYHRRIMQEAFTRSRLTGYVEHIDRVATDIVADWPTNDARFLFHPAMKELTLDIASLVFMGHEPGTDHDLVTKVNQAFTTTTRAGGAIIRQPIPPFKWWRGLRARQLLEDYFSERVKERRNATGNDMLTVLCHTEDDDGNSFTDDDIVNHMIFLMMAAHDTSTSTTTTMVYNMAAHPEWQERAREESTRLGDGPLDIEALEKLETLELIMNESLRMVTPLPFNMRQAVRDTELLGHYIPAGTNITIWPGMNHRLPELWTDPDKFDPERFAEPRAEHKKHRYAFAPFGGGAHKCIGMVFGQLEVKTVVHRLLRRYRLELARPGYQPRWDYGGMPIPMDGMPIVLRPL

SEQ ID NO: 51079 - protein, 880 aa, Arabidopsis thaliana
  misc_feature (314)..(314): Xaa can be any naturally occurring amino acid
MEFSELKEAIEKIELVDAHAHNIVSLDSSFPFIGTFSEAAGDALTFAPHSLSFKRNLREIAQLYGTEVSLEAVEEHRKTSGLDSFTSKCFKEARISALLIDDGLKLDKKHDIEWHRNFVPFVGRVLRIETLAEQILEEECPGGYFYGSESTEPPVWDLDSFTKTFVERLNSLVPEIVALKTIAAYRSGLDIDTYVSKEVAENGLGEVLRAGKPVRIGNKGLIDYILTISLEVAVRRDLPLQIHTGFGDKDLDLRLSNPLHLRTLLEDKRFGKCRIVLLHAAYPFSKEASFLSSVYPQVFLHPISIMGKIMPRHXLIFLFLKVYLDFGLAVPKLSVHGMVSSVKELLDLASIKKVKCILLALSLLLFMSNHKILLQVMFISDGDACSENASACGDLSLMEAIDAAKDIFSRNSIGFYKLNIDTDSSSPQNIISPKLKIKEPDVQEDSSSFVRIIWVDTSGQQRCRAVQAQRFNRSVKKNGVGLTFASMGMTSFTDGPAEESKLTGVGEIRLVPDLSTKQTIPWTKQESMVLADMQLKPGEAWGYCPRETLRRVAKVLKDEFDLVMNAGFENEFYLLKNVVREGKEEYMPFDFGPYCATSSFDAASPIFHDIVPALESLNIEVEQFHAESGKGQFEVSLGHTIASHAADNLVYTREVIRSVARKQGLLATFVPKYDYCDIGSGSHVHLSLWKNGENVFPASNNSSSHGISSVGEEFMAGVLFHLPSILAIIAPLPNSYDRIQPNTWSGAFQCWGKENREAALRAASPPGTPDGLVTNFEIKSFDGSANPHLGLAVIMAAGIDGLRRHLQLPTPIDINPADVAATLNRLPETLSEAVEALDKDKVLHDLLGQKLLVAIKGVRKAEVEYYSKNPDAYKQLIHRY

SEQ ID NO: 51080 - protein, 473 aa, Mycobacterium sp. MCS
MSDGRHVTDAAALAFGEREYSLNELDALASGMATSLEQRGVRAGDRVAMMSSNRPEFVAALRGIWNLGAAAVLISPAWKHAEVAHALELTRPSHAVGDHPVLAEHMPMLHLDEPVTPGRREFDAVDPGADALFVFSSGTTGMPKAVRHTHGAFAAAVRHWRDALELSSADRMQIMTPPSHILGLLNIVMALETGTWIRLHPRFDIDTMLHHVESDRITIEMAVAPIALALAAHPKLESYDLSSLRYIMWCATPVTKSVADDVTRRTGVEWVAAYGTTELPVIAANPVTGARLDTVGKPVPGVRVRIVSLDDGTPLGPGEVGEIQVRSDSVMAGYLPREATSAAFADGWYRTGDVGRLDAEGWLRITDRSKEMIKVRGFQVAPAEVEAVLHGHPAVEDCAVFGEPHPTDGEAVVAAVTTNSDVPADELTELVAGTLASYKRPSRVVFVPAIPRLPSGKVLRRVLKEQHGCTSDS

SEQ ID NO: 51081 - protein, 150 aa, Oryza sativa (japonica cultivar-group)
MGEIRALHNMDDDEVFAYANRIAAPYDLVMQTKQLGRLPVVQFATGNVATPADAALMMQPGCDGVFVSSGIFKSGDPARRAHAIVQAVTHCRSSRPSTPPPRRPRWHTFAVELCPVCRDREREEEMNGEKERKKNREREIDKWAHRQICL

SEQ ID NO: 51082 - protein, 110 aa, Tragopogon miscellus
AMDESNATCGKRLASIGLENTEADRQAYRTLLVTPPGLGNYVSGAILFEETLYQSTVDGKKIVDILVEQGVVPGIKVDKGLVPLAGSNDESWCQGLDGLASRSAAYYQQG

SEQ ID NO: 51083 - protein, 101 aa, Glycine max
VLEHKRSPCSVGQSRYTSIASKRQKADLSISTKERKEKIGKRIVALQQLVSPYGKTDTSSVLKEAMEYIGFLHKQVKVWPFLLHYAEIITVNFLLIWFHMP

SEQ ID NO: 51084 - protein, 393 aa, Atropa belladonna
MTTPTTRKDLMIVNMGPQHPSMHGVLRLIVTLDGEDVVDCEPILGYLHRGMEKIAENRTIIQYLPYVTRWDYLATMFTEAITINGPEQLGNIQVPKRASYIRVIMLELSRIASHLLWLGPFMADIGAQTPFFYIFRERELIYDLFEAATGMRMMHNYFRIGGVAADLPYGWIDKCLDFCDYFLTGIAEYQKLITRNPIFLERVEGVGIIGGDEALNWGLSGPMLRASGIEWDLRKVDHYESYDEFDWQVQWQREGDSLARYLVRIGEMTESIKIIQQALEGIPGGPYENLEIRRFDRLKDPEWNDFEYRFISKKPSPTFELSKQELYVRVEAPKGELGIFLIGDQSVFPWRWKIRPPGFINLQILPQLVKRMKLADIMTILGSIDIIMGEVDR

SEQ ID NO: 51085 - protein, 395 aa, Corynebacterium efficiens YS-314
MNPMTPSTPGNPLQLNREEIFAAHEGGKLSITSARPLADMHDLSLAYTPGVATVCEAIAADPAVARTHTGRGRTVAIISDGTAVLGLGDIGPEAALPVMEGKAQLFSSFAGLNAIPIVLDVHGVDELVDTIAAMAPSFGAINLEDISAPRCFEVERQLIERLDIPVMHDDQHGTAVVILAALRNALRLLDRQIGEARIVVSGAGAAGVAAVEMLRGAGARDVVVLDSRGIIHAGREDLNPVKQALAATTNPRGVTGGMAEALTGADVYIGVSGGHVAEEALQLMADQPILFSLANPSPEIDPELAGRYGAIVATGRSDLPNQINNVLAFPGIFHGALAARARSITPGMKLAASQAIADIAAETLDVGHVVPSPLDPRVAPAVSAAVQAAAEAEGA

SEQ ID NO: 51086 - protein, 657 aa, Orpinomyces sp. PC-2
MKTLTVFSALLAVTAAKKCIVKSDAAVASEAEEVTAELTAPEDSGVESGEDDELLDLSTIDYGDDVDMSTVKKLPADFKWGAATAAYQVEGAWDEEGRGESVWDHFTHLYPKNVESGDRSKDFSTNGNIACDSYHKFDEDVKMLKLMNAKYYRFSISWPRLFPDGQARKVDGKWNVNEKGAEYYDMVINTLLKNDIVPFVTLYHWDLPYALHEKYGGWLDYHSQDDFAKYAEFCFERFGDRVKNWITINEPWVNCVSGYRLGPGKAPYRCTGEAPRKLQNSTDLDLEGGCSYEIGPTQYSKNSEPLPANRVPQKLEDVWCSHNILLGHAKAVKVYREKFQKKQKGLIGITVDGEAQIPWVEPGMTKKEYENNLKYANLAAEFRIGWYSDPPMVGDYPKSVKERMGKDLPEFTEEEKKILKGSSSDFLGWNTYTAHWAAQAKNEDGSYIQPPTAEEANFDNSKKDMWDDNCKGRGDGWTCIPPTLGSQAGSSWNTKFAPTIRVGLNWFSKRYEGLIKNGIVITENGCAQPNYKVARANDEVTKKYFESIGQPKYADTYKEEDIEREDNLEGTLMHDTYRIDWYDQYLKNLRLAYAVDNIDVRGYMAWSLLDNFEWENGYETRFGMTYIDFYNDKEMKRVPKDSLEHLGQWYLENVEQN

SEQ ID NO: 51087 - protein, 473 aa, Bacillus megaterium
GAMTIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPFGNGQRACIGQQFALHEATLVLGMMLKHFDFEDHTNYELDIKETLTLKPEGFVVKAKSKKIPLGGIPSPSTEQSAKKV

SEQ ID NO: 51088 - protein, 1027 aa, Saccharum hybrid cultivar
  misc_feature (168)..(168): Xaa can be any naturally occurring amino acid
  misc_feature (432)..(432): Xaa can be any naturally occurring amino acid
TRPASRCSTGGSHGRLLCWLLLACSWVAATTGQQTARTDPAEVAALNTILGRWGLKASAAWNISGEPCSGVAVDTTNVDDNPNINPAIKCDCTYNNATVCHITKLKVYALNVVGQIPAELQNLTYLNNLNLMQNYLTGPVPSFIGKFPMQYLSLAINPLSGTLPKELXNLTNLISWGISLNNFTGELLLELGNLTKLEQIYFAGSGFSGHFPTFSRLKNLKILWASDNDFTGKMPDFIGSLTQLEDLRFQGNSFEGPIPKSLSNLTKLTSLRIGDIVNGSSSLSFISNLTSLNVLILRNCRISDTLATVNFSNLAGLTLLDLSFNNLTGQIPQSILNLEKLGFLFLGNNSLSGSLPDVKSPSLNDLDFSYNQLSGSFPSWATQNNLELNLVANNFILGSSNNSILPSGLNCLQQDIPCFRGSPEYSSFAVDXGSTRSMEGLRYTFYEIDPTNIGAASYYVTGQTRWGVSNVGKFNEAPNGSYIIYSSQQFQNALDSELFQTARMSPSSLRYYGIGLENGNYTVELQFAEFAYPESPTWQSTGRRVFDIYIQGGLKEKNFNIRKTAGGKSYVAVYKKYNATVSKNFLEIHLFWAGKGTCCIPTQGYYGPMISALSVTPSFTPTVRNGVPKKKSKAGAIAGIVIGAAVLGLAALAGTFMLVQKRRRVAQQQEELYNMVGRPNIFSNAELKLATDNFSSKNILGEGGYGPVYKGKLPDGRIIAVKQLSQTSHQGKSQFVTEVATISAVQHRNLVKLYGCCIDSNTPLLVYEYHENGSLDRALFGNSGLSLDWPTRFEIILGIARGLTYLHEESSVRIVHRDIKASNVLLDTDLTPKISDFGLAKLFDEKKTHVSTKIAGTFGYLAPEYAMRGHLTEKADVFAFGVVALETVAGRSNTDSSLEENRVYLFEWAWELYERDKALDILDARIEEFDSEEALRVISVALLCTQGSPHQRPPMSRVVKMLTGDVEVTEVVTKPSYITEWQRRGGNTSYVTSDYSGDTTGEFSMQRETIAPLTPSPAMTGVIDDGR

SEQ ID NO: 51089 - protein, 332 aa, Arabidopsis thaliana
MANTPLIVSFGEMLIDFVPDTSGVSLAESTGFLKAPGGAPANVACAITKLGGKSAFIGKFGDDEFGHMLVNILKKNGVNSEGVCFDTNARTALAFVTLKKDGEREFMFYRNPSADMLLKESELNKDLIKKAKIFHYGSISLISEPCRTAHMAAMKTAKDAGVLLSYDPNVRLPLWPSTEAAIEGIKSIWNEADIIKVSDDEVTFLTRGDAEKDDVVLSLMHDKLKLLIVTDGEKGCRYYTKFFDCRKAQKFKGRVPGYAVKAVDTTGAGDSFVGAFLVSLGKDGSILDDEGKLKEALAFANACGAVCTTQKGAIPALPTPADAQKLMKSKSK

SEQ ID NO: 51090 - protein, 341 aa, marine gamma proteobacterium HTCC2143
MEINRQWLLAKRPSGMVGPENFKYAETPVPVPGIGEVLVKNLFLSFDPTQRGWMVDQPGYLPPVNIGEPMRAGSVGQVVESLHAEFSVGDLVQTTGCWQDYVVVAPGQGPMGLSKLPPGVSPEMMLSVLGITGLTAYFGLLDLGQPRPGETVLISGAAGATGSVVGQIAKLKGCRVVGIAGGSEKCAWLQKEAGFDAVIDYKNENVRAQIAHHCPDKWDVFFDNVGGTILEDALEHLNLRSRVVLCGGIAGYNATEPLPGPSNLMKLVTNRSRMEGFIILDYLPRAAEAVKDIMAWVASGELKFQIDLQEGFEHIPATLQRLYTGKNFGKQLLKIADPVSV

SEQ ID NO: 51091 - protein, 253 aa, Francisella tularensis subsp. holarctica
MQKLIMGNWKMNGNSTSIKELCSGISQVQYDTSRVAIAVFPSSVYVKEVISQLPEKVGVGLQNITFYDDGAYTGEISARMLEDIGCDYLLIGHSERRSLFAESDEDVFKKLNKIIDTTITPVVCIGESLDDRKSGKLKQVLATQLSLILENLSVEQLAKVVIAYEPVWAIGTGVVASLEQIQETHQFIRSLLAKVDERLAKNIKIVYGGSLKAENAKDILSLPDVDGGLIGGASLKAAEFNEIINQANKICTE

SEQ ID NO: 51092 - protein, 175 aa, Francisella tularensis subsp. holarctica
MNLDFIKSKIAAVPDFPKPGIMFRDITPLLADPQGLRKTAEAMAQELKNKGIQPTIIAGTESRGFIFGVALAEVLGLGFVPVRKPGKLPRATYSVKYDLEYGSDSLEIHQDAFKVTDEVLVVDDLLATGGTAKATVDLIEKTQAKVAGLIFVMELDSLGGREVLAGYNVSALIKF

SEQ ID NO: 51093 - protein, 159 aa, Brassica napus
  misc_feature (119)..(119): Xaa can be any naturally occurring amino acid
MVSGLINENPTVYERKERRVRTDSTNSDEFSVEPIDQLEIFDHIRDIRDPEHPYSLEQLKVLTEDSVEVDDLKSYVRVTFTPTVEHCSMATIIGLSIRVKLMRSLPPRYKIDIRVAPGXSHATEAALNKQLNDKERVAAALENPNLVEMVEECLSPSFE

SEQ ID NO: 51094 - protein, 273 aa, Nostoc sp. PCC 7120
MRYRALIVAFLAVCLGLLTACSDAPASSTRDILTYEQIRGTGLANKCPQLTETSRGSIPLDSSKSYVLKELCLEPTNFFVKEEPANKRQTAEFVAGKLLTRYTSTIDQVSGDLKFNDDSSLTFVEKDGLDFQAITVQLPGGERVPFLFTIKNLVAQTQPGLSSLNTSTDFEGTFKVPSYRGAAFLDPKGRGVVSGYDNAVALPAQADDEDLTRTNVKRAEILNGKISLQIAKVDSSSGEIAGTFESEQPSDTDLGADEPKEVKIRGIFYARVE

SEQ ID NO: 51095 - protein, 118 aa, Medicago truncatula
MEGLQRSAVSFRRQGSSGFVWDDRFLQEEINKMNQNQNQQEQEDKDEIKEMNRDATSPQLGPINTVQRSRSNGGGRGYRTGKVSPAIEPPSPRISACGFCGAFGKVGEKRKPPKHRSR

SEQ ID NO: 51096 - protein, 296 aa, Neisseria meningitidis FAM18
MFPVFHLSGESRRRMLQAASRFPYVFKARAEDSHKGTFGTLAVVGGSAGMRGAPVLAASAAMYLGCGKVWAGFNQDALPFAVIAGFPEIMLDTADGLTKRQGINAWMVGCGLGTDKAAVGTLAGILAEHTDKPVLLDADALNILSTDAETRNLARGCKNLILTPHPAEAARLLGTTVAQVQADRTAAVRKIRAIFGATVVLKGHKTLVASPDTEIYVNESGNAGLATAGSGDVLGGIIGSLLAQGVPVFEAACAGVWLHGAAADVIKESAGIAAGLLAGEISPAARWLRNRITESM

SEQ ID NO: 51097 - protein, 723 aa, Zea mays
MALTGRRQTFGSSPHRTHTHRQQHSDLPSALPRPHPAQSSSARCRPATAAGRIRSLGLLLLLPPLNPPRVGSSRILTRSPARHLAAGRRHTDRERERERERERGRGSEETRTRAKMVGLLPETNAAAETDVLLDAWDFKGRPAPRATTGRWGAAAMILVAELNERLTTLGIAVNLVTYLTGTMHLGNAESANVVTNFMGTSFMLCLLGGFVADSFLGRYLTIAIFTAVQASGVTILTISTAAPGLRPASCSATGGGVVGECARASGAQLGVLYLALYLTALGTGGLKSSVSGFGSDQFDESDGGEKRQMMRFFNFFFFFISLGSLLAVTVLVYVQDNLGRRWGYGACACAIAAGLLVFLAGTRRYRFKKLAGSPLTQIAAVVVAAWRKRRLPLPADPAMLYDVDVGKAAAVEDGSSSKKSKRKERLPHTDQFRFLDHAAINEDPAAGASSSSKWRLATLTDVEEVKTVARMLPIWATTIMFWTVYAQMTTFSVSQATTMDRRVGGSFQIPAGSLTVFFVGSILLTVPVYDRLVVPVARRVSGNPHGLTPLQRIAVGLALSVVAMAGAALTEVRRLRVARESSESASGGVVPMSVFWLIPQFFLVGAGEAFTYIGQLDFFLRECPKGMKTMSTGLFLSTLSLGFFVSSALVAAVHRVTGDRHPWIANDLNKGRLDNFYWLLAAVCLANLLVYLVAARWYKYKAGRPGADGSVNGVEMADEPTLH

SEQ ID NO: 51098 - protein, 447 aa, Oryza sativa (japonica cultivar-group)
MAFAGRVVNALRRTSVSSNPSLLQAVRCMSSKLFVGGLSYATDDTTLKDVFSHYGDVLEARIIIDRDTGKSKGYGFITYTSSEEAAAAVTAMDGKDLQGRIVRVSTANDRAGGIRGGGGFGAGGYGSGGGYSSGGGYGTGEYGRGGGYAGNGGYGGRASEYGGYGAGGYSSSGGYNATSVLHGNAGGYGSSGVSHGNAGDYRSSDVYNTTNTYGAGNFSHSGGGFGENSGGYNSGQFGAAGHSNGGYSASNFSNASFGANSSVFSSGQSGATGRNNGGNSASNFSLGGSFGANNGGISSGQFGAVGHSNGGYSTSNFSRGSGFGANSGGSSNGQYGAAHGNNGSNFSHGGGFGAQMFGAAGGNSSIKTAARGFGGSRGGGGGAMGYGACSVVGRSLHEHGDGGRRARRTADLMSSRAIRLGRTVEVAFDGRFRLQICATFSFGNVPS

SEQ ID NO: 51099 - protein, 1971 aa, Haloarcula marismortui ATCC 43049
MSTDNIAQETTPETVFGRIDEAVFALDTDWQFTYINQQTAALVDRDPATLLGESLWEVFPDSADSAAFDACHNAVETQEPCHFEMVFGPRDTRFVVHAYPSNDGLTVCLRELTAERERKLELQRSQQLFESVFHETEDAIIVADTDRRITDFNPAAERLFGYDASEVIGEKSQLLYADPETFERQGDKRFNEQAPQRRDRYVVEYERADGTTFEGETVGTPLKREADGTFAFFATVRDVTSQLNYKRSIEQRNRALKQFHDITTDEKKPFATQAAAVLKLAVDYLDVETGVIAEIDGQTRIPRHVFTAGEAATATERRPLDTTFDERVATTRKPFGFHDVKEAEFTEHRAAESGEIAAYLGVSVTVDDKQYGVLSFTDGGSRASAFSESEETFVRIVAQWAGKEISRRRNQKRANAERERLRQIIDTIPQQVFVKDADGTYTLANKAAAAAHGVAVERLEGATHDEFALSDEQRDFKSDDAAVIENGESVHIEEDGLVEADGSSHTVQTDIVPIEIASGERRALVVATDITEQKQLEAQLEQSKRRLRQIIDMLPQLVFAKDESGTFLLANEAVADAYGTTVDELEGATDAEFADSEAEAEQFRADDRAVIDSGEPKHISEESLTTTDGIERILSTRKIPYDPVDTPGDAVLGVSTDITELKQREAELEMQSAAMEASMDGISVLDDDREYIYMNEAHAAVFGYDPDDLIGSSWRRLYSDEEVERIRQEVFPELEEHGQWRGETVGRQRDGSPVTQELALSLLDDGKLICTNRDITEQKARENVLEQYEALIENMNEAAFIVDDEWRLAYANERTLSLGDVEPRSVLGQDIMELFDGLVTDKADYKTFNDTLERTLDGEQVNERCELPLQLPTGEYILECLFSPFTSAGEQRAAVVARDVTARKAREQELERKRARLRALFDESPDGIIVHDENGEIIDTNTTQIDQLGYEELCGVNVAEFEVGHSRTELRALWSDMALGETRRVEGSHRRKNGSIFPVEVWISKTEVHGEIRFIAISRDISDRKAREREMVRNREFLEKTQNIASVGGWEIDLQTDELRWTDEVYRIHDLPLDADVTVEDGIDYYHPEERPTLNAVFDRLVEEGEPYDEELRIVTAADAVKWVRTVGDPEFDDGEVVGARGIFQDITDRKEREQDVQELTERLDLAVEGANLGVWDWDMTTDAVTFNEQWASMLGLSLDEIAHTLETWEERVHPADMDRVEDALEAHIAGEAELYDCDHRMRTASGEWKWIRDVGEVVERDSDGQPTRAVGIHLDITDQKRSENALEEERDMFAQGPAVVFKWQNEPDWPVEYVSENVTETFGFTPEELESGDIPYKTLIHDEDMDTVTAEVQANTDTETERFSHDPYRMVTADGEVKWVTDNTKIIRNDGEITHYLGYLIDITDRKRLEQSLRQSEQSLREMTEVASDTDRGFEGKLAAILELGCERLNLPYGFLTRIDDGTQHIVEASGSHSELQAGASAPMSKAYCRRTIEQDEPLTIQNAVEEDWPDDVAYEMFGLGCYVGGKVTVNGELYGTLCFADRDNRDHQFDESERAFVELLVQWVRYELAGEAVETKLRELNETAQRLLSASDASEVASTAIESAKRVLGLPMTGIWWYDEGKDALVPAGLTDEAGALLGTQPTFDGEGSLAWETFESGEVRVYDDLQEVEARFNDDTPIRSETLVPLGDKGILISGSTEQRAFSETDRGLFEILAATVETALSRAEREQVLRDTRERLEQSNEELEQFAYAASHDLQEPLRTVSSYLTLLERRNEEVLDDDALEFIDFAVDGAERMREMIQALLAYSRVDTRGQAFESTDMDAVFDTVARNLEVNIEESGAVVNVPDAGGHVVGDTNQLVQLFQNLVENGIKYSEETPHVDISVVRSDDDTVEYAVSDDGIGMEPSQLDDIFEVFQRLHTHEEISGTGIGLSMCRKIVDRHSGQIRVKSAPDEGSTFFVTLPAAGEEHE

SEQ ID NO: 51100 - protein, 207 aa, Tolypothrix sp. PCC 7601
MTSSLPKIPDTVSPNLITLARWMAGDFSNYQQAFENSKDYAHIHVFFRPLPFEFFSGIGLYSEQVYDYDLWRPYRQGVHRLIDKGDEIYIENYSLKQALYYAGAARDLNILKTITPNCIERRYHCSMIFKREGDKFIGGVEPGNLCLIEKNGCQTYLDSYVEITETTWVSLDKGMDVNTHQQVWGSTFGPLRFEKRESFADEIPNIL

SEQ ID NO: 51101 - protein, 480 aa, Streptomyces coelicolor A3(2)
MASAPAFDYAPAPESRAVVDIAPSYGVFIDGEFTEAADGKVFKTVSPATEEVLSEVAEAGEADVDRAVKAARKAFEKWSALPGAERAKYLFRIARIIQERSRELAVLETLDNGKPIRETRDADLPLVAAHFFYYAGWADKLDHAGYGADPRPLGVAGQVIPWNFPLLMLAWKIAPALATGNTVVLKPAETTPLSALFFADICRQAGLPKGVVNIITGDGRAGAALTAHPDVNKVAFTGSTAVGKQIARTVAGTRKKLTLELGGKGANIVFDDAPIDQAVEGIVNGIFFNQGQVCCAGSRLLVQESIHDELLDSLKRRLTTLRLGDPLDKNTDIGAINSAEQLARITALADQGEAEGAERWSPACELPSAGYWFAPTLFTNVTQAHTVARDEIFGPVLSVLTFRTPDEAVAKANNTPYGLSAGIWTEKGSRILAVANKLRAGVIWSNTFNKFDPTSPFGGYKESGFGREGGRHGLEAYLDV

SEQ ID NO: 51102 - protein, 549 aa, Shewanella sp. ANA-3
MTLASIRRGYHVIKTLLQYGLDDVLPPKMTPWYFKLARNSLFWIRNKHKGKSGGERLKLAMQELGPVYIKLGQMLSTRRDLLSDEWANELAMLQDKVPPFDGALARQAIEAELKAPIESYFDDFDETPLASASISQVHTATLKSNGKAVVLKVLRPNVETKIQADLLLMSQTAKVIDYLLGEGNRLRPSEVIEDYRVTILGELNLKLEALNAIKLRNNFLDSDALYIPYVYEEFCYPRLMVMERIYGIPVSDIAALKAQGTNFKLLAERGVELFFTQVFRDNFFHADMHPGNIFISREHPENPYYIGLDCGIMGTLSEVDKRYLAENFLAFFNRDYHRIAQLYIESGWVSEKTDLQAFEQAIKVVCEPMFNKPLDEISFGHVLLELFRTARHFDIVVQPQLVLLEKTLLYIEGLGRQLYPQLDLWQTAKPFLEQWMAEQVGPKAMFKKVSTKLPYWSDKLPEFPELIYDNLKLGRKLLSSQQQMLDKYLKYQQQAHKSNYLLITSAILLICGTLLFNQDATLWSPYVCLISGAVLWIIGWRSRPKNRKF

SEQ ID NO: 51103 - protein, 208 aa, Cicer arietinum
EVSARDLTEISSNTEKDVAEKKNEVTDANYDGFNGGGNYGNGGGYPSNGGGNYGHGGGNYGNGGGNYGHGGNGGGNYGNGGGNYGHGGGNYGHGSNGGGNYGNGGGNYGHGGGNYGHGGNGGGNYGNGGGSYGNGGGNYGHGGGNYGNGGGNYGHGGGNYGHGGGYPGNGGHGGGYPGNGGHGGGHGGHGGGYVGEATDVQREDKTLN

SEQ ID NO: 51104 - protein, 1070 aa, Oryza sativa (japonica cultivar-group)
MATLNTQTLLTLFLLLLLAAAAAAADAGGGGEREALLRFKAGVASDPGGLLRGWTTAASPDHCAWPGVSCGGNGEVVALNVSSSPGRRLAGALSPAVAALRGLRVLALPSHALSGQLPAAIWSLRRLLVLDLSGNRLQGEIPPALACAGLQTLDLSYNQLNGSVPASLGALPGLRRLSLASNRLGGAIPDELGGAGCRSLQYLDLSGNLLVGGIPRSLGNCSKLEALLLSSNLLDDVIPPEIGRLRNLRALDVSRNSLSGSVPAELGGCVELSVLVLSNPYTPIGGSNSSDYGDVDDFNYFQGGIPDAVVALPKLRVLWAPRATLEGELPRNWSACQSLEMINLGENLFSGGIPNGLVECSHLKFLNLSSNKLTGAIDPSLTVPCMDVFDVSGNRFSGAMPVFEQKGCPSSQLPFDDLVSEYSSFFSYQALAGFRSSSFVLGTDLTSYHSFAQNNFTGPVKSLPLAADKLGMQGSYAFLADGNNIAGQLQPDLFSKCNSSRGFIVDVSNNLITGGIPVEIGSLCSSLVVLGVAGNQLSGLIPTSIGQLNYLISLDLSRNHLGGEIPTSVKNLPNLERLSLGHNFLNGTIPTEINQLYSLKVLDLSSNLLTGEIPGALADLRNLTALLLDNNKLTGKIPSAFAKSMSLTMFNLSFNNLSGPVPANSNTVRCDSVIGNPLLQSCHMYTLAVPSAAQQGRGLNSNDYNDTSSADSQNQGGSNSFNAIEIASITSATAIVSVLLALIVLFIYTRKCAPRMSSRSSRRREVITFQDIGVPITYETVVRATGSFNASNCIGSGGFGATYKAEISPGVLVAIKRLSVGRFQGVQQFHAEIKTLGRLRHPNLVTLVGYHLGESEMFLIYNYLPGGNLERFIQERSKRPVDWKMLHKIALDIAKALAYLHDTCVPRILHRDVKPSNILLDTEYNAYLSDFGLARLLGNSETHATTGVAGTFGYVAPEYAMTCRVSDKADVYSYGVVLMELISDKKALDPSFSPYGNGFNIVAWACMLLRQGRAREFFIDGLWDVGPHDDLVETLHLAVMCTVDSLSVRPTMKQVVQRLKQLQPPIREHR

SEQ ID NO: 51105 - protein, 751 aa, Anaplasma phagocytophilum HZ
MSDFSEKDMEALEFHSRGRPGKVALLPTKPLLTQGDLSLAYSPGVAVPCIKIASDPDLVYEYTARGNYVAVISNGTAVLGLGNIGTLAAKPVMEGKAVLFKRFADIDAVDIEVNTEDVDEFINAVKYLGHSWGGINLEDIRAPECFVIERRLSELMDIPVFHDDQHGTAIIVLAGIINALDITGKVLKNVKIVVNGAGAAGIACVEMLKFVGIPNDNIILCDQNGVIYKGRQLGVNEWKLKHAVETDARDLKDAIKGADIFIGLSVRDVLSREMLLSMNKDPVIFALANPYPEVNPEFAREVRGDAIIATGRSDYSNQINNVMGFPYIFRGALDVRAKRVNNEMKLAVAQAIAMLAREVVSDEVLEAYGGRGMRYGRDYIIPTPFDPRLISVVSPAVARAAIETGVAQKGIDDWDKYARALGSRISPTSNVLNLIYGSVKQTPKRVIFSEGEEIKVIKAALQWRSQGYGVPILVGRADKIKEGLERIGVDSLDGIEIANAAVSTRNDVYIDYLYSKLQRKGYLHRRCVRDVKTDRNVFAACMLACGDGDILVTGVTRGYRESLSDVSKVIGARSEIMGLSVIVMEDRTLFIADTAINEFPTSKQMADIAVTAAAAAKKMGHEPRVAFVSCSNFGSHAQEGTERIRESIEILDRLGVGFEYDGEMSIDVALRKESLALYPFNRIKGGPANVLIMPSLYSASISSKLLQEVGGVAVVGPILMGMEKPVQIVQMTASVSEILNLAVLSTLYNAL

SEQ ID NO: 51106 - protein, 285 aa, Xylella fastidiosa Temecula1
MTTNDTWFTEHFQTTGSAIGFRVTGKLDEVQSPFQKIEIYNSTDWGKLMVIDGALMLTSRDNFLYHEMISHPALFTHTAPKCVVIIGGGDCGTLREVLKHPDIEQVTQCDIDEQVTRMAEKHFPELCTSNNDPRATLLFSDGVAYMADCPTNSVDVIIVDSTDPVGPAKGLFNRTFYESCFRALKNDGLLIQQSESPLALLELIKEMRHEMSKAGFKAFKTLPFPQPCYPTGWWSVTLSSKQPNANFAFRQTDAQTKPFDTLYYNAHLHHGVLVPPPFIAHALGE

SEQ ID NO: 51107 - protein, 559 aa, Mesorhizobium sp. BNC1
MADVKSDIEIARAARKKPIQEIGAGLGIASEHLLPYGHDKAKVSAEFIAEARKRPDGRLILVTAINPTPAGEGKTTTTVGLGDGLNRIGKKAIVCIREASLGPCFGMKGGAAGGGYAQVIPMEDINLHFTGDFHAVTSAHNLLSALIDNHIYWGNELGIDTRRVTWRRVMDMNDRALREIVCSLGGVANGYPREGGFDITVASEVMAILCLAKDLGDLEKRLGDIIVAYRRDKSPVFARDLKADGAMAVLLRDALQPNLVQTLENNPAFVHGGPFANIAHGCNSVMATSTALKLADYVVTEAGFGADLGAEKFFDIKCRKTGLKPAAAVIVATVRALKMNGGVKKEDLGAEDVDALIRGCANLGRHIENIKQFGVPAIVAINHFETDTPAEIEAVRAYVGAQGEEAVLCRHWAEGSAGIEELAHKVVALAESRASQFAPLYPDNMPLFEKINTIVRRIYRGSRAVADGTVLAQLKQWEDQGYGHLPVCMAKTQYSFSTDSNLRGAPVDHVVPVREVRLSAGAGFVVAICGEIMTMPGLPRAPSAEKIFLNEAGYIEGLF

SEQ ID NO: 51108 - protein, 212 aa, marine gamma proteobacterium HTCC2143
MSDIDALVAGFKEFHEVYTEDREGKYHGLAEYGPHSKILMIACCDSRVDPAIITNSSAGDLMVIRNMANLVPPYDAASTSYETPAAIEFAACYLQVEHIVVMGHSRCAGIRSLLTRLVDDSDPTRPLDKWTVVAEPAAKQVLIEMPDADLDDQSCACSRKALAASLNNLRTYPWIAERLSNKSIAIHGWYFNLATGELERYQEDSETFEQLF

SEQ ID NO: 51109 - protein, 280 aa, Pseudomonas aeruginosa
MDRYCVFGNPIGHSKSPLIHRLFAEQTGEALVYDAQLAPLDDFPGFARRFFEQGKGANVTVPFKEEAYRLVDELSERATRAGAVNTLIRLADGRLRGDNTDGAGLLRDLTANAGVDVRGKRVLLLGAGGAVRGVLEPFLGECPAELLIANRTARKAVDLAERFADLGAVHGCGFAEVEGPFDLIVNGTSASLAGDVPPLAQSVIEPGRTVCYDMMYAKEPTAFNRWAAERGAARTLDGLGMLVEQAAEAFFLWRGVRPASAPVLETCADSWQLSELSGGI

SEQ ID NO: 51110 - protein, 261 aa, Nostoc sp. PCC 7120
MTASNPTILALDFDGVICDGLIEYFEVAWRTYCQIWSPAENTPPDDLALRFYRLRPVIETGWEMPVLIKALVDGNSDDQILQEWTSITPKILLDDKLQAKEIATKLDGLRDEWIANDLDGWLSLHRFYQGVIEKLKIAVASEVKLYIVTTKEGRFVEQLLHQEGVDLPRDAIFGKEVKRPKYEIIRELIQAADHEPVSLWFVEDRIKTLQLVQQQSDLEDVKLFLADWGYNTQSERKAAQSDPRIQLLSLSQFAKDFPGWV

SEQ ID NO: 51111 - protein, 192 aa, Oryza sativa (indica cultivar-group)
MVLWELTAITAYFLGLRRTYRLALRIQRRLIGPNHPRIRHFVYRRTRDVFNVAVSVHKNIQQRDLEVGRNLGNMILRWLDRMKPSAQIRPHPPGPPNGSSEQFRHLSSTSKSTGAQKPTSKTLPCDGGKVLFSPLNIRPKSFPVLPTMMQPTRISASSQCRRISYSSFPSATAKRNDFMQGVFRKDIAQLMV

SEQ ID NO: 51112 - protein, 563 aa, Arabidopsis thaliana
MMISEKPLGVEESIRQDLEVLTVSRRLVKSVSQKLKKKIHKTEVVEDEEIARGAVNCLSISVGCRVADTGEDFEDSSNKRWSSASEEGKGLMTICGTEETRLDCFSYGVRERFWKKNNRKYLADSGQDYRKHVYLPDDILEMCLMRLPLTSLLNAHLVCKKWQSMANTQRFLQMRREGSFQTPWLFLFAALKDGCSSGDIHGYDVSQDKWHRIETDLLKGRFMYSVTSIHEEIYIVGGRSMDRNSFKSHRGILVFSPSIKAWRKIASMRHARSLPIVGATEVTSEFSTMQTKQNRQDRRFHLSRVGGESDVYEDPHRLSVRRQNRNSADQNGTKSHRLIRQKLDRLNRNSSKRFVLIAIGGTGLFDEPLDSGEIYDSATNTWSEMQRLPMGFGVVSCGIICNGIFYAYSENDKLSGYDIERGFWITIQTSPIPPRVHEFYPKLVSCNHRLFMFSVSWCDEGDGQIGRRNKAVRKLWELDLVYLTWTEVSVHPDAPMDWNATYVSDQNILMGIEMFKIFGQVLSFFTVCDVLTEEASWRHVSRNQRSQKLNLSCTNKTIALLHL

SEQ ID NO: 51113 - protein, 700 aa, Citrus junos
MGSSVVLIRTICFAVFLGWLLVWALIPTKVYKNTWTPKLNNKLNSTYFREQGTNLLLFSFPVMLIALLGCVYLHLQKKPNKLQSKRKMRSPRLFFSQRPVLVMAPLGIVTAIELTIAVMFVAFLIWALANYLYVSFGHLHMHKAGEKVWQAKFRSVSLRLGYIGNTCWAFLFFPVTRGSSILPLVGLTSESSIKYHIWLGHLSNALFALHAVGFLIYWAMTNQMAEVLEWSETYVSNVAGVIAIAIATVIWATSLPRFRRKMFELFFYTHHLYILYIIFYVLHAGPAYFCMILPGIFLFAVDRYLRFLQSRNRARLLSARALPCGVVELNFSKSPGLYYNPTSILFVNVPSISELQWHPFTVTFNCNMEQDKLSILIKTEGSWTQKLYQQISSSVDRLEVSVEGPYGPNSAHFLRHESLVMVSGGSGISPFISIVRELIFQSNNNPDYKIPNVHLICVFKKSADLSMLNIMLPVSDAPTELAKLQLQIEAYVTRDSEQPKTDTQKELQSIWLKSNPSDSPVSGALSCNSWLWLAVVTASSFVMFLLLLGIVTRFYIYPIERNGTEVYHYSYKCLWDMFLVCVCVFLASSAVYLWLKKQQNAIEVKQIQNMEVPTPKTSPASWFYTADRELEESLPNQCLVQATKFHFGERPNPNKILLDVKGTDVGVLVCGPRKMRHEVAKICSSGLADNLHFESISFSW

SEQ ID NO: 51114 - protein, 279 aa, Xylella fastidiosa 9a5c
MPQCGFSAKAAGILQALGVEYAHVNVLDDQEIREGIKRYGDWPTIPQLYIDGELIGGSDIVSQMYENGELSALLGVAAPDLTPPSITITPTAVEMLKSTLANAPGSALALSIDSRFQPTFELTPINTQAIAAESNGLRVQFDLASARRAEGITIDWVDDIRGQGLVIDNPNAPQPIQELSPGDAAAQVGAGALTLVDVRPADERAIASVAVPFRTMDGGERAALEQLPKETPLAFLCHHGGRSLQAAEHFRSLGFTSIYNIGGGIDAWSIQVDASVPKY

SEQ ID NO: 51115 - protein, 474 aa, Escherichia coli K12
MQHKLLINGELVSGEGEKQPVYNPATGDVLLEIAEASAEQVDAAVRAADAAFAEWGQTTPKVRAECLLKLADVIEENGQVFAELESRNCGKPLHSAFNDEIPAIVDVFRFFAGAARCLNGLAAGEYLEGHTSMIRRDPLGVVASIAPWNYPLMMAAWKLAPALAAGNCVVLKPSEITPLTALKLAELAKDIFPAGVINILFGRGKTVGDPLTGHPKVRMVSLTGSIATGEHIISHTASSIKRTHMELGGKAPVIVFDDADIEAVVEGVRTFGYYNAGQDCTAACRIYAQKGIYDTLVEKLGAAVATLKSGAPDDESTELGPLSSLAHLERVGKAVEEAKATGHIKVITGGEKRKGNGYYYAPTLLAGALQDDAIVQKEVFGPVVSVTPFDNEEQVVNWANDSQYGLASSVWTKDVGRAHRVSARLQYGCTWVNTHFMLVSEMPHGGQKLSGYGKDMSLYGLEDYTVVRHVMVKH

SEQ ID NO: 51116 - protein, 1031 aa, Idiomarina baltica OS145
MFKASEVLSKSHQAEDLKSLQQAITDNYIVDEDAYMRELLPLVPSDDDAVSTVTERAAKLVEQVREQADNGMVDSFLQEYSLDTKEGIILMCLAEALLRIPDAATADALIQDKLSGGDWQKHMGQSASWLVNSGTWGLALTNGVINPTGKAMETPRGTFRRMIRKLGKPVVRKATYAAMQIMGKQFVLGRTIEEALKESRENRDKGYTHAYDMLGEAALTMSDAEYYKQQYVNSIKTITNEKFNNPDAPRPTISIKLSALHPRYEASNHERVLTELATTLTDLVKLAKEADVGVTIDAEEVDRHELSLELFEKVYRSGVCKGWPRFGLVVQAYSKRALPTLCWITALARECGDEIPVRLVKGAYWDNEIKWSQENGVTGYPVFTRKAHSDLSYIACARYLLSDDTDGAIYPQFATHNAQTIMSIEHMNETHKRRIEYQRLHGMGDNLYDTLMKQKPGMVVRIYAPVGPHRDLLPYLVRRLLENGANSSFVHKLLDADTPVDELVVHPLKTAMRHEVYANDKIPLPPAMYEERKNSLGLNMNIHSQADDFIAAVQQYRDKQWQGGPIVDGKTVETDHQVSITSPQETTKQVGSIYWGDKKLAEQALQSANKAYRAWREVPVDERATCLEKFADLMEANRNELIALCSVEAGKGLQDGIDEVREAVDFCRYYAKEARKLMDGEIQLPGPTGEDNKLKLEGRGTFICISPWNFPLAIFVGQVVAALVTGNSVIAKPAEQTGLIAYRAVQLALEAGVPGNVLHFMPGSGAEVGSFLTSQEDIGGVCFTGSTYTAQAINRALAARTGPIVPLIAETGGQNAMLIDSTSLPEQVVTDVVASAFQSAGQRCSALRVLFVQDDIADRIFDLLLGAMEELEVGDPLLHETDVGPVIDGIAKTNLEQHISDIQQAGRLIARAPMPDYTQGGTFVAPTAIEIDSISQLVKENFGPILHVIRYKTEELDDVIDSINGTGYGLTFGIHSRNETFAYDIASRVDVGNVYINRNQIGAIVGVQPFGGRGMSGTGPKAGGPHYLTRF

SEQ ID NO: 51117 - protein, 705 aa, Oryza sativa
MNKNLLSPGVQKSAKPILAFLEQCGINASDVARSSTMYSSRLLTANPEYLRDAVARVEELGLDRSSRRFHRGLVAVALVSKETAARKIRLMEELGFSQDDLLVIMRKLPNFLALSEKKIRRAVEFLKRDVGLEGRYIVQRPVLLSYSLERRLLPRHCLLKVLRTKGLLNSELDYYSTAALSEKKFVNKFVHPYEDHIAGLADAYASGCSEEGNGVASLLSLQTEMDAWEIENGEDFLVRKKEGIVDYCQMILIDYAGANNAGEAFAQRATIAAQQLLRPYRNCSICTLVSTSRSLRFHGGGGAASSSSSTATAAAAMIHHLQRRIVSLLLLHPASPHPVAAISLGRLLSTTAPVSSKPFAAEDYLVAACGLTRAQAARASERISHLRSPSKPDAVLAFLAGLGIPRPDIATAVAADPRLLCAGVEGNLAKRVAELGDLGIPRSQIARLVPLAKIPFRSSSLATNLAFWLPVFGSLDSILRALRKNSSLLSANLDKVVKPNLAFLKQCGIDARDVASNPNLYSSRLFTSNPMKLRDAVARVEELGMVRGSRVFHRGLVAVAFLSKEAVATKTRLLVELGFSQDDVSVIFRKMPSFLTASEKRIRRAVGFLKGDVGLEERYIARRPVLLLYSLERRLLPRYYLLKVLRTKGLLDCKLCYYSTAALGEKKFIERFVHPYEDHIAGLADAYGSICSGKVANGVAPLLGL

SEQ ID NO: 51118 - protein, 499 aa, Arabidopsis thaliana
MATRLLRTNFIRRSYRLPAFSPVGPPTVTASTAVVPEILSFGQQAPEPPLHHPKPTEQSHDGLDLSDQARLFSSIPTSDLLRSTAVLHAAAIGPMVDLGTWVMSSKLMDASVTRGMVLGLVKSTFYDHFCAGEDADAAAERVRSVYEATGLKGMLVYGVEHADDAVSCDDNMQQFIRTIEAAKSLPTSHFSSVVVKITAICPISLLKRVSDLLRWEYKSPNFKLSWKLKSFPVFSESSPLYHTNSEPEPLTAEEERELEAAHGRIQEICRKCQESNVPLLIDAEDTILQPAIDYMAYSSAIMFNADKDRPIVYNTIQAYLRDAGERLHLAVQNAEKENVPMGFKLVRGAYMSSEASLADSLGCKSPVHDTIQDTHSCYNDCMTFLMEKASNGSGFGVALATHNADSGRLASRKASDLGIDKQNGKIEFAQLYGMSDALSFGLKRAGFNVSKYMPFGPVATAIPYLLRRAYENRGMMATGAHDRQLMRMELKRRLIAGIA

SEQ ID NO: 51119 - protein, 1130 aa, Solanum tuberosum
MASGSRTKHSHHSSSQAQSSGTSNVNYKDSISKAIAQYTADARLHAVFEQSGESGKFFDYSQSVKTTTQSVPERQITAYLTKIQRGGHIQPFGCMIAVDEASFRVIAYSENACEMLSLTPQSVPSLEKCEILTIGTDVRTLFTPSSSVLLERAFGAREITLLNPIWIHSKNSGKPFYAILHRVDVGIVIDLEPARTEDPALSIAGAVQSQKLAVRAISHLQSLPGGDIKLLCDTVVESVRELTGYDRVMVYKFHEDEHGEVVAESKRSDLEPYIGLHYPATDIPQASRFLFKQNRVRMIVDCHATPVRVTQDESLMQPLCLVGSTLRAPHGCHAQYMANMGSIASLTLAVIINGNDEEAVGGGRNSMRLWGLVVGHHTSVRSIPFPLRYACEFLMQAFGLQLNMELQLASQLSEKHVLRTQTLLCDMLLRDSPPGIVTQSPSIMDLVKCDGAALYYQGKYYPLGVTPTEAQIKDIVEWLLAYHGDSTGLSTDSLPDAGYPGAASLGDAVCGMAVAYITSKDFLFWFRSHTAKEIKWGGAKHHPEDKDDGQRMHPRSSFKAFLEVVKSRSSPWENAEMDAIHSLQLILRDSFKDAEASNSKAIVHAHLGEMELQGIDELSSVAREMVRLIETATAPIFAVDVEGRINGWNAKVAELTGVSVEEAMGKSLVHDLVYKESQETAEKLLYNALRGEEDKNVEIKLRTFGAEQLEKAVFVVVNACASKDYTNNIVGVCFVGQDVTGEKVVMDKFINIQGDYKAIVHSPNPLIPPIFASDENTCCSEWNTAMEKLTGWSRGEIVGKMLVGEIFGSCCRLKGPDAMTKFMIVLHNAIGGQDTDKFPFSFFDRNGKYVQALLTANKRVNMEGDTIGAFCFIQIASPELQQALRVQRQQEKKCYSQMKELAYICQEIKSPLNGIRFTNSLLEATNLTENQKQYLETSAACERQMSKIIRDIDLENIEDGSLTLEKEDFFLGSVIDAVVSQVMLLLREKGVQLIRDIPEEIKTLTVHGDQVRIQQVLADFLLNMVRYAPSPDGWVEIQLRPSMMPISDGVTVVHIELRIICPGEGLPPELVQDMFHSSRWVTQEGLGLSMCRKMLKLMNGEIQYIRESERCYFLIILDLPMTRKGPKSVG

SEQ ID NO: 51120 - protein, 1098 aa, Arabidopsis thaliana
  misc_feature (586)..(586): Xaa can be any naturally occurring amino acid
MTEPERLGGISLSFPVNEEDTVTTTSPKTLPRRLRRRLLEPKSPVSAAEIDSKLREADLRRQQYYESLSSKARPKMRSPRSGSIEELSQRLESKLNAAEQKRLSILEKELARLAKMDEARQAAKNGLEQRVEKERDELESKVEERVLKAEKNRMLLFKAMAQRRAAKRQRAAQSLMKKAIQETRYKESVRAAIYQKRAAAESKRMGILEAERRRANARLTRVFGAASSVRSQKEAERRKMKDRLEERLQRAKKLKAQYMRRRRGMDSCSSSRSETMRKNQVHLVRMLVRCWRRFAKYKKSTFVLARAYHELGINEKSIESVPFEQFAIQMNSVSVIQTVKALLDRLEIRLTLSKASNVENINHLLKHIFPPVRRGKSPSPMSKGEQNSPNSKMGYQKLKKIARYPARIFLCAYMIKQHPGAIFRGRGEHEIALVESATCLIREFELLVKVILEGPESTLPGNVSFVAQRPKKFRSQLEAFDKAWCSYLEGFVVWKINDAKLLEKDLARTQESELSEVSKHTSSPKIIDSGLNQKTVKASSPTNRALFSETDGARESKAPADSHLPSSSSPSPGSSNLSPSLNSAGXEAISTPNVVANSFDAALASENEVIVNEIVHDNSSSFADSLDPNTGDTSNLQVRVKETMEKAFWDGVMESMKQSQPDFSWVIKLMKEVRDELCEISPKDWRQEIVQTIDTDVLSQLLASGNVDMGYLGNILEFSLGILLKLSAPANEEEIRVTHHKLMTELGEIVPTDGHSNSSYAVLMVKGLRFVLQQIQILKKEISKSRLKLLEPLLKGPAGLEYLKKSFSSRHGSPDQASSSLPLTKRWLLSVRGEAEREWKEHKDALSAVINNHSGSSGLPSTTMRTGGNVSSVSKVNTPSSPFPGIELSECKGETVDLLVRIGLLKMVSEIGGLTLETVPETFQLNLSRLRDVQSQIQKITLVSISVLILQQTLVSENSSSIDMEAITRTCINRLYEMLDAKPDAGLSEIMETLSELLDSNDAETKKQVIANMLVKSLQAGDAVFTHVSQTIYLAIRAAVLAGNNTKRKQLVETMLRKIGAASLSDKVIEVSDILVLVATVSRSVHGLWYEELLKKPN

SEQ ID NO: 51121 - protein, 880 aa, Mycobacterium sp. MCS
MGPSHEATSRQYTIPSLAPMSTSISNGPARNVVVVGHGMVGHRFVEALRARDDADAWRITVLAEETDAAYDRVGLTGYTEHWDRALLALAGNDYAGDDLVDLRLGQRVTSIDRAARTVKTADGTAFAYDALVLATGSYAFVPPVPGRDLPACHVYRTFDDLDAIRADAARARETSRAPVGVVIGGGLLGLEAANALRGFGLTAHVVERSPRLMSQQLDDAGGALLSRMIADLGIEVHLDVSTDAITPAQRNRPLRRSEEDDSLRVMLGDGSFIDAGVVVFAAGVRPRDELARDAGLVIAERGGVLTDLGCKTSDPSIYAVGEVAAIEGRCYGLVGPGYTSAEVVADRLLGGAAEFPEADMSTKLKLLGVDVASFGDAMGRTPDCLEVVVNDAVNQTYAKLVLSDDAKTLLGGVLVGDASAYGVLRPMVGEQLPGDPMALIAPAGSGGADGGLGVGALPAAAQICSCNNVTKGDVTDAIAGGCCDVPGLKACTKAGTSCGSCVPLLKQLLEAEGVEQSKALCEHFSHSRAELFEIVSATEIRTFSGLLERFGTGKGCDICKPTVASILASTSSEHILDGEQAALQDSNDHFLANIQRNGSYSVVPRVPGGDITPEQLILIGEIARDFDLYTKITGGQRIDLFGARVEQLPEIWRRLVEGGMESGHAYGKALRTVKSCVGSDWCRYGQQDSVQMAINLELRYRGLRAPHKIKMGVSGCARECAEARGKDVGVIATEHGWNLYVGGNGGMTPKHAQLLAGDLDDETLIRYVDRFLMFYIRTADRLQRTAPWVEQLGLDHLREVVCDDSLGLASEFEAAMARHVEGYACEWKGVLEDPDKLSRFVSFVNAPDVPDPTVTFTENAGRKVPVPIGMPSIRPLQETP

SEQ ID NO: 51122 - protein, 377 aa, Glycine max
  misc_feature (107)..(107): Xaa can be any naturally occurring amino acid
MADAEDIQPLVCDNGTGMVKAGFAGDDAPRAVFPSIVGRPRHTGVMVGMGQKDAYVGDEAQSKRGILTLKYPIEHGIVSNWDDMEKIWRHTFYNELRVVSEEHPVLXTEAPLNPKANREKMTQIMFETFNVPAMYVAIQAVLSLYASGRTTGIVLDSGDGVSHTVPIYEGYALPHAILRLDLAGRDLTDHLMKILTERGYMFTTSAEREIVRDMKEKLAYVALDYEQELETAKSSSSVEKSYELPDGQVITIGAERFRCPEVLFQPSMIGMEAAGIHETTYNSIMKCDVDIRKDLYGNIVLSGGSTMFPGIADRMSKEITALAPSSMKIKVVAPPERKYSVWIGGSILASLSTFQQMWISKGEYDESGPSIVHRKCF

SEQ ID NO: 51123 - protein, 376 aa, Nostoc sp. PCC 7120
MDAEEILERYANGERNFCNGNRQGIDLSGTDLSEINLSKSNWNGADLSEAILTHATLNNTNLSRASLTNANLSGIEGSYLNLSWADLNGAYLSGAKLIDANLVGADLCGANLTSIKLIQVNFHGANLQRVKLRGVTFERCDLSEVNLTEADLVRVFLGQANLRNAYLQGANLERADLANANLIKANLDGANLRKANLSGANIYGASFEDADLTGAIMPDGEVYKPIAIEVEIGKQEVSLEKVISMAHQVIRTDKAPAPVGPYNQAIAASGKLLFVAGQIAIDPRLGDVVYTDDVKKQTEQVFANIQAILQAAGIKFSNVVKTTVFLADMNDFAAVNAVYAKYFEEATAPARACVEVSRLPKDVLVEIECIAVIPER

SEQ ID NO: 51124 - protein, 365 aa, Acinetobacter lwoffii
MNSAIKGTNVTALPQKIQTILDKGQGTAARALDKLPKIVQESLAKVLGYPYQYPDLDAFTKCLMAVQIKQGRIGFIGEDPIESRRQFDAQMLAILNKATQIESVEDIRLPLQSGTVFARHYHPAPNKKLPMILFYHGGGFVVGGLDTHDEVCRLIAKYAKVQVLSIDYPLAPEASPQLLIKSCEDALAWVYQNRRQLKIYKNRIAVAGDSAGGNISTVVAQHTAGKSYAPQAQLLIYPVVDFKSRHPSFYAYGEGLVLTSKDVDYVTQYYATQHNIALDNPLISPTYGNLRKLAPAYVITAGHDLLHDEGEIYSHKLRQSGVKVQYVDYPDQTHGFINLTPISSKAKRNTIEIAKNFRKFWDKHS

SEQ ID NO: 51125 - protein, 206 aa, Bacillus clausii KSM-K16
MKPIRFDKDGLVPAIVQDANSKTVLTLAYMNEESLQKTMETKETWFYSRSRQQLWHKGETSGNTQHVVDVRYDCDQDAVLVLVEPKGPACHTGAYSCFSQSLTGSTSKVEGDRFQILNDLEETIAKREAEMPEGAYTTYLFTEGVDKILKKVGEEAGEVIIAAKNRDPEELRWEVADLFYHVLVLLQEQKLPLDKVLETLKARHQS

SEQ ID NO: 51126 - protein, 122 aa, Triticum aestivum
NMAKKRTNVIPIIEDARHPARYRMLVGMVDVIFSDVAQPDQARILALNASYFLKNGGHFVISIKANCIDSTLPAEAVFAAEVEKLKADQFKPAEQVTLEPYERDHACVVGGYRMPKKQKATS

SEQ ID NO: 51127 - protein, 608 aa, Ustilago maydis 521
MGEERKVSATSSAALAIRTSSTPSAGAQLPDPSLPAPNLGEDEVGFTAADLIAQQSKLEAQANEAIPFQFDTCTHERGYIRQPVYACKTCGGGGVCAGCSVSCHAEHELVELFNKRKFRCDCGTPNLYRQQEPNRATRLTRITEQLAYPEGAKPCILRKPGFSPQNDVNAYNHNFDGGFCYCERGKTYDPEKEDETMFQCIVCEEWLHESCTSLWPSPRPLDSKSNTEAVNDSDAAASFASRALAEAEAPLIDHDLFDLMICDACVRRPGNGLLRRYAGAKGWMILVPSQDAAQVAAHDSITKIQVPTEDELREGGGPYHDGRSWQIFGLEVEQERVLTQDDVAIAADGALLSSVADLARSTVAAASEVLQGTSALAEDASTKREGEPQKEGIGLANGSDERREGKRRAVEDAGEDEAKRVKVEDEKTRDVHMATETRSETEVNETIQQPLCTLPAALDVVASLSESKVDPWTPALSEPAAKELGVQQRYDIFLSEDFRDRICRCSTCLPQWEHLSHVLDTEETYAPPSDPQASVRDDDAASITSSTYDLGMAALRSMPREKMINSLHAYSKFRDALWEHLKPFAGTGKVVREEDVRAFFQKKLNAER

SEQ ID NO: 51128 - protein, 318 aa, Synechococcus sp. RS9916
MGWSTADIPDQQGRIALITGASSGLGLETARALHQKGATVVMACRSPRKAEAARQELLEMQGEGALDLVALDLADLASVGRCSDAIHQRYGRLDLLINNAGVMAPPRLVSRQGYELQWATNHLGHMALTTALLPLMEGQADARVVTVTSGAQYFGRIAWGDPNGEQRYDRWQAYGQSKLANVMFALELDQKLRKQGSTVRSLAAHPGLARTNLQPASITANGSRIEAFAYRLMDPLFQSAAMGALPQLHAATAPSAQGGEHYGPDGFGGLRGWPKQQPVAPAARDAAQRQRLWALSEALLQEATAPDKPRRSTDRAAG

SEQ ID NO: 51129 - protein, 699 aa, Mycobacterium avium 104
MTTLEEISALTQPHLPDDWSELDSAAVDTIRVLAADAVQKVGNGHPGTAMSLAPLAYTLFQRVMRHDPSDTHWLGRDRFVLSAGHSSLTLYLQLYLGGFGLELSDIESLRTWGSKTPGHPEFRHTKGVEITTGPLGQGLASAVGMAMASRYERGLFDPDAAAGTSPFDHFIYVIASDGDIEEGVTSEASSLAAVQQLGNLIVFYDHNQISIEDDTNIALCEDTAARYEAYGWHVQRVEGGENVVAIEEAIAAAKAVTDRPSFIELRTIIGYPAPNAMNTGKAHGAALGEEEVAAVKKILGFDPDKTFQVRDKVIAHTRKLVDRGREAHQKWQTDFDAWAQREPERKALLERLTAEKLPDGWDADLPHWEPGSDAIATRKASGAVLNAVAPKLPELWGGSADLAESNLTTINNADSFGPPSISTKEFTASWYGRVLHFGVREHAMGAILSGIVLHGPTRAYGGTFLQFSDYMRPAVRLASLMDIDTIYVWTHDSIGLGEDGPTHQPIEHLAALRAIPKLSVVRPADANETAYAWRTILARGNGSGPVGLVLTRQGLPVLEGTDADGVARGGYILGSDGEEAGQEPDVILIATGSEVQLAVEAQKLLADKDIVARVVSMPCVEWFESQPDDYRDSVLPPSVSARVAVEAGVAQSWHKLVGDTGKIISIEHYGESADYKTLFREFGFTAEAVAAAAEEVVDN

SEQ ID NO: 51130 - protein, 339 aa, Solibacter usitatus Ellin6076
MPTANQQPCEHDSSMPTENEWLAAARAAMRIEAESIARAAERLDGELVRAVELILAHPGKVVVTGIGKSGHIARKIVATLCSTGTAAVFLHPAEAAHGDLGIYTPGDPTIVISKNGASSELQSLVPMLRQFRSPLVGILGNAHSPLGAEVDVLLDASVEREADPHNLAPTASAVTALALGHALAIALMCARNFTPEEFGKFHPGGQLGRNLRLSVREAMHGADEVAFVAPGAALKDVIIAMTRKPMGGACVVAEAGVLAGFITDGDLRRALTNHDDIRGLTAAEAMTARPVTIGPEATLGQALELMERRRSQISVLPVVDGDGRALGVVRIHDIYLGVK

SEQ ID NO: 51131 - protein, 492 aa, Candida albicans SC5314
MPQVTKTNNENEFRLTRSKVQHQESISTIKNTTISNSQHKQQTQQQISSPPQVSVTSSEGVSHVNTRQYLGDVSNQYITNAKPTNKRKPLGGDNAPLQKQQHRPSRPIPIASDNNNNGSTSSSSNSSNNNNNDANRLASLAVPSRLPQKRQATESSTNLVEKLRVPQPEVGERSQSYHKKSRLIDYEWQDLDEEDSDDQLMVSEYVNEIFSYYYELETRMLPDPQYLFKQTLLKPRMRSILVDWLVEMHLKFKLLPESLFLAVNVMDRFMSVEVVQIDKLQLLATAALFTAAKYEEVFSPSVKNYAYFTDGSYTPEEVVQAEKYMLTILNFDLNYPNPMNFLRRISKADDYDVQSRTLGKYLLEITIVDYKFIGMRPSLCCASAMYLARLILGKLPVWNGNLIHYSGGYRISDMRECIELMFQYLIAPIEHDEFFKKYAMRKFMRASTLCRNWAKKFQASGRDLFDERLSTHRLTLEDDDEEEEIVVAEAEE

SEQ ID NO: 51132 - protein, 487 aa, Burkholderia mallei ATCC 23344
MGIKHWIGGREVDSPETFTTFNPATGQPIAEVASGGAQEIDAAVRAAKDAFPKWAGTPAKERAKLMRRLGELIERNVPALADLETRDTGLPISQTRKQLIPRASENFHFFAEVCTRMNGRSYPVDDQMLNYTLYQPVGVCALVSPWNVPFMTATWKTAPCLALGNTAVLKMSELSPLTADQLGRLALEAGIPAGVLNVVQGYGATAGDALVRHPDVRAVSFTGGTVTGKRIMERAGLKKYSMELGGKSPVLIFDDADFDRALDASLFTIFSINGERCTAGSRIFVQRTIYDRFVAEFARRANNLIVGDPADESTQVGSMITRAHWEKVTGYVRLGVEEGARLVAGGPDKPANLPAHLANGNFVRPSVFADVDNRMRIAQEEIFGPVACLIPFDGEEDGLRLANDTAYGLASYLWTRDVGRAHRLARGIEAGMVFVNSQNVRDLRQPFGGVKESGTGREGGEYSFEVFAEIKNVCLSMGSHHIPRWGV

SEQ ID NO: 51133 - protein, 188 aa, Candida albicans SC5314
MSDRVLEINALAKELKANLKQFPNFPKEGILFEDFLPIFTKPDLFNKLVKAFKLHVGEQKIDYVIGLESRGFLFGPTLALALNAGFVPVRKPGKLPGPTFKVEFQKEYGSDEFEIQQDVIPKGAKVLIVDDILATGGSAFGAGELAKKTGAEIVEYLFVMELDFLKGRDKLDAPVYTLFGGQEEKFTE

SEQ ID NO: 51134 - protein, 119 aa, Brassica napus
LAGRHTHLQTLVRTRGEIQNDDGFNWGYNPVLWGVPKGSYASDPTGPCRIIEFRKMVQALNHVGLNVVLDVVYNHLHANGPHDKDSVLDKIVPGYYLRRNNDGFIENSTCVNNTASEHY

SEQ ID NO: 51135 - protein, 164 aa, Anaplasma phagocytophilum HZ
MLYCVQFGRRVIRLVSATVHGFFLTLLAMFKPKVTLRYPHEKGPLSTRFRGEHALRRYESGEERCIACKLCEAICPAQAITIEAEERSDGSRRTTRYDIDMTKCIYCGFCQEACPVDAIVEGPNFEYSTETREELMYNKEKLLANGDIWEEALRYRIKKNQPYY

SEQ ID NO: 51136 - protein, 195 aa, Bacillus clausii KSM-K16
MARSYELTRTTGETDISLRLNLDGEGKADIETGVPFMEHMLDLFAKHGQFDLFVKASGDIEVDAHHTTEDLGICIGQAVKEALGTKEGIKRYGNAFVPMDETLAQVVVDLSNRPHLEFRADFPSQKVGTFDTELVHEFFWKLALEARMNLHIIVHYGHNTHHIIEAIFKACARALDEATAIDPRIKGILSTKGLL

SEQ ID NO: 51137 - protein, 447 aa, Oryza sativa (japonica cultivar-group)
MKTSLCVLLCILVISEVVGVPRCAAALGINYGQVGNNLPSPAQVVSLLASLRIGKVRIYDANPQVLAAFAGTGIELIVTVPNDLVRPMAASPGEALQWVSSSVRPYFPATRVTGIAVGNEVLTDDDEALKAALVPAMRNLHAALAQLGMDGYVHVSTASSLAVLATSYPPSQGAFTAEVAPLMAQFLRFLAETNAPFWINGYPYFAYKGDPTRVSLDYALSNPYHVGAIDPYTRLQYTSMLYAQVDAVAYATSQLGYNNIPVYVSETGWPSKGDTDEVGATVENARAYNRNLLLRQAAGEGTPLRPRQRLEVYLFALFNENMKPGPTSERNYGCTSPMQSTSAASLSLAASPATKTDAKKNFAGLCFLSSLAILQCPNASSAQRKSFWHKQNGLTIVDQKPLQDQRGDAPFQGGKRKIKGSSCCQEEKLEEATLGCGRHYLGDGTEL

SEQ ID NO: 51138 - protein, 413 aa, Oryza sativa (japonica cultivar-group)
MTITVEVADWQLGRCWCRSRAGRSRWRPSSPSTWLRRAGADVSVASVDPGSAQVGGAWGVKLAADALLDDLADAEFDLISLPGGMPGSSNLRDCKLLENMVKKHAGKGKLYAAICAAPAVALGSWGLLNGLKATCYPSFMDKLPSEVNAVESRVQIDGNCVTSRGPGTAMEYSVVLVEQLYGKEKADEVAGPMLMLAFNLVLTSFKVMRPQHGVEFSLKELNSTSWNVGETPQILVPIANGTEEMEATMIIDILRRAKANVVVASLEETLEIVASRKVKMVADVLLDDALKQQYDLILLPGGLGGAQAYAKSDKLIGLIKKQAEANKLYGAICASPAIALEPHGLLKGKKATSFPGMWNKLSDQSECKNRVVVDGNLITSQGPGTSMEFSLAIVEKLFGRERAVELAKTMVFM

SEQ ID NO: 51139 - protein, 468 aa, Mycobacterium avium 104
MSTTIPVFNPSTEEQIAEVPDSDQAAVDAAVARARETFESGVWRKAPASHRANVLFRAARIIEERKDELAALESQDNGMNLTAAGHIIPVSVDMLKYYAGWVGKIHGESANLVSDGLLGTWETYHTFTQLEPVGVVGLIIPWNGPFFVAMLKVAPALAAGCSAVLKPAEETPLTALKLEEIFREAGLPDGVLNVITGYGETTGAALTAHPDVDKISFTGSTEVGRLIVKAAAGNLKRLTLELGGKSPLIMFDDANLDKAIMGAGMGLLAGSGQNCSCTSRIYVQRGIYDQVVEGLAEFAMMLPMGGSDDPNSVLGPLISEKQRQRVEGIVNDGVAAGAKVITGGKPMDRKGYFYEATIITNTTPDMRLIREEIFGPVGCVIPFDDEDEVIAAANDTHYGLAGAIWTENLSRAHRVVNELRAGQIWVNSALAADPSMPISGHKQSGWGGERGRKGIEAYFNTKAVYIGL

SEQ ID NO: 51140 - protein, 306 aa, Photobacterium sp. SKA34
MKPTATLLNEVLDEVRPLIGQGKVADYIPALANVPASKLGIAVCYNDGEVIQAGDSQEGFSIQSISKVLSLTLAMTLYEPEELWSRVGKEPSGHAFNSMIQLELEKGIPRNPFINPGAIVVSDLLHSRLCAPQYRMLELVRELSCNPHIVYDKVVASSEMQHSDRNASIAYLMRSFGNFDNEVMPVLTNYFSYCALKMSCVDLARTFSYLANKGLPLGAKKRIISQTKSKHINALLATCGLYDGAGEFAYRVGMPGKSGVGGGIVAIVPGEMTIAVWSPELDQSGNSVAGTAALEKLSERIGRSIF

SEQ ID NO: 51141 - protein, 287 aa, Synechococcus sp. RS9916
MSSAAQPNGGWIDEHHNGVRYGLEGRVLVEETSSFQRITVIESERYGNGLLLDGCWMTAERQERHYHESLVHPALCSAASIERVLVIGGGDGGTARECLRHAGVQHLDMVEIDGRVVELSQQHLPSIGGGCWSDPRFHLHVGDGIAWAAEAADGSYDVVLVDGSDPAGPAEGLFNRAFFNHCKRILKPGGVFATQSESPEAFRQVHLDTVKLIRELFGHADPLYGWVPMYPSGWWSWTFAASDGPRYRQPLPERAAAIASGCEIWSPRWQRGAFDAVPAFMDRELNG

SEQ ID NO: 51142 - protein, 267 aa, Brassica napus
  misc_feature (249)..(249): Xaa can be any naturally occurring amino acid
MCSLSASLLLPTKLKPAYSDNRSNSNSSLFLANRRRPKRKNQSIVPMARLFGPAIFESSKLKVLFLGVDEKKHPLTLPRTYTLTHSDITAKLTLAISHSVNNSQLQGWANRLYRDEVVAEWKKVKGDMSLHVHCHISGGHFLLDLFPKLRYYIFSKELPVVLKAIVHGDGNLLNNYPDLQESLVWVYFHSNVDEFNRVECWGPLWEATSPDGHRTQTLPETRCKDECSCCFPQVSSIPWSHSLSNEGCXGYSGTQTEGMPTPNPEKL

SEQ ID NO: 51143 - protein, 121 aa, Malus x domestica
VPLLCTSIGLWAGLVIEYTTEHYTSNAYSPVQDVADSCRTGAATNVIFGLALGYKSVIIPVFAIAFAIYVSFSLAAMSGIAVAALGMLSTISTGLAIDAYGPISDNAGGIAEMAGMNHERV

SEQ ID NO: 51144 - protein, 384 aa, Anaplasma phagocytophilum HZ
MGDIRDLPVIDAANISNSRVLLRVDLNVPISNGEVHDKTRIERIAPTVEFLVKAKAKVVMISHLGRPKAQEEEFSLKQVVDVVSKVLGVEITFIPDITREEVDSVIDSLPWGSVVLLENLRFFTGEVENDLGFAGQLASLADMYVNDAFSCSHRKHASVDAIMNLLPSFAGFNLQEELNYLDGIVSESPGAAIIGGAKTSVKIPMLRNFASRLDFLILGGSLSTTFLDAMGFKVGNSFFEKNVEEALAVIEAAKESGCKIILPVDHAVAQNLEGPVTVKDNNDVTMEDSIFDIGEKTSRIIEETIRKCKTIFWNGPLGVFEHESFKGGTERLTKALVSCHKENGAKTIIGGGDSIFAMRSFGYCEQDFSYVSTGGGALLHFLAL

SEQ ID NO: 51145 - protein, 178 aa, Riemerella anatipestifer
MATQELIKKLEKTIDNIPNFPKEGIQFKDITPIFLNPELYEEVIDDLVAFSKGKVDVVCGIESRGFLFGIAVAVKLGVPFVLIRKKGKLPPPFISQKYDLEYGSSEIEMKEGQLKAGDRVLIHDDLLATGGTTEAAAKLVEKQGAKAAQFSFLIGLKALGGEAKLKKFNSEIYQLLEY

SEQ ID NO: 51146 - protein, 130 aa, Anabaena variabilis ATCC 29413
MIVSFLNKQTMSAQEIIRSIEAEQLKSNLPEIYIGDTVRVGVKIKEGDKYRVQPYEGVVIARRNGGINETITVRRVFQGVGVERVFLLHSPRIDNIKVLRRGKVRRAKLYYLRGRVGKATRIKQRFDRSL

SEQ ID NO: 51147 - protein, 248 aa, Ustilago maydis 521
MARTFFVGGNWKMNGSLESTKQLTQTLTQAKLDSNVEVVVSPPALHLLAVQEQLKGSKVAVAAQNAYHKPSGAFTGEVSVTMLKDAGIPWVILGHSERRTLFHESDANVAEKTAAALAENLSVILCIGETLEQREANETVNVVVRQLDAVADHVKDWSKIVVAYEPVWAIGTGKVATSEQAQEVHAAIRKWATEKLGKDTADQLRIIYGGSVAAKNCKELAQRPDIDGFLVGGASLKPEFVDIVNANA

SEQ ID NO: 51148 - protein, 265 aa, Acinetobacter sp. ADP1
MSGSTIIPWVVGNWKMNPKQSDAIQLVQQFKDLLKQQPISEQYCHVGVAPIAIALTTIQSELATANRQVATVAQDVSRFAGTGAYTGEISAELLTDSQIRYVLIGHSERRDLLGDHVEILKAKLSHALNAGMTVIYCVGESLEQREQGLAEQIVLQQICDIAPVVSAEQWQHQIVIAYEPIWAIGTGRTASPEDAQAIHAKIREGLCQITPAGSQIALLYGGSVKPENAVELAACPDINGALVGGASLNAESFYKIAQAFAQTQQ

SEQ ID NO: 51149 - protein, 417 aa, Francisella tularensis subsp. holarctica
MAEYKNYTLNFGPVHPAAHGVLRLILELDGENVVRADPHVGLLHRGTEKLAEFKPYNQSIGYMDRLDYVSMMCNEHAYVMAIEKLLQLEVPERAKYIRVMFAEMTRILNHLLWVAACGIDLGAMTVFLYAFRVREDLFDCYEAVSGARMHAAYFRPGGVARDLPTQMPQYQKTRFTSKRKAKKLNEPRQGSMLDFLDHFVVDFEKSLDEIDTLLTDNRLWKQRTVDIGTVTAERAKELGFTGPMLRGSGVAWDLRKTQPYEVYHKLEFDIPIGANGDCYDRYLVRMAEMRESNKLIKQCVDWLRANPGSVLSDNHKVAPPKRNAMKNNMEELIHHFKLFSEGYCTTEGEVYVGTEHPKGEFGVYIKSDGANKPYRLKMRAPGFAHISAMDELLSGHMLADTPAIISTIDVVFGDVDR

SEQ ID NO: 51150 - protein, 245 aa, Zea mays
  misc_feature (73)..(73): Xaa can be any naturally occurring amino acid
MDSRLAIAALLLLASASSAAADGGKVAVALYYESLCPYSARFVVNHLAKVFADGLREVVDLTLVPYGNARIHXGGEISCQHGPYECLLNTVEACAIDAWPDLDVHFSFIYCVEDLVVKRQYKDWESCFEKLGLDAKPVTECYKSEHGHKLELKYANQTDALEPPHRYVPWVVVDGQPLLEDYENFEAYICKAYKGTPPKACEGLERLQMALETAAEARNGVSYNSGVSKLATAEDEGGEHKVGEY

SEQ ID NO: 51151 - protein, 300 aa, Xanthomonas oryzae pv. oryzae KACC10331
MDTDRDAFVAELGAAYRQWGFAGIRNHGIAKADIDAAYEVFKAFFALPEATKRRYHVEGSGGARGYTAFGVETAKDSKHFDLKEFWHIGREIPDDSPYLAVMPPNLWPSEVPGFRERGYQLYQQLDQLGSRVLSALALHIGLPQDYFVDKTNNGNSILRPLHYPPITSDGIPNVRAGAHGDINFITLLVGASAAGLEVRSNDGEWVPFTADADTIVVNIGDMLQRLTNHVYPSTIHRVVNPPGEQARQPRYSVPFFLHPNPDFLIDVLPSCISADNPSHYPEPITAHGFLEERLREIKLK

SEQ ID NO: 51152 - protein, 1084 aa, Gluconobacter oxydans 621H
MPKRTDISSILIIGAGPIVIGQACEFDYSGAQACKALREEGYRVILINSNPATIMTDPGLADATYIEPITPEFVERIILKEKPDAVLPTMGGQTALNAAMALDKSGFLKKHNVELIGADAEVIDRAEDRQKFREAMDEIGIESPRSTIAHTLEEARAALADVGLPAIIRPSFTMGGAGGGIAYNREEFDQIVTGGLDASPTTEVLIEESVLGWKEYEMEVVRDTADNCIIICSIENIDPMGVHTGDSITVAPALTLTDKEYQRMRDASIACLRKIGVETGGSNVQFGVNPKDGRLVVIEMNPRVSRSSALASKATGFPIAKIAAKLAVGYTLDELKNDITKTTPASFEPTIDYVVAKIPRFTFEKFPGSPALLSTSMKSVGEAMSVGRSFAEAIQKGLRSMETGLTGLDPVEAPGDGSHNAYLAALAEPRPERILMAAQALRAGLSVEQINEACKFEPWFLRQLEDIVASEREIEKNGLPKDAYNLRRLKAQGFSDAQLARLSDQSVKDVAALREKLAVTPVYRRIDTCAAEFASDTPYLYSTYEGGFGTPDCESRPTNRDKIVILGGGPNRIGQGIEFDYCCVHAAYALREAGFETVMVNCNPETVSTDYDTSDRLYFEPLTAEDVIALIRTEAKGGKVLGCIVQYGGQTPLKLSRALEEAGIPLLGTPADAIDRAEDRERFQAMLRKLGLRQPRNGIARSPAEAEKIAEEVGYPVVARPSYVLGGRAMEIVYDKPGLKRYLNEVLRAAGPEVSTGPVLLDHYLNDAIEADVDCICDGENVYVAGVMEHIEEAGIHSGDSACSLPPYTLSPALGTELRSQTEAMARELGIRGLMNVQYAIKDQEVFVLEVNPRASRTVPFVAKATGVPVAKIGARVMAGAKLTEFQLDGGAVSPHVAVKEAVFPFHRFANADTILGPEMRSTGEVMGLDSSFERAFAKSQLAAGVTLPLSGTVFLSVRDSDKAHVQPLARKLVAMGFTILATSGTAARLEDADIPVKRVNKVMQGRPNCVDSIRSGDVQMVINTSQGGQAAQDSYEIRRSALTMGVPHYTTIAGARAATYAIAVLKEDNLGVAPLQSYFKGKF

SEQ ID NO: 51153 - protein, 364 aa, Shewanella sp. ANA-3
MSYQIAVLAGDGIGPEVMAEARKVLKAVEARFGLNIEYSEYDVGGIAIDNHGCPLPEATLKGCEAADAILFGSVGGPKWEKLPPNEQPERGALLPLRGHFELFCNLRPAKLHDGLEHMSPLRSDISARGFDVLCVRELTGGIYFGKPKGRQGEGESEEAFDTMRYSRREIARIARIAFEAARGRRKKVTSVDKANVLACSVLWRQVVEEVAVDFPDVELEHIYIDNATMQLLRRPDEFDVMLCSNLFGDILSDEIAMLTGSMGLLSSASMNSTGFGLFEPAGGSAPDIAGKGIANPIAQILSAALMLRHSLKQEEAASAIERAVSKALNSGYLTGELLSSDQRHKAKSTVEMGNFIADAVKAGV

SEQ ID NO: 51154 - protein, 409 aa, Arabidopsis thaliana
MAAFLQTNISLNAIKIVPGKYSSLTDHQFRAPYRIRCAAASPGKKRYNIALLPGDGIGPEVISVAKNVLQKAGSLEGLEFDFKEMPVGGAALDLVGVPLPEETFTAAKLSDAILLGAIGGYKWDKNEKHLRPEMALFYLRRDLKVFANLRPATVLPQLVDASTLKKEVAEGVDMMIVRELTGGIYFGEPRGITINENGEEVGVSTEIYAAHEIDRIARVAFETARKRRGKLCSVDKANVLDASILWRKRVAALASEYPDVELSHMYVDNAAMQLIRDPKQFDTIVTNNIFGDILSDEASMITGSIGMLPSASLGESGPGLFEPIHGSAPDIAGQDKANPLATILSAAMLLKYGLGEEKAAKRIEDAVVDALNKGFRTGDIYSPGNKLVGCKEMGEEVLKSVESKVPATV

SEQ ID NO: 51155 - protein, 205 aa, Aspergillus ochraceus
DFAIQLAKTCVQCSDWLRHEVTVHLTNTHLIEEATIVASNRQLDPNHPVMKLLYPHWQKTLAVNAAARNTLIPHIIVELVGFQPSEAYKFIKHAYKTFDFKKRYVPTDLSQRGFPPEKLNQPKFHNYAYARCIYSMWHKIRSYVEDMLRLDYPQPGADQKVLRDDRIQAWSAEMRSPTGADLPSFPTISTFAELVDCVTMCIHTA

SEQ ID NO: 51156 - protein, 216 aa, Capsella bursa-pastoris
MNSFSAFSEMFGSDYESSVSSGGYYIPTLASSCPKKPAGRKKFRETRHPIYRGVRRRNSGKWVCEVREPNKKTRIWLGTFQTAEMAARAHDVAALALRGRSACLNFADSAWRLRIPESTCAKDIQKAAAEAALAFQDEMCDATTDHGFDMEETLVEAIYTAEQSENAFYMHDEAMFEMPSLLANMAEGMLLPLPSVQWNHNHEVDGDDDDVSLWSY

SEQ ID NO: 51157 - protein, 259 aa, Oryza sativa (japonica cultivar-group)
MTGFGSPCGACKFLRRKCVRGCVFAPYFCHEQGAAHFAAIHKVFGASNVSKLLAHLPLADRPEAAVTISYEAQARLRDPIYGCVAHIFALQQQVMTLQAQLASLKAAAAQGIHHQDVGATTKGGYMSAAATAADDQLGYGGYNQWCGSNGGGAPAASQPGAYSSNGGAGHGHDSITALLAAGSDYMQHSLYHAFEHSEGAGAVDDGHAAAAAFEAAAESSSCGMAASFAADESVWRSSSSGYQDCEDLQSVAYAYLNRS

SEQ ID NO: 51158 - protein, 464 aa, Paracoccus denitrificans
MSTYDLIVIGAGPGGYVCAIRAAQLGLKVACVEGRETLGGTCLNVGCIPSKALLHASHMLHETHENFEKMGLMGAKPKVDWGKMQGYKAETVGGNTKGIEFLFKKNKIDWLKGWASIEAPGKVKVGDTTHETKNIVIATGSEPASLKGVEVDNDAGIVVDSTGALSLPKIPKSMVVIGAGVIGLELGSAYARLGAEVTVVEFLDAITPGMDGEVQKQFQRILAKQGLKFVLGAAVSGVEVEKGKAEVKYKLRKDDSEHEIKAECVLVATGRRPYVAGLGLDKVGVALTDRGFVQIDDHWQTSVKGIYAIGDAVPGPMLAHKAENEGMAVAEVIAGKHGHVNYDVIPGVIYTTPEVASVGLTEEAAKESGRKIKVGKFPFMGNARAKALFQAEGFVKMIADAETDRVLGCHIIGPNAGEMIHEVCVAMEFGASAQDIALTCHAHPTCSEAVREAALACGDGAIHA

SEQ ID NO: 51159 - protein, 486 aa, Xylella fastidiosa Temecula1
MMHHNVHQSEILADPCDLQRAERWRQRDLRVLWHPCTQMREHPDTLPLVPIVRGEGVWLVGHDGRRYLDAVSSWWTNLFGHADPRISAAIAAQARTLEHVMLAGFSHEPAVRLAEALLRLAPRQDGREPLSKVFYADNGSAGVEVALKMAFHYFRNRGEEQRTRFIALHNGYHGETIGALAVGDIPLYRRVYAPLLTEVLFAPSPDAYLAEPGQSAAEYALQAAEALEALFKRYSGQICALILEPLLQCAGGMRMHHPVYLHRVRELCDAHGALLICDEIATGFGRTGTLFACEQACSAISTDTDDKDLGIMPDLLCLSKGLTGGFLPLAAVLTTQQLYEEFLDDSRERAFLHSHSYTGNPLACIAALTTLDIFENDCIIERNQVTAARMTQLAASLSGHPHVADVRQTGMVVAFELTRDGNKRTPFPPQARLGLHVYRAALARGVILRPLGDVVYWMPPYCVDEQQLHLLAETTRVAIDEAIACV

SEQ ID NO: 51160 - protein, 446 aa, Xylella fastidiosa Temecula1
MNFETLGLLPSLLRALSEQGYEIPTPIQQQAIPLALAGHDLLAAAQTGTGKTAAFGLPVLQRLMAASSNVGAGKPRALVLTPTRELATQVHDSLRGYAKYQRVSSAVIYGGVGMGNQLDVLRRGVDLLIACPGRLIDHIERRSVDLSGVGILVLDEADRMLDMGFLPSIKRILGKLPRQNRQTLLFSATFAEPIKQLALEFMCRPREVMVASHNTVAETITHRVHPVDVSRKRELLLYLLAQDSREQTLVFVRTKHGSDKLATFLEKYGIKTAAIHGNKTQGQRLRALNSFKAGRVTVLVATDIAARGIDIDQLPKVINYDLPMVAEDYVHRIGRTGRNGVQGEAISLVTQEDAKLLRQIVRLLDRDMDIRDVPDFEPQVPIRWGNSAPGKSKQPAGQHPPRKSQHRRAFGKASVHTTPALKKQSGVQHSNGSRNRDGMLPVHQRG

SEQ ID NO: 51161 - protein, 714 aa, Candida albicans SC5314
MGNYITVATCNLNQWALDFEGNRDRIFESIKEAKRQGAKLRVGPELEVCGYGCLDHFAENDLYRHSWEVYGEILSNPETHGILLDIGIPIIHKSIKYNCRIISYNGKILLIRPKIYLANDGNYREMRYFTGWNRPKYHEEYQLPKFISKITGQARVPFGDCIVQTLETRLGCETCEELFTPESPHIAMALDGVEIFTNSSGSHHELRKLDTRLKLITEATKKCGGIYLYANQKGCDGDRLYYDGCASIIVNGNVLAQASQFSLKDVEVISATVDLDDVRAYRNQKSASVQAVNQSEKFKVIYTDVELSPSDYVFDHSIIPSKPQPIKYHTPEEEIALGPACWLWDYLRRSKCGGYFLPLSGGIDSCATAVIVHSMCRLVVEAIPNDEQVLKDIQAITHDEGFVPKTPQDIAQRIFYTSFMGTENSSKETRSRSKELASKIGSYHVDLNMDNLVTSVVSLFEVATGKKPIFKIFGGSNTENLALQNIQARLRMVLSYLFAQLLPWTRGKNVPGLLVLGSANVDECLRGYLTKYDCSSADINPIGGISKTDLKRFIAWAEKNFDLPILHEFLTATPTAELEPITKDYVQSDEIDMGMTYDELSRFGTLRKVDKCGPLAMFIKLYHEWSQPPYNLSAKQIAEKVKRFWFFYAINRHKMTTMTPAYHAEQYSPDDNRFDLRPFLINPRFPHASKKIDELVEEIEKRQHEIDSSNKSVD

SEQ ID NO: 51162 - protein, 459 aa, Capsicum chinense
MANITNEFMGHDMLAPFTAGWQSDMEPLVIEKSEGSYVYDINGKKYLDTLSGLWCATLGGSETRLVEAANKQLNTLPFYHSFWNRTTKPSLDLAKELLNMFTANKMAKVFFTNSGSEANDTQVKMVWYYNNALGRPQKKKIIARAKAYHGSTYISAGLSGLPPMHQKFDLPPPFVLHTECPHYWAYHLPGETEEEFSTRLANNLESLILKEGPETVAAFIAEPVLGAAGVILPPATYFDKVQAILRKHDILFIADEVVCGFGRLGTMFGSDKYNIKPDLVSVGKALSSGYMPIAAVLVSQKISSVILSESNKIGAFCHGFTYSGHPVACAVALEALKIYKERNITEVVNKISQKFQEGLKAFADSPIIGEIRGTGLALSTEFVDNKSPNDPFPYEWAVGTYFGAQCAKYGMLVSSTGDHVNMAPPFILSLEELDELIRIYGKALKDTEKRVEELKSQKQ

SEQ ID NO: 51163 - protein, 417 aa, Francisella tularensis subsp. holarctica
MSKLSDSKSVFSKLSNKQIETIIQRYASPCFIIDENALLERARLFQQAILNQYQNSIAAYSVKTQSLNTIIQKFYEVGFIPEVVSSDEFEQIQKLQLCDKSIIFNGPYKNDASLIKALQLNAMINCDHFDEILRIAKIAKKLNITAKIGLRVADNKTPQNWSRFGFALTDQQSNSDIFTTIDKIQQIANIQLAGLHCHIGTNIRDISRFTAMAKNIAELAETILTKYKLTLEWIDLGGGLAGISPTLSDKRLQPYNPFDLELYAATIIVPLKEYLNKTNDKTKLIFELGRSLVDYSVALLTTIVGTREQNEDFQSLITDAGIHTIPTISTYRHPIYHLKTDSYHKKTLLLGPSCMQHDFLHDDIFLPKLEYGDKLLIDGVGAYNISRNNEFIHLKPSVILIDKNHQYQVLRVRQTHQ

SEQ ID NO: 51164 - protein, 260 aa, Oryza sativa (japonica cultivar-group)
MATASSINKRFSLAGATALVTGGSKGIGRAIVEELASFGATVHTCARNQAELSRCQEEWTAKGLAVTVSVCDVAVRADREALAGRVSAMFDGKLSILVNNAGTAYLKPAADLTPEETSRLMTTNFESCFHLSQLFYPLLKDSGRGSIVNISSVASVLAFHSLPIYSAAKGAMNQVTRNLACEWASDGIRVNSVAPGYIQTPLLTAFVAGNDFAQVEFNRLPLGRLGKPEDISSLVAFLCMPAASYITGQIICVDGGRMLS

SEQ ID NO: 51165 - protein, 359 aa, Arabidopsis thaliana
  misc_feature (319)..(319): Xaa can be any naturally occurring amino acid
MSAFTSKFADELIANAAYIGTPGKGILAADESTGTIGKRLASINVENVETNRRNLRELLFTAPGALPCLSGVILFEETLYQKSSDGKLFVDILKEGGVLPGIKVDKGTVELAGTDGETTTQGLDGLGDRCKKYYEAGARFAKWRAVLKIGENEPSEHSIHENAYGLARYAVICQENGLVPIVEPEILVDGSHDIQKCAAVTERVLAACYKALSDHHVLLEGTLLKPNMVTPGSDSPKVSPEVIAEHTVRALQRTVPAAVPAIVFLSGGQSEEEATRNLNAMNQLKTKKPWSLSFSFGRALQQSTLKTWAGKEENVKAAXQEALYVRCKANSEATLGTYKGDAKLGDGAAESLHVKDYKY

SEQ ID NO: 51166 - protein, 354 aa, Ustilago maydis 521
MSHAHGQQPNHSTTFKVGETYKVVDVVGEGAYGVVCSAIHVPSSSRVAIKKITPFDHSMFCLRTLREIKLLRHFNHENIISILDIVKPDDYDSFSEVYLIQELMETDMHRVIRTQELSDDHCQYFIYQTLRGLKALHSAQVLHRDLKPSNLLLNANCDLKICDFGLARSANQPEAEGTGFMTEYVATRWYRAPEIMLTFKEYTKAIDVWSVGCILAEMLAGKPLFPGRDYHHQLSLTLEILGTPSLDDFYAITSTRSRDYIRALPFRKRRNLSLMFPNANPLAVDLMEKCLTFSPRKRITVEEALAHPYLEPYHDPEDEPTAEPLDPSFFDFDYCKEQLSRSELKRLIYNEIMR

SEQ ID NO: 51167 - protein, 257 aa, Acinetobacter sp. ADP1
MNNVQWLDEVKFNEQGLIPAIAQHHQTGRILMVAWMNRESLALTAEKKEAVYYSRSRQKLWHKGEESGHFQTVYEIRLDCDGDVIILQIEQHGGIACHTGRESCFYRKLTPQGWEIVDAQLKDPTAIYGQSAKVEAHDHGHSNEQVDVLSYLGQLMQQRKQATADSSYIASLYQKGLNKILEKVGEENIETIIAAKDYAAEPTQEHLNDLIYETADMWFHSIVMLGYFDLTPQAVLDELARRQGLSGLVEKANRNQG

SEQ ID NO: 51168 - protein, 149 aa, Oryza sativa
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCVEFELEHGFVYREHGNTPGYYEGRYWTMWKLPLFGCTDSAQVLKEVEECKKEY

SEQ ID NO: 51169 - protein, 229 aa, Photobacterium sp. SKA34
MADIKQLFANNLSWSENIKNEDPDYFTELAKGQHPQYLWIGCSDSRVPAERLTGLVSGELFVHRNVANQVIHTDLNCLSVVQYAVDVLKVKHIIICGHYGCGGVTAALENPQLGLINNWLLHIRDLYLTHRNEFGALPRQEWDDKLSEINVASQVYNLGNSTIMQQAWERGQEVKIHGWIYGTSNGVLKDLGVTSTSRETLEVGYQSAMSSLLPPLEQSINDHISEKNN

SEQ ID NO: 51170 - protein, 492 aa, Arabidopsis thaliana
MLEVGTIWGFTSTTMASIMFLWPMYKQFVPYQLREYLENTIQKYLDKLFRRDSNFVYIRFPEYTGEGLSKSRAYDEIGNYLSSISTARAKRLKAKESENSKSLVLCLDDDEAVVVVFQGVNVVWSSTVVDKEDKHNSKEGRYLTLTFENHHRDIITNTYIDHVLREGKEIALKNRERKLYTNNDSSSYSSWWEGLWSNVPFNHHASFETLGMDLDKKEEIKKDLIKFTKGKDYYRKVAKPWKRGYLLFGPPGTGKSTMISAIANFLEYDVYDLELTTVKDNAELKKLMLDTKGKSIVVIEDIDCSLELTEHRKKKKEEDEDKEEKKEAENLKRVSGNNESNVTLSGLLNAIDGLWSACSDEKIIIFTTNFVDNLDPALIRRGRMDYHIEMSYCRFEAFKVLAKNYLENESHDLYGEIGRLLEEVDVSPADVAENLMPKSDEDDADICFRRLVKSLEEEKKKKIEKEARKNKKKAEDNVKQEKQNKVKGMVTK

SEQ ID NO: 51171 - protein, 207 aa, Oryza sativa (japonica cultivar-group)
MATWSNPSLIVAAIFLVISLTSATVANGGRSGGGRRLVRSYDEPCKKMTLYFHDILYDYSNSTANSTSAAAAKPTALATAVSPNGTFFGEVVVFDDPMTEGTRALPPPSSLRETAAARAQGVYLYDSKEVYDAWFAFSVVFNSTGRRGTLNLMGADLMSEKTRDISVVGGTGDFFMSRGVATLRTDAVEGLVYFRLQMDIKLYECYI

SEQ ID NO: 51172 - protein, 375 aa, Mesorhizobium loti MAFF303099
MKTRAAVAVAAGKPLEIMEVDLDGPREGEVLVEIKATGICHTDEFTLSGADPEGLFPAILGHEGAGVVVDVGKGVTSVKKGDHVIPLYTPECRQCPSCLSRKTNLCTAIRATQGQGLMPDGSSRFSIGKDKIFHYMGCSTFSNFTVLPEIALAKVNPDAPFDKICYIGCGVTTGIGAVINTAKVEQGATAVVFGLGGIGLNVIQGLKLAGADMIIGVDLNNDKKAWGERFGMTHFVNPKEIDGDIVPHLVNMTKRGADQIGGADYTFDCTGNTKVMRQALEASHRGWGKSVVIGVAGAGQEISTRPFQLVTGRTWMGTAFGGARGRTDVPRIVDWYMDGKIQIDPMITHLLKLEDINKGFDLMHEGKSIRSVVVY

SEQ ID NO: 51173 - protein, 270 aa, Arabidopsis thaliana
MYRFSNTVIGVLNLLTLLASIPIIGTALYKARSSTTCENFLQTPLLVIGFIILIVSLAGFIGACFNVAWALWVYLVVMIFLIATLMGLTLFGLVVTSQGGGVEVPGRIYKEYRLGDYHPWLRERVRDPEYWNSIRSCILSSKTCTKIESWTTLDYFQRDMTSVQSGCCKPPTACTYEAGVVDGGGDCFRWNNGVEMLCYECDACKAGVLEEIRLDWRKLSVVNILVLVLLIAVYAAGCCAFHNTRHAAHPYHPSDDNRMTRVRPRWDYYW

SEQ ID NO: 51174 - protein, 278 aa, Wallemia muriae
GRGNSIKHLRHENIISLLDVFISPGEDIYFITELLGTDLHRLLSSRPLERQFVQYFLYQMLRALKFVHPAGVVHRDLKPSNILINENCDLKICDFGLARLQDPQMTGYVSTRYYRAPEIMLTWQEYDSAVDIWSIGCIFAEMIDGRPIFPGKDHVHQLTVITELLGSPPEDVINTITSENTRRFVDALPKREKIPFQQRFPNANEEEIDLLEKMLDFNPKERITAADAIQHPYLAPYHDPSDEPVANERFDWSFNDADLPVDQWKVMMYSEILITSEF

SEQ ID NO: 51175 - protein, 278 aa, Wallemia sebi
GRGNSIKHLRHENIISLLDVFISPGEDIYFITELLGTDLHRLLSSRPLERQFVQYFLYQMLRALKFVHPAGVVHRDLKPSNILINENCDLKICDFGLARLQDPQMTGYVSTRYYRAPEIMLTWQEYDSAVDIWSVGCIFAEMIDGRPIFPGKDHVHQLTVITELLGSPPEDVINTITSENTRRFVDALPKREKIPFQQRFPNASEEEIDLLEKMLDFNPKERITAADAIQHPYLAPYHDPSDEPVANERFDWSFNDADLPVDQWKVMMYTEILITSEF

SEQ ID NO: 51176 - protein, 201 aa, Synechococcus sp. RS9916
MGSKLRLGVAGPVGSGKTALVEALCRRLRDQLQLAVVTNDIYTQEDAQFLIRAGALEPARIRGVETGGCPHTAIREDCSINRAAVAELEDQFPGLDLVLVESGGDNLAASFSPELVDLCIYVIDVAAGDKIPRKGGPGITRSDLLVINKIDLAPLVGADLAVMEHDTLAMRGERPWCFTNLQSGEGLERVADFVYRHLPNC

SEQ ID NO: 51177 - protein, 278 aa, Wallemia ichthyophaga
NSLVIKHLRHENIISLLDVFISPGEDIYFITELLGTDLHRLLSSRPLERQFVQYFLYQMLRALKFVHPAGVVHRDLKPSNILINENCDLKICDFGLARLQDPQMTGYVSTRYYKAPEIMLTWQEYDSAVDIWSVGCIFAEMIDGRPIFPGKDHVHQLTVITELLGSPPEDVINTITSENTRRFVDALPKRHKISFADRFPNANAEEIDLLEKMLDFNPKKRITAADALAHPYLAPYHDPEDEPTANERFDWSFNDADLPTDQWKVMMYCRDLNRIPAA

SEQ ID NO: 51178 - protein, 507 aa, delta proteobacterium MLMS-1
MTLYLTTPIFYVNAQPHLGHAYTGVVADTVARFARLDGEEVFFQTGTDEHGDKIVGAAKEAEVDLREYVDRISALFRQAWPLLEVEPDNFIRTTDPAHIEVVQHILQQVYQRGDIYFSDYAGLYCRGCERFLTEKELVDGKCPDHQVAPAEIREQNYFFKMSRYQQWLIDHIKEHPEFITPERYRNEVLSFLSEPLDDLCISRPVSRLEWGIPLPFDRNFVTYVWFDALINYISGIGYPDAPDFAPRWAAAEHLIAKDILKPHAIFWPTMLRAMGLPPYRRLHVHGYWNVNEAKMSKSIGNVVRPQDMVEQFGADTVRYFLLREMSFGLDASYSDEAVLARRNADLANDLGNLFSRSLTMVKNFADSRVPTPGTLTEEDQELADACLAMLDSYGRQMREFAFRQALEAVWEVIGRANRYIVTNAPWELAKDPDQQERLATVLNTLLETLRCIATTLGPVMPGAATKMAAALPLAAELTLAGQRHWPGLPPGAPVTVGENLFPRLKKG

SEQ ID NO: 51179 - protein, 264 aa, Mycobacterium sp. MCS
MTDLDRYGPWAVIAGGSEGVGAEFARSLAGDGFNLVLIARKPGPLDETAESCRELGADVRTLSLDLLDPEATSRIAEATADIEVGLLIYNAGASTCNDPFLDADLAEWRKIIDLNMSRMLELTQHFGRRMVAQSRGGIILVGSLSGYMGSVRHAVYSGVKAFGRMFAESLWLELREQGVDVLELVLGVTRTPAMERAGLRFDIPGFIVNDPADVAREGLEHLGDGPVHVAGGNAEQAARNSGPDRARIVLESHLAIQRLIGAQP

SEQ ID NO: 51180 - protein, 363 aa, Photorhabdus luminescens subsp. laumondii TTO1
MSNNYHIAVLPGDGIGPEVMAQAYKILDAIRKRFNICITTSEYDVGGIAIDRHGCSLPAKTVAGCEQADAILFGSVGGPKWEHLPPAEQPERGALLPLRKHFKLFSNLRPARLYAGLEVFCPLRNDIAAKGFDILCVRELTGGIYFGQPKGREGQGKYERAFDTEVYHRFEIERIARIAFESARKRSNKVTSIDKANVLQSSVLWREVVTEIAKAYPDVEINHMYIDNATMQLIKDPSQFDVMLCSNIFGDILSDECAMITGSMGMLPSASLNEKGFGLYEPAGGSAPDIAGKGIANPIAQILSAALLLRYSLGHNDAANAIEQAVNYALEQGYRTTDLAGNGKAISTDEMGSTIARYIAEGV

SEQ ID NO: 51181 - protein, 202 aa, Brucella melitensis 16M
MTAESTRKASIERSTKETSIAVSVDLDGVGKFDITTGVGFFDHMLEQLSRHSLIDMRVMAKGDLHIDDHHTVEDTGIALGQAVAKALGERRGIVRYASLDLAMDDTLTGAAVDVSGRAFLVWNVNFTTAKIGTFDTELVREFFQAFAMNAGITLHINNHYGANNHHIAESTFKAVARVLRAALETDPRQKDAIPSTKGSLKG

SEQ ID NO: 51182 - protein, 136 aa, Taraxacum officinale
KPSGGYRDSLDDKSKANLVQIKGRFSVTSEDLDLVKDIPLCTVPRRSPQETLLRKSASVGDWIFDSKQPTPREMSSSSSSSVHNSNLPASVLMPHLQNLFQQTSLQQDLILNLLNSLQTSEVPEASQNGKLPPLLR

SEQ ID NO: 51183 - protein, 445 aa, Picrophilus torridus DSM 9790
MELKRSITLTGAIMINLGAIIGAGIFVIIGIAAYRAGPGVIISIVLSGIIAILTGLSFSEIARHVAKEGGAYEYAKDTLSPSAGFVAGWMWTSGNIIAIAAVATSFGSYFDVLFNINVNPFFIAVICILAFMTLNILGIKNSTKTITGLVILNVLVLLVFIFSGITRFNSNNYVNFMPHGISGIITGTALIFFAFTGFSRVTTVSDEVINPEKTIPLAIIVSIIISSILYILIAVVLIGLKPYYAYQGSTSPLSLAVSSLHNRYIDIIVSIGGVTSTAGVTLTGILGTSRVLFAMGRDKELPEKLSYIDRFSTPVFAIILSSILGIIFLIFVSFGTIVEASNSSVLISYIIINVAAGFLYLKLRKRETKRLAGRPFFIIIPALGIATILLIISHINIGSLEITGVILLICIIYYIIRRIALNIEGRRVPRHSDVRLFGKSRSRTN

SEQ ID NO: 51184 - protein, 887 aa, Vibrio sp. Ex25
MSDMKHDVDALETQEWLQALESVVREEGLERAQFLLEQVLDKARLDGVDMPTGITTNYINTIPADQEPAYPGDTTLERRIRSIIRWNAIMIVLRASKKDLELGGHMASFQSSAAFYETCFNHFFRAPNEKDGGDLVYYQGHISPGIYSRAFVEGRLTEEQLDNFRQEVDGKGIPSYPHPKLMPEFWQFPTVSMGLGPIASIYQARFLKYLEGRGLKDTSEQRVYAFLGDGEMDEPESRGAISFAAREKLDNLCFLINCNLQRLDGPVMGNGKIIQELEGLFKGAGWNVVKVIWGNNWDSLLAKDTSGKLLQLMNETIDGDYQTFKSKDGAYVREHFFGKYPETAALVADMTDDEIFALKRGGHESSKLYAAYKNAAETKGRPTVILAKTVKGYGMGEAAEGKNIAHQVKKMDMTHVLHLRDRLGLQDILTDEAVKELPYLKLEEGSKEYEYLHARRKALHGYTPQRLPKFTQEFIVPELEEFKPLLEEQKRDISSTMAFVRALNVLLKNKNIGKNIVPIIADEARTFGMEGLFRQIGIYNPHGQTYTPEDRGVVSYYKEATSGQVLQEGINELGAMSSWVAAATSYSTNDLPMIPFYIYYSMFGFQRVGDMAWMAGDQQARGFLLGATAGRTTLNGEGLQHEDGHSHILAGTVPNCISYDPTFAYEVAVIMQDGIRRMYGPEQENVFYYLTLMNENYAMPAMPEGAEEGIRKGIYKLETYTGDKAKVQLMSSGTIMNEVRKAAQILSEDYGVASDVYSVTSFNELTRDGQDAERFNMLHPEAEAKVPYIQTVMGTEPAIAATDYMKNYAEQVRAYIPAESFKVLGTDGFGRSDSRENLRRHFEVNAGYVVVAALTELAKRGEVEKSVVAEAIKKFDIDTEKTNPLYA

SEQ ID NO: 51185 - protein, 475 aa, Vibrio sp. Ex25
MSKEIKAQVVVLGSGPAGYSAAFRCADLGLETVLVERYSTLGGVCLNVGCIPSKALLHVSKVIEEAKAMADHGVVFGEPQTDISKIRIWKEKVVNQLTGGLSGMAKMRNVTVVNGYGKFTGPNSILVEGEGEPTVVNFDNAIVAAGSRPIKLPFIPHEDPRIWDSTDALELKEVPEKLLIMGGGIIGLEMGTVYHSLGSKVEVVEMFDQVIPAADKDIVKVFTKRIKDKFKLMLETKVTAVEAKEDGIYVSMEGKKAPAEAERYDAVLVAIGRVPNGKLIDGEKAGLEIDERGFINVDKQMRTNVPHIFAIGDIVGQPMLAHKGVHEGHVAAEVISGKKHYFDPKVIPSIAYTEPEVAWVGKTEKEAKEEGIKYEVATFPWAASGRAIASDCTDGMTKLIFDKETHRVIGGAIVGTNGGELLGEIGLAIEMGCDAEDIALTIHAHPTLHESVGLAAEVFEGSITDLPNKKAVKKK

SEQ ID NO: 51186 - protein, 1748 aa, Oryza sativa (japonica cultivar-group)
MTSGGDSFVRMMSEDTDVEVLMPNEDLRTSTNGAKGSAKRSSNYTRKEDIQLCISWQSISSDPIIGNEQPGKAYWQRIAEHYHANRDFESDRNANSLEHHWGNIQKEVSKFQGCYNQIERHHPSGIPHQELVLEAEALYSSTAPKNRAFQFNHCWLKLRNSPKFQTLESHKRPRSRKSLTPIERAGEEDEGDDASKSTAPDLSQPSAKKRPIGRKQAKEKLKNGGEDGPYKEAMKDLLDAKEKEAKLKEERWKETKEIQERKLLFAERKLVWDQEQKIMFCDVSTLEPDVRTYVLAMRAQIAASKVAALNGGFDGSSGFGDIESPKYISSDEDINTIDTSMSPHIQHDGPITRARARQLNYQDECPRGRVDAHHKFAATIGDGPEDKDEEGASHSPRTKGIIQYFTRQVKQHTEGLDTDLQISTNTKLTGLETAVARIDTSLAALVRHFDALNAGGNGGGNDDDIDGEYIEDNLEDEYIADTEQDDRDAQDRRRLHNNRRGMGGRRRREVRNNDDAFSKIKFKIPPFDGKYDPDAFLSWEIAVDQKFAYHEFPENTRVRAATSEFTDFASVWWIEHGKKNPNNMPQTWDALKRVMRARFVPSYYARDLLNRLQQLRQGAKSVEEYYQELQMGLLRCNLEETEDTAMARFLGGLNREIYDIVDYKDYTNMTRLFHLACKAEREVQGRRASAKANFSAGKTSSWQTRTTPPAGRTASPSSTPTTSRAAPPPSSDKSVTKAAQPAPSASSMVSTGRMRDVQCHRCKGFGHVQRDCPSKRVLVVKNDGEYSSASDFDDDTLALLAADHADNEPPEEHIGAAFADHYESLIVQRVLSAQMEKAEQNQRHTLFQTKCVLKERCCRMIIDGGSCNNLASSEMVEKLALSTKPHPHPYYIQWLNNSGKVKVTKLVHINFAIGNYHDVVECDVVPMQACNILLGRPWQFDRDSMHHGRSNQYSFLYHDKKIVLHPMSSEDILRDDVAKAAKSKCESDKKAQSDGKKPETINLKPKCLLATKSDITELIASPSVAYALEYSDVFPKEVPPGLPPVRGIEHQIDLIPGASLPNRAPYRTNPEETKEIQRQVHELLDKGYVRESLSPCAVPVILVPKKDGSWRMCVDCRAINNITIRYRHPIPRLDDMLDELSGSIVFSKVDLRSGYHQIRMKLGDEWKTTFKTKFGLYEWLVMPFGLTNAPSTFMRLMNEVLRPFIGKFVVVYFDDILIYSKSMGEHFNHLRAVFNALRDARLFGNLEKCTFCTDRVSFLGYVVTPQGIEVDQAKVEAIQSWPTPKTVSQVRSFLGLAGFYRRFVQDFSTIAAPLNALTKKGVPFTWGTSQENAFHMLKDKLTHAPLLQLPDFNKTFELECDASGIGLGETWQHYLWPKEFVIHSDHESLKHIRIQGKLNRRHAKWVEFIESFPYVIKHKKGKENIIADALSRRYTLLTQLDYKIFGLETIKDQYAHDADFNDEAHGGSLMGHFGAKKTHDILASHFFWPQMRRDVGRAVLKKNIKMWEECLPHIEFAYNRSLHSTTKMCPFQIVYGLLPRAPIDLMPLPSSEKLNFDAKQRAELMLKLHETTKENIERMNAKYKFAGDKGRRELNFEPGDMVWLHLRKERFPDLRKSKLMPRADGPFKVLAKINENAYKIDLPADFRVSPTFNVADLKPYLGEEDELESRTTQMQEGEDDEDINTIDTSTSPHIQHDGPITRARTRQLNYQDECPCGRVDAHHKFAATIGDGVSVAKVQRLWTVVVGP

SEQ ID NO: 51187 - protein, 476 aa, Photobacterium sp. SKA34
MSKEIKAQVVVLGSGPAGYSAAFRCADLGLDTVLIEKFNTLGGVCLNVGCIPSKALLHVAKVIEEAKAMAEHGIVFGEPQTDINKVRLWKDKVITQLTGGLGGMAKMRKVNVVNGYGKFTGPNSIVVEGADGPTTVNFDNAIIAAGSRPIELPFIPHEDPRIWDSTDALELKEVPEKLLVMGGGIIGLEMGTVYHALGSQIDVVEMFDQVIPAADKDIVKVFTKRIAKKFNLMLETKVTAVEAKEDGIYVTMEGKKAPAEPVRYDAVLVAIGRVPNGKLIDAEKAGINVDERGFINVDKQMRTNVAHIHAIGDVVGQPMLAHKGVHEGHVAAEVISGKKHYFDPKVIPSIAYTEPEVAWVGKTEKEAKAEGINYEVATFPWAASGRAIASDCADGMTKMIFDKDTHRVIGGAIVGTNGGELLGEIGLAIEMGCDAEDIALTIHAHPTLHESVGLAAEVFEGSITDLPNAKAVKRKK

SEQ ID NO: 51188 - protein, 888 aa, Photobacterium sp. SKA34
MSEVMKSDVDVLETQDWLEALESVVREEGVERAQFLLEQVLEKARLDGVDMPTGVNTNYINTIPAAQEPAYPGDVTLERRIRSIIRWNAIMIVLRASKKDLDLGGHMASYQSASAFYEVCFNHFFRAPNDVDGGDLVYYQGHISPGIYSRAFVEGRLTEEQLDNFRQEVDGKGIPSYPHPKLMPEFWQFPTVSMGLGPISAIYQARFLKYLEGRGLKDTSAQRVYAFLGDGEMDEPESRGAISFAAREKLDNLCFLINCNLQRLDGPVMGNGKIIQELEGLFKGAGWNVVKVIWGNNWDSLLAKDTTGKLLQLMNETIDGDYQTFKSKDGAYVREHFFGKYPETAALVSDMTDEQIFELKRGGHDSSKLFAAFNNAKETSGKPTVILAKTVKGYGMGEAAEGKNIAHGVKKMDMTHVQYLRDRLGLQDLISEEELKALPYLKLEEGSAEYNYLHARRDALHGYTPKRSPKFTQEFKVPELDAFAPLLSEQKREISTTMAYVRALNILLKDKAIGKNIVPIICDEARTFGMEGLFRQVGIYNPDGQTYTPEDKGIVSFYKEATSGQVLQEGINELGSMASWVAAATSYSTNDLPMIPFYIYYSMFGFQRIGDMAWLAGDQQARGFLLGATAGRTTLNGEGLQHEDGHSHILANTVPNCISYDPTFAYELAVIMQDGIRRMYGENQENVYYYLTVMNENYAMPAMPEGAETGIRKGIYKLESHAGDKSKVQLMSSGTIMNEVRKAAQILSEDYGVASDVYSVTSFNELTRDGQDSERYNMLHPTAEKKVPYLTTAMGSEPAIAATDYMKNYAEQVRAFMPSESYKVLGTDGFGRSDSRANLRRHFEVNAGYVVVAALSELAKRGDIDNAVVVDAIAKFDIDADKINPLYA

SEQ ID NO: 51189 - protein, 166 aa, Arabidopsis thaliana
MAWDLFLWIVSFFVSLALVASVFYQVICLTDLEADYLNPFETSTRINRLVIPEFILQGSLCLLFLLTWHWVFFLVAVPVTVYHAMLYKERRYLIDVTEVFRGISFEKKLRYTKLGFYVFLFIMVVFSDQIATQEGLRPNPRELSSLITSQTPYDPIRTGSDHLTNR

SEQ ID NO: 51190 - protein, 316 aa, Mycobacterium sp. MCS
MTVPGLDPDAAARVASFGAIPPMRERGLDAVRRAVEATPHPDDTPEMADVDDLSIPGPAQPIPVRIYRPTDDDSAPVLVYFHGGGMVMGSNRSFEPLARALAAHSGATVVSVEYRLAPEAPTPAQFDDAYAATVWVAGNAEVIRVDASRLAVVGDSAGGSLAAAVALAARDRGGPSILCQVLLYPGLDRDMTCESIQLLADAPMLTHADIDYMHELADQGAAVPPDQYRFPALATDLTGLPPAIVVTAGCDPIRDWGERYATRLRDAGVQTTQTRYPGAYHGFLMRSDATARGRLAIAETGALLRAKFACPVPVSR

SEQ ID NO: 51191 - protein, 190 aa, Zea mays
SLGTCSFPLQLQDEVLVSDTDRLSMTHSNVKKLQRHFQADTYPWIQRLKQQELAIQRRLLRFVRIVEALENRGYRCPLTKEEADLYERLVAILKRLKGHNADLSKRVNTLVSTSRLLASSGGAGGSVYIPSSAKVDERSVTELLEALQQQTEAVAKLGNVLKRDIRDMEIIQSEGTDMAEDNVGRRAQKI

SEQ ID NO: 51192 - protein, 401 aa, Musa acuminata
MATKKSVGALTEADLKGKKVFVRVDLNVPLDENLKVTDDTRIRASVPTIKYLMERGARIILASHLGRPKGVTPKYSLKPVVPRLSELLGVNVAMANDCIGVEVEKLISALPDGGVLLLENVRFYKEEEKNDPEFAKKLASLADLYVNDAFGTAHRAHASTEGVTKYLKPSVAGFLMQKELDYLVGAVSNPKKPFAAIVGGSKVSTKIGVMESLLEKVDILILGGGMIFTFYKAQGYSVGSSLVEEDKLNLATSLLEKAKSKGVSLLLPTDVVVADKFAADAESKIVPASGIPDGWMGLDIGPDSIKSFSGTLESTKTIIWNGPMGVFEYEKFAVGTEAIAKKLADLSGSGVTTIIGGGDSVAAVEKVGLAAKMSHISTGGGASLELLEGKTLPGVLALEDA

SEQ ID NO: 51193 - protein, 224 aa, Brassica napus
  misc_feature (207)..(207): Xaa can be any naturally occurring amino acid
MELEDEKKGGEASGQTSDKEMGLSRKNSDSSLSPTEDDDEDEEKKPQLGPMIALKEQLEKDKDDESLRRWKEQLIGVVDLEDVGETPDPVVKILDLTVRSPNREDMVLTIPDDGLPNPKGPWFTIKEGSKYTLVFNFRVTNNIVSGLRYNNTVWKTGVKVDSTKAMLGTFSPQAEPYQHVMPEEITPSGIFARGSYSARTKFIDDDXKCYLEINYTFDIRKNWQ

SEQ ID NO: 51194 - protein, 143 aa, Zea mays
  misc_feature (11)..(11): Xaa can be any naturally occurring amino acid
MASLAAVSVKXPVAIKGLAGSSISGRKLAVARPSARSIRRPRAAAVVAKYGDKSVYFDLDDIGNTTGQWDLYGSDAPSPYNPLQSKFFETFAAPFTKRGLLLKFLLLGGGSLLAYVSASASPDLLPIKKGPQEPPQPGPRGKI

SEQ ID NO: 51195 - protein, 472 aa, Mycobacterium sp. MCS
MHDYTRKTLFIDGRWATPDGGDAIEVIDPATEQVIGSVPDGTTADVDAAVAAARRAFDPLITVAERRERLDRVIAAMEKRLPDIGETITREMGAPVRIAQGVQTKVPLAVARGIADVLATFEFEERMGNSLVVREPYGVVGAITPWNYPLYQVVAKVVPAIAAGCTVVLKPSNEAPLSVFEFVEALDEAGLPPGVVNLVSGSGRVVGERIAEHPDVDLVSFTGSTAVGQRVAELAAKTVKKVALELGGKSANVILEGGDLTTAVKVGVGNAYLNGGQTCMAWTRMLVPESRYGEALELVEAAAARYTVGDPLDPATRIGPSASASQFATVRGFIERAQRDGARLITGGAEKIRDIGYYVAPTVFADVDPDSELGQEEVFGPVLAVIPFRDEDDAVRIANGTPYGLAGAVWAGDLDHAIAFARRVQTGQLDLNGGAYNPVAPFGGYKKSGVGRELGRAGFEEFLQTKSLQLPA

SEQ ID NO: 51196 - protein, 426 aa, Synechococcus elongatus PCC 6301
MPLPDLLQQLEPLLAQAMNPANPGYLGHMDPVASTASVIGDAIAALLNNNLLSVEMSPSFSRLETAVLRELAQRFGLGDEAGGLLLSGGSLANLQAIALARNWALQVQETGLAGLTQRPILFASEAAHTSIQKAAMLLGLGSQAVIPIATDRRGRMQVAALTEAIASARRQGQRPFCLVATAGTTVTGSIDPLPELSAIARTEGLWFHVDASYGGAVIFSPRYAHKLQGIEQANSVTFNPQKWLCVAKTSASLLLRDWSLLTEHFRIAAPYMGEADDLINLGEVSVQGTRPADILKLWLTLQHFGDRGCAALVEHGLRLCRCFVAELRQRPQIQVATPPDLNILCFRLASDRLTAELQQFLLDRYFFLSLPRFRDRLWLKAVLVNPFTTPEHIRQLFGAIDAFCRDRQIQPDPQSQDNEITYSQSL

SEQ ID NO: 51197 - protein, 371 aa, Glycine max
NKLCIAKMIKTNSSQDWPEPIIRVQSLSERCTDSIPERYIKPLSERPSDDVVAVDDDDDVNIPIIDLAGLYGGDPDARASTLKQISEACNEWGFFQIVNHGVSPELMDMARETWRQFFHMPLEVKQHYANSPKTYEGYGSRLGIEKGAILDWSDYYYLHYLPLSLKDHNKWPTQPPSCREVCDEYGREVVKLCGRLMKVLSINLGLEEDVLEKAFGGEDVGACLRVNFYPKCPRPELTLGLSSHSDPGGMTLLLSDDQVPGLQVRKGNNWITVKPLPHAFIVNIGDRLEVLSNANYKSVEHRVLVNSNKERVSLAFFYNPKSDIPIEPVKELVKPDKPALYTPMTFDEYRLFIRLRGPCGKSHVESLKSPR

SEQ ID NO: 51198 - protein, 671 aa, Hypocrea jecorina
MARADQPQDKTKTEQRIGAYTVVRTLGEGSFGKVRLAIHNGTGQKVALKIITRKKLISRDMAGRVEREIEYLQLLRHPHIIKLYTVIKTPSEIIMVLEYAGGELFDYIVQNGRMKEAEARRFFQQMICAVEYCHRHKIVHRDLKPENLLLDENLNVKIADFGLSNIMTDGNFLKTSCGSPNYAAPEVIGGKLYAGSEVDVWSCGVILYVLLVGRLPFDDEHIPSLFAKIARGTYSMPQWMPPGAAALIKGMLVVNPVQRMTIDEIRADPWFNTDLPAYLQPPVEEFFNTGVDPNKAIKKSDIAPNAPEKVQEKLHNEVTEKISKTMGYGKDDVEEALQSDEPSAIKDAYMIVRENKLMLANNPDAGLTGDEGSPMMSISSTRSAISPGGASPRPYVTKIGILPSSLPAYHKDYMEREKNGTGHDPVTPAITINDELPVTRTEVEKEEAARRLNPHSRSALRLDESSKRPQGMTPITAPVKKPKPVRWQFGIRSRNAPWEALLCIHKALNKLGASHLRDEGYDEAQRRGVEDATSRDSSFANGAPLERDPNGHDKDPTKRYKLPADPWHIQVRWPSTSMQAGADRRDELGSKAGSPDSFVYTRGDAASRKDFVALHMDIQIYEMEQGVYLVDFKCSGYETQDGRLLEEKEVTSPFPFLDRAAKLIMQLAEAD

SEQ ID NO: 51199 - protein, 776 aa, Picrophilus torridus DSM 9790
MSEKSKKPVLWLNEVDKNDVSIAGGKAAGLGELMNIPDVHVPEGFVITAYAYKLFLDRNDIEKKINEIIEMLDVDDTRALQRASSEIKSLFVNSKMPDDLFDSIIEHYEDLVQREGAAYVAVRSSANLEDMANASFAGEQETYLNVKGNDQVIEKVKECFASLYSTRAIYYRKKENINERASLSVIIQKQIFSDVSGVMFTLDVSNGDRSKIVIESSYGLGEYIVSGQVTPDTFYVDKNTMKIVKSTVVSKSKMLKALEGGGTMEVSVPETLCEEPSLTDDEVIELAMAGKSIENHYNHPMDIEWAKYQGKLYIVQARFETVWSNREPEEPEKKDYENEVILKGLPASPGFITGRAHVILDVSNIDHFKNDEILITRMTAPDWVPVMKKSRAIITDDGGMTCHAAIVSRELGVPCIVGTSSFGKKATETIKTGDLITVDSRNGLVYRGKVGSETENEVSVEIPEIITGTKVMVNMGEPSIAERIAKLPCDGIGLMREEFIWAEIGEHPLSLLKNNRGDYFVDKLSEYMAQVCRAFNPRPVILRFSDFKTDEYSNLKGGSEFEPVEDNPLLGWRGASRYYDERYREAFKLELMAVRKAREEYRARNLWVMVPFTRTVEEMERIIRIMEDNGLYRGKDFKVFLMAEIPSNILLADKFNKYVDGYSIGSNDLTMLLLGSDRNNGKMSSMFDERDLAVKRAIKYLIKIAHKDKKIVSICGQAPSQYDELVDFLVRAGIDDISVNPDAVIHVKKLVASVEARIKLEAALGHVEIDDDWDLP

SEQ ID NO: 51200 - protein, 58 aa, Taraxacum officinale
EAANHPTDPEADEILSKKGVIILPDIFANSGGVTVSYFEWVQNIQGFMWDEEKVNTEL

SEQ ID NO: 51201 - protein, 57 aa, Taraxacum officinale
KIPYGMAVWSTGIATRPVVMDFMKQIGQANRRVLATDEWLRVDGTNSIYALGDCATI

SEQ ID NO: 51202 - protein, 199 aa, Anabaena variabilis ATCC 29413
MTHSTDIATLARWMAADFSNQAQAFENPPFYAHIRVCMRPLPWEVLSGVGFFVEQAYDYMLNDPYRLRVLKLMTVGDRIHIENYIVKQEENFYGASRDLNRLKTLTSESLEKLPGCNMIVEWTGNSFKGTVEPGKGCIVVRKGQKTYLDSEFEINEEKFISLDRGRDLETDAHIWGSVAGPFYFVRLRNFADEVKISAE

SEQ ID NO: 51203 - protein, 439 aa, Glycine max
LIVYVVIPVSYWGLNVYNANRFPIFSSHLFTAQGQKYNIPKIVDNHFELNVAEYEKQGTSRFGSSFALTYGFGFATIASTLTHVVCFYGREIMERYRASSKGKEDIHTKLMRRYKDIPSWWFHSLLLVTLLVSLALCIFLKDQVQMPWWGLLFAGVLAFGFTLPISIITATTNQTPGLNIITEYVFGLIYPGRPIANVCFKTYGYISMAQAVSFLSDFKLGHYCIHFVHTCIYVQFIGTMLAGTINIGVAWWLLNSIKNICHDDLLPEGSPWTCPGDRVFFDASVIWGLVGPKRIFGSQGNYSAMNWFFLGGAVGPIIVWLLHKAFPKQSWIPLINLPVLLGATGMMPPATPLNYNAWIFVGTIFNFFIFRYRKKWWQRYNYVLSAALDSGVAFMTVLLYFALGLENKSLNWWGNDGEHCPLAVCPTAKGVIVDGCPAN

SEQ ID NO: 51204 - protein, 396 aa, Frankia sp. CcI3
MSVRDMVEKDYYAALGVPKDASATDIKKAYRGLARELHPDKNPGDAKAEARFKEVSEAYDVLSDEGRRREYDEARALFAAGGRPGGGFGGPGRAGGYGGFGAPGTGYGSGPNLNLDDLLGGANGGLGGIFDNLFQRSSPGRGPRRGADIEAEVTIPFEKSLTGLEASVRLPGAATCTTCTGSGARPGTTPRTCPTCRGLGVVSRSQGGFALSEPCRDCLGKGTLIDHPCPDCRGTGRREREQRIRIPAGVSDGQRLRVRGRGIPGERGGPAGDLEVTVHVLRHPVFEREGSNLAITLPVTITEAALGASIRVPTLDGAPLTMKVPAGTSSGRRLRARGRGVPTAGGGNGDLIVTLEVTVPKPSDLSPRARTALLEFAQAHPEDPRAPLMERMEAGG

SEQ ID NO: 51205 - protein, 637 aa, Yarrowia lipolytica CLIB122
MNCPTRDPDPKGVPGFNQQPPQFDNELNNNKSFNKNNSGAESGKKLSAKGLANAMGDSDLAGGQNTRSASRPSRRSRPGHQNRGLSESSLGIQLRRSTSSLNNMSDNSSNSDDSNESTPLTASGSADPNKKPLSTWGNMMRILSKYGKFVGPGIMVSVAYMDPGNYSTAVSAGAMYQYKLLFIIFVSNLFAVFLQVLCVKLGSVTGLDLAENCRQHLPPWLSVSIYVMAEIAIIATDLAEVVGTAISLNILFGLPLFMGVLVTVVDVLIVLMAYRPNGPMRIVRYFEYGVAGLVAVVVVCFAFELAALDNLDIPLVLEGFLPSKELLETNGLYLSCGILGATVMPHSLYLGSGLVQPRLREYDEDNGYAIPEDARFGDDDEDLKYKPSIHAIKYAMKYSIAELVISLFTVAIFINSAILIVAGSTLNGSPDAYDADLFSIYDMLRTILSPAAGTVFALALLASGQSAGIVCTLSGQMVSEGFLRWSFKPWIRRLITRSIAIVPCLFVTLFVGRKGLADVLNASQVVLSLLLPMVSAPLIYFTGSKKIMKVAANAAVVHTRPRSNSNGTLTPADRSSNGYGMVEDEASTDDESICIPEYVDMSNSATTQFIAYLVFGMVSALNLFLIISIAMGADVPL

SEQ ID NO: 51206 - protein, 1056 aa, Magnaporthe grisea 70-15
MQPIQHAPDSAAEPEDPADIQDNQQQSFPLRNLAPNTRRPTRAELSPSAAPRAIAASTSIRGPLFDTTADGHSALDPSPQQPSLSPSFNTRQAFGAPSAGRQPSSSSSSSIASHVNAAASRQEKNDVPVQTDADIQSTTGLDDEATTNPMRKATPALRDSDEFRSAPSYGAVSLDHVKPPGANGHFSTGTTIDADELARIASQNSSRRRKSEDINVKSRRSGEELGASSVLGGLEGRFGVTEGGALDDPKHGDDSSSDGGISPEAIEDENNPPDNSPYPQVRASVSPVDNTSLSINTPRMWALSVLFSILGSSTNLFFSLRYPSVSITPVIALLLVHPLGLAWDYLLKRKGDPDEEFVEGVQVPGQWDETHERSKLQRLRLWLAQGRWNEKEHSCVYVSSNVSFGFAFATDVIVEQTQFYKQDASITYQLLLTLSTQILGYTFAGLTRRFLVRPSGMIWPSTLMSAAMFTTLHKEENKPANGWKISRWNFFYVVFISAFLFYFLPGLLFPALSYFNVITWFAPKNVVVANLFGVVSGLGLFPLTFDWAQVAYIGSPLLTPFWAAMNVVGGLVIVMWILAPLAYYSNWMYSSYMPILSAAVFDNTGKVYDVSKILTKDFIFDAEAYKNYSRVFLPITYVLSYGVQFAGLAALLTHTACWHGRDIWTQWTKSLQEARQEGKVATYQPVATSSDDYGRSNTNGAQARREASTSSAFFEDIMSREDVHNRLMKRYKDAPMHWYLMTFVSMTAIGIFVVEYYPIHLPWYGLLLALGICSILFIPIGIVMAVTNQHTSIYLICQLVCGAIFPGRPVANMVFVTYGYISSSQGIKFAADLKLGHYMKIPPRILFMVQMVATVVSSLTQIAVLNWMFRNIPGICTPQAINGFTCPIARVHFNGSILWGVVGPSEFFGRGATYRPLVWCFLVGAIAPIPLWYISKGKKDSIIRKINLPVLFGSLSWIPPATGLNFSVWALVCYLFNSLLKNRATAWWAKYSMTLSAALDSALASGIVVVFFTFIYPGVMDGFSWWGTEVYKQGCDWQACAYMSVPEGGRFGPDTW

SEQ ID NO: 51207 - protein, 289 aa, Brucella melitensis 16M
MDDKSMARGRKAFVTGFPIRHSRSPLIHGFWLKELGIDGSYEAVEVKPEDFSSFAASLAANGFAGGNVTIPHKEAAYAAAESLDEAARAIGAVNTLWLENGRLCGGNTDAYGFAANLDASAPGWDKADRALVLGAGGASRAVVHALLSRGVCHVSVVNRTLSRAEELAAHFGARVYAHGWDEAQALVSNAGLIVNTTALGMSGHGEGQDFPIDLTCAPKEAVATDIVYVPLRTAFLNKAEKAGLKTVDGLGMLLHQAVPGFERWFGQRPQVTQALREHILADMAKAGAL

SEQ ID NO: 51208 - protein, 295 aa, Staphylococcus epidermidis ATCC 12228
MSKIVGSDRVKRGMAEMQKGGVIMDVVNAEQAKIAEEAGAVAVMALERVPSDIRAAGGVARMANPKIVEEVMNAVSIPVMAKARIGHITEARVLESMGVDYIDESEVLTPADEEYHLRKDQFTVPFVCGCRNLGEAARRIGEGAAMLRTKGEPGTGNIVEAVRHMRRVNSEVSRLTVMNDDEIMTFAKDLGAPYEVLKQIKDNGRLPVVNFAAGGVATPQDAALMMELGADGVFVGSGIFKSEDPEKFAKAIVQATTHYQDYELIGKLASELGTAMKGLDINQISLEERMQERGW

SEQ ID NO: 51209 - protein, 310 aa, Mycobacterium sp. MCS
MTGALDPQIADLIEGLDRGFPPVQTMTGAQARATIRSRFIAPAEPEPVAAVEDRSVGEIPIRIYHPAGAGPLPVLVYAHGGGFVFCDLDSHDGLCRDIANQTAAIVVSVGYRLAPEHPWPAAAEDVYAVTRWVADNCTALGADPGRIAVGGDSAGGNLAAVTALIARDRGGPSLVAQLLVYPMVTPDFTTESYRLFGSGYYNPAEALRWYWDQYVPNDFDRTHPYVSPLHADLSGLPPAVVVIAGHDPLRDEGVRFGEALSAAGVPTVVRRFDGGIHGFMTMPSLELAQTARAQLCQDAVALLTGVPAGG

SEQ ID NO: 51210 - protein, 402 aa, Triticum aestivum
  misc_feature (153)..(153): Xaa can be any naturally occurring amino acid
  misc_feature (182)..(182): Xaa can be any naturally occurring amino acid
  misc_feature (361)..(361): Xaa can be any naturally occurring amino acid
  misc_feature (365)..(365): Xaa can be any naturally occurring amino acid
  misc_feature (368)..(368): Xaa can be any naturally occurring amino acid
  misc_feature (370)..(370): Xaa can be any naturally occurring amino acid
MGSVPEESVAAAAPEVVFRSRLPDIEIPNEQTLQSYCFAKMSEVGSRPCIIDGQTGASYTYAEVESLSRKAAAGLRRMGVGKGDVVMNLLRNCPEFAFSFLGAARLGAATTTANPFYTPHEIHRQADAAGAMLIVTEACAVDKVLEYAAGKGXCPWVTVDGRRDGCVEFSELIAGEELPEAXEAGIHPDDVVALPYSSGTTGLPKGVMLTHRSLITSVAQQVDGENPNLYFSKEDVLLCLLPLFHIYSLNSVLLAGLRAGSAMVIMRKFDIGALVELVRAHGITIAPFVPPIVVEIAKSPQVTAGDLASIRMVMSGAAPMGKDLQDAFMAKIPNAVLGQGYGMTEAGPVLAMCLAFAKEPXFKVXSGXCXTVGAQRGLKFVDPTPGLPSAQQPGEICIPRQQ

SEQ ID NO: 51211 - protein, 397 aa, Synechococcus elongatus PCC 6301
MAANLLEQLRGMTVVVADTGGIQSIATFTPRDATTNPSLITAAAQMPQYQSIIDDTLRQVRTELGAEAPVEAIVAEAIDELFVAFGLRILEIVPGRVSTEVDARLSYDTEATIAKARKLIGLYERAGIRRDRVLIKIASTWEGIRAAEVLEKEGIHCNLTLLFGFHQAVACAEAGVTLISPFVGRILDWYKKESGRDAFPGAEDPGVQSVTQIYNYYKKFGYATEVMGASFRNISEIIELAGCDLLTISPGLLEELRQTEALLERKLDPAIAESLELEQIHLDRDRFAELHQADRMANEKLDEGIRGFCKAIDTLEGLLKQRLAVLEGKAVFHHAAHEVFSVCDLDGDGFITREEWLGSDAVFDALDLNKDGKLNEEDLLAGLGATLQMAGRAVATV

SEQ ID NO: 51212 - protein, 325 aa, Nostoc punctiforme PCC 73102
MSNSRVLCLGEILFDCLADQLGLKLEEVKSWTPYPGGAPANVACALVKLGTTAGFIGAVGEDEPGNALVKLLQDVGVDTTGVQRHPTAPTRQVYVTRDLAGDRTFAGFGQYDTAEFADTRLQAKQLPDALFQEADFLVLGTLELAYPESEQAIYRALELAEHYDLKIVLDINWRPVFWDEPKIAHQKIPELFKRVDFLKLSKEEAEWLFETADPGAITYRLASIEGVLVTDGENGCTYCLGENEGKLPSFSIPVVDTTGAGDSFLAGFIHQLSHYGIHSLRDAETAKRIVTYASAVGALTTIKPGAIASQPTDAEVEAFLASHQL

SEQ ID NO: 51213 - protein, 440 aa, Synechococcus elongatus PCC 6301
MGVERDMDSLAALARDRGIRYFLIAFTDLFGVQRAKLVPASSIDLMATSGAGFAGFAAWLDLSPADADVLAIPDRDSLFQLPWQPEVAWMPADLYLNDQPLEQAPRWVLKRVLSVAESLGYRPKTGVECEFFLLDETGDAIADPRDRQAKPCYDQQSLMRRYDLITQISEAMEELGWGPYQSDHEDADGQFEMNWTYADALVTADRQAFFKYMVKTLAERQGLRATFMPKPFADLTGNGCHMHLSLWNREGTTNTFVDPVATAPLSTLGYQFIGGLLHSAASLCALTNPTINSYKRINAPATTSGATWSPNGISYSGNNRTHLIRIPDAGRFELRLADGAANPYLLPAAAIAAGLDGIQNKRDPGPRYDNDNYAQPLPPGTVPTLPEHLLDALRSLQESTVLTEGLGAAFTSAYLKLKHQEWRSFCAEITPWERATTLDC

SEQ ID NO: 51214 - protein, 323 aa, Synechococcus elongatus PCC 6301
MAPLLFRQILDLEAEAIQRAAERADAEAFANATQLIANCSGKVVLSGVGKSGIIARKITATLLSIGTLSAFLHPCDALHGDLGIVTEQDVVVMLSNSGETDELLAMLPHLQRRQVPIIAIVGNMRSTLARVAAAVLDASVDREACPLNLAPTASTTVALAIGDALAAQVMDYRSVTSEQFAFNHPAGRLGKRLTLKVVDVMHQGEELPLLPPEARFVEVVTAISRGGLGAVPIVEADGRLLGLITDGDLRRLLEQTSPAKLDQITAAEFMTPQPIAVEGDLLAYDALHLMENRPSQISVLPVVDAAQRCLGLVRIHDLIRSGI

SEQ ID NO: 51215 - protein, 258 aa, Glycine max
  misc_feature (40)..(40): Xaa can be any naturally occurring amino acid
  misc_feature (70)..(70): Xaa can be any naturally occurring amino acid
  misc_feature (89)..(89): Xaa can be any naturally occurring amino acid
MTMHRESWAFVFGVMGNIISFGVFLAPLPTFYQIYKKKSXEGFQSLPYVVALFSAMLWIYYAFVKREAAXLLLITINTFGIVVESIYLXIFLLYAPRKPRLTTIKLLLLLNVFGFGAMLLSTLYLSKGAKRLAIIGWICLVFNISVFAAPLFIIRRVIKTRSVEYMPFTLSMFLTINAVMWFFYGLLLRDYYVALPNTLGFVFGIIQMGMYLMYRNATPVALEEPVKAQELNGHIIDVGKMGTMEPNHAATAGAVGKV

SEQ ID NO: 51216 - protein, 503 aa, Ralstonia metallidurans CH34
MRDRTLVLSVLIVASCGLGYELIAGALSSYLLGDSILQFSSIIGCYLFAMGVGSWLSRYVKDEDVLTRFIDIEILVGLLGGISAALLFVVFAWLSAPFRTALYALVFVIGMLVGMEIPLVMRILNARRAQFSDLVSRVLTFDYLGALAVSLVFPLVLAPRLGLSRTGFLFGMLNVAVALFTLRIFRDEVSRTTLRTLRAGMVLAVLTVGFAGSNYLTHWAERGLFGDEIIHSETTPYQRLVITRWKDDLRLYINGNLQFSSRDEHRYHEALVHPVLQALPWARRVLVIGGGDGLALREILKYRNIEHVTLVDLDPAMTTLFSRSEPLRALNHGSLTDQRVTVVNADAAQWLEQNQDSFDAIIVDLPDPSNFGLGKLYSVPMYRLMSRHLAEKGYAVVQSTSPYYAPRSFWDIDATLREAGLHTWPYHTYVPSFGEWGYILVGKRNDYTPPTRYDVPMKFLDGDTTALMFRFPADMAPRQGEPNRLNEQTLVHDFERDWRNVIR

SEQ ID NO: 51217 - protein, 955 aa, Ustilago maydis 521
MASLATTPGGAKLIDGTALAKQVRARVAERIAELKQQHTSFQPHLCIMQVGAMSASTTYIRMKKLAAEECGMRYTHVQLPEGSSEAEIIKRVGELNEDISVDGILVQLPLGDHIDSDAERRVTEAISPEKDVDGFHALNIGHLSSKACNPLFFPCTPAGCIKLLENAGITNMAGLRAVVIGRSDIVGNPVASLLRSRDCTVTQVHSKTVDLQAHLSQADIVIAAMGKPHFIQGEWIKKGAVVIDVGTNFVDDATKKSGYRLVGDVDFDAASKVASAITPVPGGVGPMTVAMLMENVLISAERSLADGRALGIGRGVVRPNPIKPLAKVPSDIEVARSQTPKPITQVAREIGLISTELEPYGSVKAKVDLSVLKRLAHRRNGKYIVVAGITPTPLGEGKSTTTIGLAQALGAHLGKAAFACVRQPSQGPTFGIKGGAAGGGYSQVIPMEEFNLHLTGDNHAVQAANNLLAAAIDTRMFHEATQKDAALFDRLCPKKKGVRTFAPIMFRRLKKLGIDKTNPDDLTDEEKSRFARLDIDPETVTWRRVTDTNDRYLRDITVGQAATEKGITRRTGFDIAVASECMAVLALSRDLKDMRERLGRMVIGTSRAGDPVTADDIGVGGALAILMKDAIKPNLMQTLEGTPVFVHAGPFANIAHGNSSILADAIALKLAGIEQGEPIERTGYVITEAGFGADIGMEKFCNIKCRESGLVPDAAVIVATVRALKTHGGGPEVSPGKPLSEVYLEENLEILEKGCVNLAKHIANAKKFGLKVIVAINQFTTDTPAELELVRQKALEAGADDAVPANHWALGGEGAIDLAKSVINQLEGTASQFNFLYEPTLPITQKIEAIAKEMYGADGIELSEAANKQIQVIEKNGFGNLSICMAKTHLSLSADPTKKGAPSGFTIPVREVYASVGAGLLVVMCGAMSKMPGLNTRPGYYDMDLTEDGEVIGLS

SEQ ID NO: 51218 - protein, 150 aa, Escherichia coli O157:H7 EDL933
MNSSRMLFHVPLPRRSDAGGCMKKIIETQRAPGAIGPYVQGVDLGSMVFTSGQIPVCPQTGEIPADVQDQARLSLENVKAIVVAAGLSVGDIIKMTVFITDLNDFATINEVYKQFFDEHQATYPTRSCVQVARLPKDVKLEIEAIAVRSA

SEQ ID NO: 51219 - protein, 175 aa, Xanthomonas axonopodis pv. citri str. 306
MGVSGSGKTTIAQALAAHYRFRFLDADDYHSVAARAQMAAGQPLTDAMRLPWVELLSATLRDCVQAGESVVLAFSGLRSAHRQLLRNSGVPMRFVFLHAAPHVIAARLSTRAGHFMPATLLDSQLQTLELPLDEADVVSVDVDASVPAVVQDAIAQLAAIDPAAVQHTSRASERV

SEQ ID NO: 51220 - protein, 374 aa, Arabidopsis thaliana
MMTLQSSPMSVLTEDLVEDILSRVPATSLVRLRSTCKQWNAILNDRRFIKKHFDTAEKEYLDMLLRSLRVSSMSVNLHGLHDNIDPSIELKRELNLKGLLCNSGKVESFEVFHCNGLLLFTNTSTIVVWNPCTGQTKWIQTESANTRYHKYALGYENKNLCRDYKILRFLDDGTNFELEIYEFNSSSWRVLDSVEIDFELDIGSQGMSVKGNTYWIVIDDHEVDGELVNCFLTSFDFTRERFGPHVCLPFQTSWYSDVISLSSVREERLSVLFHEEDSLTMEIWVTNDITDTIVTSWSKFLRVDLYTHRFYNGVTFFIDEENKAAVFSEDVPDDSDDIHSIVYIIGQDRLRIVDLEDGPFWPQMFCYVPSLVQI

SEQ ID NO: 51221 - protein, 379 aa, Solanum tuberosum
MANQTGGASSTGSRDIRGVLIHGGQYVRYNVYGSLFEVSSKYVPPIRPIGRGAYGLVCAAVNSETREEVAIKKIGNAFDNRIDAKRTLREIKLLRHLDHENIVAIKDLIRPPKKEAFNDVYIVSELMDTDLHQIIRSEQPLTNDHCQYFMYQLLRGLKYVHSANVLHRDLKPSNLFLNANCDLKIGDFGLARTTSETDFMTEYVVTRWYRAPELLLNCSEYTGAIDVWSVGCILGEIMTREPLFPGKDYVQQLRLITELLGSPDDASLQFLRSDNARRYVRQLPQYPKQQFSARFPSMSPLAVDLLEKMLVFDPTRRITVDEALCHPFLSSLHDLNDEPICPSPFSLDFDEPSITEEKIKELIWRESVKFYPDFVDQNI

SEQ ID NO: 51222 - protein, 381 aa, Arabidopsis thaliana
MMSNLPLDLVEEILSRVPATSLKRLRSTCKSWNNCYKDQRFTEKHSVIAAKQFLVLMLKDCRVSSVSVNLNEIHNNIAAPSIELKGVVGPQMQISGIFHCDGLLLCTTKDDRLEVWNPCTGQTRRVQHSIHYKTNSEFVLGYVNNNSRHSYKILRYWNFYMSNYRVSEFEIYDFSSDSWRFIDEVNPYCLTEGEVSLKGNTYWLASDEKRDIDLILRFDFSIERYQRLNLPILKSDYETEALSVVREKQLSVLLKRNDTLEREIWVTTNDKIDHTTKNLLWIKFLAIDQRTCYHWSCVSFFIDEEKKMAVFCDGYIGGINETSRRMFYIIGEDKYYRELYVGDSPIRSHRPFVFNYVPSLVQIPQATVIPKRRRRKRKNRN

SEQ ID NO: 51223 - protein, 467 aa, Arabidopsis thaliana
MSRLLQTPFLPSVSLPTKTRSSVTGFRVKPRIIPIQAKIREIFMPALSSTMTEGKIVSWVKSEGDKLNKGESVVVVESDKADMDVETFYDGYLAAIMVEEGGVAPVGSAIALLAETEDEIADAKAKASGGGGGGDSKAPPASPPTAAVEAPVSVEKKVAAAPVSIKAVAASAVHPASEGGKRIVASPYAKKLAKELKVELAGLVGSGPMGRIVAKDVEAVAAGGGVQAAVAVKEVVAAPGVELGSVVPFTTMQGAVSRNMVESLGVPTFRVGYTISTDALDALYKKIKSKGVTMTALLAKATALALAKHPVVNSSCRDGNSFVYNSSINVAVAVAIDGGLITPVLQNADKVDIYSLSRKWKELVDKARAKQLQPQEYNTGTFTLSNLGMFGVDRFDAILPPGTGAIMAVGASQPSVVATKDGRIGMKNQMQVNVNVTADHRVIYGADLAQFLQTLASIIEDPKDLTF

SEQ ID NO: 51224 - protein, 372 aa, Solanum tuberosum
MDAENIENSVEIKGIPTRDGKYVEYNVVGNFFEVTSKYVPPIQPVGRGAYGIVCCATNSETKEEIAIKKIGSAFENRIDAKRTLREIKLLSHMDHENVIKIKDIVRPPDREEFNDVYIVYELMDTDLHQIIRSSQALTEDHCQYFLYQLLRGLKYVHSANVLHRDLKPSNLLLNANCDLKICDFGLARTTSEADFMTEYVVTRWYRAPELLLNCTEYTSAIDIWSVGCILMELIKREPLFPGRDYAQQLGLIIKLLGSPEESDLGFLRSDNARKYVKQLPQVPKQPFSEHFPDVSPLALDLAEKMLVFDPAKRITVEDALNHPFMISLHEINEEPVCTSPFNFDFEQASLSEEDIKELIWNEALKFDPDTTK

SEQ ID NO: 51225 - protein, 119 aa, Triticum aestivum
MSAMETDAPDAAPPPAADAGASSSSSRKPGKRFEIKKWNAVALWAWDIVVDNCAICRNHIMDLCIECQANQASATSEECTVAWGVCNHAFHFHCISRWLKTRQVCPLDNSEWEFQKYGH

SEQ ID NO: 51226 - protein, 275 aa, Triticum aestivum
AYLGDTIEQVCTKKQAGTGPEFPGYRRPTRPPGQVEVTDRGLLGNLLGKKKAEEDKEKQEELVTGMEKVSVEEPEVKKEEHEDGEKKETLFSKLHRSSSSSSSSSDEEEEEVIDDNGEVIKRKKKKGLKEKLKEKLPGHKDTEGEHVTGLPAPAAPASVQTHHDTDVVVEKIDGDVKTEAAPAVPEEEKKGFLEKIKEKLPGGHKKPEDAAPVPVTHAAPAPVHAPAPAAEEVSSPDAKEKKGLLGKIMDKLPGYHKTGEEDKAAAAAGEHKPSA

SEQ ID NO: 51227 - protein, 480 aa, Arabidopsis thaliana
MVRRQEEEKKAEKGMRLGKYELGRTLGEGNFGKVKFAKDTVSGHSFAVKIIDKSRIADLNFSLQIKREIRTLKMLKHPHIVRLHEVLASKTKINMVMELVTGGELFDRIVSNGKLTETDGRKMFQQLIDGISYCHSKGVFHRDLKLENVLLDAKGHIKITDFGLSALPQHFRDDGLLHTTCGSPNYVAPEVLANRGYDGAASDIWSCGVILYVILTGCLPFDDRNLAVLYQKICKGDPPIPRWLSPGARTMIKRMLDPNPVTRITVVGIKASEWFKLEYIPSIPDDDDEEEVDTDDDAFSIQELGSEEGKGSDSPTIINAFQLIGMSSFLDLSGFFEQENVSERRIRFTSNSSAKDLLEKIETAVTEMGFSVQKKHAKLRVKQEERNQKGQVGLSVTAEVFEIKPSLNVVELRKSYGDSCLYRQVCHYCHFLIRLKKHISKIKMFMFDIGVGAVVRETIKRRGHILAGARDSNLGVGVFG

SEQ ID NO: 51228 - protein, 413 aa, Arabidopsis thaliana
MAHYINIYGKRLFDIGLYLKTSVDLILQQQHVLMSQQKFTDISLCHREAPNPVKLEDIGQQSKTLGTAIHRKISEQKRVIESGSVASIVEHKRTNLSAIMATRANIPEQVRGAPLVDGLKIQNKNGAVKNRRALGDIGNLVSVPGVQGGKAQPPINRPITLSFRAQLLANAQLERKPINGDNKVPALGPKKEVAMSPKNKKVTYSYVLSAQSKAACGIVNKPKILDIDESDKDNHVAAVEYVDDMYSFYKEVEKESQPKMYMHIQTEMNEKMRAILIDWLLEVHIKFELNLETLYLTVNIIDRFLYVKAVPKRELQVVNDLVYVTDNAYSSRQILVMKKAILGNLEWYLTIPTQYVFLFCFIKASISDPEVSTFLLKVQFFCYYNVDWFSFVVQFLDLIVPKLRDNYSTHKMF

SEQ ID NO: 51229 - protein, 648 aa, Zea mays
MAPHLLAVAVAVAAIIATVSLLAPGAAAYPWPVCGTSNDFEPNSTYQANLNLLAAMLPNNVSASPVLYATAVVGAVPEQVWGMGLCRGDANASSCLACLTQAFQDLPNDCSYNKDAAIYYDPCTLHYSDVHTLADDDTGPTTMSYNINNNANVTSDPARFERLLAALVNATAEHAASNSTRRFATGEADADFDRQFPKVYALAQCTPDQTPAQCRKCLAGLISQSLDGFQNNIGGRVLWVNCTWRYETSPFFNGPAMVRLASSSSPPAAAAAGGGERKYSVFIVVLAVVLPTLAALNLVFCFCFWRRPAPQAKQSQPMYSTEAEDVETVDSMMIDVSALRAATGNFDESNKLGEGGFGAVYKGVLPDGDEIAVKRLSKSSTQGVEELKNELALVARLRHRNLVRLVGVCLEQQERLLVYEFVPNRSLDLVLFGTDTREPLSWEQRYRIINGIARGLQYLHEDSQLKVVHRDLKASNILLDVEMNPKISDFGLARIFGRDQTQAVTSRVVGTYGYLAPEYLMRGNYSVKSDAFSFGVMVLEIVTGRKNNGSSHKSGDLLTTVWEHWEAGTVAELVDPSLGGSFPEGDVLRCIHIGLLCVQGDPAARPVMSSVVTMLGTDTVTLQAPSKPGFFARKSGTSTTVSADDGSI

SEQ ID NO: 51230 - protein, 102 aa, Taraxacum officinale
RRVKFTPTYLQSAGLNLKHVYIRSLLASICFHAYQQVAYMILQRVSPVTHSVGNCVKRVVVIVSSIFFFRTPISLINSIGTGIALAGVFLYSQVKRIKPKTT

SEQ ID NO: 51231 - protein, 417 aa, Clostridium acetobutylicum ATCC 824
MRKINIFKGKHNPQRTAIDFFKYVGPGLLVTVGFIDPGNWASNVSAGSDYGYSLLWIVTLSTIMLIILQHNAAHLGIVTGDCLSEAVSKKFKPWLTNIILYSAIGAAISTAMAELLGGAIALNMLFRLPIKIGTLIMLSLVIWMLFSSSYKKLERWIIGFVSIIGLSFIFELLLVKVNWQVAAVSFVSPSFPKNSMPIIMSVLGAVVMPHNLFLHSEIIQSRQWNVEKEDVIKRQLRYEFLDTIISMIVGFAINSAMVLLAASTFFKMHVSVSELSQAQALLKPLLGGSASVVFALALLFSGIASTVTAGMAGGSIFAGIYKEPYDIEDSHTQIGVIITMVLAAVIIFFIKDPFKGLIYSQMILSIQLPITIFTQIYLTSSKKVMGKFSNSLLDRVLLGIIAVIVTALNIALLVSYF

SEQ ID NO: 51232 - protein, 127 aa, Clostridium tetani E88
MKKVINTELAPKAIGPYSQGIMIGDLAFLSGQIPVDPATGELATGDDPVVAQANQSLKNVQSILESQGMSFDNVIKTTVFIANMDDFAKINQVYAQYFKEPYPARSCVQVAKLPKEALVEIEVIAKK

SEQ ID NO: 51233 - protein, 502 aa, Ceratodon purpureus
  misc_feature (493)..(493): Xaa can be any naturally occurring amino acid
KSVGQSAESVPAGAVTAYLQRMQREGLIQNFGCMVAVEEPNFCVIAYSENASEFLDLIPQAVPSMGEMDVLGIGTDIRTLFTPSSSAALEKAAATQDISLLNPITVHCRRSGKPLYAIAHRIDIGIVIDFEAVKMIDVPVSAAAGALQSHKLAARAITRLQALPGGDIELLCDTIVEEVRELTGYDRVMAFKFHEDEHGEVVAEIRRMDLEPYMGLHYPATDIPQASRFLLMKNRVRLIADCYASPVKLIQDPDIRQPVSLAGSTLRAPHGCHAQYMGNMGSIASLVMAVIINDNEEYSRGAIQRGRKLWGLVVCQHTSPRTVPFPLRSVCEFLMQVFGMQLNLHVELAAQLREKHILRTQTLLCDMLLRDAPIGIVSQTPNIMDLVKCDGAALYYGKRVWLLGTTPTENQIKEIADWLLEHHNDSTGLSTDSLADANYPGAHLLGDAVCGMAAAKITAKDFLFLFRSHTATEVKWGGAKHDPDEKDDGRKMXPRSSFKAFL

SEQ ID NO: 51234 - protein, 472 aa, Arabidopsis thaliana
MTSNNKKKKTELCDLPKCLAPHILSWLPTKTAVTVSLLFMKGWWRSEMKNLSSLKFSFSDDQEEEHFVRFVDQVLRQRGNRKLDSFSLTLNDEIDGGFVTHLVDYPLDNGVEKLKLSIYDIKGNFQLSSRVFSQATLVTLKLATNRSLIWINGDDVAAAHLPCLKTLWLDDVLVADVKVFVRLLSRCPILEELVMIDMKWHNWEACFVVSASLRRLKIVWTDYVEMDEYDRCPQSVLFDTPNVLYLEYTDHIAGQYPLLKFSSLIEAKIRLEMIDEKEEEDEGQEVIVGDNATAFITGITSVRKLYLYANTIQVLHHYFDPPIPEFVYLTHLTIQSDKELGWDAIPELLSKCPHLETLVLEGLFHLATDVCGDVCPCRRNMEQAISYLVKSPVTHLEIYEGVVGKKRGEVTEDAARFGEQVRWFLMRMLHLQQVKIYGQTEDSVTALYDIATELRRLEGKASPNVQISVLQA

SEQ ID NO: 51235 - protein, 310 aa, Synechococcus elongatus PCC 6301
MASQVTAGSSGPVCFLTVGLRLPSARGQPVVSNFNQPRPPQRQRWVDSLLGVSLVALVVAAALPLLLPLVRLPGGSSARDRELAAAQATAFQTVLQRDPDNLSALRSLIGVYLQQQQLQAAIAPLQRLARLQPQQPAYRVLLAQTQAQLGDREAAAQTYRQILETAPTNLEALRGFTQLLLTQKQPTAAVDLLQKARQTDKITPADQVSIDLMLAQVYANQGQIDDAIALYDRSAQNNGRDFRPLLAKALLLKQQGDLQKATPIFQEAIAIAPAQYRDQIRQLSPASMPATPPTQPATKTPPTAPPPPPN

SEQ ID NO: 51236 - protein, 262 aa, Acinetobacter sp. ADP1
MTKQFAVIGNPIEQSRSPELHHAFAEKLGIELNYSKRLAPLDGFEANVKTFFDQGGLGINVTVPFKEQAFAMCHQLTERAKIAKAVNTLWIENGQLHGDNTDGQGLVDAIQALNWPLQGTRILILGAGGATRGVIYPLVQAGVTEIVIANRTQQRAEQLVQDLAGSVSEATLRVMTLDQLHGNFDLVINATSASLSGDALVLPETLQFKYAYEMAYGKPSSFLDQAKARGVPTTEGFGMLVGQAIEAFSIWHGVKPNLTDFL

SEQ ID NO: 51237 - protein, 863 aa, Oryza sativa (japonica cultivar-group) [sequence omitted]

SEQ ID NO: 51238 - protein, 256 aa, Hordeum vulgare subsp. vulgare
  misc_feature (2)..(2): Xaa can be any naturally occurring amino acid
  misc_feature (7)..(7): Xaa can be any naturally occurring amino acid
PXTLPVXMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLSIAVAKEASSGAPSLSPSSGSDSAGSTGTSEPSANGVFEGPVVMDSEMFRLDLFPEMDLGSYYMSLAEALLMDPPPTATIIHAYEDNGDGGADVRLWSYSVDM

SEQ ID NO: 51239 - protein, 641 aa, Clostridium tetani E88
MNKKTFYITTPIYYPSAKLHIGNTYTTVAADALARFKRLTGHDVLFLTGTDEHGQKIQRVAEEKGLKPKEYLDNMVDSIKELWKSMNISYDKFIRTTDDYHIESVQKIFKKLYEQGDIYKGEYEGWYCTPCESFWTESQLDDHNCPDCGRPVEKTKEEAYFFKMSKYADRLIKYIEENPHFIQPESRKNEMLNNFLKPGLQDLCISRTSFDWGIPVSFDNKHVIYVWIDALSNYITALGYNSDNQELLEKFWPANVHLVGKDILRFHTIYWPIMLMALGIELPKQVFGHGWLLVDGGKMSKSKGNVVDPVVLVDHFGEDTVRYYLLREIPFGSDGLFNNELFIKKINSDLANDLGNLLSRTVAMVQKYFNGIMPAPIAKEPIDDELINLALDTREKVENNMEKLKIPEVLDEIWTLIGRANKYIDETTPWILAKDEDKKDRLGTVLYNLSETLRIISVLISAFIPKTSERINEQLNVDLTTWDSIASFDGTKAGTKVVKGDALFPRIDVEAKIEELNSLKEKKEKKEIKPIKEEITIDDFDKIDLRVVKVISCEPVKGAKKLLKLKVDLGGEERQVISGIAQYYKPEELVGKSVVLVANLKPAKLRGELSQGMILAAATDDDSKLFTVSIPGELPTGSQVR

SEQ ID NO: 51240 - protein, 664 aa, Bacillus thuringiensis serovar konkukian str. 97-27
MTQNINQLAVNTIRTLSIDAINAANSGHPGLPMGAAPMAYALWANHLNHNPNHPKWFNRDRFVLSAGHGSSLLYSLLHLAGYDVSIDDLKNFRKLNSKTPGHPEFGHTSGVEATTGPLGQGIANAVGMAMAEAHLAAKFNKDGHSIIDHNTYALVGDGDLMEGVAYEAMSMAGHMKLGKLIVLYDSNEISLDGELNIAFSEDMQKRVESAHWQYVRVEDGNDVDAITKAIQLAKDNTDQPTLIEIRTVIGYGSPKVAGTNKAHGNPLGVEEATATKQVYGWHYEEDFFVPEEVTAHFNELKQKGIEKERGWNEQFNLYRESNPALADELEKAITGEVLIEAKDILSFDTEKTISTRVASGEAINHYVKSIPSIFGGSADLSHSTMTDIKGEAVYAVESYAGRNIYFGVREHAMGAAANGLALHGGVKPFVSTFFVFNDYLRPSIRLAALQKLPVTYVFTHDSIAVGEDGPTHEPIEHLAALRAIPGLTVIRPSDANETASAWAYALQQTDGPVVLVLSRQNLPVFHETKANIENLSKGAYVLTQTNENPDVILIATGSEVSLAASAKAKLEEDNVSVRIVAMPSWELFDRQSKEYKESVLPSSVTKRVSLEMGVSLGWERYVGQEGNILSIETFGASGTGAEVMNLFGFTTENVVQITKNVLNS

SEQ ID NO: 51241 - protein, 140 aa, Brassica napus
RPTRPKSARETINILQNHYPERLAVAFLYNPPRLFEAFWKIVKYFIDAKTFIKVKFVYPKNPESVELMSSFFDEENLPTEFGGKALLQYNHEEFSKQMNQDDVKTADFWGLVHSNNNHQQQSSSGFSGAEIAPEPIQTNT

SEQ ID NO: 51242 - protein, 305 aa, Medicago truncatula
MDPNNNHFNTQNFSNYPYNYENPNNYPNPNQFYNQRPQNIHQNVPNFGFSPNFNQSSSVPNFHPYYGSMMRYPSQTPPFNGYMPMGNENFPSVDANQYPEFSTQITPGGMAVADEVTPEDSTPKSKRSKEPAWNIQQNLVLISAWIKYGTSSVVGRNQRGETYWGKIAEYCNEYCSFDSPRDLVACRNRFNYMSKIINKWIGAYESAKRMQGSGWSEDDVLTKAQELFAGGKNIQFTLNEEWHALRDQPRYGSQMGGNVGSGSSGSKRSHEDSVGSSARPMGREAAKKKGKMKSKGETLEKVEKE

SEQ ID NO: 51243 - protein, 121 aa, Prunus dulcis
KICGDHDQKVEDTAVPVEKIYEEPTLEEEKEEEKKGFLEKIKGKLPGQQKKTEEIPASYDDQQCHDQHAEPAEPAVVGCEPKEKKGILEKIKEKIPGYHPKTEEEKEAIKEKEKEKETSSY

SEQ ID NO: 51244 - protein, 424 aa, Medicago truncatula
MAADVLPPEILAEIFSRLPVQSLLRFRSTSKSLKSLIDSHNFTNLYLKNNPLNRFIILRHKSDLYQLQVDDDDFSKSMIPLNHPLSTNIMLSLFSLKGNRTFPLIGSCNGLLALSDGEIVFKHPHGVLETTIWNPNTRKDRTIPFIPLPIPNIEDSDNPNRGGICVHGFGFDPFTADYKLLRITWLFARQNIFYDSHVSLFSLKTNSWKTIPSMPYALQYVQAMGVFVQNSLHWVMAKKLDGSYPWLIVAFNLTLEIFNEVPLPVELEGEEVNSNSNGSFKIRVAVLGGCLCMSVNYEATKIDVWVMKDYGSRDSWCKLFTLVKSCFNSPLDFLRPLCYSSDGGKVLLEANPNLDKTLRKLFWYDLKSEQVSYVEGIPNFDEAMFYVGSLVSPFFPVDTCKKENRTSKTKRRDDFLSRGFKLKL

SEQ ID NO: 51245 - protein, 427 aa, Clostridium perfringens str. 13
MNMDRNKEIFEESKKYMPGGVNSPVRSFGSVGINPPVIKSGKGAMIKDENGNEYIDFVLAWGPMILGHCDEDVVEAIKKTSEESIAFGASTKLELDLAKLLCETLDNVDMIRMVNSGTEATMSAVKLARGYTKKDKIIKFAGCYHGHFDGFLIEAGSGVLTEGIPGCLGVPEESIKNTLIGIYNDEKQVEELFEKYGNDIAGIIIEPVAGNMGVVKCDPKFMRKLRELCDKYGALLIFDEVMCGFRVAYKGAQTLFDVKPDLVTYAKIMGGGLPCGAYGGRREIMENLSPLGGVYQAGTMSGNPIVMSAGLATVKKLYENPSYYNHIEKIGSKLEKGVLEIAKKKGLGLVVNRQGGMITLFFTDLKEVKCYDDVKTCDGERFKRYFLHMLNKGFNIPPSQFEAMFLSVKHTEEHIDKFLEAFETFEG

SEQ ID NO: 51246 - protein, 153 aa, Mesorhizobium loti MAFF303099
MSALGFPKTPSDKKALEEGAVFSPRFDPAGLVTVVVTDAEDGMLLMVAHMNAQALALTLETGIAHYWSRSRNALWKKGETSGNFQHVVEMRTDCDQDALWLRVKVLGHDATCHTGRRSCFYRTVGLVDGKGTLVDDGSKPLFDAEFTYRKPSS

SEQ ID NO: 51247 - protein, 210 aa, Medicago truncatula
MKKLYHKATVHPSPPVITDQLSFLPATILTLAAALSPEDREVLAYLIYCSSTTAPPTFSNFSGNPRRSTVKTGDHATLFNCSCFRCYTSYWVRWDESPNRQLIHEIIDAFEEWLVQSGKGGKKGKGKKEKRNKKGFENKNKNKNSGELNRSVLNESTTELESVGESSNSSNNSGGSENSEKVVVVVADEEKGSVRKFVSFIGERIWGVWG

SEQ ID NO: 51248 - protein, 149 aa, Methanosarcina mazei
MEQTYVMVKPDGVQRGLVGEVISRIEKRGLKIVALRMNVIAEATAKEHYGEHAARPFFPSLIEFITSGPSVSMVVAGKDAIKVMRAINGATNPVDAAPGTIRGDFALDVGRNVVHASDSPEAAAREIAIHFKDSEIANYSRVDEVCLYE

SEQ ID NO: 51249 - protein, 116 aa, Solibacter usitatus Ellin6076
MQNALLTKYINKNKREKEFPEFRPGDTIKVHVKIKEGEKERLQAFEGVLIARNGMGMGESITVRKVSFGQGVERIFPVNAKVVDHIDVVRTGRVRRAKLYYLRALKGKAARLKERE

SEQ ID NO: 51250 - protein, 359 aa, Brucella melitensis 16M
MPSPVRVKKRATFVGQAAKKRLTLCAMEKLDITQKLADAEAAITSALRTIKTENAGLVALEEALNNGLSGPFVEAVERIVASRGRLVVTGVGKSGHIGSKLAATFASTGTSAFFVHSGEANHGDLGMIGLEDVILAISWSGETVELKGIVNYSQRFRIPLIAITSRQDSALGRAADVVLLLPKATEACPHGLAPTTSTMMQLAIGDALAIALLEARGFTPSDFKTFHPGGSLGASLIHIRDIMHRGNRLPLVKTGTPMPDAMKVLAQKSFGCVVVTDDAGELAGIVTDGDISRNLSRNLSALAVDDIMTRSPRTIDQNMLASAALKTINENHIGALIVVEANRPIGLVHFHDLLRIGAA

SEQ ID NO: 51251 - protein, 245 aa, Synechococcus elongatus PCC 6301
MTAEPAKGPQAEDWDDWVDADPESATALTPAAIAARTEPQGPLALVETAFMASAAALLWLVNYFFPLGPVLRVLFPLPIALLYRRWGLRSAWLGAIVASLLLFVLLGPTRGILFLLPPGCLGVLLGCCWQRRLSWGWSILLGGGLETIGFFFRLWVLSVLLGEDIWTYVTAQATGFLEWLTGVLGWLVQIPLSTVQAVAFAMITLSSLLYILVVHGVAWVLFRRLGTPIPAPPHWLQTVLDLDAD

SEQ ID NO: 51252 - protein, 1054 aa, Lactobacillus johnsonii NCC 533
MPLHNEINKVLVIGAGPSIVGEVTELDILAKQALTAFEESNVQVVLINPNPATVTTDPHPNVNVYLEPMTLPFVKRIVRMEKPDAIIPAFGGKPALKLTSELLESGILTQMNIELLTINSLALSLSAPHNFYSFLKANKIAVANQWLLEKEEDLRRVIEHAHFPLLLSKKQHYRPDSMISLENLAQLEQYFLDEESDDHFNWKDYRLTEDLSNWEELIFDIVRDNNGNFVFVGNIGSLEPVGINSSDSLLVTPILTRNNNQIQRLRNCCRKIANCLNLHGALSIHFAVKQSGEDFNFKVLSIKPRLTQSSLLSYRSGVYSIGYVTAKIALGYNLNEITDPQSGISAAVDPVQDACFVKLPYWSFTEAGYNHYTLNNKTTSGGQALGIGRNFESAFLKALQSTTGFSNNVKTFKKEYKKSEKELLQDLSKPNEIHLITLLAAIAKGINYHTLHQLLHIHLVFLQKFNHILILLKKLRNDELTADLMLKVKKNGFSNRLIAEITQRDEKSIADLCKKWSIKPSYIEIDGTAGLIHPNIQAVYSSYGIEDEIIPLSNSKKCLLLGLKPFQVSLTGEFDYMLYHAAKTLKEQGISPVIISNNPESVSAAYDVCDRIYFEPITLENILEVAWKENIKEVVTQFSGKQINEYRSSLLEHGLTILGQPNLKEILREDHADEVYQAGVNPVPALQCDNEESILAFVKRNGFPALIGGTSNGKKQKSAVVFDLPALQRYIAENSLEHMNVSKFIEGKKYEVTAISDGKNVTIPGIIEHFEQTGSHASDSIAVYRPQNLSTNDQRRLRDSAISIATKLNLRGPVNLHFLLANDQIYLLQIKSYSGHNVAFLTKALKKDITAITMKVLLGSTLSELDLPSDIWPSNDLIHVKMPVFSYLSYSSENTFDSKMKTSGSVMGRAKHLPTALFKGYEGSDLMISTYGTVFISVKDSEKHNAIKIAARFHQLGFKLLATEGTANVLAEEGITTGIIEKVQEGSNSLLEKIKQHRINLVINVTSLSDSASHDAIMIKDAALSTHIPVFSSLQSAQDVLIVLETLAMTTQPL

SEQ ID NO: 51253 - protein, 849 aa, Oryza sativa (japonica cultivar-group)
QVDGEEQGGVEGREDPWDGVHNILGHKEGVAFRLVSATARDPSNGGRGKLGKPAHLEELVVTMKSTAAGESVFRVAFEWDESQGIPGAVVVTNSNRSEFFLKTLTLDGVPGKGTVVFVANSWIYPADNYQYERVFFANDTYLPSKMPAPLIPYRQEELNILRGDGKIGPYKEHDRIYRYDYYNDLGQPDKGSKLVRPVLGGSQELPYPRRGRTGRAPTKTDPNTESRLPLLDLNIYVPRDERFGHLKMSDFLGYSLKAIVEGVLPIIRTYVDTTPKEFDSFQDIMELYEGGLKVANASALAEIKKRVPFELIKSLLPVAGDQVLKLPLPHVIKEDKFAWRTDEEFAREMLAGVNPVMIKRLTNFPAKSTLDPNVYGDHTSKITEAHIKHNMEGLTVQNALKGNRLFILDHHDHFMPFLDKINKLDGNFIYASRTILLLKDDGTLKPLAIELSLPHPDGQQHGAVSKVYTPANTGVESQIWQLAKAYASVNDSAWHQLISHWLNTHAVIEPFVIATNRQLSVVHPVHKLLSPHYRDTMNINALARQTLINADGIFEKTVFPGKYALEMSSVVYKNWKFTEQALPVDLVKRGVAVPDPTSPYNVRLLIKDYPYAVDGLVIWWAIERWVGEYLAIYYPNDGVLRGDEELQAWWKEVREVGHGDLKDQDWWPKMDTVQELTRACTIIIWIASALHAAVNFGQYPYAGFLPNRPTVSRRPMPEPGTEEYAKLERGGDEADLVFIHTITSQFQTILGISLIEILSKHSSDEVYLGQRDTPEWTSDAKALDAFKRFGSRLVDIENRIKDMNGNSALKNRNGPVKMPYMLLYPNTSDVTKEKGQGLTAMGIPNSISI

SEQ ID NO: 51254 - protein, 172 aa, Phaseolus vulgaris
MPNPKVFFDMTIGGQPAGRIVFELYADVTPRTAENFRALCTGEKGVGRSGKPVHFKGSIFHRVIPNFMCQGGDFTAGNGTGGESIYGAKFADENFVKKHTGPGILSMANAGPGTNGSQFFICTTKTEWLDGKHVVFGQVVEGLDVVKDIEKVGSGSGKTARPVAIADCGQLS

SEQ ID NO: 51255 - protein, 377 aa, Musa acuminata
MADDGYIQPLVCDNGTGMVKAGFAGDDAPRAVFPSIVGRPRHTGVMVGMGQKDAYVGDEAQSKRGILTLKYPIEHGIVSNWDDMEKIWNHTFCNELRVAPEEHPILLTEAPLNPKANREKMTQIMFESFNVPAMYVAIQAVLSLYASGRTTGIVLDSGDGVSHTVPIYEGYALPHAILRLDLAGRDLTDALMKILTERGYSFTTTAEREIVRDIKEKLAYVALDYEQELETAKTSSDVEKSFELPDGQVITIGAERFRCPEVLFQPSLIGMEAAGIHETTYNSIMKCDVDIRKDLYGNIVLSGGSTMFAGIADRMSKEITALAPSSTKIKVVAPPERKYSVWIGGSILASLSTFQQMWISRGEYEGSGPAIVHRKCF

SEQ ID NO: 51256 - protein, 474 aa, Oryza sativa (japonica cultivar-group)
MAIPTLVLLPTWGTGHLMSLLDAGKRLLGCRGGGGLSLTVLVMQPPRKEYASAVAATVRREEASGLDIRFRHLPAVEPPTGCAGVEEFVSRFVQLHADHVRAAVSGLDCPVAGLVIDFFCTTLLDVARELAVPAYVYFTSNAACLALLLRLPALEGEVTVEFEEMDGEVDIPGLPPVPPSSLPMPVMDKKNPNYTWFVYHGRRFMEANGIIVNTVREIERSVLAAIADGRVTPGVRAPVIHPVGPVISFTPPSDDPPHECVRWLDAQPPASVVFLCFGSMGSLAPPQVLEVAHGLERSGHRFLWVLRGAPAAGGSMNPTDADLDELLPEGFLERTTGRALVWPTWAPQKEILAHAAVGGFVTHGGWNSTLESLWFGVPMVPWPLYAEQHLNAFTLVAAMGVAVAMKVDRKRNNFVEASEVERAVRSLMGGSEEGRKAREKAAEMKAVCRKAVEEGGSSDMAVHKLYEELSTQTA

SEQ ID NO: 51257 - protein, 586 aa, Frankia sp. CcI3
MAGVAPRLLRPSQSRPRSRAGRSRAGTRSFSHTSLGRTARSATGNRIWENVSHRVTTLPAGASGEIGSGCRRRHEHRHNFIAPRTIRTAGSANGRAPLVTGSPDVALGVHLTFGSDPATSMVVSWLTRTAVPRPQVRFGPAAGGSTGSVTALTRSYTDALTNEVVFAHHAHLSGLLPAADYRYDVGHDGRWGLAHGSFRTAPRHRAAFSFTCFGDQGTDEPHDPYGSAASRHVITGVERLAPLFNLANGDLSYANQRTDPVRAWFDWFAMISASARFRPWMPCNGNHETERGNGALGLAAYQTYFALPQHDEEAYLAGLWYAFTVGGVRFVMLSAADVCYQDSGRVYLHGYSAGRQTSWLRQTLKQARADPGIDWIVVGMHHAAVSTAVEHNGADLGIREEWLPLFDTYEVDLVLCGHEHHYERTHPLRGVVPDSATRTPRPVPGATTPARKTADGAGAAAGDGAGDLLDTSAGTVHLLVGTGGSSSPSAHALFDPPACWVIVGVHEQDPGRWHRQSVRAREDAPWLAFRAPEHPYAFAAFEVDPGEPGGSTSIRVTVYDSSAPTPVPFDRFTLVRPRADAAVPTT

SEQ ID NO: 51258 - protein, 363 aa, Gibberella zeae PH-1
MTSTQSVKAVRYHGQQDIRLESVPVKPLDPTTVRIAPKFCGICGTDVHEYLGGNNLIPKPGTPHGITGETSPLTLGHEFSGIVEEVGSEVTRLQKGDRVCVQPIIYDNECRSCKRGLQNCCDQNGFIGLSGWGGGLAESTVVPQDAVKKLPDNVSLEVGALVEPLAVGWHATKISPYEDGNSAFVVGGGPIGLAVVQALVGRGCKNIMLTEVSSKRREFAKKFGAHHVFDPTKDDVVAMVKKLTGGLGADVGFDAAGSQHAIDVAFDCLKARAVLVNIAVWEKRAQLNMNQIVFRERSYVGCATYALGDFEEVIDALSNGKIKPEGMITKVIKMDKVVEEGFQTLINDKDNHVKILVDVSAGV

SEQ ID NO: 51259 - protein, 403 aa, Mesorhizobium loti MAFF303099
MEEFHKVRRLPPYVFEQVNRLKASARSRGADIIDLGMGNPDLPTPKAIVDKLCEVVRDPRTHRYSSSRGIPGLRRAQAAYYQRRFGVKLNPDTQVVATLGSKEGFANMAQAITAPGDVILCPNPTYPIHAFGFIMSGGVIRSLQVEPDDGFIPALERGVRHSIPKPLALILNYPSNPTALVASLDFYKDVVAFAKKNDIIILSDLAYSEIYFDGNPPPSVLQVPGAIDVCVEFTSMSKTFSMPGWRMGFAVGNERLISALTRVKSYLDYGAFTPIQVAAAHALNGDEIAEVREVYHKRRDVMVDSFGRAGWNIPAPAASMFAWAPIPEPFKHLGSLEFSKLLIEHADVAVAPGVGFGEHGDDFVRLALVENEHRIRQAARNIKRFLSTSAKQPNNVVPLSAHR

SEQ ID NO: 51260 - protein, 388 aa, Francisella tularensis subsp. tularensis SCHU S4
MNNNEIIHQTIEKQGSIVWKSVFGLLLLPLVALIAIPWYAKTYGFSTSDYVCLVVFYMLTGVGITMGYHRLWSHKTYKANKIVSYALLLFGTAALQNSVIQWSSDHRKHHKDVDDPIKDPYAATRGFWFSHFGWLLRHSSPDVQEIRGVNDLLKDKALVFQHNNYTVLAILSCFGLPALLGFIFGFLSGHTLTGAWHSALGFLLLGGLLRVILVHHATFCINSLAHTIGKRPYSTKNTARDSWITAIVTGGEGYHNYHHAFAGDYRNGIRWFDLDPSKWFIAGLAKIGWCYDLKTTPKHLIEIAKAKVKLEEALTKKNKTFHLGIEEKYAKLVANVKNMYNAKQEYLKAKKDNVLSKADIKEIKSKYKDLKIEFIQAKKKYNKASTIA

SEQ ID NO: 51261 - protein, 757 aa, Saccharomyces cerevisiae
MMRGFKQRLIKKTTGSSSSSSSKKKDKEKEKEKSSTTSSTSKKPASASSSSHGTTHSSASSTGSKSTTEKGKQSGSVPSQGKHHSSSTSKTKTASTPSSSSSSSRSSSVSRSGSSSTKKTSSRKGQEQSKQSQQPSQSQKQGSSSSSAAIMNPTPVLTVTKDDKSTSGEDHAHPTLLGAVSAVPSSPISNASGTAVSSDVENGNSNNNNMNINTSNTQDANHASSQSIDIPRSSHSFERLPTPTKLNPDTDLELIKTPQRHSSSRFEPSRYTPLTKLPNFNEVSPEERIPLFIAKVDQCNTMFDFNDPSFDIQGKEIKRSTLDELIEFLVTNRFTYTNEMYAHVVNMFKINLFRPIPPPVNPVGDIYDPDEDEPVNELAWPHMQAVYEFFLRFVESPDFNHQIAKQYIDQDFILKLLELFDSEDIRERDCLKTTLHRIYGKFLSLRSFIRRSMNNIFLQFIYETEKFNGVAELLEILGSIINGFALPLKEEHKVFLVRILIPLHKVRCLSLYHPQLAYCIVQFLEKDPLLTEEVVMGLLRYWPKINSTKEIMFLNEIEDIFEVIEPLEFIKVEVPLFVQLAKCISSPHFQVAEKVLSYWNNEYFLNLCIENAEVILPIIFPALYELTSQLELDTANGEDSISDPYMLVEQAINSGSWNRAIHAMAFKALKIFLETNPVLYENCNALYLSSVKETQQRKVQREENWSKLEEYVKNLRINNDKDQYTIKNPELRNSFNTASENNTLNEENENDCDSEIQ

SEQ ID NO: 51262 - protein, 556 aa, Magnaporthe grisea 70-15
MQCHTGRDEDTVGPEDEIPIVGPLRFHDLALVIASASTLVAVALSFFLIFMHATHYTKPNEQRHIIRILFMVPVYSLTSLLSLKYYWHAIYFTIISECYEAFAISAFFALMCHYIAPDLHEQKKFFRALTPIKPWVWPLDWFRACCCGQRGPWRTPANGLTWFNIIWIGIYHYIVIRVACTITAVVTHYFHKYCESSNSPVFAHIWVLVIVFIAVGIAMYCLIQFYVQLKEELAEHRPFLKICAIKLVVFLSFWQSAAISVATAQLEIVKPNEIIAYPDLKVGIPSLLLCIEMALFAILHIWAFPYSPYRVGAKPTFYPVADPSSGEAPKQSIQLPPSGGFLGLAALWDALNIWDFIKAFGRGIRWLFVGVKQRGKDGSYGGHRRKGSNSSSGDLDLGNLAKSRNGFTSTDHLPIANQFRRSKFMFGGGGNGSSNSTTGNGSRSLARPRLSPVPQSPVSVNRPTIIEEEDSGLIANAAEPGRRGVPEPPSPYRDHYPGDHANEDAMAAFPVPPGAYGNQPQSHDEMAYSQPFTPTRNFSRGGSQAPSGRVLLGQQR

SEQ ID NO: 51263 - protein, 383 aa, Triticum aestivum
MSPAIALQRAAAWLLRGAAGAGAPRAASSAALPGMGGALLSPARGLQGREAAGFLGIWGGPAAGGGGSWWFRCAASSVPRPGLLMEQLLVGGGRSFATGAAPEEVSFSPAAREADVSQPEKSVGTADKTMLGDRSLKLVSGVCYLPHPDKEETGGEDAHFIWDEQAIGIADGVGGWASYGIDAGQYARDIMSNAVTAIEEEPKDSIDLTRVLEKAHSSTTVPGSSTACIIAITNQGIQAINLGDSGFIVIRDGCTLCRSPVQQHDFNFSYQLQSGNSSDLPNAAQVFKVPVASGDVIVAGTDGLFDNLYNNDITAVVVHATRAGLEPQVTAQKIAALARQRAQDKNRPTPFSTAAQDAGYRYYGGKLDDITVVVSYVTAFGNS

SEQ ID NO: 51264 - protein, 125 aa, Glycine max
WLVPDDNAQVLKFDFICHLHHITGAVKKIRKPKPWKHPQPITKTQLTQLRDEFWDTAPHYGGRKEIWDALRAAAEADLTLAQVIVDSAGVIVQSSDLTVCYDERGAKYELPKYVLSEPTNLIRDS

SEQ ID NO: 51265 - protein, 339 aa, Pseudomonas putida KT2440
MNIVHKALTTSLLALSVSSAFAAGSPGVEQHTQAFLEALEKGGGKPLEQLTPNDARAVLTGAQASVKVDLSGVEVKERTIQANGQSIKLQVVRPTNVKGDLPVFMFFHGGGWVLGDFPTHQRLIRDLVVGSGAVAVYVDYTPSPEAHYPTAINQAYAATRWVAEHGKEIGVDGKRLAVAGNSVGGNMAAVVALKAKEAGTPALRFQLLLWPVTDASFETASYKQFAEGHFLTTGMMKWFWNNYTVDAKARAQIYASPLRASAEQLKGLPPALVQTAEFDVLRDEGEAYARKLNAAGVTVTSVRYNGMIHDYGLLNPLSQVPAVKAALRQAGNELKVHLQ

SEQ ID NO: 51266 - protein, 317 aa, Glycine max
MPATAGRVRMPANNRVHSSAALQTHGIWQSAIGYDPYAPNKEDKKDSSQNLPNAEPDAENAYASFQGLLQLAKITNAEVDVSRGACKKCGRVGHLKFQCKNYVKIKDENEKDPEAMQPVGLVGLDKKLKADKVDKRSNVESSEEEEDSESSDSEIDSEMERIIAERSGKKISGKRGSSRKKGDLDDDGSDKHSGKRRKRGRSKKRSAKREVSDSDDSGEERRRRKRRREPRRKRDNSSDEDDEYKRRHRKSRKEKRRRRSRLSDPDSSEDFIRRHKRKNKRASSSSDTDSSGYNDSRKGRDVNKSGKRRSRHHGDDE

SEQ ID NO: 51267 - protein, 164 aa, Glycine max
  misc_feature (84)..(84): Xaa can be any naturally occurring amino acid
  misc_feature (115)..(115): Xaa can be any naturally occurring amino acid
  misc_feature (147)..(147): Xaa can be any naturally occurring amino acid
MSAAVCSTTPHLEEELKNKATYNKKKNNVGGESDQPPYNDGANSDVAEETEPEEDDDSKLESNKDLDLGPQFTLKEQLEKDRNXKDPEVKILSLIITSPDEPDLTLPIPCTTDAXKRSFMLKEGSKWQMKCTLTVCTNIGSGLKYTXVGWKTGVRVDSRKKMLG

SEQ ID NO: 51268 - protein, 67 aa, Triticum aestivum
MGCAGSTQSQGEGSVKKIRKPKPWKHTQPITKAELMKLREEFWDTAPHYGGRKEIWDALRAAAEADI

SEQ ID NO: 51269 - protein, 272 aa, Triticum aestivum
MAAAEPSGSSQPGAPGRWSLHGKTALVTGGTRGIGRAVVEELAALGAAVHTCSRKEAELGERLKEWEARGFRVTTSVCDLSVREQRERLIGDVAERFGGKLNILVNNVGTNIRKPTTEFSAEDYSFLMATNLESAYHLCQLAHPLLKASGLGSIVFISSVCGLVAVFSGTLYAMTKGAINQLTKNLACEWAKDGIRTNSVAPWYITTSLTEGLLANKEFEASVVSRTPLGRVGEPGEVSSLVAFLCMPGSTYITGQTISVDGGMTVNGLYPA

SEQ ID NO: 51270 - protein, 557 aa, Lactobacillus johnsonii NCC 533
MKSDIEIAQDTKELPITEIAKKVDLQPDEIELYGNDKAKISWKGINRIKQGKKLGKLILVTSISPTPAGEGKSTITIGLGDAISNQLHKNTLIALREPSMGPVFGLKGGATGGGYAQIITMEDINLHFTGDMHALTSAIDTLAALVDNYIYQDNSLELDPNRILLKRGIDVNDRTLRKITIGQGSRFNGIEHEASFAITVANELMAILCLATDIDDLKKRIGNMLVGFSVKDEPVYVKDLGFEGAIAALLSTALKPNLVQTLEHTPAIVHGGPFANIAHGANSVIATNTALHLSDYVLTEAGFGADLGGQKFMDFVSNHLDKRPDAVVVVATVRALKYQAEETTDHLDEENIPALEKGFENLKRHMENMAHYGVPVIVLINKFASDTEQELSKLKELVKADGFECEVVSYHDEGSKGGIKAAEKVVELTNKASDFTSVYEPTDSVEEKISKIAHNIYHAKDIEYSDKAKDQLAEIKKMGKDNLPVIMAKTQYSFTDKKSILGAPKDFTLHVKNLALKNGAGFIVVATGSILDMPGLPKYPAALDIDVDNNGKISGLF

SEQ ID NO: 51271 - protein, 287 aa, Hordeum vulgare subsp. vulgare
MSPTLSLKLKKSSHTPQSSVSSSTKLRLFKKEAACQSPSTLPVAMDMGLEVSSPSPFSSSVSSSPEHTAKRPAGRTKFRETRHPVYRGVRRRGNTERWVCEVRVPGKRGARLWLGTYATAEVAARANDAAMLALGGRSAACLNFADSAWLLAVPSALSDLADVRRAAVEAVADFQRREAADGSLAIAVPKEASSGAPSLSPSSGSDSAGSTGTSEPSPNGVFEGPVVMDSEMFRLDLFPEMDLGSYYMSLAEALLMDPPPTATIIHAYEDNGDGGADVRLWSYSVDM

SEQ ID NO: 51272 - protein, 106 aa, Taraxacum officinale
EAIKQVATEAQNWHYRAKYNESMVNILKTNLHQALAQGKDNQIKEGFGDTDDAVSSYMDPNVKSSSTACKVCRVKEVSVLVMPCRHLSLCKECDGFASVCPVCEVV

SEQ ID NO: 51273 - protein, 245 aa, Oryza sativa (indica cultivar-group)
MASSSSWWVVMLLMVVAAAGWGGVAAATAAEAAHEVLRAHGLPRGLLPAGIADFRHDEGSGRFEAALGESCTAQFEVGLRYNATVAGVISYGRIASLSGVSAQDLFLWFPVRGIRVDVPSSGVIYFDVGVVFKHFPLAVFEAPPPCTPDPLLLLTQLVTNELVGGKGQDSMFRIALGSELVKLHRNSERQRGGEDQASDCVFCITGEGEMGGLEEQRHVLGGKLMMGKRQAYQLQRLPAAAGLVE

SEQ ID NO: 51274 - protein, 418 aa, Frankia sp. CcI3
MILGSGSAWDTACVQLANAARHLGLDDGMHDLLRTPRRAITVSVPLQRDDGQLTVLTGYRVQHNLARGPGKGGIRFHPTTDLDEVKALAMWMTWKCALMGIPYGGAKGGIAVEPAMLSLPERERLTRRYAAELVPLIGPEKDIPAPDVGTDEQTMAWIMDTYSAHTGYTTTGVVTGKPLSIGGSAGRAGATSLGVQLSVFAALRETGRDPHAMTIAVQGFGKVGALAAQYLHDAGCTVVAVSDVKGGIYNPQGLNPAALIRHLAGGAETVVGYPGTDTITNDELLELDVDVLVPAALEGVITVENVDRVRAPIIVEGANGPVTAEADQVLDDRGVLVVPDILANGGGVAVSYFEWVQDIQAYFWSEDEVSDRLRALMDRAYREVSLLATTQKISMRNAAHVIGVGRVADAHRTRGLYP

SEQ ID NO: 51275 - protein, 115 aa, Francisella tularensis subsp. tularensis SCHU S4
MKNKFVELVEKSQLRTDLPEFNPGDSITVNLWIKEGDKQRIQAFKGFVLRKRNRGLHSAFTVRKMSSGMGVERTFQTHSPLIDSIIVEKRADVRRAKLYYMRGLTGRAARIKEKV

SEQ ID NO: 51276 - protein, 283 aa, Francisella tularensis subsp. tularensis SCHU S4
MVMNILSVDYYADDAAELFTRSLKETGFAVLRTHPIDWNLIQTVYKEWQEFLKSGAADKYIFDVENQDGYFPIDVSEVAKGETVKDIKHFYHLYFPNGRYPTEVSSAAREMFEKMIRLGETLLQWIDDYMDPAVASKLPQRLRDTASYENTLLRILHYPAIQGDEEPGAVRAAAHEDINLITLLPIASSPGLQVLSPFNNQWYDVPCDSESIIVNIGDMLQEMTNGEYIATKHRVVKPQDEKENLDRISTPCFIHPKSDVYLSDKYPRAEIFLNERLKELGLK

SEQ ID NO: 51277 - protein, 176 aa, Triticum aestivum
  misc_feature (19)..(19): Xaa can be any naturally occurring amino acid
MPPTVMALSATSVGPFQGXLKSTPGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 51278 - protein, 461 aa, Zea mays
MAVTHEQAINHSWDQLRQRHRALPPQMQQYLRHGKTERKMKRRGKGEKICNISPATPLEEKLSICAPPERVAPPAPTAIPRGAAPESAPSALRSPPSALPDVMIRPHLPKDPAFPRTNGSLDGGARGLGEIEEVGAAATVAVEQSPSQSSSPSASSPAAAMSSCGQYMLHRVRKLDTLAGVAIKYGVEVADIKRLNGLSTDLQMFAHKTLRIPLPGRHPPSSYQQNGSYESDDRECTPRRIHDDILESILKTPNSKVSPAMSLLQGYYGLEPPPKRDQTSEGTEMAVHSKGKSAFLDVEPWLEPPNSDPFPLQNRKNRSLMIGSFLDGGTDENGDSERFIRRRQKADGELLPREENGGDFLASVGKGLALRPKSSNRPDMNKSQQNLFAMAEPLFGNGLQTVRKSSSTPEFQEPETNTSSSIWSASKWSINTDAFALPLPIPRFDNIPKPIAAWRNKPARD

SEQ ID NO: 51279 - protein, 338 aa, Arabidopsis thaliana
MQIGQALAAAKEGESQMIVMMGNNLSLTSIILNGDPSIEHKGKLTCLDEQVKISQFYHCEGLLLCILKDDSRFVVCNPYLEQTRWIEPRYSHRPYGMDRFSYALGYVNTDSCRSYKLLRFIDYYYNAPEKQFFWYEVYDFDSDLWTTLDVTPHWRIAFCNTGVPFKGNTYWCAAERNVDVDEVLANRLICFDFTSERFGPLLPLPFSEEKLAVLLQHDESNPYELDLWITTKIETEEVLWSKFLRVETAGFNSYVPFISGSFFIDEEKKVAFGFDERNRQRVIVIGEAGYLRGLDLVGDFGDQSCKPDLCSYVPSLVQIKQPEGGEREEESEYGEASI

SEQ ID NO: 51280 - protein, 451 aa, Pseudomonas putida KT2440
MAFDFDLFVIGAGSGGVRAARFAAGFGAKVAVAESRYLGGTCVNVGCVPKKLLVYGAHVADELEQAAGFGWTLEEGHFDWGTLIANKNREIERLNGIYRNLLVNSGVTLLQGHARLTGANEVEVDGQRYTAEHILIATGGWPQVPDIPGKELAITSNEAFYLKDLPRRVLVVGGGYIAVEFAGIFQGLGADTTLLYRGDLFLRGFDGSVRTHLKQELEKRGLDLQFNADIQRIDKLEDGRLKATLKDGRELVADCVFYATGRRPMLDNLGLENTGVELDERGYIRVDEQYQTTAPSILAIGDVIGRVQLTPVALAEGMAVARRLFKPEQYRPVDYQNIPTAVFSQPPIGTVGLTEEQALEAGHKVQVFESRFRAMKLTLTDIQEKTLMKLVVDAETDKVLGCHMVGPDAGEIIQGLGIALKAGATKQQFDETIGVHPTAAEEFVTMRTVTR

SEQ ID NO: 51281 - protein, 218 aa, Bacillus simplex
LVVDGHKVKVLAERDPAQLAWGELGVEVVVESTGRFTKRADAAKHLEAGAKKVIISAPASDEDITIVMGVNEDKYDAANHHVISNASCTTNCLAPFAKVLHEQFGIKRGMMTTVHSYTNDQQILDLPHKDYRRARAAAENIIPTTTGAAKAVALVLPELKGKLNGMAMRVPTPNVSVVDLVAELEKDTTVEEVNAAFKKASEGELKGILEYSELPLVS

SEQ ID NO: 51282 - protein, 217 aa, Bacillus simplex
LVVDGHKVKVLAERDPAQLAWGELGVEVVVESTGRFTKRADAAKHLEAGAKKVIISAPASDEDITIVMGVNEDKYDAANHHVISNASCTTNCLAPFAKVLHEQFGIKRGMMTTVHSYTNDQQILDLPHKDYRRARAAAENIIPTTTGAAKAVALVLPELKGKLNGMAMRVPTPNVSVVDLVAELEKDTTVEEVNAAFKKASEGELKGILEYSELPLD

SEQ ID NO: 51283 - protein, 353 aa, Arabidopsis thaliana
MANIGVVTTATNNQVIFRNYVNGFPKESDLYIAASTVDLRVPPGSMAVLVKNLYLSCDPHSRTRMGKPDPSSPASMAHAFTIGKPISGFGVAKAIDSGHPNYKTGDLLWGRVGWEEYSVITPTPSSHFKIHHTDVPLSFYTGLLGIPGLTAYIGFYEICSPKKGETVFVSAASGAVGQLVGQFAKMAGCYVVGSASSEEKVDLLKTKFGYDDAFNYKEEKDLSAALKRCFPEGIDIYFENVGGKMLEAVLENMRTHGRIAACGMISQYNLKKPEVLHNTATIVHKRIRVQGFAAVEFFDRYSKFLDFILPHVREGKLTYVEDISQGLENGPSALIGLFHGKNVGKQLVEVARV

SEQ ID NO: 51284 - protein, 345 aa, Myxococcus xanthus DK 1622
MKVAVLTGGGDCPGLNAVIRAVVRRANAHGFEMMGLRDGWKGLLEDNHFRLTRETTSGILHRGGTILGTSRVNPFKVENGLERVKRAIERNGIHAVIAIGGEGTLSAATRMSQEGLRIVGVPKTIDNDINATDFTFGFDTAVAIATEAIDRLHSTAESHKRVIVCEVMGRHVGWIATYAGIAGGADVILVPEIPADLAKVAEHIQRRHAGGRTFSIVVVAEGTRIKLSADQQEQLVTSGALDEAGRPRLGGVGTILAHEIERRTGFETRVSVLGHIQRGGAPTAHDRVLATRYGVHACDMVARGEFGKMAALRGNDIISVDLADATRELKRVPQEFFEVAQVFFG

SEQ ID NO: 51285 - protein, 348 aa, Candida albicans SC5314
MINKTKKTPTPVPETKSTTGTSNVENKSTTESSTQNKAQGSTNESTTTTSSSSAPAPAPAGATTTTSEQQQPQPAASNESTFAVGSEREASIQNIMEMGYERPQVEAALRAAFNNPHRAVEYLLTGIPESLQHPVAPAQPPATGTAPAQQTEGNTSESGQQGEDEEHEGDESTQHENLFEAAAAAAAGAGAGGAGSGAGAGAGSAEGDIGGLGDDQQMQLLRAALQSNPELIQPLLEQLAASNPQIANLIQQDPEAFIRMFLSGAPGSGNDLGFEFEDESGETGAGGAAAAATGEDEQGTIRIQLSEQDNNAINRLCELGFERDIVIQVYLACDKNEEVAADILFRDM

SEQ ID NO: 51286 - protein, 307 aa, Phytophthora parasitica
MVVKLLQHEHGKGRVRMLKVTRTPEKHSVIQLEAEVLLEGAPAASAYYDGDNGRVLPTDSVKNTVWVLAKKHEFASLEDFGVILAKHFVTKHPDIISVAKVKLFETPWQRVVVPDSKGKTRPHHHAFVSASPGFSTAYVVARKSAYGAPDVTVQGGVDGLKVLKTTQSSFVDFFRDDFTTLPDVPDRLVCTCVTATWSYTPDAIGGDFVARVAEIKNVLLETFAGPADVGVSSPAVQFTLYKMGEAVLEKCPYVKDIKITMPNIHNNPIDLSRFGCKNIHPHGEVFLPTDEPHGIISATMVRAASKL

SEQ ID NO: 51287 - protein, 508 aa, Glycine max
  misc_feature (177)..(177): Xaa can be any naturally occurring amino acid
  misc_feature (312)..(312): Xaa can be any naturally occurring amino acid
  misc_feature (314)..(315): Xaa can be any naturally occurring amino acid
  misc_feature (373)..(373): Xaa can be any naturally occurring amino acid
MLSRFTRLFSAPSNVARLVNGVQPRFSTTTVQDAPKIEEEPRFLEMVHQYFDIAGTFTDIPKDKLEVYKQCSAVFKVRLPLVRDNGKMEFIPAYRAQHKHHRLPVKGGTRYSEHIDLQEVEALSCLMTLKCAVVELPYGGGKGGIKIDPSKYSARELEDLTRRYTLELARKNFIGAXIDVPGPDMGTGAREMSWMKDTYTVFYGHNDINATACVTGKPLSQGGIKGRVESTGLGVFFGVREFLKDVELMKKYGIDSTNGYEGKTIIVQGFGNVGYFASKFMCEQGAKLIGVVDVEGSIYNPDGIDPDKLLEXRXXKGTLLDFPGSESYKDDSAFYKPCDFAIPAAVEKSINKLNAGRLQCKVLAEAANGPTTXAAEDILTKRGILVLPDILLNAGGVTVSYFEWLKNLDHMRPGRLVKRWEEKSKQNLLKIIADKTGTDLKLTAEDAKLLRGASELDIVYSGLEEVMCAAVEETVATSKKLNVPFRLASYVNAILKVHKVYEESGFAL

SEQ ID NO: 51288 - protein, 324 aa, Rhizobium leguminosarum bv. viciae 3841
MTTSAAFGPPPGRERRVLCVGAAVMDTLFRVRTLPTGQGKILPYDMLQIAEGMASSAAFAVVRLGGDASLWGAVGNDAIGERIVADLSESGIDTSGMLRVEGARSAISTILVDDQGERLIVPFYDAGLHETVKPVTEQDASAFDAVLVDVRWPKLALRTLLAAREAGKPAILDGDVAGDGVIEMLAPAASHIVFSQPAAERLAGAAELVKVVGLLKRKFEHAFISVTAGENGSFWFDDLTGDVFRLAAPKVRAVDTLAAGDVFHGAFALAVAEGLPIEETMRFSSMAAALKCQVFGGRIGAPTRAEVWDALRDWDVPMTKMRDR

SEQ ID NO: 51289 - protein, 293 aa, Hordeum vulgare subsp. vulgare
MSPTLSLKLKKSSHTPQSSVSSSTMLRLFKKEAACQSPSTLPVAMDMGLEVSSSSPSSSSVSSSPEHAARRASPAKRPAGRTKFRETRHPVYRGVRRRGNTERWVCEVRVPGKRGARLWLGTYATAEVAARANDAAMLALGGRSATCLNFADSAWLLAVPSALSDLADVRRAAVEAVADFQRREAADGSLAIAVPKEASSGAPSLSPSSGSDSAGSTGTSEPSAHGVFEGPVVMDSEMFRLDLFPEMDLGSYYMSLAEALLMDPPPTATIIHAYEDNGDGGADVRLWSYSVDM

SEQ ID NO: 51290 - protein, 99 aa, Taraxacum officinale
ELDALRDWEYKFMSKYAKVGTVKTSEPAPESSTSEPTTTAQPTEPTESSAAQPTEPVESRTAQPSEPVVGADEDHPKVTEDAPSENTSTVTTSEAKKED

SEQ ID NO: 51291 - protein, 308 aa, Medicago truncatula
MAKNVEGFEFEQRHGKERVRVARVWKSKDGKQQFVVEWRVSINLLSDCVNSYVRDDNSDIVATDTMKNTVYAKAKECSEILSVEDFAILLAKHFTSFYSQVTTAIVKIVEKPWERVNVDGQPHDHGFKLGSEKHTTEAIVKKSGALQLTSGIEGLSVLKTTKSGFEGFVRDKYTILPDTRERMLATEVTALWRYSYESLYSVPKKPLYFTEKYLDVKRVLLDTFFGSPKEGVYSPSVQATLYQMAKAALNRFPDIASIQLKMPNIHFIPVNLSNKNGQFVKFDDDVYLPTDEPHGSIEASLSCSRSKM

SEQ ID NO: 51292 - protein, 307 aa, Solanum lycopersicum
MAELRGLKLEQRHGKSRVRVARVWRDRDGKHHFAEWSVNISLISDCLPAYVSGDNSDIVATDTMKNTVYAKAKECSEKLSAEDFAIVLAKHFTSFYQQVTAAIVNIVEKPWERISIKGQQHEHGFKLGSERHTTEVMVDKSGTLHLTSGIEGLSILKTTKSGFEGFIRDRYTMLPETRERMMATEVTASWRYSFESLSSLPLKPLYFTDRCIDVKEVLLNTFFGPSKEGVYSPSVQATLYEMAKAVLGRSPDISFIQLKMPNIHFLPVNLPSKDKPDIVKFADDVYLPTDEPHGTIQATLSRLTSKM

SEQ ID NO: 51293 - protein, 115 aa, Taraxacum officinale
MEGTFFAKTVFGNEPSKPDYSNVPCAVFCIPPLSVVGLSEEQAIEQAEGDILVFTSTFNPMKNSISGRQEKSLMKLIVSAETDKVIGASMCGPDAAEIMQGIAVAVKCGATKARF

SEQ ID NO: 51294 - protein, 307 aa, Nicotiana tabacum
MAEVNGLKLEQRHGKSRVRVARVWKSHDGKYHFAEWSVNISLLSDCLPAYVAGDNSDIVATDTMKNTVYAKAKECSEQLSAEDFAIILAKHFTSFYQQVTAAIVDIVEKPWERISIKGQHHEHGFKLGSEKHTTEVMVDKSGTLRMTSGIEGLSVLKTTKSGFEGFIRDKYTMLPETRERMMATEVTASWRYSFESLSSLPLKPLYFTERYMDVKEVLLNTFFGPSKGGVYSPSVQATLYEMAKAVLGRFPDISFIQLKMPNLHFLPVNLSSKDNPVIVKFDNDVYLPTDEPHGTIQATLNRIRSKM

SEQ ID NO: 51295 - protein, 307 aa, Solanum tuberosum
MAELSGLKLEQRHGKSRVRVARVWRDRDGKHHFVEWSVNISLISDCLPAYVSGDNSDIVATDTMKNTVYAKAKECSEQLSAEDFAIVLAKHFTSFYQQVTAAIVNIVEKPWERISIKGQQHEHGFKLGSERHTTEVMVDKSGTLRLTSGIEGLSILKTTKSGFEGFIRDQYTMLPETRERMMATEVTASWRYSFESLSSLPLKPLYFTERYMDVKEVLLNTFFGASKEGVYSPSVQATLYEMAKAVLGRFPDISFIQLKMPNLHFLPVNLPSKDKPVIVKFADDVYLPTDEPHGTIQATLSRLRSKM

SEQ ID NO: 51296 - protein, 430 aa, Ralstonia eutropha JMP134
MSTQTPILIIGAGQAGAMAAAELRKLGHAERIVMVGGERHAPYERPPLSKAVLADASQQGQVGVHPAGFYAERDIELRLCTTVSAIDAARSVATCTDGSEIRFDACLLATGGRARTLPHLPAGTPNVHYLRTLDDAARLREAMQGADEVLVIGGGFLGLETASTAVDLGLKVTILESADRLLARAAPAELSDWLAQRVRARGVDLRLGCRITAIEPQAQGVQVRLADGTTWHIPVLVVAIGLTPNTELAAIAGLALHPGNGGIQIDEQGRTSVPNIYAAGDCASQFQPLFGAEMRMESWQSANEQARIAATSMLGLQAALAATPWFWTDQFGCNVQMLGAALPGMRYVWRDMPASGAASPKSMLLGTLDGCLRHAIAVNAGGDLRQLRSLFDLPVNEHLARLCDAALPLRQIVREVQAEISSRTASLTTN

SEQ ID NO: 51297 - protein, 376 aa, Triticum aestivum
  misc_feature (117)..(117): Xaa can be any naturally occurring amino acid
  misc_feature (150)..(150): Xaa can be any naturally occurring amino acid
MGCCGGGAMSSSSSSSRPRGGIREETLLRVPGASVHLVAGSEGPLELGRGELSVVRIFKDDVAVTTVVRVGRELGWPLARDEPVVKLDRLHYLFTLPDKDGGLLNYGVSFADATLLXSFDALLKSNSCFSTPSAPSRGSRPPPAGVGVAXGAYWNDFSPKVGSYNNVLAKAIGGGAPGHLVKGIFMCSEAYASQVQKGANLISPQAAGGASKRFGGAGGADGSSQAGPAKRGGVNKSLKRVRKMSEMTEKMSKTMLDTVISVTGSMAAPLLRSNQGKALLSTVPGEVVIASLDAINKVMDAVEAAERRSLAATSNVVSGAVSKRYGESAGEATGDAFATVGHTVGTAWNIFKIRKAVTPSSSLPGNMVKSAVRNRN

SEQ ID NO: 51298 - protein, 490 aa, Escherichia coli
MDIQKRVSDMEPKTKKQRSLYIPYAGPVLLEFPLLNKGSAFSMEERRNFNLLGLLPEVVETIEEQAERAWIQYQGFKTEIDKHIYLRNIQDTNETLFYRLVNNHLDEMMPVIYTPTVGAACERFSEIYRRSRGVFISYQNRHNMDDILQNVPNHNIKVIVVTDGERILGLGDQGIGGMGIPIGKLSLYTACGGISPAYTLPVVLDVGTNNQQLLNDPLYMGWRNPRITDDEYYEFVDEFIQAVKQRWPDVLLQFEDFAQKNAMPLLNRYRNEICSFNDDIQGTAAVTVGTLIAASRAAGGQLSEKKIVFLGAGSAGCGIAEMIISQTQREGLSEEAARQKVFMVDRFGLLTDKMPNLLPFQTKLVQKRENLSDWDTDSDVLSLLDVVRNVKPDILIGVSGQTGLFTEEIIREMHKHCPRPIVMPLSNPTSRVEATPQDIIAENKPPFSVFRDKFITMPGGLDYSRAIVVASVKEAPIGIEVIPAHVTEYL

SEQ ID NO: 51299 - protein, 346 aa, Arabidopsis thaliana
MTSMYYNHDHLTASGKNMWSNFYVLVDTAVMLYEEEKQRRKIVSEEEEETQKRIFCLFPRKTRSSLVKRQQKLSGFLTSASSSLIDLNQFPSDSEIEDPLNHHQLLSSSCFIAADFETLQNPSSEPCSSLVLFDCKTAGSEKTETKDPPNPNFPCPLSLCLTENKNRKRRAVEQRKRTGGVKKAKVAPFSQTARETPEWLVNVMRDMKEAKDAKLIFEKTLFVTDVNPTQNRLSMPFNNLLRNDFLTSVESRIIDKDIKNDKKIGVGAILVDQRCKKWGVMLKRWEMKKESGKGSWNYNLICGWNDIVEANGLKEGDNISLWSFRSCGILCFAMEQRSPSLALCLC

SEQ ID NO: 51300 - protein, 400 aa, Clostridium perfringens str. 13
MNCIIAQSGGPTSVINASVYGLVKANKKLNLYENVYGGLNGIEGILNKKIINLSDLDELQLERFKNSPASGLGSCRYKLKPLSESEDEYLKLLDILNSLNIKAFFYVGGNDSMDTTAKLNAFAKAKNIDIKFFGIPKTIDNDLMHTDHTPGFGSAAKFISTAVLETYLDSKVYTNNGIFIIETMGRDTGWLAASGALATINGNKCADLVYLPERAFSVQSFLTDVARIFKEKKHVYIVASEGLKDENGKFLTETAPNDDSFGHAQLGGVGAYLKNLIIQASITHRVKSLELNTLQRCSMHASSKIDVNEAVMVGQAALEASINSEGGYMVAIRRDSSFPYKSSTFLIEADKIANNIKYFPSEWINEEGNNITEEGLLYLKPLISDFEDRDSLPLYHSFVL

SEQ ID NO: 51301 - protein, 341 aa, Burkholderia xenovorans LB400
MKIKFVPVLLASALAFGSAFAASPASQPTPDRVTSGFLKALNSGKGPAINTLPPAQARQVLVDAQNGVKVDLSGIDVSNRTIEQDGVSVPLTIVRPHGASGTPPVFMFFHGGGWILGDFPTHERLVRDLVVQSGAVAVFVNYTPSPEARYPVAINQAYAATKWVAAHGDEIGVDGSRLAVVGNSVGGNMAAVVSLMAKDRQGPAIRFQGLMWPVTDNNFNDGSYNQFQEGHFLTRPMMKWFWDAYTKDPKQRNEIYASPLRATTEQLKGLPPALIQVAGSDVLRDEGEAYGRKLDAAGDEVATVRYDGTIHDFGLLNALAEDAPTKAATRQLANELKQRLQ

SEQ ID NO: 51302 - protein, 532 aa, Coprinopsis cinerea okayama7#130
MPDYNARVASNPYVVGSFACIGGGLFGLDISSMSGVLNNQHYLQAFGHPGPSAQGAIVASMPAGSLLGALTVTQLADRIGRKKTIILAGLIWIVGSVLQCAAQNRAMLVVGRIISGFSVGLSSAVVPIYQSEITYPSIRGRMVSLQQWSITWGILLQYFVQFGCSYIDGVASWRIPWGLQMIPAMVLSAGMTIFPESPRWLFDHGREDEALQVLADLHGNGDKTNELVVLEYEEIKEQVEYERTQGAKSYLDLLKPGNPRRVMLGCSLQMWSQLTGMNVMMYYIIYVFEGAGLTGRRSNLIADSVQYVLNVLMTVPAIIYIDKWGRRPMLLAGTLFMGFFLYLVGGLQGRFGHWGDIEGKRVWVITDNPSATKAVVVCSYLFVCSFAVTMGPVSWTYPAEIYSLKIRGKAVALATASNWTFNTALAFAVPPGLDTIAWKTYFIFGTFNFACFIHVLFMFPETVGRSLEEIEEIFGKGHVFTAWRIGRDVGRGKVAELSAQRAQRKEAKETENQEKEKEKAGSVEEKHEHEVA

SEQ ID NO: 51303 - protein, 203 aa, Brassica napus
  misc_feature (147)..(147): Xaa can be any naturally occurring amino acid
  misc_feature (151)..(152): Xaa can be any naturally occurring amino acid
  misc_feature (155)..(155): Xaa can be any naturally occurring amino acid
  misc_feature (157)..(162): Xaa can be any naturally occurring amino acid
  misc_feature (166)..(167): Xaa can be any naturally occurring amino acid
  misc_feature (170)..(170): Xaa can be any naturally occurring amino acid
  misc_feature (173)..(176): Xaa can be any naturally occurring amino acid
  misc_feature (178)..(178): Xaa can be any naturally occurring amino acid
  misc_feature (180)..(181): Xaa can be any naturally occurring amino acid
  misc_feature (183)..(184): Xaa can be any naturally occurring amino acid
  misc_feature (186)..(192): Xaa can be any naturally occurring amino acid
  misc_feature (194)..(195): Xaa can be any naturally occurring amino acid
  misc_feature (197)..(198): Xaa can be any naturally occurring amino acid
MASGEQKFPPQQQQTQPGKEHAMTPVPQFTSPDYKPSNKLQGKIALVTGGDSGIGRAVCNLFALEGATVAFTYVKGHEDKDARDTLEMIKRAKTSDAKDPMAIPSDLGYDENCKRVVDEVVSAYGRIDILVNNAAEQYECGTVEDIXELRXXEGXFXXXXXXLFLXXGRXALXXXXGXEXXLXXPXXXXXXXGXXKXXPGWPP

SEQ ID NO: 51304 - protein, 295 aa, Pinus taeda
MGEDLILEQKHGKARVRVARAWRQSGKQWIVEWNVNIMLYSECLAAYTNGDNSDIVATDSMKNTVYAKAKECADHVPVEDFGILLGKHFIATYSQVTAVTIKIVEKPWERVWIDGIPHEHGFKLGTEKHTVEININKGGDVKVTSGVEGLALLKTTQSGFEGFIRDKYTMLPETKERILATEVSAKWRYTRKPSCYTDAYNAVKKTLVDVFFGSPHVGVYSPSVQNTLYFMAQAVMHKFPVVESIHLSMPNLHFLPVNISNIVKFDHDVYMPTDEPHGTIEASLTRKDFTGFSKM

SEQ ID NO: 51305 - protein, 306 aa, Saccharum officinarum
  misc_feature (257)..(257): Xaa can be any naturally occurring amino acid
MAENFQLQSRHGKSRVRVSRVWRRPAAAGGHVIVEWNVAVSIVSDCLPSYISSDNSAIVATDSIKNTVYVKAKECTEVVSMEEFAVILGRHFTSLYPQVSEATVTIVERPWERVTVDGKPHSHGFKVGVEKHSTEVIVKKSGSLLINSGIQGYSLLKTTQSGFEGFVTDRYRLLPDTRERIVATEVTAWWRYPFEHVSQLPSKPFCFTQRYQDVKKVLAETFFGPADVGVYSPSVQNTLYLMGQEVLTRVAEISSIXLKMPNLHFLAVNLGSKETPLVKIADDVYPATDEPHRTIGAPLTRPMSKL

SEQ ID NO: 51306 - protein, 347 aa, Arabidopsis thaliana
MEFVKVLGKGTYGSVELFSHKQNDGSLLYNAVKIMDSENYGSIDQEFRILSELRGCPCIVQLCGNSLVQGIDCNGKKVYMMSMEYAAAGTLTNFIKRNRTKLSDSVIKDFTRMILQGLVSIHNHGYVHCDLKPDNILLFPLYDKDTWNCSYELKISDFGISTRAGDKSGCWRVDEPWVGTSIYMSPESVSDGTTVEKTLDLWSLGCIVLKMYTGKRPWLGFEKDVKSLLLNQKAPEIPETLPCDARLFLEKCFSRKPEERGSASELLLHPFLTGDEKKGSSVAGGERTGMVLRLRKPPPISKDIPTKPRKLKVISQKPQQLKKVSNKPLKVKIVPPRPPRSDFVPVL

SEQ ID NO: 51307 - protein, 306 aa, Sorghum bicolor
MAENFQLQSRHGKSRVRVSRVWRRPAAAGGHIIVEWNVAVSIVSDCLPSYISSDNSAIVATDSIKNTVYVKAKECTEVVSMEEFAVILGRHFTSLYPQVSEATVTIVERPWDRVTVDGKPHSHGFKVGVEKHSTEVIVKKSGSLLINSGIQGYSLLKTTQSGFEGFVTDRYRLLPDTRERIVATEVTAWWRYPFEHVSQLPSKPFCFTQRYQDVKRVLTETFFGPADVGVYSPPVQNTLYLMAKEVLTRFPDISSVQLRMPNLHFLPVNLGSKETPLVKFADDVYLPTDEPHGTIEATLSRPMSKL

SEQ ID NO: 51308 - protein, 311 aa, Rhizobium leguminosarum bv. viciae 3841
MTQLDESAKRALAWPGDPQTPVESCTPALARQQYLDSFADIQRPLEDVVETLERHAGAIRLKIWRGRAAPRQGAPALLYLHGGGFVIGAPETHEDICRTLANMAGAVVVSPDYRLAPEHPFPAAIDDCAAALVWMTEQADALGIDPLRVVVAGDSAGGNLAAVVALLARDGQVPAVIGQVLIYPVTDQLQTSDSYSRYEEDFGLTAAAMKWFRDHYLPDAASRSDWRASPLNAASLAGVAPALVILAGYDVLFDEGAAYAERLGTEAKATTRTWPGQIHGFVSKRRAIPEGQEALEAIATAWRAMDPALAR

SEQ ID NO: 51309 - protein, 307 aa, Triticum aestivum
MAGRFDLQGRHGKSRVRVSRVWRRPAEAGGHLFVEWSVAVSVVSDCLPSYTSDDNSAIVATDSIKNTVYVKAKECTEVVSMEEFAVILGRHFTSLYSQVSEATVTIVERPWERVAVDGKPHSHGFKLGSEKHTTEVNVKKSGSLLINSGIQGYSLLKTTQSGFEGFVRDRYTLLPETRERIVATEVTAWWRYPFEHISQLPSKPFCFTQRYQDVKKVLADTFFGPSDVGVYSPSVQNTLYLMAREVLTRFPDIASVQLRMPNLHFLPVNLGGKENPGLVKFADDVYMPTDEPHGTIEATLSRANSKL

SEQ ID NO: 51310 - protein, 211 aa, Geobacter sulfurreducens PCA
MKDIERFIAGFRRFREDYFGSEYSPFEHLKQGQSPKTMIIGCSDSRVDPAILTDCAPGDIFTVRNVANLVPPFEENGGLHGVSAALEFAVCHLGVEHIIVLGHSQCGGINALMKGTCGCKGGGFISRWMSIATPARERVLAELPEKDTALQQRAAEQAAILLSLENLHSFPWIDERVVRGELTLHGWYFDISAGELLEYRSETGLFEKVSK

SEQ ID NO: 51311 - protein, 307 aa, Hordeum vulgare subsp. vulgare
MAGRFDLQGRHGKSRVRVSRVWRRPAEAGGHLFVEWSVAVSVVSDCLPSYTSDDNSAIVATDSIKNTVYVKAKECTEVVSMEEFAVILGRHFTSLYPQVSEATVTIVERPWERVAVDGKPHSHGFKLGSEKHTTEVTVKKSGSLLINSGIQGYSLLKTTQSGFEGFVRDRYTLLPETRERIVATEVTAWWRYPFEDISQLPSKPFCFTQRYQDVKKVLADTFFGPPDVGVYSPSVQNTLYLMAREVLTRFPDIASVQLRMPNLHFLPVNLGGKENPGLVKFADDVYMPTDEPHGTIEATLSRANSKL

SEQ ID NO: 51312 - protein, 793 aa, Yarrowia lipolytica CLIB122
MMRGFKQRMLSRSKSHSESSTKNKKKEDGPKRTFSLGDRKKTPEPTPAAATPSNVQAAATPVSSSSSASSITSVSGSSGNNNSSSNNNSNNNITSGATNTTNSSNANTTNPATSSNSNPSTGNVSSMLTPQQPAQSQAALQGLQQNQQQQGQQMDTNTPPAILVEGPTQLGSAQASSHVTMGHVTGHMSTHSGTPHHHPSSPGQLETMPTDLEPPKRHSFELLNADGPEVKTPRRHNSSRLEISKERELERLPGFNEVPFRKRAELFLQKVKQCNTIFDFGDPSSDIQGKDIKRMALHELLDFVANTRITITDEMYAQVVGMFGKNIFRPTPPLVNPVGEVFDPDEDEPVCEVAWPHMQLVYEFFLKFIESPDFNHTSAKKFIDHRFVQNLLELFDSEDIRERDCLKTTLHRIYGKFLNLRAYIRRSINNVFFQFIYETERFNGVAELLEILGSIINGFALPLKDEHKIFLSRVLIPLHKAKTLSLYHPQLAYCVVQFLEKDPSLTEEVILGLLRYWPKVNSSKEVMFLNEIEDIFEVMEPTEFQRIQIPLFSQLAKCISSQHFQVAERALYYWNNEYFCTLMSENITEILPVIFPALYENSRGHWNRTIHSMVYNTMKMIMEANPQLFDQCTMVYQERQDLKEEHEALVAKWWDMVVERAANSQENVDSPQFAKLLNQAQEEFSMLKTEDRDLQMSGIPEEGEEDSNKLANNQGPEEGMEHDHHEQHQQHQGLGQHEQQQQQQQGVEQQQQPHNIQPLGVVTNHETPVVAHNDEEHTGFHTPRGSSDFPFGY

SEQ ID NO: 51313 - protein, 472 aa, Bacillus thuringiensis serovar konkukian str. 97-27
MNHLRGGSEVANKELKRGLEARHIQMIALGGTIGVGLFMGSASTIKWTGPSVMLAYAIAGIFIFFIMRAMGEMLYMEPSTGSFATFGHKYIHPLAGYMTAWSNWFQWVIVGMSEIIAVGAYMQYWFPDLPAWIPGVIAMVILGAANLISVKSFGEFEFWFAMIKIVTILLMIIAGFGLIFFGIGNGGEAIGISNLWSNGGFFTGGFSGFFFALSLVVGAYQGVELIGITAGEAKDPKKTLTRAIQSTIWRILIFYIGAIFVIVTVYPWDQLSTIGSPFVATFAKVGITAAAGLINFVVITAAMSGCNSGIYSAGRMLYTLGVNGQAPKYFTKLSGNGVPLFGTVGVIIGLAVGVVLSYIAPKNLFVYVYSASVLPGMVPWFVILISQINFRKEKGTEMKDHPFKMPFAPVTNYLTIAFLIMVLIGMWFNDDTRISLVVGIVFLAIVTISFYAFGIGKRPPLDVPNDQEISSK

SEQ ID NO: 51314 - protein, 516 aa, Blumeria graminis
MHRTFHPYFLLKMSGSSQRHSHVTGYLILLVAVATLGPLQYGYHLAELNAPQDVITCHSLLGRQNVASKSLSNPSQCIPMTEAEFAALSSIYILGGLAGAITAGPISSSHGRLLTMRITGIFFILGSLIETIAESVPVMSTGRFLAGLGAGAATVVAPMYISEISPAEKRGLFGTMTQAMISVGIFVTQSLGYFFSRGMLWRIILGVGAGFGLLLGAGLCFIPESPSWLASHHNPTLAVKTLQRIRGAGTPIHKETAGWNVQEINGEEERLIRPSDLSSTSQYNQHNLATPNLKLPSVGFFGVLQDPLYRPAIMAVCGIMIAQQLSGINSIMMYSVSLLRGVLPIPSILLTIIMSAMNVITTIVCAPLADRIGRKSCLLLSIAGMGTMSLLLAISLRMEWKLFSAIAVISFVAFFATGLGPVPYIMASELVGQEAVGAAQSWALAANYLASFLVAQFFPLLNSWMNNRWGGAGWVYFIFTAFAGVSWIFVTYYVPETNGKTGPDEVWGRTTGEVAD

SEQ ID NO: 51315 - protein, 180 aa, Nicotiana tabacum
MASSVLSSAAVATRSNVAQANMVAPFTGLKSAASFPVSRKQNLDITSIASNGGRVQCMQVWPPINKKKYETLSYLPDLSQEQLLSEVEYLLKNGWVPCLEFETEHGFVYRENNKSPGYYDGRYWTMWKLPMFGCTDATQVLAEVEEAKKAYPQAWIRIIGFDNVRQVQCISFIAYKPEGY

SEQ ID NO: 51316 - protein, 217 aa, Bacillus simplex
LVVDGHKVKVLAERDPAQLAWGELGVEVVVESTGRFTKRADAAKHLEAGAKKVIISAPASDEDITIVMGVNEDKYDAANHHVISNASCTTNCLAPFAKVLHEQFGIKRGMMTTVHSYTNDQQILDLPHKDYRRARAAAENIIPTTTGAAKAVALVLPELKGKLNGMAMRVPTPNVSVVDLVAELEKDTTVEEVNAAFKKASEGELKGILEYSELPLV

SEQ ID NO: 51317 - protein, 511 aa, Arabidopsis thaliana
MDIISGQPLFLIFCFILSCLLFFTTARSRRSPCQLSKSPPGPPRLPIIGNIHLVGKNPHHSFTDLSKTYGPVMSLKLGCLNSVVIASRDAVREVLKTHDQILSGRYISEATKSNNHHEFSVGWIHPSSSRFRMLRKLSATQLFSPQCIQATKALRMKKVQELVNFLSESCEREEAVDISHVSFVTALNIISNILFSVNLGSYDSKNSSAFQEMVIGYQESIGNPDLANFFPFMRFLDLQGNSKKMRESSGRLLQVFREFYDARIVEKSSRSVEKDVSSKDFLDVLIDLQQGDETEINIDEIEHLLLDMFVAGTDTNSSTVEWAMAELLGNPKTMTKVQDEINHVIGQNGDFQESDISKLPYLKAVVKETFRLHPAAPFLLQRKAETNVEILGFTVLKDSQVLVNVWAIGRDPLVWENPTHFEPERFLGKEIDVKGTDYELTPFGAGRRICPGLPLAMKTVHLMLASLLYTFEWKLPNGVGSEDLDMEETFGLTVHKTNPLLAVPLKKRAIN

SEQ ID NO: 51318 - protein, 368 aa, Arabidopsis thaliana
MTFTQLFSPQRIEATKALRMKKVQELVNFLSESSERGEAVDISRASFVTALNIISNILFSVNLGSYDSKNSSAFQEMVIGYMESIGNPDVSNFFPFMRLLDLQGNSKKMKEYSGKLLQVFREFYDARILENSSRIDEKDVSSRDFLDALIDLQQGDESEINIDEIEHLLLDMFLAGTDTNSSTVEWAMTELLGNPKTMTKVQDEINRVIRQNGDVQESHISKLPYLQAVIKETFRLHPAAPFLLPRKAERDVDILGFHVPKDSHVLVNVWAIGRDPNVWENPTQFEPERFLGKDIDVKGTNYELTPFGAGRRICPGLPLALKTVHLMLASLLYTFEWKLPNGVGSEDLDMGETFGLTVHKTNPLLACL

SEQ ID NO: 51319 - protein, 336 aa, Pseudomonas putida KT2440
MKAAVVAPGRRVDVIEKSLRPLEHGEALLKMQCCGVCHTDLHVKNGDFGDKTGVVLGHEGIGVVQEVGPGVTSLKPGDRASVAWFYQGCGHCEYCNSGNETLCRDVKNSGYTVDGGMAEACIVKADYSVKVPDGLDSAAASSITCAGVTTYKAVKISNVRPGQWIAIYGLGGLGNLALQYAKNVFNAKVIAIDVNEEQLRFASEMGADLVVNPLNEDAAKVIQAKTGGAHAAVVTAVAKGAFNSAVDALRAGGRLVAVGLPSESMDLNIPRLVLDGIEVVGSLVGTRQDLQEAFQFAAEGKVVPKVTLRPIEDINQIFDEMLEGKIKGRMVIQFEG

SEQ ID NO: 51320 - protein, 530 aa, Magnaporthe grisea 70-15
MSSFSPTQIFEEGTTEEKGENARLSAFVGAIAVGDLVKSTLGPKGMDKILQSASTGEIMVTNDGATILKSIALDNAAAKVLVNISKVQDDEVGDGTTSVSVLAAELLREAEILVGKKIHPQTIIEGYRIASRAALEALEQSAVDHSKNPEAFKKDLLAIARTTLSSKVLAQDRDHFSRLACEAVLRLKDSSDLSHIQIIKKAGGKLSDSFLDEGFILDKKIGVNQPKRLENAKILVANTSMDTDKVKIFGARMKVGSTSKLAELEKAEKDKMKAKVDKIKAHGINCFINRQLIYNWPEQLFTDAGIMSIEHADFDGIERLALVTGGEITSTFDHPDQVKLGHCDLIEEIIIGEDTLIKFSGVAAGEACTIVLRGATEQLLDEAERSLHDALAVLSQTVKEPRTTLGGGCAEMVMAKAVEGAATRVEGKRQMAVASFATALRQLPTILADNAGLDSGELVARLRKAIYDGMTTYGLDLMTPGGGIADMRDIGVIESYKLKKAVVSSASEAAELLLRVDDIIRAAPRRRERQ

SEQ ID NO: 51321 - protein, 364 aa, Solanum lycopersicum
MTTSNTQQSYDKTSELKAFDDTKAGVKGLIDSGITKVPQIFIHPEALENKTTNPKNTHFIFPLIDLQNISINNKEIVKQIQEASETWGFFQVINHGIPVPVLDEMLRGARRFHDQDIDVKKPYYSRDIARKVMYNCNFDLFSEKSLAANWRDSLYSVMAPNPATPEEIPETCREITIEYSNYVMNLGYTLLELFSEGLGLKPNHLKEMGCAEGLGILCNYYPKCPQPEIAIGTSRHADNDFFTVLLQDDIGGLQVLHKNQWVDVPPTHGALVVNIGDILQLISNDKYKSVVHRVLANTIGPRISIASFFSTGPFSTSRIYGPIEELLSKDNPPKYRSTTMKDFFEYSNKKGLDGNSNLSHYKII

SEQ ID NO: 51322 - protein, 113 aa, Chromobacterium violaceum ATCC 12472
MSEELKIEDLVVGEGKEAVRGALITSHYTGWLEDGSKFDSSLDKGRPFQCVIGTGRVIKGWDQGMMGMRVGGKRRLWVPAHLAYGERQIGDRIPANSNLVFEIELLEVLTRDE

SEQ ID NO: 51323 - protein, 412 aa, Arabidopsis thaliana
MLENPKFDLHAVGNHNNDNNYYAFTQDFYQKLGEEGTNMSVDSMQTSNAGGSVSMSVDNSSVGSSDALIGHPGLKPMRHPYSLSDGQSVFRPGKVTHALNDDALAQALMDSKYPTEGLVNYEEWTIDLRKLHMGPAFAQGAFGKLYRGTYNGEDVAIKLLERSDSNPEKAQALEQQFQQEVSMLAFLKHPNIVRFIGACIKPMVWCIVTEYAKGGSVRQFLTKRQNRAVPLKLAVMQALDVARGMAYVHERNFIHRDLKSDNLLISADRSIKIADFGVARIEVQTEGMTPETGTYRWMAPEMIQHRPYTQKVDVYSFGIVLWELITGLLPFQNMTAVQAAFAVVNRGVRPTVPADCLPVLGEIMTRCWDADPEVRPCFAEIVNLLEAAETEIMTNVRKARFRCCMTQPMTVD

SEQ ID NO: 51324 - protein, 297 aa, Physcomitrella patens subsp. patens
MEGFALQHQHGKAKVRVGRLWRGATSQEHRFVEWNVSVSITSFVLPAFTDGDNSKIVATDSIKNTIYYLAKQCTEELSLEDFGVVVGQHFLRTYPKIVTGAKVILSQKPWERVVVDGVEHNHGFKLGSGKHTAEVIIGSNGCVKVTSGITDLSLLKTTQSGFEKFVRDQFTILPDTDERMLASTITGVWSYSGKPANYQRSWEAVKKVLMDTFFGSPPTGVYSPSVQHTLYQMAKAVLVRFPEIENIHLNMPNIHFLPVNLPTVGVKFENDVFLPTDEPHGSIEAKLSRMEIFQCKL

SEQ ID NO: 51325 - protein, 389 aa, Clostridium tetani E88
MKVLIFSISAGGGHSKAAESLKEYIDLYSSKSTVKVIDTLKYINPIIDKVIIGSYLKTIKITPSLFGKLYDYTESDYGLSIISAKFNEIMTYRLLPLIKDFNPDILIATHPFPTEMLSILKSKHKINRPIISILTDYAPHSFWLHPCIDAYIVSNKYMISEMVSKGIPKNTIYPFGIPVSRDFLTNYSREETLSEINFYSDKPTILVMGGSLGIGKITKVYENLLKINEDIQIIVIAGNNKKLYYELLSYRHSLDKDSTSYIIGFTDKVNKYMQASDLLLTKPGGLTITEALVSSIPLALFSPIPGQEEKNAEFLLTNNLAVDLGDGSNTKDIIENLLKDKSKLSNIKENQRKFSKPDVGKNIYNLILKLISDYKINIEEIYLNEKNPD

SEQ ID NO: 51326 - protein, 309 aa, Vitis vinifera
MASDKIDGFTLEQRHGKARVRLGRVWRSQSGRHIFVEWTVSISLLSNCLAAYVRDDNSDIVATDSMKNTVYAKAKECAQQLSMEEFAIKLAKHFTSFYQQVTTAIVTVEEKPWERAYIDGQPHDHGFKRGSETHTTEVIVEKSGALQVTSGIQGLALLKTTQAGFEGFIRDKYTALADTRERIVATEVTASWRYPFESLSGIPLQPLYFTEKYLDVKKVLAETFFGPPRGGVYSPSVQSTLYQMAKNVLNRFPDISSIQLKMPNLHFLPVNISSKDNPAIVKFDDDVYLPTSEPHGSIEATVSRIRAKI

SEQ ID NO: 51327 - protein, 417 aa, Oryza sativa (japonica cultivar-group)
MPALGTLSGGAAGVAGLLRLRRATPSPAVATPFPAAAAARCAAAAAAVVPDGGQLVWGRQLRPALLLPAAGGLLQPPTSPSSSQAGRRQALRPPAAATSGEAKPAGFLEKYPALITGFFFFMWYFLNVIFNILNKKIYNYFPYPYFVSVIHLLVGVVYCLVSWTVGLPKRAPINSTLLKLLFPVALCHALGHVTSNVSFATVAVSFAHTIKALEPFFNAAATQFVLGQQVPLPLWLSLAPVVLGVSMASLTELSFNWTGFINAMISNISFTYRSIYSKKAMTDMDSTNVYAYISIIALIVCIPPAVIIEGPQLLQHGFNDAIAKVGLTKFVSDLFFVGLFYHLYNQVATNTLERVAPLTHAVGNVLKRVFVIGFSIIVFGNRITTQTGIGTCIAIAGVAIYSYIKAKIEEEKRAKSA

SEQ ID NO: 51328 - protein, 149 aa, Geobacter sulfurreducens PCA
MITQIKKFEKMIIFSLVVMMALVLFLATLELAWIIVKDIVSPPFLLLEIDELLEIFGLFMLVLIGIELLETIAKTYLAQSTDHARIVMAVAIIAIARKVIILDVKDLSGQVLLGIAAIILALSIGYYLIRRRSGGSEREGDTSSEPERL

SEQ ID NO: 51329 - protein, 308 aa, Nostoc punctiforme PCC 73102
MAVSVVKKLDKLTTTELSAWVQQAKIQAKQGRVLDRIPQLALADPDWFAVHVCCESGKNISFGDTACIFPLMSVIKTFSLLYLLEHFGAETVFSWVGVEPSDAPFNSLEQLVSDRGRPRNPMINSGAITLADKLPGKDATQRTLLFCQWLNQLAGCQLSLDEVMLASVRLTRSTANEAITNYLTETGYLENLEIALDTYEQICCISGRIKDLALLGKLLACDGLVNPQNRRIVNAVMLTCGLYEASAEFAVRIGLPMKSGIGGGLVAIVPGEGAIACYSPGLDNIGNPVAGLVFVEAFSQKLELSIFG

SEQ ID NO: 51330 - protein, 522 aa, Yarrowia lipolytica CLIB122
MLRRITLNQFKGGLRRLSTLTPVKNEPLTLPNGAKYEQPVGLFINGEFVKSQSGKRFETENPTTETPIISVYEAGEADANAAVEAAKNAFKNWGFKTAPSERGVLLNKLADLIERDLDLISAIETTDNGKVFAQAQGDVALVVKVLRYYAGFADKIGGDLVQTNDGFFNYTRKEPLGVCGQIIPWNFPLLMWAWKIAPALTTGNTVVLKTAESTPLSALYACKLSQEAGFPKGVLNVVSGYGPVGGVLSAHPDIKKIAFTGSTATGKQVAKTALTSNLKKTTMELGGKSPNIIFDDANLEDALSAAALGIFFNSGEVCCAGSRLFVQAGVYDQVVEAFKKKAESVKVGDPFDPNSLQGPQQNKNQFKKILGYIEQGQKEGAHLLCGGSAQAGPNKGYFIQPTVFTDVNNDMSIVREEIFGPVLTITKFNTVDEVIDMANDSEYGLAAGIHTTDINKAHYVAENIASGTIWVNCYNAFHEAVPFGGYKQSGFGKEMGRDGLENYLQTKAVRVKLDERKWADKQ

SEQ ID NO: 51331 - protein, 168 aa, Triticum aestivum
MAPTVMASLDSSVAPFQGLKSTDGLPVSRRSNGASLGSVSNGGRIRCMQVWPIEGVKKFETLSYLPPVSTEALLKQVDYLIRSKWVPSLESSKVGFIFREHNASPGYYDGRYWTMWKLSMCGCTDASQVINEVEEVKKEYPDAYVRIIGCDNMRQVQCVSFIAFKPPG

SEQ ID NO: 51332 - protein, 261 aa, Bacillus cereus G9241
MTLQEQIMKALHVQPVIDPKAEIRKRVDFLKDYVTKTGAKGFVLGISGGQDSTLAGRLAQLAVEEIRNEGGNATFIAVRLPYKVQKDEDDAQLALQFIQADQSVAFDIASTVDAFSNQYENLLGESLTDFNKGNVKARIRMVTQYAIGGQQGLLVIGTDHAAEAVTGFFTKFGDGGADLLPLTGLTKRQGRALLQELGADERLYLKMPTADLLDEKPGQADETELGITYDQLDDYLEGKAVPADVAEKIEKRYTVSEHKRQ

SEQ ID NO: 51333 - protein, 408 aa, Stenotrophomonas maltophilia
MSKADVVIVGAGHGGAQCAIALRQNGFEGTITVIGREPEYPYERPPLSKEYFAREKTFDRLYIRPPTFWAEKNIEFKLGTEVTKVDPKAHELTLSNGESYGYGKLVWATGGDPRRLSCQGADLTGIHAVRTREDCDTLMAEVDAGTKNIVVIGGGYIGLEAAAVLSKMGLKVTLLEALPRVLARVAGEDLSTFYQKEHVDHGVDLRTEVMVDSLVGENGKVTGVQLAGGEVIPAEGVIVGIGIVPAVGPLIAAGAAGANGVDVDEYCRTSLPDIYAIGDCAAFACDYAGGNVMRVESVQNANDMGTCVAKAICGDEKPYKAFPWFWSNQYDLKLQTAGINLGFDKTVIRGNPEERSFSVVYLKDGRVVALDCVNMVKDYVQGRKLVEAGATPDLEALADAGKPLKELL

SEQ ID NO: 51334 - protein, 567 aa, Oryza sativa (japonica cultivar-group)
DCGTDTAGILLEMGGYEYATNGYHRGMEDDYEDEYYSEDPYDEEGEGAGQEYAEEDDEPPEGQQEFLQIRERLKEQIRRKAQAASASAAGRSSSSHDRKPQSTFGSFFGPSKPVISQRVIEERKSLKELQNTASMSRDRRPSAKEIPSSSKVQSKTNGHHHKQKIVNEAKRKAEALKDNRDYSFLLSDDADISPSPMEKPVARSSLSQKSDRESTHSAVKSRAPTGQTARLSNGYGLKNTLSSQRHTEGRVDSNRKVAGANRERVVLPDNGRMHSVVRNGSTQATTSKAASQKLPSKAPIANRPPIKSVSDQSLRANHSASKQLLSQNGRPQSSQSQRMQSTSHGQRPHQPVQSQWPLQSLQGRRPQQSPQNTRPQLMSKSQRPQQSLQRQRPQLSSQNERLESSERQRPPSQSYRPQSSQGQRPSSVQGRQYSEQRRIQANDRVKSAERQIRPPSKPMPSRQIPSNGMRDAHAKKKQPMKRRFNDLSEDEEDPLAMIRSMFRYDPSKYAGRDDDDSDMEADFATIEMEEQRSARIAKEEDDEQLRLIEEEERREQERKRRKMARGR

SEQ ID NO: 51335 - protein, 409 aa, Stenotrophomonas maltophilia
MQRADVVIVGAGHGGAQCAIALRQNGFEGTITVIGREPEYPYERPPLSKEYFAREKTFDRLYIRPPTFWAEKNIEFKLGTEVTKVDPKAHELTLSNGESYGYGKLVWATGGDPRRLSCQGADLTGIHAVRTREDCDTLMAEVDAGTKNIVVIGGGYIGLEAAAVLSKMGLKVTLLEALPRVLARVAGEDLSTFYQKEHVDHGVDLRTEVMVDSLVGENGKVTGVQLAGGEVIPAEGVIVGIGIVPAIGPLIAAGAAGANGVDVDEYCRTSLPDIYAIGDCAAFACDYAGGNVMRVESVQNANDMGTCVAKAICGDEKPYKAFPWFWSNQYDLKLQTAGINLGFDKTVIRGNPEERSFSVVYLKDGRVVALDCVNMVKDYVQGRKLVEAGATPDLEALADAGKPLKELQY

SEQ ID NO: 51336 - protein, 520 aa, Zea mays
MERTINSLMYKGSIPDAINQSRREKKLFVVYISGEDEASSSLEQSSLIDENVVEVIGRCCILLHLKQGNVDASQFSAIYPQKSVPSISVIGLNGVLLWNHDGYINSENLKESIEKAWADLHLQETAATLLTASLATRNSEPVNSATTVLPAQGGSSTLENPSDLSSQSPDVSGASEVAHSTDLISQVPNSTALYEPLEINEKEGSKSNSDDKTVEKLGSTSTEFDCDLLDISRKSNTVSSADSKGEDITPSAKRKNKDDGSHTSIPLEDTPSTLTNKGVSSQSRVEQDKATSFVSVKSDDIQLSIRMPSGNRLEIKLTKQDVLRKVKNFVDENQGNGLGSYDLSLVYPKRVFSEQDMEATLSELGIQNRHAMIVVPHRQSGQVSRRHSSASYDMGVNSGADDVGGNSGAGGYFGYLRTVLSYVNPLSYLRGNTNSSNTELQSNEGLRQLRHGSGPWSEPRPLGNRGHEVTDADSANTLRRRPRPFGANIHTLGSEDHGPSDERNVFWNGNSTEFGGDDRK

SEQ ID NO: 51337 - protein, 181 aa, Zea mays
PKDEEIPHGFIFATFMLSSMLGSSIASRLLARKLKVEGYMQIVFSVSAFSLFLPVVTNFLVPPSGEKGGSISLGGCLQLLGFCTFESCVGIFWPSIMKMRSQYIPEEARSTIMNFFRIPLNLFVCVVLYNVNAFPITVMFGMCSIFLLMAAVLQRRLMAVSDLHRSTKAVMMTAEDEPLNP

SEQ ID NO: 51338 - protein, 261 aa, Vicia faba
MATAPTPREEFVYMAKLAEQAERYEEMVEFMEKVTAAVESEELTVEERNLLSVAYKNVIGARRASWRIISSIEQKEESRGNDEHVSVIRDYRSKIETELSNICNGILKLLDSRLIPSAALGDSKVFYLKMKGDYHRYLAEFKSGAERKDAAESTLTAYKSAQDIANTELPPTHPIRLGLALNFSVFYYEILNSPDRACGLAKQAFDEAIAELDTLGEESYKDSTLIMQLLRDNLTLWTSDMQDDGADEIKEAAPKGNDEPQ

SEQ ID NO: 51339 - protein, 404 aa, Oryza sativa (indica cultivar-group)
MPTSNNEENAPDRISRLPDGLLRFVMLYLTAQEAVQTCVLSRRWQNVWSSTKWLKADAAKFSSMKSFKKFVDNLLLYRKPVPLDALWILATCNRSDDSLDYSDIHPWIRHALRSNAWALGIMEHCGTNLLSIDGYPFPFTSVYLSILHVCHFIIDDSFVKNLSSCCPVLEDLELKNCAIIVTMFSSTTLKNLLINSTETTEHFPPKFEHLMIDMPNLVTLHLDEIPNRNIQLVDVSSVKKATFYFFELSFQNSAVDCNIIPALSNVTSLELVSPTAYEDVVPNVLIRSFPRCKTFSNLKYLKLGEWFLRDGCYPLLFLLRCSPNIEKLHLQLNKYGSDDYEDYPDAAAAIDPTRRETEEMFNCVKLRKITIFYPQGDERVHIIVRILIANISPLPAIKIKPIPV

SEQ ID NO: 51340 - protein, 408 aa, Clostridium acetobutylicum ATCC 824
MKKKFSRLLFIFSIVGPGLITANAGNDAGGVTTYSVIGSKYGYSMLWGLFAIGIGLAVVQEMNARMAVVTGKGLSDLIRERYGVKLAFFAMLVLMIANLGVCIADFAGIAASLQLFNINKYISVPILAIMIWIIMTKGNYSKAEKVFLLLTLTFFGYVITAFMLKPNWSNVFSHISNPGGTLSKNYWLDLIGMVGTTITPYMQFYLQSSIVDKGISLKEYGYEKLDVYLGTVWGILTALFITICTSETLFKAHMAISSAQDAAAALKPLAGQYSFVLFGVGLFGASFLACCIIPLSTSYAVCEAFGFESGLDNKIKEAPVFFGLFFFMIITSVIIVLMPNISLISIILFTQQLAGVLCPVVLIFMIKLVNDKEIMGKHTNNRLQNFIAKFTIGLIIILTILAFAGNFV

SEQ ID NO: 51341 - protein, 142 aa, Triticum aestivum
VLLLPPPLLIHLPSPEHPFSRPRPKPIKFGEIIGILNKQFIEEAEKVKVLPDLKPGDIIELRMQRPNKRRLSLFKGIIIAKHKSGVHTTIRVRRIIAGVGVEITFPIYSPRIKEIKVIRHKKVRRAKLYYLKYKLPRFSTFK

SEQ ID NO: 51342 - protein, 310 aa, Arabidopsis thaliana
MAATSLVLTCASPLFSSPRVISATKKLTTELSISTAKFRRRCSGNNDEVLLEGMPPEYYDDEWQARQREKTKELRRMQREEEEEEERKIEEYREIGTRLKEFPEQDLRKARKLVSSFIRAAEEVEERIEEAAEKGELDELVLMIIWNRLDLARRDDEKDAIRSLDLLYRRVETEILKRQASPAMKLLNDLLNMHDGFEDDAWLKDCRKRMAETFPREDPFSILMPPGFDIDMHQGQLRPPIETETDNTLLRVDFVREVDALLQEVRIEEDATTGSKGEGLDPEAIALKFKQQEKQRTIRQIEAILDLAST

SEQ ID NO: 51343 - protein, 545 aa, Acidovorax sp. JS42
MLGLMQSQPLLISSLISFAERHHGDGEIVSRRVEGDIHRYTYRDLARRSRQLANALDALGLQFSDRVASLAWNGYRHMEMYFGVSGSGRVLHTINPRLHPDQIAWIVNHAEDQVLCFDMTFLPLVQAVHAKCPTVKKWVALCDSDKLPADSGIPGLTSYEDWIGGASAEYQWPTFDENSASSMCYTSGTTGNPKAALYSHRSTTLHAYAAALPDVMNLSARDAVLPVVPMFHVNAWGIPYSAALTGCKVVFPGPALDGKSVHDLIEAEGVTFAAGVPTVWQMLLNHVKSAGLKFSTLRRTVIGGSACPPAMITAFQDEYGVSVLHAWGMTEMSPLGTLCTLKNKHLQMGKDEQMHILQKQGRAIYGVDMKIVGADGQEQPWDGKSYGDLLVRGPWILDSYYKGESPLVKDEQGRGWFPTGDVATIDPDGFMQITDRSKDVIKSGGEWISSIDIENIAMAHPAVAMAACVGMPHPKWDERPIVVVALRPGAQVTREELLKFYEGKTAKWQIPDDVVFVDAIPLGATGKMLKTRLREQLAGYQLPGL

SEQ ID NO: 51344 - protein, 236 aa, Clostridium tetani E88
MIYMIIIGSIISLVGTAIGGLVGIMFKNPSEKALGSLLGFAGGLMLAVVVFDLIPEALTNWNFIYTIIFCILGIIFIAFVDKNMNNEYIDEHKKMAIITALGLMLHNFPEGMIMGCGFAAGTNLGIKMSVVIAIHDIPEGMAVATPLMASKENSFKIFLYTVLTALPTALGAIIGAFMGQVSNNLLGANLSLASGIMLYVVCGEMLPQSNKLWEGVSSTIGVLSGLIFGLIIVYLL

SEQ ID NO: 51345 - protein, 345 aa, Brassica napus
  misc_feature (154)..(154): Xaa can be any naturally occurring amino acid
MPATAGRVRMPANNRVHSSAALQTHGIWQSAIGYDPYAPTAKEEPKTTQQKTDDPENSYASFQGLLALARITGSNNDEARGSCKKCGRVGHLTYQCRNFLSTKEDKEKDGGEIEAAVMAGLEKVRRCAGRGEVEEVESSEEEEESESEDSDVDXENDNIIAERYGKKKKGSGSSSSVQKKKKKRDESESDSDPGNPIGRGATGGGGYGTGGGYGGGATGGTYGTGGEGYGAGTGALGAGVGGRHHGQEQLHKESGGGGLGGMLHRSGSGSSSSSEDDGQGGRRKKKGITDKIKEKLPGHHDQSGQSQGMGMGTTTGYDEGGYTGERHEKKGMMEKKKKKKKKKTC

SEQ ID NO: 51346 - protein, 213 aa, Yarrowia lipolytica CLIB122
MQVFEWAFGKRQTPQEKLRKHQRALERTQRELDRERVKLEGQEKKLIADIKKSAKAGQTGACKVMAKDLVRTRSYIQKFYQMKTQLQAISLRIQTVRSNEQMMQSMKGATRLLQGMNKSMNLPQLTRIAMEFERENDIMDQRQEMMDDSIDDAMEDDEVESEDIVNQVLDEIGIDLGQSMGAVPDGIQGQQERVAVAEGGDDDLEARLGALRR

SEQ ID NO: 51347 - protein, 513 aa, Francisella tularensis subsp. tularensis SCHU S4
MKTIMIKTTSSSGEDYYKNIFSAICDKDGFMTKTDILDILVESGISNDDPRITKLIAKLNKFCDIDKIDFDTFQEITFENIGLIEKAINKGFIIPNFKDFKKEIEAIYNETKKNETGRNANYIPQLARVDPNLFAVAFCSVDGQIITLGDYLQPYCVQSTAKTITYCIATEENGEDKVHQHVGREPSGITFNAIALNKYDLPHNPMINSGAIMMCSLIKPEWNLADRFEYITNVWQDLAGGEPIGFDNAVYHSEKETADRNYALAHFMKEVGAFPEGTNIHTALDFYFQTCSIQVNAKKMAKIMASIANGGVCPFTSKKIFSPTTIRNCLSMMYSCGMYDFSGEYAFSVGLPAKSGVSGALAIAIPNVGGFAIFSPRLDPNHNSVRGVEFSKRLIEKFSFHNYDHITHCDKINPVENRMVVESNLTFELIWAASAGDLSEIKRAVALGVDINKGDYDKRTALHLAAAEGHEDIVKYLIRKGADINAIDRWGKKPLDDAIMNNNISIIELLDRT

SEQ ID NO: 51348 - protein, 163 aa, Triticum aestivum
  misc_feature (106)..(106): Xaa can be any naturally occurring amino acid
  misc_feature (113)..(113): Xaa can be any naturally occurring amino acid
  misc_feature (131)..(131): Xaa can be any naturally occurring amino acid
SGLPKTAQEKIKLLGRSATQNESDAYHEGEKNDADESSPMLAPKQTDQPKDQPVNNNPANPTPSSRHARSTPPASKSIQKNKSGGGEAILSNVAPSIKPRGGCDTXKHQLSNXETPSTSKPTPNASASSRXSNLSPVTHDHITSVLLALAPVTPPTSISTSQS

SEQ ID NO: 51349 - protein, 3487 aa, Microcystis aeruginosa PCC 7806
MVESIDYKKLMATTLSKMEVMQARINELETRQSESIAVVGMACRFPGGINSPEKYWSFCQAGLDAIVEVPKSRWDISKLYSQKPTLGKMNTAYGGFLQENITEFDARFFSISAKEAASMDPQQRLLLEVAWEALENANLPLKNLADNKVGVFVGITSIDHALKVYGTNYDQIDSFFGSGNALSAAAGRLSYFLNLHGPCLSIDTACASSLVAVHQGIRSLRNRECELALVGGVNLILEPAITISLSQSGMMSPDGRCKTFDASANGYVRGEGCGVLILKTLSEAQKNGDHILALLRGSAVNHNGAAAGLTVPSGPAQQELLRQALADARIVPEDVSYIEAHGTGTSLGDPIELNAIASVYGKRSDPLYVASVKTNIGHLEAAAGMAGIIKTILILQQGEIPPHLHFQSPNPLINWQDHPIEIPTQNIPWPNNNKVPIAGVSSFGFSGTNAHVIVQQAPVSKISEIQQQIPSHLLTLSAHNKTALKELAKRFHTLLESHPEIGDICYSAAVGRIDLPERLAIVGDTCPELQQRLAAFAEENPLDDLTFYQRFTSEKSPKIVFLFTGQGACYPGMGHQLYQTQPTFRQYIDQCAEILSKYLDHPLTEILFGEQTDLLNQTAYAQPAIFALEYSLTMLWKSWGITPTLLIGHSVGEYVAACIAGVFSLEAGLALVVKRGQLMQTTTSGKMASIFADEETVIYLIKNYTQTVSIAAINHPQQIVIAGESASIEEVISTCKKQKIPAQYLPVTQAFHSPLMEPILKEFEKEARQISYQRPQILLLSGLDGEVLENAPDATYWSKQCREPVRFLSSLITAFNKGYNLFLEVGPRPILAEQGRRYKDEVIWLSSLNRGLDNWQTILSALAQLYLNGAPFNPEQFNQNYGYKKVRLPNYPFQRKPFQFQPNPRTENQSIDKIFLDSQTSNLTDTETTVFNMQKHQQEIRNQLKSILALLLKEDENDLPEDETLLNLGADSIILTDFSRKVEEKFQVKVKIDQLFTDLQTLVDIAEYLCQFVKEKPLENTSEITTKVIDDETELSNYLQVIEQLQPIATAYIIKALESLGKKLNQGEQWTIENLRQTLPVARKYHILLNRYLQDLEEANILHNQGNIWTVKNLPESFSLPQALQKLEKTCPSAKPELEMLQRCGENLAEVLKGNIDPLTLIFPEGSVAHAESIYGNSPVSRLMNQRVAQAINQILTNFSNSDHPYQILEIGGGTGATSEAILNHLNLDHITYSFSEASPFLLHQARQKFQKKYNLNFHQLDIEKSPISQGIPARNYHIVVAANVLHATRNITETLTHIRELLRPGGYLVLLETVENNSWLNLTFGLTPGWWRFQDQQLRSDTPLLRGENWCSVLKSCGFATANSFSKQNNIPINNGQELILACVPDEPLSIPSIPKFTVFGESSGKEALMMAQLQSLKDLKDLHEKTIIKQLEVLQTATVSPSIAPEILTNQTQIIPTQSSKTETYLPVSQEKPKSPEKPSSPNLNPLALKLTENKSLTEQQQAFIQNLQSIYNQKTAKSKAYSQNSRKTMVDVKPTIDFRMALKEFQYPIVSESAQGAYFKDIDGNNYIDLAMGFGVNFFGHSPDFVIEAVQEQMNRGIGLGMQSNLAAETAALISEMGRVERVAFSNTGTEAIMAAVRIARSRTKRQKIVMFAGSYHGTFDGILARVGEDKTTTQPLSLGTPLGMVEDIIVLSYGVEESLDIIATHADDLAAVLVEPVQSRKPDLQPQEFLQKLRQITHKKGITLIFDEIITGFRIAPGGAQEWFNVEADIVIYGKAIGGGLPISMICGKADFLDTVDGGFWQYGDDSHPQTELTAFGGTFCRHPLALAACRAVLLHLRENSPTIQEKVNQLTHRLATEVNQFFQEIGIPIRVVNFGSLFRFEPFGAYSIFLQPIELPLFYYLLNLKGIYTWEKRVCFLSTCHTNEDIDRVIVAVKEAITELQQAGFFANAKRPQVKKEEKKPLSEDEDGRGHLPSLNQSFPTSEAQRQLWLLAELDRNASASYNVTTSLELLGSLDVYILEKTINQVINRHEALRTKIIEQGELQEVVNEVNIKLNLIDFKDEDNPEATALALRSQFSQKPFDLSIAPLFAVILMRLKSDHYLLSLKTHHIVADGWSLGLILQEIGQLYSSQNNTTKEVLTPPMQFRQYLTLRAQETQSPQMLEHRDFWLKTYQEELPTFELATDFPRPAVKTYTGGQESQVIPSEVGQNLQKVGRKNKATLFMTMFAAYTAFLRRISGHKDLVIGIPISGRQIEGSDNLVGFCSQFLPLRIQVDATTSFIEHLQHTKQTLIDAFRHQSYTLEDLLAALQLPRDFSRSPLISVSFNMDPSLTLPEFKDLKVSLPPSPIGYTPFDLGFNLIELNDNLIIYCNYNTELFKKETIKQFIESFEILLRGIIDDANHLLYQLPLLTPVQQEKLLRQLTGKTRKLPEKATIIDDFIAQVKLTPNTPALIAGKISLSYQELNEKVNRLTHYLQQEYQLGVGKVIGVMLQRNHYLIIGILATFKTGATYVPIDSQYPHSRIEFILKDSGCHVCLTESNFISKLPEKMEKICLDKIDPIVEKYDKDEPKIFRNSSQTAYIFYTSGSTGNPKGVMGRHISILNVIQSLRLTFDLDKHPEWRYIFTAAVTHDPSIRNIFLPLTIGASLYMYEIKYIGHLVSFLQENQINALHTTPSIYREILGLLEPGETISSLKYISVGGEKLDRETALALRKRFPAEIISNVYGSTETCVGVSQYEIKENLDSEIPLGQVFHNNRLGVLDEFNNPVPLHVIGEICVEGAALASGYHNQPEMTQEKFKPSFLDETKTLFRTGDLGKQTAPGIIEFMGRKDNQVKVNGYRIDPGEIEYQLTRYAPIERAIVLPVQVNNQTQLSAYCQTDKTLEIAEIRELLAKFLPVYMIPSYFIFLKQFPLTRHGKLDLHSLRELRETGKSLVNSNYVAPRNYLESNLVSIWEKILSKHPIGIFDNFFEIGGHSLLLSRVVTRVHKELNVSVKLADFFKVPTIAGLATLISQTQYNYQEPISAIPPQKSYPMSHGQRRLWALEFLDQNHNAYGMPSAYQFKGNLNIDAFENAFQQLIQRHEILRTTFTLINNQPRQVVHNQMNFVIKQIDLTAYVSTEQENLIEESISHNAKTTFDLEVGPLLKVNLLKLSQENYIVLFNMHHIIFDGWSAGVLIKDFLTHYHAYGQENSQLMPPLRIHYKDYTSWQESQLETLKLQSQRDYWLAKLTPVPVRLNLPVDYPRPPVKSFQGNTITWQPEPELIDTFEKLVKAQEASLFMGLVSLVKSFLFRYTEQNEITIGSAIAGRNHPDLEDQIGFYVNTLVLRDQITDHDSFTDVLSKVKTTTLEAYDHQDYPFDQIVSDLNLQRDPSRNALFDVAIVLQNNQNVDLALDGITVNSIDPKMITAKFDLEFIFVEEEELYLKLIYNTDIFIHERILLLIDLFKNWLEQVLKFAHEPLINLSLASSENLIQEGQDMFTEDFNF

SEQ ID NO: 51350 - protein, 125 aa, Oryza sativa (japonica cultivar-group)
MARLIASSSSSAAVCFVVLLIIAMAMAAAATVSPSAADKCEKDLDLLMGSCEGYLRFPAEAKAAPSRACCGAVRRVDVGCLCGMVTPEVEQYVCMDKAVYVAAYCHRPLLPGSYCGSYHVPGPVV

SEQ ID NO: 51351 - protein, 1464 aa, Coccidioides immitis RS
MSLVGNFGANDNRGAESAKDGVSSVVTREEEVHQLARQFTEQSTYSTTVQNRFAADPGSALDPNGDNFNARAWCKAMLRMHTEDNQAHPLRTLGVAFSNLNVHGFSSDADYQKSVGNVWLETLSLARKFISQRQRKIKILQSLDGLVEAGEMLAVLGPPGSGCSTFLKTIAGETYGLIVDKTSNINYQGVSAKQMANEFRGEGIYTAEVDVHFPKLTVGDTLFFAARARVPRHIPGGATVNQYATHMRDVIMAIFGISHTKNTIVGNDFVRGVSGGERKRVSIAEACLSMAPLQCWDNSTRGLDSANAIEFCKTLRMQTDINDTTACVSLYQAPQAAYDNFDKVLVLYEGRQIYFGRTTTAKQYFLDMGFACPDRQTDADFLTSMTSHLERVVQPGYEARVPRTPDEFAARWKASAERAQLVKDIEAYNAKFALGGEYLDKFKQSRRAQQAKAQRVSSPYTLSYVQQVKLCLWRGFKRLKPDPSITISSLVGNSIMALVIASIFYDLKADTNSFFQRSALLFFAVLMNAFGSGLEMLTLYAQRGIVEKHSRYALYHPSAEAFASMLMDLPYKTLNTITYNLVLYFMTNLRREPGAFFFFVFTSFILTLTMSMFFRSIASLTRTLVQALVPAAILILGLSMYTGFTIPTQYMLGWARWIAYINPISYGFESLMINEFHNRDFACVNYVPSGPGYAGIGPNNHVCSTVGSVPGQPYVNGDSYIESSYGYTASHKWRNVGIIFAFMFILMIVYLVATELVTEKKPKGEILVFRRGHKALKKSKSEDDVESGSGRSVVVEKSQSDDIAIIERQTAIFQWKDVCYDIKVGKEHRRILDHVDGWVKPGTLTALMGVSGAGKTTLLDVLATRTTMGVITGEILVDGKPRDESFQRKTGYAQQQDLHLNTSTVREALTFSALLRQPAHVPRQEKIDYVTEVIKLLEMTEYADAIIGVPGDGLNVEQRKRLTIGVELAARPALLLFLDEPTSGLDSQTSWAILDLLDKLKKNGQAILCTIHQPSAILFQRFDRLLFLQAGGRIVYYGDIGENSQILIDYFVRNGGPPCPPAANPAEWMLDVIGAAPGSHTDIDWYDTWRNSPEYRRVQEHLAKLKLESSQQVGLARTLSGQKREDKASYREFAAPFGAQLCEVQTRVFQQIWRSPTYIYSKTALCVSSSLFVGFSLFNTPNTIQGLQNQMFAIFMLLTLFGQLIQQIMPHFVAQRALYEARERLSKTYSWKAFMISNIVVELPWNSLMSVLMFICWYYPIGLNHNAEPTDSVTLRGVQMWLFIWTFLLFSSTFAHFMIAAFETAENAGNTGNLLFMLCLLFCGVLATPNQLPGFWIFMYRVSPFTYLVSGMLSVGISNTEVTCAPNEYLRFDPLNGTCGEYMEAYKATMGGYIENELATSNCNFCPISDTNVFLSSVSANYSDVWRNFGIMWVYIIFNIFAACALYWWVRVPKAKKPVAAKTN

SEQ ID NO: 51352 - protein, 260 aa, Solanum lycopersicum
MADSSREENVYLAKLAEQAERYEEMIEFMEKVAKTADVEELTVEERNLLSVAYKNVIGARRASWRIISSIEQKEESRGNEDHVNTIKEYRSKIEADLSKICDGILSLLESNLIPSASTAESKVFHLKMKGDYHRYLAEFKTGTERKEAAENTLLAYKSAQDIALAELAPTHPIRLGLALNFSVFYYEILNSPDRACNLAKQAFDEAISELDTLGEESYKDSTLIMQLLRDNLTLWTSDNADDVGDDIKEASKPESGEGQQ

SEQ ID NO: 51353 - protein, 464 aa, Bordetella bronchiseptica RB50
MHRNTTRCTIALPGGSILKLQSLDDFLRRVAARDPQQAEFMQAVQEVMLSLWPFIEKHPHYAEHALLERLVEPERVIQFRVCWTDDQGQAQVNRAFRIQHSSAIGPFKGGMRFHPTVNLSVLKFLAFEQTLKNALTTLPMGGGKGGSDFDPKGKSDAEVMRFCQALMLELHRHLGPDTDVPAGDIGVGAREVGFMAGMMKKLSNSAASVFTGKGLCFGGSLIRPEATGYGTVYFAQEMLQRAGLSFDGMRVSVSGSGNVAQYAIEKAMALGAKVVTISDSCGTVIDEAGFTHEKLLALMHIKNDLRGRLDTYASQFGLRYEAGVRPWHVPVDVALPCATQNELDENDARTLIRNGVKCVAEGANMPATLDAAKAFIAAEVLYAPGKASNAGGVAVSGLEMSQNSARLPWTREQVDARLHAIMRDIHENCVRHGHGAGNYVNYVDGANIAGFVKVADAMRQQGLY

SEQ ID NO: 51354 - protein, 260 aa, Oenothera elata subsp. hookeri
MATAPSPREENVYLAKLAEQAERYEEMVEFMEKVCAAADSEELTVEERNLLSVAYKNVIGARRASWRIISSIEQKEESRGNDDHVSTIRDYRSKIETELSNICGGILKLLDSRLIPSAASGDSKVFYLKMKGDYHRYLAEFKTGAERKEAAESTLSAYKAAQDIANAELAPTHPIRLGLALNFSVFYYEILNSPDRACNLANEAFDEAIAELDTLEEESYKDSTLIMQLLRDNLTLWTSDMQDDGGDEIKEAAPKPDEQY

SEQ ID NO: 51355 - protein, 414 aa, Yersinia pestis CO92
MEQPSPVTRQSFDEWIVPTYAPADFIVVRGEGSTLWDQQGKSYIDFAGGIAVNALGHGHPAVRAALIEQADKVWHLGNGYTNEPVLRLAKQLIDATFAEKVFFCNSGAEANEAALKLARKYALDNFANKAGQQGEKNQIVAFRNAFHGRTLFTVSAGGQPKYSQDFAPLPGGIHHGIFNDLASAEHLITDQTCAVIVEPIQGEGGVLPADKEFLHGLRALCDRHNALLIFDEIQTGVGRTGELYAYMHYGVSPDVLTSAKALGGGFPIGAMLTTTKYASALSVGSHGTTFGGNPLACAVAGTVLSLINQPTLLAGVKARHQWFIDELAEINARHNVFAEIRGRGLLIGCVLNAQYAGKSKEIVQAAAQYGLIALIAGPDVVRFAPSLIISPKEIKEGLARLAMGIEQVCQKVTS

SEQ ID NO: 51356 - protein, 260 aa, Pisum sativum
MAAAHTPREENVYMAKLAEQAERYEEMVEFMEKVSANADSEELTVEERNLLSVAYKNVIGARRASWRIISSIEQKEESRGNEDHVAVIRDYRSKIESELSNICDGILKLLDTRLIPSASSGDSKVFYLKMKGDYHRYLAEFKTGAERKEAAESTLTGYKSAQDIANAELPPTHPIRLGLALNFSVFYYEILNSPDRACNLAKQAFDEAIAELDTLGEESYKDSTLIMQLLRDNLTLWTSDMQDDGADEIKEAAPKADEQQ

SEQ ID NO: 51357 - protein, 510 aa, Oryza sativa (indica cultivar-group)
MASAALPEAVAPKKKGNVRFAFACAILASMTSILLGYDIGVMSGASLYIKKDFNISDGKVEVLMGILNLYSLIGSFAAGRTSDWIGRRYTIVFAAVIFFAGAFLMGFAVNYAMLMFGRFVAGIGVGYALMIAPVYTAEVSPASARGFLTSFPEVFINFGILLGYVSNYAFSRLPLNLGWRIMLGIGAAPSVLLALMVLGMPESPRWLVMKGRLADAKVVLEKTSDTAEEAAERLADIKAAAGIPEELDGDVVTVPKRGSGNEKRVWKELILSPTPAMRRILLSGIGIHFFQQASGIDSVVLYSPRVFKSAGITDDNHLLGTTCAVGVTKTLFILVATFFLDRVGRRPLLLSSTGGMILSLIGLGAGLTVVGQHPDAKIPWAIGLSIASTLAYVAFFSIGLGPITWVYSSEIFPLQVRALGCSLGVAANRVTSGVISMTFLSLSKAITIGGSFFLYSGIAALAWVFFYTYLPETRGRTLEEMSKLFGDTAAASESDEPAKEKKKVEMAATN

SEQ ID NO: 51358 - protein, 119 aa, Zea mays
  misc_feature (53)..(53): Xaa can be any naturally occurring amino acid
  misc_feature (60)..(60): Xaa can be any naturally occurring amino acid
HAFVHASGGVLPLPVLDHSVQACIVTGYWEDVASFKPLFAALLPLAVHPSQLXFYDPREXWVSGPRCSPATHWDTCTILCAFISYGCLLLRRLVHLSVLGVWSRVLSGCDLGDFAVMGA

SEQ ID NO: 51359 - protein, 502 aa, Oryza sativa (indica cultivar-group)
MAVDPKKKNASYAFTCAILASMASIILGYDIGVMSGASLYIKKDLKITDVQVEILMGILNIYSLVGSFAAGRTADWIGRRFTVVFAAAFFFAGALLMGFSGDYATLMVGRFVAGVGVGYAIMIAPVYTAEISPASSRGFLTSFPEVSINLGILLGYVSNYAFARLPLSLGWRVMLGVGAAPSVLLALMVLGMPESPRWLVMKGRLADAKAVLEKIADTPEEASERLADIKAAAGIPDDLDGDVVTVSKKRGGEEGQVWRELVVSPTPAMRRIVLAAVGLHFFQQASGVDSVVLYSPRVFQSAGITGDDQLLGTTCAVGVAKTVFILVAAFLLDRAGRRPLLLTSTGGMVFSLVGLATGLTVVGRSPDAQVPSWAVGLCVASILAYVAFFSVGLGPMSGVYTSEIFPLRARALGFAVAVACNRVTSGVISMTFLSLSSAITIGGSFFLYAAISSLAWVFFFTRLPETRGQTLEEIGKVFGMDDTAMEAEDSAAYRERLLATSP

SEQ ID NO: 51360 - protein, 577 aa, Aspergillus nidulans FGSC A4
MTASLSAQWSSLVHPVCDKGRPGELLAAVAVADGAVERFPIEEGGRKKIDRDTRDSGGHSVLKRILRRSTLSRPMTYRPLGIAGAPYNTFDGPGYPACNEVAAVHSPTSVDEIQSLVQDAIQAGQKVRASGKAHMWYDTMCSDDPNTVIIQTENVNNIHDLDLEAGTVMIEAGVTFLQLAEYLHERGASAGYTLVNWNITLAGCVAMGAHRSSIREDSMVAAGVLALDIIDGEGNLRHLERDDSDEWLAASTSLGLLGVIARMKFKIYPDFKVYADQKTLDEAEVFDGDIYGMIAPYATANFWWWPYKRKFHWRYYDVVENSINEQQGFQNTFSVTGVEAAAIKVLWNSGRWLATSNMLAEEILFGQWEAPNFREKTTNKAIDTWPVYGWNYDVLIGGLYPDQKPVWEYGLSGYTLELAFPVTQANAVLKRARELFDAELKKGLVMTSTYRSGINIKFGRPYYDLLGQVTYNTSDGADWSKGAIMFDFPSFKPTVGDGSRFNEPFSLSKQAADGTLEKALIEEFPCRPHWTKNTREVFQLAKKNLDPDHIARFKAIREKFDPNGVYRSVVGEIIGVY

SEQ ID NO: 51361 - protein, 590 aa, Triticum aestivum
  misc_feature (160)..(160): Xaa can be any naturally occurring amino acid
  misc_feature (496)..(496): Xaa can be any naturally occurring amino acid
  misc_feature (530)..(530): Xaa can be any naturally occurring amino acid
  misc_feature (535)..(535): Xaa can be any naturally occurring amino acid
  misc_feature (557)..(557): Xaa can be any naturally occurring amino acid
  misc_feature (578)..(578): Xaa can be any naturally occurring amino acid
MASFARQEHQFLAELGLAPRNPGSFACGAWGGSGPVVTTTNPSNNEVIAEVVEASMDDYEKGMSACFDAAKTWMAVSSTGSKCPLASQQFGPHDDVANNMLLLCFPRYHQMLGDSSPLQLLSFQEVCSITVHELVEALWALILIREQEIDGQIGDALRAXLHHLGRLLSLEMGKILPEGIGEVQEIIDMCDYAVGLSRQLNGSIIPSERPNHMMMEVWNPLGVVGVITAFNFPCAVLGWNACIALVCGNCVVWKGAPTTPLITIAMTKIVASVFEKNNLPSAIFTAFCGGAEIGQAIALDTRIPLVSFTGSTKVGQMVQQQVSARFGKCLLELSGNNAIIVMDDADIPLAVRSVLFAAVGTAGQRCTTCRRLLLHESIYQTFLDQLVEVYKQVRIGDPMEKGTLLGPLHTTASKESFLKGIQNIRSQGGKILLGGSAIESEGNFVQPTIVEISPAAPVVREELFGPVLYAMKFQVVNNPDLCVIHLLYMALISLSXAYVPWLSIILQTLKEAIEINNSVPQGLSSSIFTXEPDAXFKWIGPHGSDCGIVNVNIPTNXAEIGGALGGKKATGGGQEQEXPWKQYMRRATVN

SEQ ID NO: 51362 - protein, 445 aa, Glycine max
MATIKAVKARQIFDSRGNPTVEVDVILSDGTFHRAAVPSGASTGVYEALELRDGGSDYLGKGVLKAVENVNSIIAPALLGKDPTKQTEIDNFMVQQLDGTVNEWGWCKQKLGANAILAVSLAVCKAGAAVKKIPLYKHIANLAGNKTLVLPVPSFNVINGGSHAGNKLAMQEFMILPVGASSFKEAMKMGVEVYHHLKAVIKKKYGQDATNVGDEGGFAPNIQENKEGLELLKTAIAKAGYTGKVVIGMDVAASEFYDNKDKTYDLNFKEENNDGSQKISGDSLKNVYKSYVTDYPIVSIEDPFDQDDWEHYAKLTAEVGQQVQIVGDDLLVTNPKRVEKAIKEKACNALLLKVNQIGSVTESIEAVRMSKQAGWGVMASHRSGETEDTFIADLSVGLATGQIKTGAPCRSERLAKYNQLLRIEEELGSAAVYAGAKFRAPVEPY

SEQ ID NO: 51363 - protein, 251 aa, Coprinopsis cinerea okayama7#130
MTRSFFVGGNWKLNPTSLSAAKALVEALNKADLDPSTEVVVAPPALYLLPIQEIAGKAVKVAAQNAYFKESGAFTGEISPKQISDAGIPYVILGHSERRTLFHETSEVVALKTRAALDNGLKVILCIGETLKEREEGRTAAVCEEQLSAVVKQLKEEDWSNIVIAYEPVWAIGTGKVATTSQAQETHVDVRKYLATAVSPKVASETRVIYGGSVNAANSKDLASQQDIDGFLVGGASLKPEFVDIINARKA

SEQ ID NO: 51364 - protein, 206 aa, Saccharomyces cerevisiae
MNSEYDYLFKLLLIGNSGVGKSCLLLRFSDDTYTNDYISTIGVDFKIKTVELDGKTVKLQIWDTAGQERFRTITSSYYRGSHGIIIVYDVTDQESFNGVKMWLQEIDRYATSTVLKLLVGNKCDLKDKRVVEYDVAKEFADANKMPFLETSALDSTNVEDAFLTMARQIKESMSQQNLNETTQKKEDKGNVNLKGQSLTNTGGCCC

SEQ ID NO: 51365 - protein, 467 aa, Oryza sativa (indica cultivar-group)
MGVWREGAGCSILDLTIVGLDPAENETTLQAQQPHYLKTCCKPSLDHGSVVYLLGHTGKKELVIGEGKVVIGTDNLLKLSTDGVTWCPGSAGFDAQGNLAFMICDPMKLASSPTTRSSSTSSSSSHSSKKDHPMQFGVPISVVCDWLYQHWQGNLDEVSKPKLPLVRLMSSRSDHSSTSFTRCHVFKPADDENDDTSVSSQVTSKPKHQQASGSSANARISHDANPLVDLRANNEQGVSTPEIYESPRQSSCQGQKDAGSVQLLDINFPPSAPKTIFLPLPLKQMLSDENNADTSKPRNQSRDNGFPSGIIWHRNCEALSRDPPVAPLQDDCSSEGQSSSSPVELLEYRNEDHFSSEEETMYSAETMESRNIPSPREKHVGRSQSCVTYRRWSSPRMSTIQNGTLRKQHTLVPVRKSHSQNTSLPQRSHDYLSPTVSSAMKKRNSMEQQLPTKPRRSIAQTSPKWMF

SEQ ID NO: 51366 - protein, 795 aa, Vibrio vulnificus CMCP6
MKFSESWLREWVNPAVTTDELTHQITMAGLEVDDVLPVAGTFNGVKVGHVVECGQHPDADKLRVTKVDVGEEELLDIVCGAANCRQGLKVAVATVGAVLPGDFKIKKAKLRGQPSHGMLCSFTELGIDVESDGIMELAIDAPIGMDFRDFLALNDVTVDVDLTSNRADCFSIRGMAREVGVLNRADVTEPSVAPVAPSIDDTVAIEVKAPAACPRYLGRVVKNVNVQAKTPLWMQEKLRRCGIRSIDPVVDITNFVLLEQGQPMHAFDLAKIDGGIVVRLAEQGEKITLLDGSEAELNADTLVVADHNKALAIAGIFGGEESGVTSETKDVLLECAFFAPDHIRGRARSYGLHTDSSMRFERGVDYALQVSAMERATALLVEICGGEVAPVVAVESEAELPKPNKVALRRTKLDNLLGHHIADSDVVEILERLGMTVETTAEGWVAVAPTWRFDIAIEQDLVEEVGRIYGYDNIPNQNPAAALKMHDHQEANIPLKRVRDLLVDRGYHEAITYSFVEPEQQKLVVPGVDALILPNPISAEMSAMRLGLIQGLLNTVVHNQKRQQPRVRLFEYGLRFIPCDTAENGMRQEPMLAGVIAGTRSEEHWNIDTNTVDFFDLKGDVEAILELSANDKAYSFVAAKHPALHPGQSAAIVVDGKEIGVIGTVHPELERKFGLNGRTIVFEIEWSAINRKVIPEAVALSKFPANRRDIAVVVDEAVASGDIVNACLEVGGEFLKAAKLFDVYVGKGVEEGKKSLAIALTLQSNERTLEDADIAGAVDAIVTHVSEKFGASLRD

SEQ ID NO: 51367 - protein, 200 aa, Zea mays
LIPRVLTRAQVTLGNILKESGQEGIPVNKTWRLNERHYGSLTGLNKSETAAKYGEAQVQIWRRSFDTPPPPMEPDHPYYNTIVKDPRYAEGPSEAEFPMFESLKLTIARTLPYWNDVIIPQLKEGKSIIIAAHGNSLRGIVKHLDNLSDDAIMALNLPTGIPFVYELDENFKPVVSMKFLGDEETVRKAIESVAAQGKAK

SEQ ID NO: 51368 - protein, 273 aa, Oryza sativa (indica cultivar-group)
MTLSEQLSAPDQAIRDFLKIPHDGLGGGDGEGGRIPAAAGASGGGGGVGGMINWKPLRDRLRLRRAASAWINKYNYSPGEAAAAFSRTFSRTRSLRPTPTFSRATSTRLGATAFSSGSRRAAVDGGGHANEDDDEDHTDDDDDDDEEEQGKDDAPAAQMSLMALLEQSDSQWDSEDEDDQGHGGGGGGGGNGGGGGGGGGARKNGDGDDDEDDGEGREEEMVHVCCVCMVRHKGAAFIPCGHTFCRLCSRELWVSRGNCPLCNGFIQEILDIF

SEQ ID NO: 51369 - protein, 363 aa, Bordetella bronchiseptica RB50
MSSPRTYRIAAIAGDGIGREVMPEGLRVVRAAARRFGLDLDIVTFDWAHCDYYREHGQMMPDDWKAQLAGMDAIYFGAVGWPATVPDHVSLWGSLLKFRREFDQYINLRPVRLFEGVPCPLAGRQPGDIDYLVVRENTEGEYTSAGGVIYEGTEREIVIQESVYSRYGADRVLHYAYALADSRPRRRLTVATKSNGIAISMPWWDKRADAVGQQYPGVAVDKQHIDILSARFVLQPDRFDVVVASNLFGDILSDLGPATTGTIGLAPSANLNPEREFPSLFEPVHGSAPDIYGQNIANPVAMIWSGALMLDFLTEGAGAGRAAHDAIVAAIEQVLAHGPRTRDLGGTASTDAMGEAIAARLAA

SEQ ID NO: 51370 - protein, 428 aa, Zea mays
  misc_feature (171)..(171): Xaa can be any naturally occurring amino acid
MLLSVPIQMALNPSFRFRAKSTDNDAQDWDLQRAIGLMEVGDARNGSAAAALTKGGADDAARKPLPPCCVKAKARVPETEANCHDTVVSGWFTEPRSRFGKTSKVQYFNNPMWPGEAHSLKVEKILFQGKSPYQEILVFESSTYGNVLVLDGIVQLTDKDECAYQEMVTHXFPLCSIPAPKNVLVVGGGDGGVLREIARHDSVETIDICEIDQLVIDVCKEFFPNLSIGFKDPRVRLHVGDAVDFLRNSPEGKYDAIIVDSSDPIGPAQGTRWRKLFIQTIARALKPGGVLCNLAESMWLHTHLIQDMLAICRQTFKGAVHYAWTSVPTYPSGVIGFLLCAKEGRAVNFLTPVNPIEKIEGTTKAGRELRFYNSEIHRAAFVLPTFVRRELEAYTTPSTSAENEKPKESVSEPQKIKILSNNAILTAS

SEQ ID NO: 51371 - protein, 1015 aa, Aquifex aeolicus VF5
  misc_feature (199)..(199): Xaa can be any naturally occurring amino acid
MNYMDISRRGFLKLSVGSVGAGILGGLGFDLTPAYARVRDLKITKAKVTKSICPYCSVSCGILAYSLSDGAMNVKERIIHVEGNPDDPINRGTLCPKGATLRDFVNAPDRLTKPLYRPAGSTEWKEISWDEAIEKFARWVKDTRDRTFIHKDKAGRVVNRCDSIVWAVGSPLGNEEGWLMVKIGIALGLSARETQATIXHAPTVASLAPTFGRGAMTNNWVDISNSDLVFVMGGNPAENHPCGFKWAIKAREKRGAKIICIDPRFNRTAAVADIFVQIRPGTDIAFLGGLINYVLQNEKYQKEYVRLHTTGPFIVREDFGFKDGLFTGYDPKTRSYDTTTWDYEFDPATGYPKMDPEMKHPRCVLNILKEHYSRYTPEVVSQICGCSKEDFLRVAEEVAKCGAPNKFMTILYALGWTHHSYGTQLIRTACMLQLLLGNIGCPGGGINALRGHSNVQGMTDLAGQNKNLPTYIKPPKPEEQTLAQHLKNRTPRKLHPTSLNYWANYPKFFISFLKCMWGDAATPENDFAYDYLYKPEGGYNSWDKFIDDMYKGKIEGVVTAALNFLNNTPNAKKTVRALKNLKWMVVMDPFMIETAQFWKAEGLDPKEVKTEILVLPTAVFLEKEGSFTNSARWVKWKYKATDPPGDAKDEFWIFGRFFMKLKEFYEKEGGAFPEPILNLVWPYKNPYYPTAEEILTEINGYYTRDVDGHKKGERVRLFTDLRDDGSTACGGWLYCGVFPPEGNLAKRTDLSDPLGLGTYPNYAWNWPANRRVLYNRASCDEKGRPWDPERPLLRWDPERDMWVGDIPDYPATAPPEKGIGAFIMLPEGKGRLFAAKSYVTFKDGPLPEHYEPYESPVTNILHPNVPHNPVAKVYKSDLDLLGTPDKFPHVATTYRLTEHYHFWTKHLYGPSLLAPVMFIEIPEELAKEKGIQNGDLVRVSTARASIEAIALVTKRIKPLKVAGKTVYTIGIPIHWGFEGLVKGAITNFITPNVWDPNSRTPEFKGFLANIEKVKT

SEQ ID NO: 51372 - protein, 465 aa, Corynebacterium glutamicum ATCC 13032
MSEQPASIKHYDLIIIGTGSGNSIPGPEFDDKSIAIVEKGAFGGTCLNVGCIPTKMYVYAADIAQEIQESARLGIDATVNSVDWPSIVSRVFDKRIDLIAQGGEAYRRGPETPNIDVYDMHASFVDSKTISTGIAGQEQLISGTDIVIATGSRPYIPEAIAESGARYYTNEDIMRLAQQPESLVIVGGGFIALEFAHVFEALGTKVTILNRSDVLLREADADISAKILELSKKRFDVRLSTAVTAVHNKADGGVKISTDTGDDIEADILLVATGRTPNGNQMNLDAAGIEMNGRSIKVDEFGRTSVEGVWALGDVSSPYKLKHVANAEMRAIKHNLANPNDLQKMPHDFVPSAVFTNPQISQVGMTEQEAREAGLDITVKIQNYSDVAYGWAMEDKDGFVKLIADKDTGKLVGAHIIGAQASTLIQQLITVMAFGIDAREAATKQYWIHPALPEVIENALLGLEF

SEQ ID NO: 51373 - protein, 130 aa, Zea mays
  misc_feature (25)..(25): Xaa can be any naturally occurring amino acid
  misc_feature (46)..(46): Xaa can be any naturally occurring amino acid
  misc_feature (54)..(54): Xaa can be any naturally occurring amino acid
  misc_feature (105)..(105): Xaa can be any naturally occurring amino acid
HPFNRHLSRAYDISSGLAIGDGFCXVLAATQRPGTEGKRQFSGACXMQVRQVNXLFNDAESNDSEEVLILCGDHMFRMDYMDFVQSHIQRGACISICCLPNDDSXRASDFGLVKIDYTGRCISFNEKPKG

SEQ ID NO: 51374 - protein, 975 aa, Bacillus anthracis str. A2012
MVHITIDGKKYTAEPSSTILGVINENGIEHPQICYVPEVDPIQTCDTCIVEVDGKLMRSCSTVVTEGMNIERNSTRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVSINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKGKFGWDFVNSKERITKPLIRKNGTFVESTWEEALNVVANKLGSIKEEYGKDAIGFISSSKITNEDNYVIQKLARQVFETNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHDQQFIDENVNFFEDFKESLTEYTLEYAEEVTGISKETLIQMAEMIRDADGTCILWGMGVTQNTGGSDTSAAISNLLLATGNYRRPGAGAYPLRGHNNVQGACDMGTLPGWLPGYQHVTNDMERAKFEMAYGVKINSEPGLNNIEMLHAIDEGEMKAMYLVGEDMALVDSNANHVHEVLSSLDFFVVQDVFLSKTAQYADVVLPAAPSLEKEGTFTNTERRVQRLYQVLPTLGDAKPDWWIVQAIANKLGANWNYSHPSEIFAEMASLSPLFSQANYEVLEGWNSFHWGSFDGTNTPLLFQDGFNFPDKKARFAIADWVRPAEFPAEFDLHINNGRMLEHFHEGNMTNKSTGIQTKVPGVFVEVSPALAKERGVKTGSLVRLVSPFGALKLRVLVTDRVKANELYLPMNSTDNETAINFLTGPAVDTRTNTPAYKQTKVRMEVLEVDGENPMPKANPRNKKRHPQSGIEVHRKWARPGYVHLTDK

SEQ ID NO: 51375 - protein, 265 aa, Brassica napus
  misc_feature (238)..(238): Xaa can be any naturally occurring amino acid
  misc_feature (245)..(245): Xaa can be any naturally occurring amino acid
MEFILGQALFLLFCFILSCFLIICTTRSRRKSFEAAATPPGPPRLPIIGNIHLVGKNPHHSFANLSKTYGPVMSLKFGSLNTVIITSPEAAREVLRTHDQVLSWRSSTNSIRSINHHEVSVAWLPPSARWRLLRKLSVTLLFSPQRIEATKALRLNKVKELVNFMNESSERDEPVDISRASFITALNIISNILFSVDLGSYDLKNSNEFQDAVIGVMEAIGNPDAANYFPFLGFLDRXGNRKAMXGCLRKVFRVFREFIDAKIAK

SEQ ID NO: 51376 - protein, 721 aa, Thermococcus kodakarensis KOD1
MMYSAMMEVLRMDEKLVPVVCPYCGVGCRLYIRSSDGHPLGIEYANDIPGISNENGKLCPKGNAVLEYVLARDRLKKPLKAKEQGKFVEISWSQAIKEVAERLKEYSKDDPNSMMFFGSAKTFNEPNYLIQKLARMLGTNNVDHCARLCHASTVSGLKAVFGAGAMTNTYRDIEEANVIFIIGHNFAETHPVGFRYVLKAKERGAKVIVADPRFTRTAWFADIYLQHYPGTDIALINGLIHVIIEERLYDEKFVRERCTGFDELAKTVEKFTPGYVEKITGVPADLIVQAARTFATGGKGVITWAMGITQHTHGHDNVRLLATLSAICGYQGREGCGVSPMRGQNNVQGACDLGVLPNVFPGYKAVSDPEGRKFFEEFWGTELSGEVGLTVIEAAHAIEKGKVRAYYVMGENPVISDANTNHVIKALHKLEFMVVQDIVPTPTMEFADIVLPAAAMLENEGSLTNTERRVQWSFQAINPPGEARPDWWIVSEIGKAAGFTGDGPKGFNYSGPEDILREVNACTPQYRGITPERLKANLAGIHWPCPSEDHPGTRVLYKERFLTSDGKAHLAAVEYRGPAETPDEDYPFLLTTVRYVGHYHTLTMTGRSRALVKRWPEPLAEIHPEDAERLGIKTGDWVKIVTRRGEYPIRAKVTRTVKKGVIAVPWHWGANVVTNDALDPVAKIPETKACACKVVKITEEEARELMKKVPPVIPEIEIVRG

SEQ ID NO: 51377 - protein, 390 aa, Gloeobacter violaceus PCC 7421
MKAVCWHGAGDVRVETVPDPAILYPRDAIIKVTSTAICGSDLHLYDGVIPTMQKGDILGHEFMGEVVEVGAAVKNLRKGDRVVVPFTIACGHCHFCERTLWSLCDNSNPNAWMAEKVYGSTSGSGLFGYSHLFGGYAGGQAEYVRVPFADTGPMKVPESLTDEQVLFLTDIFPTGYMAAENCNIQPGDTVAVWGCGPVGQFAIKSAYMLGADRVIGIDRHPKRLKMAKEQGGAEVLNLDEVEVGEALKEMTGGWGPSHCIDAVGLEAHGSGIEGIYDNVMNALKLETDKPAALRQAIVACRKGGTVSIPGVYGGLLDKMPMGAAFAKGLTFKMGQTHVHRYLQPLLERIVQGELDPTFVITHRLKLDDAPEGYRTFRDQKDDCIKVVLKP

SEQ ID NO: 51378 - protein, 373 aa, Haemophilus somnus 2336
MAKRDYYEILGVQKGADDKEIKRAYKRLAMKYHPDRTKGDKESEEKFKEINEAYEVLADKEKRAMYDQYGHAAFEQGGGAGGFGGFSGADFGDIFGDMFGDIFGGGRSRQRVVRGEDLRYDIEISLEEAVKSCKKDIQINTLVHCGTCHGSGAEAGSKIESCPTCHGAGRVRRQQSFFVTEQTCPHCHGTGKKIEKPCHTCHGEGRVHKTQNLTVTIPMGVDTGNQLRLAGKGAAGENGAPAGDLYVVIHVKKHHIFERDGNNLYCEVPISFTMAALGGEVEIPTLDGRLKVKIPAETQTGKLLRLRGKGITSRGYAGDLICEIVIETPIKLNEEQKELLRKLEESLEGKTLQRPKSSGFLDGVKKFFDNLGK

SEQ ID NO: 51379 - protein, 428 aa, Lactobacillus johnsonii NCC 533
MTVYVEKVRALEIFDSRGNPTVEVHAYLSDGTVAKAEVPSGASTGEKEAVELRDGGNRLQGKGVTQAVTNVNGPINDALKGLSPYNQAEIDRTMIKLDGTLNKAKLGANAILGTSMAIARAAARSKDEPLYRYLGGCELEMPQTFHNVINGGKHADNGIDIQEFMITPVAKNSFRDGFEKIVNTYHALKAVIEEAGFETGLGDEGGFAPNLNSSEEALKMLRKAIIKAGYKPRKDIAIAFDAAASSFYNTEDGKYHFEGHIWNGEEMLQYYDKLLKEFPEIISCEDPFDENDWENFEKFTAKFGSTHQVVADDNVCTNPKLVRKAIKDKLCNSILIKLNQIGTITETLETIRLARKNNMTTMVSHRSGETGDTFIADFTVATNAGQLKSGAPARSERVEKYNRLLEIENQIGVENERLNHFPNNVDFD

SEQ ID NO: 51380 - protein, 334 aa, Clostridium acetobutylicum ATCC 824
MAKIAINGFGRIGRLALRRILEVPGLEVVAINDLTDAKMLAHLFKYDSSQGRFNGEIEVKEGAFVVNGKEVKVFAEADPEKLPWGDLGIDVVLECTGFFTKKEKAEAHVRAGAKKVVISAPAGNDLKTIVFNVNNEDLDGTETVISGASCTTNCLAPMAKVLNDKFGIEKGFMTTIHAFTNDQNTLDGPHRKGDLRRARAAAVSIIPNSTGAAKAISQVIPDLAGKLDGNAQRVPVPTGSITELVSVLKKKVTVEEINAAMKEAADESFGYTEDPIVSADVVGINYGSLFDATLTKIVDVNGSQLVKTAAWYDNEMSYTSQLVRTLAYFAKIAK

SEQ ID NO: 51381 - protein, 250 aa, Brassica napus
RPPFFFFFVRKNILRFIIEDTYFPLCVKKAIKNAFLKADYHFADDSSLDISSGTTALAALIFGRRLIIANAGDCRAVLGRRGRAIELSKDHKPNCITEKTRIENLGGVVYDGYLNGQLSVARAIGDWHMKGPRGSACPLTPEPELQETDLSEDDEFLIMGCDGLWDVMSSQCAVTIARKALMIHNDPERCSRELVREAGRVGRRDNLTVVVVCFSPDPPQRIEVRVQSRVRRSISADGLNLLKGVLDGYP

SEQ ID NO: 51382 - protein, 397 aa, Clostridium acetobutylicum ATCC 824
MKFNKKTIEDVDVKGKRVLVRCDFNVPLKDGVITDENRLNGALPTIKYLSEHGGKVILCSHLGKAKGPDPSKTLAPVAKRLSELLGREVKFAADDTVVGENAKKAVAELKEGEIVLLENTRFRPEEGKNDDAFSKDLASLADVYVNDAFGTAHRAHCSTVGVTKFVDTAVCGYLIQKELKFLGSAVENPVRPFVAILGGAKVSDKINVINNLLEKVDTLIIGGGMAYTFLKAQGYTIGTSLLEADKVDYAKEMIEKAEAKGVKLLLPIDNIVGAEFKADTKAVTTEDANIPEGYMGLDIGPKTQKLYADAVKEAKTVVWNGPMGVFEFENFAKGTKDVAKAMAESDATTVIGGGDSAAAVNQLGFGDKMTHISTGGGASLEFLEGKELPGIVALNDK

SEQ ID NO: 51383 - protein, 338 aa, Acidovorax sp. JS42
MPRNQQILLDNRPQGEATVDNFRLVTTDTPALQDGQVLVRHHYLSLDPYMRGRMNDSKSYAASQPLGEVMIGGTVGEVVESRHPAYAVGDKVVGMGGWQEYSVADGNAPGMLRKVDTTHVPLSYYLGAVGMPGVTAWYGLVKIIDPQPGQTLVVSAASGAVGSAFGALAKARGCRVVGIAGGPDKCRYVTDELGFDACVDHRANGDLKSMARALKEACPDGIDGYFENVGGYILDAVLLRANAFARVAVCGMIAGYDGQPLPLQNPALILINRMRVEGFIVSEHMEVWPEALKELGGLAASGKLRPRETIAQGLAAAPEAFLGLLKGKNFGKQLVKLV

SEQ ID NO: 51384 - protein, 379 aa, Chromobacterium violaceum ATCC 12472
MSHDIIRCQAAVAWAAGQPLSIEEIEVHPPKAGEVRVKMVATGVCHTDAFTLSGADPEGVFPCILGHEGGGVVESVGPGVTSVAVGDHVIPLYTPECRECKFCLSGKTNLCQKIRATQGKGLMPDGTSRFSKDGKPIYHYMGTSTFSEYTVLPEISLAKVNKAAPLEEVCLLGCGVTTGMGAVVNTAKVKAGDNVAVFGLGGIGLSAIIGARMAGAGRIIGIDINEGKFELAKKLGATDCVNPNGFDKPIQDVIVEMTDGGVDFSFECIGNVKVMRAALECCHKGWGESVIIGVAGAGQEISTRPFQLVTGRVWRGSAFGGVRGRTELPEYVERYLKGEFRLDDFITHTMPLERVNEAFDLMHEGKSIRSVIHYAAEPA

SEQ ID NO: 51385 - protein, 248 aa, Clostridium acetobutylicum ATCC 824
MRTPIIAGNWKMNNTISESLKLIEELKPLVKDAKAEVVVAPTAVSLETVVNATKGSNIKVAAQNAHFEESGAFTGEISLKALEELGVSYVILGHSERRQYFNETDCALNKKVKAAFAHNITPILCCGETLEEREANVTNEVTGKQIKLDLAGLSAEQAAKVVIAYEPIWAIGTGKTATDEQANETIGAIRKTVEVMFGKEVAEKVRIQYGGSVKPNTIKAQMAKPEIDGALVGGASLKAADFAAIVNF

SEQ ID NO: 51386 - protein, 311 aa, Rhodopseudomonas palustris CGA009
MSNQLLDRVVAEIADEMAQRADRGEVASYIPELARVDPKAFGLAVIGADGHIAAAGDADVPFSIQSISKVFTLTLALGKAGDRLWRRVGREPSGSAFNSIVQLEHERGIPRNPFINAGAIAVTDLILSGHQPREALGEILRFMQFLAGDSSIAIDEAVAKSEQRTGFRNAALANYMKSFGVLDNPVEYTLGVYFHHCAIAMSCRQLAMAGRFLAHNGQNPSTGLNVVSSERARRINALMLTCGHYDGSGEFAYRVGLPGKSGVGGGILAVAPGRASIAVWAPGLDAAGNSHLGRVALEGLTKRMGWSIFGV

SEQ ID NO: 51387 - protein, 551 aa, Rhodopseudomonas palustris CGA009
MYAYDDIDRAIVHERVEEFRDQVSRRLSGELTEDEFKPLRLMNGVYLQLHAYMFRVAIPYGTLSSAQLRKLAHVARTYDRGYGHFTTRQNIQFNWIALKDLPDALADLAEVGIHAMQTSGNCTRNVTADQWAGVAPGEVEDPRVWAEILRQHTALHPEFSFLPRKFKFAITASDHDRAAIKIHDIGLKLVKNDAGETGFEVLVGGGLGRSPFIGRTIKSFVAGRDILSYIEAVLRVYNQYGRRDNIYKARIKILVHELGIEKFAAEVEQAWAEIADGPLTLDHEMIEDIRSRFIYPAYEKLPAEPDELRAAAGDARFEAWRNNSVAPHRHDGYAIVTLSLKPAGGPPGDATAEQMDAVADLADKYSFGEIRVGHEQNLVLPHVARRDLPALWAALDKLGLATPNVGLVSDIIACPGLDYCSLANARSIPIAQELSRRFASPETAALIGRLHINISGCINACGHHHVGHIGILGVEKNGEEFYQITIGGRADEGAELGELIGPAVPYGEVADVIEDIVEAYLSLRQRPDELFVDAVKRLGVEPFKERVYATR

SEQ ID NO: 51388 - protein, 566 aa, Oryza sativa (japonica cultivar-group)
MAEVAATQHGHAVAARAMPGRGEVDTSSPFESVRQAVDLFGGGALSPWRHHHPPPPPPPPPLQLRPEEVELMKVEEQTVKLEMELFVKEKETFKVLKELQATKQVADNLKLQLEKAASESAASARGHSDAGKVYPLPDTERKCSYHTGQPVESAKGNQSALTTLIKLNQAKAFLNMDTVMTIKRQIEEEKGSLEKTRERLQLNRAKASSLEADLNKIVSQLQAARGPKPTLEPSDIWLQMKQLNSEKEKHRKIADDSKNEIGELTATIEHTKSRTKTLQFRIVMAEKLKEASRRGEALALAERKNLSNGEHEASTASDVTLSVEEHSVLVQKAEEADAACRKKIDAAMQELDQANRGKLELLERVEEAMAAVETSRKALEEALKREESTNKAKLVAEESLRKLRSEQIIQNWRPTGNSSVKFKTSAATTAAVVAHRRAGSGIYDVNGLSLVTATPKSTKAMSIGQILSMKLDHRELEVAGKGGGAKKKVSLGQILSQKYDALSPLRIDHGGASRRQFHPRRRKLGFVVYALLLAKHRHRKKRQPAAAAAADSSSCTHGSFSTKAVY

SEQ ID NO: 51389 - protein, 478 aa, Listeria monocytogenes str. 4b H7858
MEHQKRSPFPKDFLWGSASAAYQIEGAWDADGKGKSVWDEYVRIPGTTFKGTNGDVAVDHYHRYKEDVKLMADAGLKAYRFSIAWTRIFPNGKGEVNEAGLKFYDNLIDELLKYDIEPLVTLYHWDIPQALFDEYGGWESRQVIEDFTNYSTTLFKRYGDRVKYWVSLNEQNIFVGMGYGQALHPPKVSDPKRMYAVNHIANLANASVIKAFHEIVPDGKIGPSFAYTPHYPIDTDPKNVQAADDAEELNSYFWMDMYAFGRYPKAVWKYLEENDIAPVIEDGDMELLASAKPDFMGVNYYQSATVAYNPLDGVGQNNEMNFTGKKGSTKETGVPGVYKKVVNPFVKTTNWDWTIDPKGLQIALRRINSRYALPILITENGLGEFDKLVDGEVNDDYRIDYLSAHATAIRDAISDGVDMLGYCTWSFTDLLSWLNGYQKRYGFVYVDRDVEDDAPMTRIPKKSYYWYKQVIETNGADL

SEQ ID NO: 51390 - protein, 308 aa, Arabidopsis thaliana
MSVTSTVEENHQKNPSTPAAVEEEKKKRRWVFWDRRWRRLDYVKFSASFTVHSLALLAPFYFTWSALWVTFLFYTIGGLGITVSYHRNLAHRSFKVPKWLEYLLAYCALLAIQGDPIDWVSTHRYHHQFTDSERDPHSPKEGFWFSHLLWIYDSAYLVSKCGRRANVEDLKRQWFYRFLQKTVLFHILGLGFFLFYLGGMSFVTWGMGVGAALELHVTCLINSLCHIWGTRTWKTNDTSRNVWWLSVFSFGESWHNNHHAFKSSARQGLEWWQIDISWYIVRFFEIIGLATDVKVPTEAQRRRMAIVR

SEQ ID NO: 51391 - protein, 349 aa, Oryza sativa (indica cultivar-group)
MKGLFKSKPRTPADVVRQTRELLIFLDLHSGSRGGDAKREEKMAELSKNIRELKSILYGNGESEPVTEACVQLTQEFFRENTLRLLIICLPKLNLETRKDATQVVANLQRQQVSSKIVASEYLEANKDLLDTLISGYENMDIALHYGSMLRECIRHQSIARYVLESDHMKKFFDYIQLPNFDIASDASATFKELLTRHKATVAEFLSKNYDWFFSEFNTRLLSSTNYITKRQAIKLLGDMLLDRSNSAVMMRYVSSKDNLMILMNLLRDSSKNIQIEAFHVFKLFAANKNKPTEVVNILVTNRSKLLRFFAGFKIDKALELVQIISIKLSHFSCSSMGFDMPLYRLHMS

SEQ ID NO: 51392 - protein, 342 aa, Aquifex aeolicus VF5
MAIKVGINGFGRIGRSFFRASWGREEIEIVAINDLTDAKHLAHLLKYDSVHGIFKGSVEAKDDSIVVDGKEIKVFAQKDPSQIPWGDLGVDVVIEATGVFRDRENASKHLQGGAKKVIITAPAKNPDITVVLGVNEEKYNPKEHNIISNASCTTNCLAPCVKVLNEAFGVEKGYMVTVHAYTNDQRLLDLPHKDFRRARAAAINIVPTTTGAAKAIGEVIPELKGKLDGTARRVPVPDGSLIDLTVVVNKAPSSVEEVNEKFREAAQKYRESGKVYLKEILQYCEDPIVSTDIVGNPHSAIFDAPLTQVIDNLVHIAAWYDNEWGYSCRLRDLVIYLAERGL

SEQ ID NO: 51393 - protein, 342 aa, Gloeobacter violaceus PCC 7421
MNLKPIEQQVVVVFGASSGIGRASALQFAGRGASLVVAARSEGGLASLVAEVRRFGTQVVPIVADAADFAQVSRVADLAVESYGHLDTWVHAAATAVIGRFEETTAEEFRRVVDVSLLGQVYGAMAALPHLKRTGGGALIHVSSVEGRRAMPLMAAYAAAKHGVEGFLESLRLELRKDGVPVSVTSILPSVINTPFYNKARSKLGVKPSGVPPYYQPELVADAIVFAAQHPVRELIVGDSGRVLDWLQRLSPPLLDKLLEWTAFDLQRTQQPKSPGDPDNLFTPIDSEQGYDRSRGDFSHLAIPSLLDWTDRYPAVAAALGAFALLGLVGLLRPRVNEQVSK

SEQ ID NO: 51394 - protein, 444 aa, Arabidopsis thaliana
MNPREFISNLPDEILGKILSLLPTKLGVSTSVLSKRWRNLILLVDNFDLEDSSTSGFSAFLEQTVARLNTCPIKRLSLNGRHYRFSSADSWISTAFERGCLELHLQSQYLDTGILSSNTLVKLTLSDQIYLQGLVPHDGTVFFPALKTLSLGAVVADRDVYESLISGCPVLDELSIRDGCDDPPTWKKSVVNKSVKRLTVSFHHPMSAWAYEDNVWFKTQSLVFLDYSAFVSQGYTIVDRMDSLVEARLDLRLWVSTDSYDSDYEDKDFDVYRPYDVFGDVTSLVSGIRKVKTLHLSPDSLEAFFFCCNHMPVFNNLRNLSLESDEEKGWQALPLLLNNSLNLHTLSIKGLVHRVTSRCGDACACISERKTGMCCLSACRIKVLEITGYGGSFIELKQMRHFLGKLQCLETVRIGVERDGNNEHLRANLSSLHRASSECNIQFI

SEQ ID NO: 51395 - protein, 444 aa, Listeria monocytogenes EGD-e
MAKYTKEDIFRFADEQNVKFIRLQFTDILGIIKNVEIPVSQLKKALDNKIMFDGSSIEGFVRIEESDMYLFPDLDTWVVFPWTAEKGKVARMICDIYNPDMTPFAGDPRANLKRVLKEMEELGFTEFNLGPEPEFFLFKLDENRRPTLELNDSGGYFDLAPTDLGENCRRDIVLELEEMGFEIEASHHEVAPGQHEIDFKYEDAVTACDSIQTFKLVVKTIARKHGLHATFMPKPLFGVNGSGMHFNMSLFNEKGNAFFDESGELELSQTAYHFLAGMLKHARGYTAVTNPTINSFKRLVPGYEAPCYIAWSGKNRSPLVRVPSSRGLSTRLELRSVDPSANPYLAMAVLLKAGLSGIKDELTPPAPVDRNIYGMNEEEREATGIYDLPESLGHALIELEKDDIIKAGLGEHIFEHFIEAKTIECDMFRTAVHPWEREQYLEIY

SEQ ID NO: 51396 - protein, 551 aa, Myxococcus xanthus DK 1622
MTLRAMTDVGAELGLSPEDVLPWGTHRAKVSLDALGKRGGRQGRLVLVSAINPTPPGEGKTTMSVALAMGLRKRGRRAVAALREPSLGPVFGVKGGGTGGGQASLEPAADINLHFTGDLHAITSANNLLSALVDNAVFYGQPVALDATRVRWRRALDMNDRFLRNVIVGLGGKAQGVPREDHFDITAASEVMAILALAEGLKDLEARLGRVIIGHTRDGQPVRARDVDAAASMVALLKDALMPNLAQTREGGPALVHAGPFANIAHGCSSVMGTRMGLAYADEVITEAGFGFDLGAEKFLDIKCRGSGLWPRGVVLVVTLRALKHHGGASPARVAEPDREALVRGFAHLEKHLESVAAFGLPAVLCVNRFPQDTESELEELRAFGKARGVETAVCDGFSRGGDGSLELADCVLEMLDGTDAAPPQPRFLYDVAQTPEEKVAAIARTVYGADDVAFTASAKKDLDAIRELGGAGLPVCMAKTHLSLSDDPTKLGRPRGFTLTVREVRLSAGAGFMVALTGEILTMPGLPREPAARRVTVHDDGRVTGLMQGE

SEQ ID NO: 51397 - protein, 466 aa, Oryza sativa (indica cultivar-group)
MKQVSCSVVNKCLAYNPCLSRNYYQRSHTVKLQRSQAGQIILPRKLRKSTLWQTNFTQRQIATHCSSDLSTSCREELPSYLTVNVLKDQSCARQGIFRKVIVILNPNSGFRSSREVFYQKVQPTLELSGFMMQVVETAYAGHAHALASTVDLSTCPDGIICVGGDGIVNEVLNGLLGRDDLEEAIQLPIGIIPAGSENSLVWTVLGIRDPVSAATTLAKGGITPIDVFSVKRTQAGITHFGLTASYYGFVADVLQLSEKFRLHFGPFRYVIAGVLKFLSLPQYRFEVNYLPLSPRRNHKLLLVTEKCNDHLAADSSAEDNWVTRKGEFLGIFVCNHFCKPAQGLLSPVIAPKAQHNDGSLDLILVHGSGRLRLFCFFIAYQFCWHLLLPYVEYVKVKHVKVRPMAKPTMGAVLTESFFLERAKQNGSAHCSQHKADCLAGIAAHLSRFLTTKGPNSSVKLRNHFNV

SEQ ID NO: 51398 - protein, 508 aa, Coprinopsis cinerea okayama7#130
MLQIQRLARRNASSSARRLRQASVQVCAWQSSRGYASASEPYDVVVIGGGPGGYVAAIKAAQMGLRTACVEKRGALGGTCLNVGCIPSKALLNNSHLYHQAKHDFARRGIDVENVSLNLPKFMEAKDSAVTGLTKGIEFLFKQNKVDYIKGAASFVNANKISVDLLDGGKSEVDAKNFVIATGSEVAPFPGGAIPIDEEQIVSSTGALSLTKVPEKMVVIGGGIIGLEMGSVWSRLGAEVTVVEFLGAIGGAGIDEEVSKQFQRLLTKQGLKFKLNTKVVSAEKKDGKVFLKAEAAKGGKEETLDADVVLVAVGRRPYTDGLNLEAAGVELDNRGRIVIDDQFTTSAKNIKCIGDVTFGPMLAHKAEEEGIAAVEFIKHGHGHVNYGAIPSVVYTHPEVAWVGQTEQDLKAAGVKYNIGKFSFSANSRAKTNLDSDGFVKFLSEKETDKILGIHIIGPNAGEMIAEGVLAIEYGASSEDVARTTHAHPTLSEAFKEAAMAAYSKPIHM

SEQ ID NO: 51399 - protein, 641 aa, Rhodococcus sp. RHA1
MCGLLGLLTSGETSDNAVSQVDQAMHCLRHRGPDEHGTWHDDHLVFGFNRLSIIDIEHSHQPLRWGPAENPERYALTFNGEIYNYLEVRAELAEQFGAQFVTEGDSESIVAAFHYWGEDAVRRLRGMFAFAIWDTETRELFIARDPFGIKPLFLATGTGGTAFGSEKKSLLELASLIGIGTELDPRAVEHYTVLQYVPEPETLHKQIRRLESGCFARVRPGEEPVITRYFAPTFPVRPFAAGTDQARYREIAEALEDSVAKHMRADVTVGSFLSGGIDSTAIAALAMRHNPNLITFTTGFEREGYSEVDVAAESAEAIGARHVVKVVSPSEFAAAIPEIVWYLDDPVADPALVPLWFVAKEARKHVKVVLSGEGADELFGGYTIYREPISLKPFEYLPKGLRRAAGKLSERIPEGTRGKSLLNRGSLTLEERYYGNARSFNDAQLRAVLRDFRPEWTHRDVTDPIYAQSQGWDPVARMQHLDLFTWLRGDILVKADKMTMANSLELRVPFLDPEVFKVASQVPLDQKITKSTTKYALRQALEGIVPGHVLHRAKLGFPVPLRHWLRGTELFDWAHEQIAASGTDHLLDKAAITKMLNDHRDGVSDHSRRLWTVLIFMVWHGIFVENRIVPEIAEPAYPVSL

SEQ ID NO: 51400 - protein, 313 aa, Glycine max
MSTFMLKIFLLISIFQISFATRRLNELVQDQTQLLRYHNGPLLSGKISINLIWYGHFKPSQKAIVSDFITSLSPSSPHSTQPSVATWWKTTEKYYHHLSNTKKTSPLSIPLNKQILDENYSLGKSLTSKHLIQLASKGDHKNAINVVLTSADVAVEGFCTSRCGTHGSSSAGHAKNKNYKFAYIWVGNSEAQCPGQCAWPFHQPIYGPQSPPLVAPNNDVGIDGMVINLASLLAGTVTNPFGNGFYQGPAEAPLEAATACPGVYGKGAYPGYAGNLNVDSSTGASYNAHGANGRKYLLPALYDPATSSCSTLV

SEQ ID NO: 51401 - protein, 344 aa, Hyoscyamus niger
MATFVSNWSTKSVSESFIAPLQKRAEKDVPVGNDVPIIDLQQHHHLLVQQITKACQDFGLFQVINHGFPEELMLETMEVCKEFFALPAEEKEKFKPKGEAAKFELPLEQKAKLYVEGEQLSNEEFLYWKDTLAHGCHPLDQDLVNSWPEKPAKYREVVAKYSVEVRKLTMRMLDYICEGLGLKLGYFDNELSQIQMMLTNYYPPCPDPSSTLGSGGHYDGNLITLLQQDLPGLQQLIVKDATWIAVQPIPTAFVVNLGLTLKVITNEKFEGSIHRVVTDPTRDRVSIATLIGPDYSCTIEPAKELLNQDNPPLYKPYSYSEFADIYLSDKSDYDSGVKPYKINV

SEQ ID NO: 51402 - protein, 209 aa, Rhodopseudomonas palustris CGA009
MSDHHGPLRVGIGGPVGSGKTALMDLLCKSMRERYDIAAITNDIYTKWDAEFLVRSGSLTPDRIAGVETGGCPHTAIREDASMNLAAVAEMRSKFPGLDLVLIESGGDNLAATFSPELADITIYVIDVAAGDKIPSKGGPGITRSDLLVINKIDLAPYVGASLEKMDTDAKRMRGARPFVMTNLKKSEGLDRIIGFIEEKGGLTPRRSA

SEQ ID NO: 51403 - protein, 257 aa, Francisella tularensis subsp. tularensis SCHU S4
MKDLYHVIGFPVKHSLSPAIQMRLAQQYNQDMLFTAIEVAPQDLEAKIQEFKTNPQVKGLSVTVPHKERVYALADDADTTAKAVQAASNVIFTAERKMIALNYDGLGIVNDIKNNYKIDFAGKKVLVVGAGGAAKAVVAAVLKESPLSLSITNRTLAKAKAIEELFKVDTKIKIIDFDNISDSFDIVINSTSSSIDGKLLPLKDSNFNKNAFAYDLMYADGGTIFTKWCQAHNIAAADGKGMLKELSIAVFKYWRGL

SEQ ID NO: 51404 - protein, 436 aa, Methylococcus capsulatus str. Bath
MSVVCGPGNNGGDGYVIARLALAAGFDVRAYPVGPVERLRGDGAAAFAEYRNADGPLLNFIPPGFEGAEILVDALLGTGLDRDVTDEYAAVIDAVNDFPGKVVAVDIPSGLNADTGAVMGNAVRADLTVSFIGLKQGLFTGAGPAHCGEIVFDDLDTPPEIRLAQTPSSRLLRSNDFTLPPRRRDAHKGHYGHVLVIGGECGYSGAARMAAEAAARTGAGLVSIATRTSHAPLLNVGRPELMVHGAESGGELGPLLQRASVLALGPGLGQGEWAKALFDAALDCGKPAVIDADALNLLAKLPRRCDHWILTPHPGEAARLLGVAVADVQRDRFAAVSALQRRYGGVAVLKGAGTLIAGPDGVPHVARWGNPGMASGGMGDVLTGVIAGLRAQHVPPFESACLGVRIHGQAGDLAASAGERGLLAGDLIDALRACIN

SEQ ID NO: 51405 - protein, 380 aa, Vitis vinifera
MSSTAGQVIRCKAAVAWEAGKPLVIEEVEVAPPQVMEVRLKILVTSLCHTDVYFWEAKGQTPLFPRIFGHEAGGIVESVGEGVTDLQPGDHVLPVFTGECKECRHCKSEESNMCDLLRINTDRGVMLSDNKSRFSINGKPVYHFVGTSTFSEYTVVHVGCVAKINPAAPLDKVCVLSCGISTGLGATLNVAKPSKGSSVAIFGLGAVGLAAAEGARIAGAARIIGIDLNPKRFNDAKKFGVTEFLNPKDHDKPIQEVIAEMTDGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLSGDGLRCIIRMDA

SEQ ID NO: 51406 - protein, 363 aa, Vitis vinifera
MGVPQVLATFLALGELTNFLRLGFLRYWQRHGFCSLILLQHSLDGGVDDVIAPTQELSSVGLHVTATVMCASARSSTSTAQTAIYDTFIFALTDMVETERERERETRAEFGTSSCRIRHEGKPVYHFVGTSTFSEYTVVHVGCVAKINPAAPLDKVCVLSCGISTGLGATLNVAKPSKGSSVAIFGLGAVGLAAAEGARIAGAARIIGIDLNPKRFNDAKKFGVTEFLNPKDHDKPIQEVIAEMTDGGVDRSVECTGNVNAMISAFECVHDGWGVAVLVGVPNKDDSFKTHPVNLLNERTLKGTFFGNYKPRSDLPSVVEKYMNKELEVEKFITHEVPFAEINKAFEYMLSGDGLRCIIRMDA

SEQ ID NO: 51407 - protein, 332 aa, Oryza sativa (japonica cultivar-group)
MAEGRQLEAQSVVVPTATGDKGDDILSSLPTREGWWTTFVLYDGCWMDRQAAMSVSLVRAQFVPRDDDVLLATYPKCGTTWLKALSFAIANRHRHPVVSAGHHPLLTQSPHDLVPFIELPFRHIHPLAAALDAIPSPRLLGTHMPHHLLPPRIGCRIVYLCREPKDVVISTWHFMNKVIEGFSIDFDKAFELFVDGCSPFGPIWNHYLGYWNKHVEEPDRVLFLKYDDMMADPAGHVKKLAEFLRVPFTDDEVDAGVVEEVVRLCSFEKLSRLPVNSSVVAGRVGVDERPMKNSVFFRKGKVRDWKNYLTEEMAKKLDAAIEEKLKGSGLTL

SEQ ID NO: 51408 - protein, 551 aa, Gibberella zeae PH-1
METNWKPFMKSTADDWTSIPDPAQRKRIQNRLSQRARRMRQKKAITQSDSGSVTTDASSAGDAMPSPDQGQSFAQHDLNTVVVDTLGTSPLADSHFIILADMTACAALAVIAECLNLDCQPRPGFHIKALFLELPSAIAPTDLQKLVPHKPYLDMLPWASLRDKLLQSVSVINEDEFMADMRSGNLRVWGQVPWDPMGWEVTPDFARRWWFLMDAGIHLAPRSATMSATFTQLFPSKPAYKEEHIPSLNAKVFLVTGGTNGVGLELVNILYSKGGTVYIPCRSETKAAKTIKTIQTSHPDSPGQLKYLPLDLNDLTSVAACASAFLEQETRLDVLWNNAGISYAPPDEVTVQGYEPHMGINCLAPFLLTKLLLPVLKRTASISSEPSTRVIFVASGMVDSSPLGGIPLEELHPGKPSRDLARNYTISKTGNWFLASEFDRRMRTDGIIFIAQNPGNLLTNIWERVPWFLKAPIRILLHPPIKGAYSELWAGLSTEIKLEDGGRYGVPWGKWHPGPRKDLLLSLKTKDDGGSGVAVAFWDWCEKETASFVKD

SEQ ID NO: 51409 - protein, 325 aa, Gloeobacter violaceus PCC 7421
MSVVSAANWSALVEDDLSQMTRNLKNLLGTKHPVLYAAAEHLFNAGGKRIRPALVLLVSRATAAYGEPTERHRRLAEITEMIHTASLVHDDVIDTSAVRRGIDTVNSRFGNRVAVLAGDYLFGMASAYLARLGSLEVVELLGIVISHFGEGELLQSTLQFDSDLTFEQYIDKSFYKTASLMAGTSRAAAVLSESPAAVCEALYEYGRHLGIAFQVIDDLLDFTGSTAKLGKPAGSDLRDGNLTAPVLYALEESPHLSGLIERQFEQKGDLEKALSLIHASRALERTRELAETHARRAVTSLDTLSPSPAREALKDLVGHTVSRLY

SEQ ID NO: 51410 - protein, 494 aa, Bacillus anthracis str. Ames
MLTTNIELKPKVKAFLDEEIKMFINGEFVPSISGKTFETYNPATEDVLAVVYEAQEEDIDVAVKAARSAFESGPWVEMTTAERAHLIYKLADLIEEHGEELAQLEALDNGKPYQVALDDDIAATVENYRYYAGWATKIIGQTIPISKDYLNYTRHEPVGVVGQIIPWNFPLVMSSWKMGAALATGCTIVLKPAEQTPLSLLYTAKLFKEAGFPNGVVNFVPGFGPEAGAAIVNHHDIDKVAFTGSTVTGKYIMRQSAETIKHVTLELGGKSPNIILEDADLEEAINGAFQGIMYNHGQNCSAGSRVFVHRKHYETVVNELVKMANNVKLGAGMEKDTEMGPLVSKKQQERVLHYIEQGKAEGATVAAGGERAFEKGYFVQPTVFTDVTDDMTIVKEEIFGPVVVVLPFDSTEEVIERANRSSYGLAAGVWTQNIKTGHQVANKLKAGTVWINDYNLENAAAPFGGFKQSGIGRELGSYALDNYTEVKSVWVNIK

SEQ ID NO: 51411 - protein, 298 aa, Bacillus anthracis str. Ames
MKIIKGAFPVLITPMDEFQEINWNGVKQNVNYFIEQKVAGIIINGSTGEFVSLSKEERFKMVETVLKEVNGRIPVIVGTAAETTKETIEFTKHAETHGADCALIINSYYCKPKEEEIYFHFKEISNAVNIPIMLYNNPFTSGVDMSTELMLRIGKDCENVTHIKESSGDIRKARDLVRQGEGAFQVFCGSEDLVMESYLVGATGWVSVAGNVVPGLVTKMYEHFQNGELEKAWEINDAILPLCEFLEGSGKYVQIVKRSMELQGQAGGPSRYPRLGLTEEEDQKLQAIISKIAAHAAV

SEQ ID NO: 51412 - protein, 536 aa, Gloeobacter violaceus PCC 7421
MAFMGTSSAVHPAILVILDGWGYREQTDGNAVAAAKTPIFDALKASYPFTLIHTSGKAVGLPRGQMGNSEVGHLNLGAGRMVPQELVRISDAVEEGTLLSNPELLRLCRTVRERGGKLHGVGLVSDGGVHSHIEHLFGLLDLAKREGFETLFIHGMSDGRDTPPTSGVAYFEKLEARIAETGFGTIATLGGRYFGMDRDRRWDRTEAMYRVMTETGPGTGKRASETLRESHAAGKTDEFVLPVRLAAGAVEPGDGVIYFNFRPDRARQLTRAFVQADFDGFVRPYLDPLAFLTFTQYDATLPVAVAFAPQSLDNLLGQVIAHHGLRQFRIAETEKYAHVTYFFNGGIETPLPGEERSMIQSPLVPTYDLKPEMAAREVTDHAVAAIETRQYSLIVINYANPDMVGHTGNFDATVKAVETVDACIGRLVEACVRAGGTMLLTADHGNAELMWDEQGNPWTAHTTNPVPFILIESEGLKIPGWGTDVQLRAGGSLGDIAPTILEILGLPQPAEMTGRSLLGESEIEIRTPRSPLRVGL

SEQ ID NO: 51413 - protein, 664 aa, Listeria monocytogenes EGD-e
MFDNTDSLAVNTIRTLSMDAIQKANSGHPGLPMGAAPMAYALWSRVLNTNPKNSHWFNRDRFVLSAGHGSMLLYSLLHLSGFKLELEDLKNFRQWESKTPGHPEYRYTDGVDATTGPLGQGIAMAVGMAMAERHLEAKYNKDGFPVVDHYTYALCGDGDLMEGVASEAASYAGHQQLGRLVVLYDSNDISLDGDLDKSFSENVKQRFEAYGWEHLLVKDGNDTAEILAAIEKAKQNTSQPTMIEVKTVIGFGAPNAGTSKVHGAPLGDEGILEAKKAYGWNYEEKFFVPEEVTARFKETIGERGEKAEKAWNELFASYKAEYPELAKQLEDSLNNKLPADWDADLPVYDDSKALASRASSGEVINALAGKIPTIFGGSADLAGSNNTTIKTDGEFTKATPAERNIWFGVREFAMGAALNGMALHGGLQVYGGTFFVFSDYVRAAIRLSAIQHLPVTYVMTHDSIAVGEDGPTHEPVEQLASLRAMPGLSVIRPADGNEVVEAWKLAITSTSTPHVLVLTRQGLPTLPNSAKLTAEGVKKGAYVISPAKGEVPEAIILASGSEVNLAIEAQKELQAQGTDVSVVSVPSFDLFEQQSAEYKESVLPNAVRKRIAVEMGASFGWERYVGLDGKVIGIDKFGASAPGETVIKNYGFTVENVVNTVKSL

SEQ ID NO: 51414 - protein, 218 aa, Olea europaea
SGQLEWQDYFFHCIYPEEKRDIWPKTPTDYSPATSEYAKQLRGLTSKILSALSLGLGLEQERLEKEVGGMEELLLQFKINYYPKCPQPELALGVEAHTDVSALTFILHNMVPGLQLFCEGKWVTAKCVPNSIIMHIGDTIEILSNGKYKSALHRGLVNKEKVRISWAVFCEPPKEKIVLKPLPETVSEAEPPRFPPRTFSQHIMHKLFRKSEDSGEEK

SEQ ID NO: 51415 - protein, 445 aa, Thermococcus kodakarensis KOD1
MVVRPNVKELPGPKAKEVIERNFKYLAMTTQDPENLPIVIERGEGIRVYDVDGNVFYDFASGVGVINVGHSHPRVVEAIKKQAEKFTHYSLTDFFYENAIILAEKLIELAPGDIERKVVYGNSGAEANEAAMKLVKYGTGRKQFLAFYHAFHGRTQAVLSLTASKWVQQDGFFPTMPGVTHIPYPNPYRNTWGIDGYEEPDELTNRVLDFIEEYVFRHVPPHEIGAIFFEPIQGEGGYVVPPKGFFKALKKFADEYGILLADDEVQMGIGRTGKFWAIEHFGVEPDLIQFGKAIGGGLPLAGVIHRADITFDKPGRHATTFGGNPVAIAAGIEVVEIVKELLPHVQEVGDYLHKYLEEFKEKYEVIGDARGLGLAQAVEIVKSKETKEKYPELRDRIVKESAKRGLVLLGCGDNSIRFIPPLIVTKEEIDVAMEIFEEALKAALK

SEQ ID NO: 51416 - protein, 300 aa, Aspergillus nidulans FGSC A4
MPLNISLSSVFYLIPLYILVISPILRQLFPNDPQHGSYQFYDDEEALDEDTSLDLNSEVLSLDDGVNVVCPDETDAYRVHILSQAPLVIYIENFLSAEEADYLVDVSIPNYTPSTLYSSSLTSANDTSTPKTDVTKRLSDRALLPRTQTVRCIEARARSFQGWKPNLYIERMWAQRYNVSGHYTHHYDWAGTARGRGGDRISTFMVYLKAECKGGGTNFPLLRKPKDSKWCEFIECGEADEGRKGVTFKPIKGNAVFWENLRADGSGWPETWHAAFPVEEGEKVGLNIWSWYQPPKGRWR

SEQ ID NO: 51417 - protein, 258 aa, Zea mays
MATRVWLTALLLGFLVAASPFTGRVARAESEEDAAAAEVVEGADLGIVGDDTQVSSDGPLSPAPGVETVVVFPKNAGKIVLAGEETELLVGLQNDGESILNVVAVHSTLHLPFDHNMYGQNLTVQNFFNSSVPVSVQATFPYKFVVSKFLQPGAYDLVGYIVYEIDQHPYQNVFYNGTIEVVEAGGLLSVESVFLITLGFALLGLFGLWAYGQVQQLSKKTKKAPKVELGTGTTDANIDEWLEGTSFVQRSKSKKKQT

SEQ ID NO: 51418 - protein, 379 aa, Rhodococcus sp. RHA1
MGRRKVFDKITGMTGVTEFVRVPHPALTSDEVRREILAAPGFGRYFTDHMVSITYSTELGWHDAKVEPYGPLQLDPAAMVLHYGQAIFEGLKAYRQPDGGISTFRLEANAERLATSARRLAMPELPEELFVKSITELLELDHEWVPAAGGEDALYLRPFMFSTEAGLGVRPADEYRYLLIASPAGAYFPRGVKPVSVWLSTEYVRAAPGGTGAAKFAGNYAASLLAQAQAADEGCDQVVWLDAIERSYVEEMGGMNLFFVFGSGSDARLVTPSLSGSLLPGITRNSLLTLATDAGFAVEERRISTDEWRTKTKSGEITEVFACGTAAVITPVGRVKSAEGEFTIADGEPGEVTMALRDTLTGIQRGTFADTHGWMTKLR

SEQ ID NO: 51419 - protein, 329 aa, Acidovorax sp. JS42
MTTPGSASHVPSPHHARLTPQMRNVIDGMARAGRPPLHTLSPAQARAAYELGAGVLELPKAALPRVEDLRIPARDGTPLPARLYAPTASDAQALPLLLYLHGGGFTIGSIATHDVLCRELARLAGCMVVSLDYRLAPEHPFPTASDDAWDALAWLAQHATTLGADPSRLAVGGDSAGGTLAAVCALQARDAGLPLALQLLIYPGTTAHQDTPSHTEFAHGLVLERAAIGWFFDQYIPSRAEREDWRFAPLLAPDAEGVAPAWIGLAEYDPLVDEGVEYADKLRAAGVPVQLEIYRGVTHEFIKMGRALPEARQAHADAAAALRSAFQLD

SEQ ID NO: 51420 - protein, 576 aa, Rhodococcus sp. RHA1
MAFSVQMPALGESVTEGTVTRWLKQEGDTVEVDEPLLEVSTDKVDTEIPSPVAGVLSKIVAQEDDTVEIGGELAVIGDAGEAPASDSAPAPAAEEPAAEPAPAAEAPADEPAPAASGNGSAEGTAVKMPELGESVTEGTVTRWLKAVGDEVAVDEPLVEVSTDKVDTEIPSPVAGTLLEISAEEDDTVSVGGQLAVIGSGAPAAKPAAEPKPEPTPEPAPAPEPAKPEPAKSAPAPAAAPAASAPAPAAAAPAPAATSGDSTPYVTPLVRKLAADNSVDLSSVTGTGVGGRIRKQDVLAAAEAKKAPAAAAAPAAAPAAAAAPAAASAGVRPELAHLRGTTQKANRIRQITATKTRESLQSTAQLTQTFEVDVTKIAALRAQAKNTFVEREGVKLTFLPFFAKAVVEALKSHPNINASYDEANKQITYYDAEHLGIAVDTDQGLLSPVIHNAGDLSLAGLARAIADIAKRARSGGLKPDELSGGTFTITNIGSQGALFDTPILVPPQAAMLGTGAIVKRPVVVTDESGSESIGVRSMCYLPLTYDHRLVDGADAGRFLTTIKQRLEQGAFEADLGL

SEQ ID NO: 51421 - protein, 589 aa, Oryza sativa (japonica cultivar-group)
MAPATAISCAVVKCGGGGGPRQPRVSAPPRQQGHAAAAASLEQLLLLPRWSPPSSPLSFARPAAERVAARRARAAAVAMKVVEDATPPAAGAVLLAGAQSRHAIFRDELVRRAFYAAEAAHRGQMRASGDPYLQHCVETAALLAELGAGPAVVAAGLLHDTVDDAGLGYGSLSVQFGAGVADLVKGVSNLSHLSKLARRNDTASRVDEADKLRTVFLAMEDARAVLIKLADRLHNMRTLDSLPKVKQQCFAKETLEIFAPLANQLGILNWKEQLENLCFKYLYPELYEELSSNLLEFYNQDMIAAAIRRLEQALQVRGLCYHTISGRNKSMYSIYSKMAKKLDMDEIYDIHGVRVILDNKADCFTTLEIVHHLWPRIPGKFKDYINSPKPNYQSLHTVVLSEETLPLEIQIRTRDMHLQAEFGIAAHWRYKEAVRNCCSSVPEMVEWVRWVVTWQCETLHIDHPSSLTHGAPPRAICSCSSQSDDCPFSYSKRCDHSGPILVILLENEKMSVQEFPQNSTVLDLLKRTSSYDMQLRLRLNCHVVHNLNQELKMGDVVELIPLAQCNPGAGGYAREFHQMYDHRLTVSQS

SEQ ID NO: 51422 - protein, 411 aa, Mycoplasma genitalium G37
MLNFKTLQAIDFQNKTVVLRSDFNVPMINGVISDSERILAGLDTIKFLVKKNCKIVLLSHLSRIKSLEDKLNNKKSLKPVAELLQQLLPTVKVQFSCKNTGAEVKQKVQALAFGEILLLENTRYCDVNDKGEIVKLESKNDPELAKFWASLGEIFVNDAFGTAHRKHASNAGIAKYVAKSCIGFLMEKELKNLSYLIQSPQKPFVVVLGGAKVSDKLKVVENLLKLADNILIGGGMVNTFLKAKGKATANSLVEKELIDVAKQILDKDTHNKIVLAIDQVMGSEFKDQTGITLDVSDKIQEQYQSYMSLDVGSKTIALFESYLKTAKTIFWNGPLGVFEFTNFAKGTSKIGEIIAKNKTAFSVIGGGDSAAAVKQMQLSDQFSFISTGGGASLALIGGEELVGISDIQKNS

SEQ ID NO: 51423 - protein, 399 aa, Oryza sativa (indica cultivar-group)
MALSISTPPTSSSLLPASLQVGRWSSSAAMSARPVAFSLRRPVLAARVAAGGNAPSSSVDEVVTELDAVASFSEIVPDTVVFDDFEKFAPTAATVSSSLLLGIAGLPDTKFKSAIDTALADGECNTMEKPEDRMSCFLTKALANVGAEMAHLVPGRVSTEIDARLAYDTQGIIQRVHELLKLYSDHDVLSERLLFKIPATWQGIEASRLLESEGIQTHLTFVYSFAQAAAAAQAGASVVQIFVGRVRDWARTHSGDPEIDEALKKGEDAGLALVKKVYAYIHKNGYKTKLMAAAIRNKQDVFSLLGIDYIIAPLKILQSLEESVTDTDVKYGYVPRLTPALGKTYNFTEEELVKWDQLSLAAAMGPAAEELLASGLEGYVNQARRVEELFGKIWPPPNV

SEQ ID NO: 51424 - protein, 284 aa, Pseudoalteromonas tunicata D2
MSIAKWQLDFLNEYQLPHSYLYQIEPVVQRILNLYQHHRVPKPWLLAINGAQGSGKSTLSAYLVAYFKWEKQKKALVLSLDDYYYSPKQRADVAKHYHPLFRTRGVPGTHDIKQAIADVNALLAKQPCLIPRFDKSQDCVFSQEFWQSVDEPQDVVIFEGWCVGLPAEPANNLLTPVNHFEQTCDADGRFRQLVNQHLAAAYQDLFALFEHLIYLRMSDFNHVLAWRQKQEHKLIAKTGSGLSDEQIQDFIAYFERLTRYALKSLPAKADIIVDVLANHQLALV

SEQ ID NO: 51425 - protein, 393 aa, Listeria monocytogenes str. 4b H7858
MKISKRLQNLPDQFFSSLVEKVGKKVAEGHDVINLGQGNPDQPTPKHIVEAMKTASEKPLNHKYSLFRGKHELKQAAADFYAREYNVTIDPNTEVAILFGTKTGLVELPMCLMDPGDTMLLPDPGYPDYLSGVVLGEVQFEKMPLIAANNFLPDFTKIPEDIAEKAELMYLNYPNNPTGAVATADFFEETVAFAKNHNIVVAHDFAYGGIGFDGKKPISFLEANGAKEVGIELYTLSKTYNMAGWRVGFAVGNSEVIEAINLIQDHMYVSLFPGIQDAAIEALTGDQTCVGELTARYESRRDAFISACKKIGWEAVAPAGSFFAWMPVPENFTSSEFADYLLEEVSVAVADGSGFGEFGEGYVRVGLLMDEERLEEAVTRVSKLHLFDKVTQQ

SEQ ID NO: 51426 - protein, 132 aa, Glycine max
  misc_feature (53)..(53): Xaa can be any naturally occurring amino acid
MLPKCHLVQLVVFFIFLGNFFSLNIERNVIVWLQHIELVSPAPANAEIANFDXVVGPVCESADFLGKDRQLPTPAKGTGLVVHDAGAYCMSMASTYNLKMRPPEYWVEEDGSVSKIRHGETFEDHIRFFEGL

SEQ ID NO: 51427 - protein, 339 aa, Ralstonia eutropha JMP134
MKTMNRRWILRQRPVGDIGDNDLQLVEAPLPRPGDGEILVRNIYLMVAPTNRVWMSEIDQYMAPVALGEVMRGVTMGVVTESHHPDFKAGDIVEGGMAWEEYSVTKMARRVPVEYGLPLHAYASVLGNSGMTAYFGMLDIARPKAGETIVVSAAAGGVGSIAGQIGKILGCRVVGVAGGQNKCRLVREEFGLDACVDYKAGNVLADLRAACPDGIDVDFENVGGETMDAVLALINPGARIAMCGMISTYNASGDWWSPKMFRNVIMKRARIEGFLIADYRSRFHEAVEVMAKWVRDGQLKYRVDIVEGIEQAPAALNRLFTGKNIGKQLVRLAPESVIG

SEQ ID NO: 51428 - protein, 113 aa, Corynebacterium glutamicum ATCC 13032
MNILDKIDAASLRDDVPAFRAGDTLDVHVKVIEGTTTRTQLFKGVVIRRQGGGIRETFTVRKVSFGIGVERTFPVHSPNIEKIEVIRRGDVRRAKLYYLRELRGKAARIKEKR

SEQ ID NO: 51429 - protein, 188 aa, Triticum aestivum
VRPEGEKLMETAKQTFDGKLDILVNNVGRNVAKAAVEWTAEEYSHLMSTNLEAAFHLSQLAHPFLRDASIAGGGSVVNISSVASSLGYPTLALYCISKGGVNQLTRSLAAEWAQDKIRVNSVAPGGINTELQNSVDPKVIENTLLRTPMHRLGEPVEVASMVSFLCMPAASFLTGQVIYVDGGRTISG

SEQ ID NO: 51430 - protein, 430 aa, Thermococcus kodakarensis KOD1
MENPFEITNVIAREILDSRGNPTVEVEVYTPISMGRAAVPSGASTGTHEALELRDGGSRYHGKGVRRAVENVNKIIAPEIIGMDVTWQRDIDTLMLELDGTENKSNLGANAILGVSLAVAKAAANALGLPLYQYIGGTNAYVMPVPMSNVINGGVHAGNELDFQEFMIMPVGADSFREAIRWVSETYHVLKKVIMEKYGRNAVNVGDEGGFAPPMKEVTEPLDVLIKAIEEAGYKPGDEIAFALDAASSEFFDGEKGKYVVAGKEYDKGELLELYRELVTTYPIVSIEDPFHEEDWEGFVMITKELGSKVQIVGDDLFVTNPKRIRKGIEMGAANALLLKVNQIGTLSEAIDAAYTSFRAGYGVVVSHRSGETEDATIADLAVALNAGQIKTGAPARSDRNAKYNQLIRIEEELEGIAVYPGKKFRNPFL

SEQ ID NO: 51431 - protein, 197 aa, Gloeobacter violaceus PCC 7421
MEPRIASTVRTTRETDIQIRLDLDGTGRVQAETGVPFLDHMLAQIATHGLIDIDVSAQGDLHIDDHHTNEDVGIAFGQCLAKALGDKRGISRFGHFAAPLDEALVQVVLDLSGRPHLSYGLEIPTQRVGSYDTQLVREFYQAVVNNSSMTLHLRQWAGINSHHIIEASFKAFARALRLAVEIDPRRAGSLPSSKGAL

SEQ ID NO: 51432 - protein, 478 aa, Rhodococcus sp. RHA1
MAFTTAEEVIKFIKDENVEYVDIRFSDLPGVQQHFSIPASAFNQDVFEDGLAFDGSSVRGFQSIHESDMMLLPDVATAQLDPFRAAKTLNINFFVHDPFTRESYSRDPRNVARKAEEYLKSTGIADTAFFGAEAEFYIFDSVRYDSGINGAFYELDSISGSWNTGNDVNADGSPNLGYKVRPKGGYFPVAPYDHYVDLRDEISTNLQNAGFELERGHHEVGTGGQQEINYKFNTLLAAADDLQLFKYIVKNTAWQHGKSATFMPKPLFGDNGSGMHVHQSLWKDGKPLFHDEAGYAGLSDMARHYIGGILHHAPSLLAFTNPTINSYHRLVPGYEAPINLVYSQRNRSAAVRIPITGNNPKAKRLEFRAPDSSGNPYLNFAAQMMAGLDGIKNKIEPQAPVDKDLYELPPEEARNIPQAPTSLSAVIDRLEADHDYLTEGGVFTSDLIETWISLKREQEIAPVNLRPHPYEFQLYYDV

SEQ ID NO: 51433 - protein, 876 aa, Hordeum vulgare subsp. vulgare
MLLHGLVDRLTGKNKEAWKEGKIRGTAVLVKSDVLDLGDFHASLLDGVHKILGKDDGVSFRLVSATAPDPQNGSRGKVGKPAHLEEMVVTMKSTAAGESVFKVTFEWDDSQGVPGAVIVRNTYRSEYLLKTLTLHGVPGKGTVVFVANSWIYPNVDRLFFANDTYLPSKMPALLVQYRQDELNNLRGDDTTGEYKEADRVYRYDYYNDLGEPDNDNPRPVLGGTQELPYPRRCRTGRPPTETDPRSESRIPKYKIKEALNIYVPRDERFGHLKLSDFLGYSLKAITEAILPITRTYVDSTPKEFDSFQDIYNLYDGLLKVPDNQHLKELKNKSLQFIKKSLAVAGDDSKLALPHVIKSDQYAWRSDEEFAREMLAAVDPVCIRRLTKFPVKKYLDPSVYGDQSSTITEDQIQLNLEDGLTVRQAMDKKRLFILDHHDNFMPFLDRINKLEGNYIYASRTLLFLKADGTLKPLAIELSQPHPDGIQHGAKSTVYLPADINSGVDGQIWQLAKAYASVDDSAWHQLISHWLNTHAVIEPFVIATNRQLSVVHPVHKLLSPHYRDTLNINALARTTLINAGGVFELTVFPGQYALEMSAVVYKNWKLTEQGLPDDLVKRGMAVPDESSPYGIRLLIKDYPYAVDGLVIWWAIERWVNEYLAIYYPNDGVLRADKELEEWWKEVREVGHGDLKDADWWPKMVTVQELAKTCTTIIWVASALHAAVNFGQYPYAGYLPNRPTVSRRPMPKEGDEEYEQLKEGGEAADMVFIHTITSQFQTILGITLIEILSKHSSDEVYLGQRDTPEWTSDAKALEAFKRFGSRLVEIEKRILDMNKDPALKNRNGPVKMPYMLLYPNTSDANGEKALGLTAMGIPNSVSI

SEQ ID NO: 51434 - protein, 457 aa, Zea mays
MATSPAASSSSAPTASAVAAATMAVEATDGPVLSVVSKRLRALRKKYNRITQMEESLAAGKTLNREQEEVLRSKPVVAALIDELERLRPPLASALAEELSSRPAPAPSAASSSDSDSSVQDLLALVYFGSLFDVKQQSDFVSLVYTRELERSSCLTYDYVGDDPEDSLAETDLNAVSALASLAALRPPAAAGVSHRDALQACAHHARLWLCRADEPIHPDSTITYAGVRAKLDRIMASGYFTAQLEMRTPLDLAAAVANFGAGGVQVQESMVVSPQALEAVEGSQDVEEHKDEKEDSQATEIYSDHQAPVVDAEHVDDEGLVNPAHEVPSAEAEQETFDDYVDDQEQKDQQFTQRRSYQNQRSGGGRGGGRRGYPNGRGVRGYQNGRGGGGYQNGRGGGGGYYESGYYQPRNYNNRGRGGRNSYYNNHGGGAQAGGHGHPGRVELGANALPRADCFV

SEQ ID NO: 51435 - protein, 234 aa, Zea mays
MDLATTPARRRPMEPGLARRLWHVVVAVCHILRRGLSPKRIMMDVHLLLGRGKLVGRTLRGHLAHPSSGHHLATYGASSSSSSTLASFYGHPREVEFSCATTPSYPQQHYGLFPSNKARGGGGYGGLDAAAVARAFEMLSRAEVDTGGGGTPAVAATTATPSPMLAWILGRSPAGVRPLRVTDSPFPAVAGDGDGCCGERVDADADDFIRKFYEQLRLQPTAATPDAHLRRRGY

SEQ ID NO: 51436 - protein, 296 aa, Zea mays
MTRELNPFLLSFCNLLTAQHRQDDDLPIDVLMELVQQIVSFHMKHNAEPEAVDLLMEVEDLDLLVEHVDATNYKRACLYLTSSSKFLPAPDDMLALDIAYTIYMKFGDLASALRISLQLEKSTQYVKQVYTATDDLLLKKQFSYLIARHGLAMEIDDEIAADDNDKEVLQEIVNNTKLSEGYLTLARDIEVMEPKSPEDIYKVHLIDGRGASSSLDSARQNLAATFVNAFVNAGFGQDKLMTAPSDSSSSGSSGNWLFKNKEHGKASAAASLGMILLWDTDSGLAQLDKYLGRDHA

SEQ ID NO: 51437 - protein, 252 aa, Triticum aestivum
  misc_feature (202)..(202): Xaa can be any naturally occurring amino acid
  misc_feature (232)..(232): Xaa can be any naturally occurring amino acid
MSASYWQSTQCRFWTFTKEQLATMRQKLEEDNAELVRMFPLPQQRHLNIYFNQQLIRLAKRLTIRQQSMATAQVYMKRFYSKVEIRRTNPYLVIATAIYLACKIEESPQHIRLIVTEARQMWGDLVAIDTSKLGECEFFMISEMRSQLIVYQPYRTVVALRSELGLQEDEVQLARSVINDHFMTDLPLLYPPHVIAMVAMLXLALVLRPNNSGPGQNPSGAAAAAGLAAAQXALMRAQGQQTFRGRATDAAT

SEQ ID NO: 51438 - protein, 473 aa, Ralstonia eutropha JMP134
MKTLDRFYIQGEWVTPAAGSTLVDVINPATEAPVARLAMGTTADADRAVAAARDAFGTWSQSTREERIALLERIAEQYRARVPELAEAVRLEMGAPVTLCNAMQAPIGLVHIQNTLEVLRNFAFETTHGKTWLRREPVGVAALITPWNVPLNQIAAKVAPALAAGCTVVLKPSEIAPLDAVIFAEIMHAAGTPLGVFNMIFGDGPSVGAALSSHPDVDMVSITGSTRAGVEVAKNAAPTVKRVAQELGGKSPLVVLDDADMKTAVTTAVAQCMVNTGQVCVAPTRLLVSRTRYDEALAIAAATAGALQVGDPADPATKIGPLSNRAQFEKVQQMIGIGIEEGARVIAGGPGRPDGIERGFYVRPTVFADVHNSMTVAREEIFGPVLCVIPYDSEEDAIAIANDTVYGLAAYVASGDAERARRVAARLRAGTVRVNFAPADLTAPFGGVKRSGNGREFGAEGLVEFLEWKAISL

SEQ ID NO: 51439 - protein, 266 aa, Triticum aestivum
  misc_feature (67)..(67): Xaa can be any naturally occurring amino acid
  misc_feature (80)..(80): Xaa can be any naturally occurring amino acid
  misc_feature (113)..(113): Xaa can be any naturally occurring amino acid
  misc_feature (120)..(120): Xaa can be any naturally occurring amino acid
  misc_feature (223)..(223): Xaa can be any naturally occurring amino acid
  misc_feature (244)..(244): Xaa can be any naturally occurring amino acid
MSTAEATREENVYMAKLAEQAERYEEMVEFMEKVAKTADVGELTVEERNLLSVAYKNVIGARRASWXRIISSIEQKEESXRGNEAYVASIKEYRTRIETELSKICDGILKLLXSHLVPSXATAAESKVFYLKMKGDYHRYLAEFKAGAERKEAAENTLVAYKSAQDIALADLPTTHPIRLGLALNFSVFYYEILNSPDRACNLAKQAFDEAIAELDSLGEESXYKDSTLIMQLLRDNLTLWDSXDNAEEGGDEIREAASKPEGEGH

SEQ ID NO: 51440 - protein, 288 aa, Gloeobacter violaceus PCC 7421
MCYGTQSMTGSIVASEYLKSADGLRLHITRWDVNEPFGTLLVLPGKGEHGGRYGQLAAGLAACGWQTWGLDPRGQGLSDGARSRIGSYDEFLTDIAAALEALGREFPGRPAVVLGYSMGAVTGVLAALRWPERIQGLICVSPAFVIDNRLRGLAKVFAYLGSWLFPQRIVASGYNPAAVTNCPLEQQQIAADPLIDGTTRPRLVVELHKAGAQCLRLAPRLAIPTLILATAFDRIVDARGAQAFYDRLPGDRTLHWYDDQLHDLLHERRSAEVTGEITGWLRERWPGA

SEQ ID NO: 51441 - protein, 379 aa, Zea mays
MATAGKVIKCKAAVAWEAGKPLSIEEVEVAPPQAMEVRVKILFTSLCHTDVYFWEAKGQTPVFPRIFGHEAGGIIESVGEGVTDVAPGDHVLPVFTGECKECAHCKSAESNMCDLLRINTDRGVMIADGKSRFSINGKPIYHFVGTSTFSEYTVMHVGCVAKINPQAPLDKVCVLSCGISTGLGASINVAKPPKGSTVAVFGLGAVGLAAAEGARIAGASRIIGVDLNPSRFEEARKFGCTEFVNPKDHNKPVQEVLAEMTNGGVDRSVECTGNINAMIQAFECVHDGWGVAVLVGVPHKDAEFKTHPMNFLNERTLKGTFFGNYKPRTDLPNVVELYMKKELEVEKFITHSVPFAEINKAFDLMAKGEGIRCIIRMEN

SEQ ID NO: 51442 - protein, 248 aa, Mycobacterium sp. JLS
MSTAPLTGRRALVTGGSRGIGAEIVRRLAADGAAVAFTYSASGTNAEKLVAEVAADGGTAVAIQADAADPAQTAAAVDRAVAELGGLDIVVNNAAVAHIAPFDEFPAEQFDRLVAINIGGMYWTTRTAIKHLGEGGRIINIGSINADRIPGPGLSVYGMTKGAVASFTRGLARDLGASGITVNNVQPGPIDTDANPDSGDFAESLKQVTTQGRYGHTTDVASFVSFLAGPQSGYITGANLNVDGGFTV

SEQ ID NO: 51443 - protein, 79 aa, Glycine max
  misc_feature (30)..(30): Xaa can be any naturally occurring amino acid
  misc_feature (57)..(57): Xaa can be any naturally occurring amino acid
LKSMAGFCTMQNMNDIISIASNGGRVQCLXVWPPVGKKKFETLSYLLDLDDAQFANXVEYLLRNGWILVRYHWSTFVYV

SEQ ID NO: 51444 - protein, 446 aa, Rhodococcus sp. RHA1
MDRQKEFVLRTLEERDIRFVRLWFTDVLGYLKSVAIAPAELEGAFEEGIGFDGSAIEGFSRVSEADTVAKPDASTFQVLPWSSSKGHQHSARMFCDIAMPDGSPSWADSRHVLRRQLNKASDLGFSCYVHPEIEFFLLENGPIDGTPPKPADSGGYFDQAVHDSAPNFRRHAIDALESMGISVEFSHHEAAPGQQEIDLRYADALSMADNVMTFRYVVKEVAIAEGVRATFMPKPFSDQAGSAMHTHMSLFEGDTNAFHNPDDPMQLSETGKAFIAGILEHANEISAVTNQWVNSYKRLIHGGEAPTAASWGPSNRSALVRVPMYTPNKASSRRVEIRSPDSACNPYLTFAVLLAAGLRGIEKGYELPPEAEDDVWALTSAERRAMGYRELPGNLDGALREMEKSELVAEALGEHVFDFFLRNKRREWEEYRSHVTPFELKTYLGL

SEQ ID NO: 51445 - protein, 510 aa, Arabidopsis thaliana
MFEAGGLFGFTGTTMASLMFFWSVYRQFVPYQIRDYLEKCFYKMFGLVSNSVHIKFTEYTEDKGLKKSQAYDLIRNYLSSKSTARAQRLKANESKNSKSLVLSLDNHEAVEDVFQGVKVVWSLSVWKSNDQADSSEKRYLTLSFHNRYREMITTTYLDHVLREGKEIGLKNRERKLYTNNSSQDYSAWREGRWSNVPFDHPATFETLAMDLEKKEGMKKDLIKFTKGKDYYRKVGKPWKRGYLLFGPPGTGKSTMISAMANFLEYDVYDLELTTVKDNSELKKLMLDTKGKSIVVIEDIDCSLDLTGQRKKKKEEDEDEEEEEKKKEAEKLLKRERGERESKVTLSGLLNAIDGLWSACSGEKIIVFTTNYLDKLDPALIRRGRMDNHIEMSYCRFEAFKVLAKNYLEIESHDLFGEIKRLVEETDMSPADVAENLMPKSDEDDADICLTRLVKSLEEEKEKAKKLAEEEKIKKAARDARRIKKKAEEEHKKKNKVEENGDVSHDNGNHI

SEQ ID NO: 51446 - protein, 493 aa, Oryza sativa (indica cultivar-group)
MASRKPPGIRLFGGITALRTYQTLVLVLTFVAYTCFHMTRKIPSIVKSVLDPQTKLGSSPWGRLHTKNTLNIGWLPFNTIDGSALLGEIDVAFLAVYSVGMFFAGHLGDRMDLRIFLTIGMFGTAVFTALFGAGYWLNIHNFYYFLVIQMIAGLFQAIGWPSVVAIVGNWFGKSKRGLIMGIWNAHTSVGNISGSLLAAFLLKFGWGWSFAIPSLIMVAVGLLVFVFLPVSPEVMEIDIDDGEISSVKDTTKEPLLEPGQEVKHNAVGFLEAWKIPGVAPFALCLFFSKLVAYTFLYWLPFYISHTPIGGEYLSDALAGSLSTIFDVGGVLGGVLAGHISDRLNARAVTAASFMYCAIPALFLYRTYGSMSIMWNICLMFITGMFVNGPYALITTAVSADLGTHSSLNGNSRALATVTAIIDGTGSVGAAIGPLLTGYISSSSWSAVFTMLMAAALLAGLLLTQLVCSELKGKATSNASKDVAAAQGTYSDEV

SEQ ID NO: 51447 - protein, 850 aa, Rhodococcus rhodochrous
MKADKDVVIVGAGFAGLYAVHKLRNELGLEVQAFDAGGGPGGTWWWNRYPGARCDFDSVYYSYSFSEEIQREWQWTEKYAAQPEILNYLEWVADRLDLKRSFQFNTRVTSMVWNDEGQYWTVGTDDGRTCTARYVVCGTGNVSIPKKPEFPGIEDFKGEVLQTSSWPHEPVDFSGKRVGIIGTGATGIQLIPELAKHAAHLTVFQRTAQFASPLGNEKLDPEARRWLAENHKQVRAGARDHFLGAPYDAPRPSALADSPEERKKVYDEHYGSGGFRMVVSTYGDLLYNRESNDTIADYLRDRIRERVTDPKIAEMLCPTDHPYATKRAPFETNYYETYNRDNVTLVDVRSTPIERVTEHALKTTAAEYEIDVLVMATGFDVFTRPLLEMGIVGRDGLTLDEKWSGVPGTYLGIQTAGFPNLFTVTGPQSAVALYNNALAIEDHVEWISRAIGHLRTTGATTIEPTAEAESRWGDFAEGILNQTLIPQSESSWYMGANVVGKTRGTYIFAAGAPVYRAICAQVAERGYAGFAIDGVETAVPPMAKLDPEVVTALSAIHRPGYKPLEDCTVEETRAMVEQLVGMQVPGPDMLVDDIVDPAVRLYVPRTQTEGTRPVIVFLHGGGWVAGSLDVVDNPCRQIARATDAIVVSVDYRLAPEHPFPAAHDDAFEAVRWVQENIAGYGGDADKIVIMGESAGGNLAASTALRARDAGLKLAGQVLVYPPTDPEASTQSRVEFADGPFLSVKAVDTMWGAYLNGAEVTETVAPLRAENLRDLPPALIFSMELDPTRDEAEDYARALQDAGVRVELHRFEGMIHGVFNMDAIVSAAPEMYSLTAQFVADTVTAEPVSVR

SEQ ID NO: 51448 - protein, 286 aa, Bordetella bronchiseptica RB50
MDTSSSSLPAIERQHLPALFAARPTDAHKGSCGTLGVIGGGPGMVGAALLAARAGLKVGAGKVLVGLVAETPPLPCDPMQPELMLRDFRGLLEAGLGIDAWTAGCGCGMDALAANALSELFQLRGDAALVLDADGLNLLAAGAVQPRWGDAPVVLTPHPAEAGRLLGLSTEAVQADRPAAARTLAARYGAWVVLKGAGSIVCDPAGACRINRTGNPGLATAGTGDVLAGILGALLAQRIAPEQAVPGAVWLHGAAADALVTHGIGPIGLTAGELADSARRLRNSRA

SEQ ID NO: 51449 - protein, 314 aa, Methylococcus capsulatus str. Bath
MGLHRLRQMTTRPLDVLCIGHASFDLVFSVPHHPAADEKIVADALLACGGGPAANAAVTVARLGRKAGFAGYLGMDLYGERHLEELRAAGIDTRAVVRGSSPTPLSVVLVKPDGRRALVNHKGDTRPLPPQAFVPPATPARCILFDGHEPDLSEPALAWARTHDAATVLDAGSLHGGSEWLMFRVGHLVASEKFAAQWLGKNDPERALAALAERSPCVVITLGEHGLIWRRGAESGRLPAFPVEAVDTTGAGDVFHGAYAAGLAAGMDWPEMLRYASAAGALCCTRLGARPGIPSGADVERLLAGYGSKPQVMG

SEQ ID NO: 51450 - protein, 390 aa, Pseudomonas syringae pv. phaseolicola 1448A
MPQPYSARSRAIEPFHVMALLARANELQAAGHDVIHLEIGEPDFTTAQPIIKAGQAALADGKTRYTAARGLPQLREAISGFYARRYGVDIDPQRILVTPGGSGALLLASSLLVDPGKHWLLADPGYPCNRHFLRLIEGEAQLVPVGPQERYQLNPELVAAHWNQNSVGALVASPANPTGTLLNRDELAALSQALKARNGHLVVDEIYHGLTYGVEASSVLEVDNEAFVLNSFSKYFGMTGWRLGWLVAPQDAVADLEKLAQNLYISAPSMAQHAALACFEPQTLEIFEQRRAEFGRRRDFLLPALRELGFGIAVEPEGAFYLYADISAFGGDAFAFCRHFLETEHVAFTPGLDFGRHQAGHHVRFAYTQSLPRLQQAVERIARGLRSWGA

SEQ ID NO: 51451 - protein, 436 aa, Clostridium perfringens SM101
MAQQVISKEQGSIKTLGIFSYFKNGILGLQHLVAMFGATILVPLVTGLDPSVALFTAGIGTLIFHLCTKGKVPVFLGSSFAFIPVIQVIAAKYGDLRYAQGGIFFAGLAYVLISFGIKKIGVDKIKRFLPARVVGPMIMVIGLNLIPNALEMAGVKSLIAGETGAMTSVLIACTTLGLALTISKFGKGFFSQLAIITAVFVGYTLSLILGQVDTSLIQQSTMVAVPNFTLPKFDFGAIMITLPVILAVSMEHIGDITTNGQVVGKNFIEDPGLNRTILGDGLATLVASLLGGPANTTYGENTGVLAITKNYNPSILRLTAVFAIILSFIAKFGAVIRTIPQSVMGGISLMLFSMIALVGVKTIKNEGVKLNKTNLILMGSIIFVGLSGLFMSEPIGIEISEAVSISGLSLAALIGVILNLIMTKFESAKSSKEVIA

SEQ ID NO: 51452 - protein, 415 aa, Pseudomonas syringae pv. phaseolicola 1448A
MDAFNYRDGELFAEGVALSAIAERFGTPTYVYSRAHIEAQYRAYADALSGMPHMVCFAVKANSNLGVLNVLARLGAGFDIVSRGELERVLAAGGKAEKIVFSGVGKTREDMRRALEVGVHCFNVESTDELERLQEVAAELDVRAPISLRVNPDVDAGTHPYISTGLKENKFGIAIADAEDVYIRASQLPNLEVIGVDCHIGSQLTTLEPFIDALDRLLDLVDRLGDCGIHLHHIDLGGGLGVRYRDEEPPLAADYIKAVRERLAGRDLGLLFEPGRFIVANAGALLTRVEYLKHTEHKDFAIVDAAMNDLIRPALYQAWMDVTAVRPRDGEPRAYDIVGPICETGDFLAKGRELALAEGDLLAVHSAGAYGFVMSSNYNTRGRAAEVLVDGSQAFEVRRRETVAELFAGESLLPE

SEQ ID NO: 51453 - protein, 325 aa, Thermococcus kodakarensis KOD1
MIALGIEGTAHTLGIGIVTEKSVLANVFDTLTTEKGGIHPKEAAEHHARLLKPLLRKALETAGVTMEDVDLIAFSQGPGLGPALRVVATAARALAIKYNKPIVGVNHCIAHVEITKMFGVKDPVGLYVSGGNTQVLALEGGRYRVFGETLDIGIGNAIDTFARELGIGFPGGPKIEKLALKGEKYIELPYAVKGMDLSFSGVLTEAVRKYRTGKYRIEDLAYSFQETAFAALVEVTERAVAHTGKEEVVLVGGVAANNRLREMLKIMAEDRGIKFFVPPYDLCRDNGAMIAYTGLRMYRGGVRFKIEDTVVKQKFRTDEVEVVWD

SEQ ID NO: 51454 - protein, 77 aa, Glycine max
ISSPAVATVNRAGACMVAPFTGLKSMDGFPTINTNDDVASIAIYGVTVQCIQVWTPVGRRKFDTLSYLPDLDDAAIG

SEQ ID NO: 51455 - protein, 646 aa, Oryza sativa (japonica cultivar-group)
METQSVRIRLGTEVVYKEQPSSVDGCEVEADVLLEAPLAAASSRSMCCCRRFIEAVAGQQEPRDAAQAGAAANSTVMACVASTRPAIAAPVAQAIRQMPDPRVAQRTSRRLRRALRRRRSRWFLRPTKLRCMPWKPAAGAGERVGHLVEQEEGVERAVAVRRGERGRVRYQREEVRDGPVQRPRAAQRPAEGEAEQRRVVRAAEVVRGEAGQLRVRRVPQRALHHRVLRLEHAGEGAPVLVLLIFLPTTTTTDAALPLPIPAVHMDLRPDLVVGAGVDGERVLLAQGAWVLKPKSQEPSFVVHFVGGIFVGAAPQITYRFFLERLADKGALVIATPYASGFDHFFIADEVQFKFDRCLRNMVEPVNDLPTFGVGHSLGSVIHLLIGSRYAVQRSGNILMAFNNKEASLAVPLFSPVIVPMAQSFGPIFSQLTSYPTLRFGAEAAIKQLENLSPPVVKQLLPLVQQLPPLYMDLVKGREEFVPKPEETRRLVKSYYGISRNLLIKFKDDQIDETSILAQVLSSESAISSLLDMSIRSLPGDHGLPLQQVLPDVPPAMADAVNRGGELLTNLATGTPWEAVAKEVGTGGAQYCTVLSANLQFSFTRNVHLVATEDGYFIRLLQQQQQQQLILSHMGSTYPDIKYCMCV

SEQ ID NO: 51456 - protein, 141 aa, Mannheimia succiniciproducens MBEL55E
MSLERTFSIIKPDAVERNLIGKILARFEQSGFEIVAAKMVRLTKAQAEGFYAEHQGKPFFEDLVEYMVSAPILVSVLQKENAVKDYRTLIGATDPAKAKEGTVRKEFAESLRRNSVHGSDSLESAAREIAYFFIDSEICSR

SEQ ID NO: 51457 - protein, 700 aa, Burkholderia mallei ATCC 23344
MTNQNRRDFLRLAAGTAGAAALQLFPPVIREALAIPANRRTGTIRDVEHIVILMQENRSFDHYFGKLRGVRGFGDPRPLALQNGKSVFHQPVLLGPAELLPFHPDASNLGMQFLQDLPHGWQDMHGAWNKGRYDRWIANKGTTTMAYLERDDIPFHYQLADAFTICDAYHCSIPSSTDPNRYYMWTGYVGNDGAGGGPVLGNEEAGYGWSTYPETLEQAGVSWKIYQDIGTGLDAAGSWGWTQNPYIGNYGDNSLLYFNQYRNAQPGSPLYDKARTGTNVSAGGTLFDVLQQDVQNGTLPQVSWICAPEAYSEHPNWPANYGAWYVEQVLKALTSNPDVWSKTALFITYDENDGFFDHVAPPFAPQSRENGLSTVSTAGEIFAGDATHMAGPYGLGPRVPMLVVSPWTKGGWVCSQTFDHTSLLQFIEARFNDRYSVRAPNVTPWRRAVCGDLTSAFNFSSPDGSWPQLPDTSGYAPPDRNRHPSYVPVPPAAQSMPKQEAGLRAARALPYELFVLGRIDQSTGKFKLTFANTGRAGAAFQVTAGNRLDGPWAYTVEARKRLSDEWSTALTLSIYDLTVYGPNGFLCQFRGSTAAALGLSANPEVIYGYDVANGNITLRLSNRGRAAVRLTVTNAYGNAAPRVYELKPGQRINDYWDLRDSHSWYDLSVSDGAPNGFLRRFAGHVETGRPSTSDPLIATA

SEQ ID NO: 51458 - protein, 421 aa, Bradyrhizobium sp. BTAi1
MNHFDYRDGVLHAEAVNLAGLAAQVGTPFYCYSTATLERHYRVFAEAFTGQDVLICYAMKANSNQSVLRTLAKLGAGADVVSGGELKRALAAGIPARKIVFSGVGKTEAELRAALAADIHCLNIESEPELDLLARLANETGHTARISVRVNPDVDAGTHAKISTGKSENKFGIPLEHARKVYARAAKMKGIEVTGVDVHIGSQITDLGPMETAFRILAEFVQTLRADGHTISHVDFGGGLGIPYHMDRAVPPEPAAYAAMVKRVSHNLGCTLMFEPGRMIVGNAGILVAKVIYVKHGEAKNFVIIDAAMNDLIRPTLYEAHHDILPVIQPAPNAPAFVADVVGPVCESGDYLALDRTLPEPRPGDLLAIMTSGAYGAVQACTYNTRALVPEVLVKGDQSAVIRPRIEVEQLIAMDTPAPWL

SEQ ID NO: 51459 - protein, 226 aa, Bradyrhizobium sp. BTAi1
MSAITAICAGSPGCGRCSTSSSRNWRPREMRLTLRRSRSRRRSGSRPPRASSFVQCHRNPAYAAMVKRVSHNLGCTLMFEPGRMIVGNAGILVANVIYVKHGEAKNFVIIDAAMNDLIRPTLYEAHHDILPVVQPAPGAPSFTADVVGPVCESGDYLALDRTLPEPAPGDLLAIMTSGAYGAVQACTYNTRALVPEVLVKGDQAAVIRPRIEVEQLIAMDTPAPWL

SEQ ID NO: 51460 - protein, 453 aa, Mycobacterium sp. JLS
MKTLHDKQDDHARLAAELADDGVQFAMAAWVDVTGRPKSKVVPIGHLPDMLAGSERYTPRGIGRLGEMNPAEDECVGLPDPDTMRILSWDPRIALFHADLVLGDAGEPFENCPRSALKGVIAKARDMGFAMNLGVETEFYLFRTSALPELTPRFASSVIEPTPAYDARAVIDSLEFFSEVSAHMEAAGYGLYSFDQEGGEGQYELDFSYTDVLSMCDRLTYMRLMLPALAQKVDATVSFMPRPETRSWGSGAHMNMSLVSTTTGDNVFVEPDGSWSKTAMSFAAGVLRHAPALSALTCPTVNSYKRLTPKLADGTVSWAPVWARYGTNNRSCMLRLPGNRPAIENRSVDMMANMYLASAFTLAAGLEGIELGLDPGEPVTDDASDWEASAGGAGERLPRTLLEAIDAFATDPLVATTFPAGFVRDYLAMKVDEWNGYHSVVTQWEVDRYLLDV

SEQ ID NO: 51461 - protein, 156 aa, Triticum aestivum
  misc_feature (71)..(71): Xaa can be any naturally occurring amino acid
ICPCAVSLGPKLYETVRGKLSLGARILQAGGVEKVFRRWFSVEKGEKLLNASQCYLSTTAGPIAGMLFVSXRRVAFRSDRSLALTSPKGDTVRVPYKVAVPLRRVKAARRSENQHRPEQKYVQLVTDDGFEFWFMGFVSYQASLQHLEQAIAESHL

SEQ ID NO: 51462 - protein, 332 aa, Candida albicans SC5314
MPFVNKSGFFDPSTAPYYDPKETRKVVFITGGNSGIGWYTVLHLYLHGYIVYVAGRTESKVLKAIDDIKAEAENRQAKETTKHPLGELNYIHIDLLDLSTVTKAVDEFAEKEKILDVLINNAGLMGVPYEVTKDDYEIQYQVNFVAHYLLTLKLLPFLQSAVKIGVTPRIINLASIGHNFQFKHFTPEQNKLDKFPNSVFTWVRYGIAKSSQIQFAKELANHYPDILSVSVHPGVILGTELYNHWKNIPIIGIGARGIFALSDKLIGVSNEEGSLATLRAALDPSLTLKENGEYLITGGKIDEPSKIASNTQYSKETWDWNYEQLKKRGYNI

SEQ ID NO: 51463 - protein, 745 aa, Burkholderia mallei ATCC 23344
MTADSASTAAAPSLDDVLAFVREHAGDARLSSGERLADHAAGTSTIMQRLNVDPPATQAAALFALAPYLSDPDKQIAEHFGDEVAHLVADVRKLLRLGTVSLRAVQSAPVDAGRDAQAERRAQIEALRKMLLAFAQDIRVVLIRLASRLQSLRYYAAAKIEPPPDVARETLEIYAPLANRLGIWQLKWELEDLAFRFEDPVTYKRIAKLLDEKRVEREAYVAGAIERLQHELAAAHIQAEVSGRPKHIYSIWRKMRGKELDFSELYDVRAFRVIVPDIKDCYTVLGIVHHLWQPVPKEFDDYISRPKPNGYKSLHTVVIGDDGRAFEVQIRTQEMHRFAEYGIAAHWRYKEAGARGYGGQFSASEKYDEKIAWLRQLLAWKDEIADGGGAEVSGQQAWAQLREATLDDDHIYVLTPQARVIALPQGATPVDFAYHLHSELGHRCRGARVDGAMVPLNTQLANGQTVEIVAVKEGGPSRDWLNPQLGYLHSSRARQKVRAWFNAVDQQENVAHGRALVEKTLQREGKTSVNLEHLAAKLGFKSPDELFSVVGKEEFSLRNVEQALSDAPAPEPEPEAPANFEKRASGANVAHGASAGVLVVGVDALLTQLARCCRPAPPDPISGFVTRGKGMSIHRSDCATFRRMAERAPERVLQTTWSADVLGGRGASVYPVDLMIEATDRQGLLRDISEVFAREKMNVIGVKTQSRRNAAFMQFTVEVSSASQVQRACTLLGEIQGVVRAARKA

SEQ ID NO: 51464 - protein, 447 aa, Corynebacterium glutamicum ATCC 13032
MTVDEQVSNYYDMLLKRNAGEPEFHQAVAEVLESLKIVLEKDPHYADYGLIQRLCEPERQLIFRVPWVDDQGQVHVNRGFRVQFNSALGPYKGGLRFHPSVNLGIVKFLGFEQIFKNSLTGLPIGGGKGGSDFDPKGKSDLEIMRFCQSFMTELHRHIGEYRDVPAGDIGVGGREIGYLFGHYRRMANQHESGVLTGKGLTWGGSLVRTEATGYGCVYFVSEMIKAKGESISGQKIIVSGSGNVATYAIEKAQELGATVIGFSDSSGWVHTPNGVDVAKLREIKEVRRARVSVYADEVEGATYHTDGSIWDLKCDIALPCATQNELNGENAKTLADNGCRFVAEGANMPSTPEAVEVFRERDIRFGPGKAANAGGVATSALEMQQNASRDSWSFEYTDERLQVIMKNIFKTCAETAAEYGHENDYVVGANIAGFKKVADAMLAQGVI

SEQ ID NO: 51465 - protein, 252 aa, Zea mays
  misc_feature (184)..(184): Xaa can be any naturally occurring amino acid
  misc_feature (193)..(193): Xaa can be any naturally occurring amino acid
  misc_feature (215)..(215): Xaa can be any naturally occurring amino acid
MASRMSLTRLSAPLAKRALSTTAPAAVASSSAAKLTGRNALLSTPVARVHRGESRFLVGQEQRRMASSEEGGSTMTVREALNAAMEEEMTRDDSVFVMGEEVARYNGAYKITKGLMDKFGEDRVIDTPITESGFAGMAVGAALAGLRPVCEFMTWNFAMQAIDQIVNSGGKTSYMSGANVPGPXTFRGPNGAXAAGVAAQHSQDYCAWYGSIPGXLKVVSPWSAADLQGLLKAAIRDPNPVCVLETSSCTVS

SEQ ID NO: 51466 - protein, 351 aa, Oryza sativa (japonica cultivar-group)
MARIHADPVLEADQFDRLPDSLVLVILNNVEDVRSLGRCSAVSKRFYGLVPLVHDVYVKIDRVVTVDGEAEDALNLSSPKPRNILSHFLKMMLFTIIKPFHSMRGPNGAGRPLFPQLAQHSPAQVLRNFTHIRNLRVELPSGDVGTEEGVLLKWRAEYGSTLQNCVILGGTQVDRKPVGAEHELYSEDNGSMPESFYTNGGLKLRVVWTISSLIAASTRHYLLRSIIKDHPTLTSLVLTDADGQGTLSMGAEQLKEFRENQLSASACSNRTQVPACNMKLKYAPYLELPGGIALQGATLVAIKPSPEGSNGGHTSRKETDAFVSGAFDGPFKFAVKALMKRRTYLLEMNGF

SEQ ID NO: 51467 - protein, 447 aa, Geobacillus kaustophilus HTA426
MAIEQLTMPQLGESVTEGTISKWLVSPGDKVNKYDPIAEVITDKVSAEIPSSFAGVIRELIAKEGETLPVGAPICTIEVEGAAPASEAKPADEAPKAEDNAKPAAPKKAGRANNGRYSPAVLRLAQEHGIDLEQVEGTGLGGRVTRKDLLKLIESGQIPKAGAAPAAEQAAPKAEPRTEQPATAAATVQPSAAAAPTAPQAAPIKPAAPNVEAGAGDIEIPVTPVRKAIAANMLRSKHEAPHAWTMVEVDVTDLVAYRDAIKDEFRRREGFNLTYFAFFVKAVAQALKEFPQLNSVWAGDKIIQRKDINISIAVATDDALFVPVIKHADEKTIKGIAREIAELAAKTRAGKLRPEDMQGGTFTVNNTGAFGSVQSMGIINYPQAAILQVETIVKRPVVKNGMIAIRDMVNLCLSLDHRVLDGLICGRFLARVKAILENMNKDNTPIY

SEQ ID NO: 51468 - protein, 327 aa, Geobacillus kaustophilus HTA426
MPVISYIDAVTMAIREEMERDPRVFVLGEDVGRKGGVFKATQGLYEQFGEERVIDTPLSESAIVGVGIGAAMYGLRPIAEIQFADFIMPAVNQIISEAARIRYRSNNDWNCPIVIRAPYGGGVHGALYHSQSVEAIFANQPGLKIVMPSTPYDVKGLLKAAIRDEDPVLFFEHKRAYRLIKGEVPEDDYVLPIGKADVKREGDDITVITYGLCVHFALQAAERVAQDGISVHLLDLRTVYPLDKEAIIEAASKTGKVLLITEDNKEGSVMSEVAAIIAEHCLFDLDAPIMRLAGPDVPAMPYAPTMEKFFMINPEKVEKAMRELAAF

SEQ ID NO: 51469 - protein, 473 aa, Geobacillus kaustophilus HTA426
MAKEYDVVILGGGTGGYVAAIRASQLGLKTAVVEKGKLGGTCLHAGCIPSKALLRSAEVYAQTKNGEAFGVIADGVRLDFAKVQARKAAIVEQLHKGVQHLMKKGKIDVYAGTGRLLGPSIFSPLPGTVSVEMNDGSENEMLVPKFVVIATGSRPRTLPGLEPDGEFVMTSDEALQMETLPSSILIVGGGVIGMEWASMLNDFGVDVTVLEYADRILPTEDEDVSKEMEKLLRRRGVNIVAGAKVLPETLEKGNGVTIQAEHQGERKTFTADKMLVSVGRQANIEGIGLENTEIVVEKGYIQTNEFGQTKESHIYAIGDVIGGLQLAHVAAHEGIVAIEHLAGHNPAPIDYTMVPRCIYTRPEAAAVGLTEQEAKAKGYDVKVGKFPFKAIGKALVFGEAEGFVKLIADRNTDDLLGVHMVGPHVTDLISEAGLARVLDAAPWEVAHAIHPHPTLSEAMAEAALAVDGKAIHF

SEQ ID NO: 51470 - protein, 367 aa, Geobacillus kaustophilus HTA426
MELFQYMEKYDYEQVLFCQDKESGLKAIIVIHDTTLGPALGGTRMWMYNSEEEALEDALRLARGMTYKNAAAGLNLGGGKTVIIGDPRKDKNEAMFRAFGRFIQGLNGRYITAEDVGTTVADMDIIYQETDYVTGISPEFGSSGNPSPATAYGVYRGMKAAAKEAFGSDSLEGKVVAVQGVGNVAYHLCRHLHEEGAKLIVTDINKEAVARAVEEFGAKAVDPNDIYGVECDIFAPCALGGIINDQTIPQLKAKVIAGSANNQLKEPRHGDMIHEMGIVYAPDYVINAGGVINVADELYGYNRERAMKKIEQIYDNIEKVFAIAKRDNIPTYVAADRMAEERIETMRKARSQFLQNGHHILSRRRAR

SEQ ID NO: 51471 - protein, 669 aa, Saccharomyces cerevisiae
MLRTRLSVSVAARSQLTRSLTASRTAPLRRWPIQQSRLYSSNTRSHKATTTRENTFQKPYSDEEVTKTPVGSRARKIFEAPHPHATRLTVEGAIECPLESFQLLNSPLFNKGSAFTQEEREAFNLEALLPPQVNTLDEQLERSYKQLCYLKTPLAKNDFMTSLRVQNKVLYFALIRRHIKELVPIIYTPTEGDAIAAYSHRFRKPEGVFLDITEPDSIECRLATYGGDKDVDYIVVSDSEGILGIGDQGIGGVRIAISKLALMTLCGGIHPGRVLPVCLDVGTNNKKLARDELYMGNKFSRIRGKQYDDFLEKFIKAVKKVYPSAVLHFEDFGVKNARRLLEKYRYELPSFNDDIQGTGAVVMASLIAALKHTNRDLKDTRVLIYGAGSAGLGIADQIVNHMVTHGVDKEEARKKIFLMDRRGLILQSYEANSTPAQHVYAKSDAEWAGINTRSLHDVVENVKPTCLVGCSTQAGAFTQDVVEEMHKHNPRPIIFPLSNPTRLHEAVPADLMKWTNNNALVATGSPFPPVDGYRISENNNCYSFPGIGLGAVLSRATTITDKMISAAVDQLAELSPLREGDSRPGLLPGLDTITNTSARLATAVILQALEEGTARIEQEQVPGGAPGETVKVPRDFDECLQWVKAQMWEPVYRPMIKVQHDPSVHTNQL

SEQ ID NO: 51472 - protein, 1062 aa, Debaryomyces hansenii CBS767
MDGEDLFDVFDEAPANAPPVIQTEPNSKKETSKKRQASEEPKENGEEKQAKKEKKTDTKKDEKTKAKQDITPVVFDAVEIEASREVAVSDGLMGKTSDAKPGQLQLRHQVRHQVAIPPEYPYVPIGEHKRQNEARTYPFVLDPFQDTAISCIDRSESVLVSAHTSAGKTVVAEYAIAQSLREKQRVIYTSPIKALSNQKYRELLAEFGDVGLMTGDVTINPDAGCLVMTTEILRSMLYRGSEVMREVAWVIFDEVHYMRDKARGVVWEETIILLPDKVHYVFLSATIPNAMEFAEWIVKIHAQPCHVVYTDFRPTPLQHYLFPAAGDGIHLVVDEKGTFREENFQKAMASISDNVGDDPSSADKSKGKKGQTYKGGNKDGKSDIYKIVKMIYMKRYNPVIVFSFSKRDCESLALKMSKLDFNTDDEREALTKIFNNAIELLPDADKELPQIKNILPLLRRGIGIHHSGLLPILKEIIEILFQEGLLKVLFATETFSIGLNMPAKTVVFTSVRKWDGKGFRWVSGGEYIQMSGRAGRRGLDDRGIVIMMIDEKMEPQVAKGMVKGQADRLDSAFHLGYNMILNLMRVEGISPEFMLESSFYQFQNAASVPVLEKNLQELTLKSNSIQIDDEATVREYYDLKKQFDIYQDDVRQVVTHPGHILPFLQAGRVIKVKVGDMDYGWGMVTSFTKRTNKRNPSQTYSDHEAYIVNVFVYTMFVDSPVNLIKSFNPDLPIGIRPANAGEKSRAEYIPITLDSIEKISSVRLRVPDEFKSSSAKKNLLKTMKDLPKRLPDGIPLMDPIESMKIDDNDFKLLLRKIDVLESKMLSNPLHESVRLKDLYEKYSEKVEIENKIKSLKDKILEAQAVIQLDDLRHRKRVLRRLGFTTQNDIIELKGRVACEISTGDELLLTELIFNGTFNDLTCEQCASLLSCFVFQEKAKEVPRLKPELAEPLKSMQDMASKIAKVFKECKIELVEKEYVESFRPELMEVTYAWCKGASFTQICKMTDVYEGSLIRMFKRLEEMLRQMVTAAKTIGNAELEEKMEKSMGLVHRDIVSAGSLYL

SEQ ID NO: 51473 - protein, 431 aa, Pseudomonas fluorescens Pf-5
MRALSFRLIFLGSSLLLAVVFIAAWRSHPPHQLAPFAQATVGSDAAKANSTPQYNSRFVSSDLDDFVHSSSVTALPGGDLMAVWFAGSREGAADVQVRSARFDAQSGEWGAEQVLATRESTRVGTGRYIRKLGNPVIALGPDQRLWMFYVSVSVGGWATSAINLMVSDDLGRSWSAPRQLVTSPFFNISTLVRAAPVFHADGSIGLPVYHEFMGKFAEYLYLSADGAVIDKFRISRGKHSLQPTIVPLDERRAVAMLRYAGDTHHKVLASRTEDAGQTWSEPYPLQPSNPNSSLAAVGTDDQGLLVALNDLQDGRFKLSLYGTDAGLSQWRPLVELDQSPDPLGQPFSHEAYKDIIGEGFRASSGARRLPLEQRFLSNLDYRVCKPQGCDFEYEYPYFSRGTDGLYHLVYSWNNTFIKHVSFNAAWLAERL

SEQ ID NO: 51474 - protein, 177 aa, Glycine max
ERARERERQEEEGRAKPKGKGPPVQRKPLKHRDYEVDLESRLGKTQVVTPVAPLSQQAGYYCSVCECVVKDSANYLDHINGKKHQRALGMSMRVERASLEQVQERFEVLKKRKDVGSFTEQDLDERILKQQQEEEERKRLRREKKKEKKEKAVEEPEIDPDVAAMMGFGGFRSSNKK

SEQ ID NO: 51475 - protein, 520 aa, Zea mays
  misc_feature (152)..(152): Xaa can be any naturally occurring amino acid
  misc_feature (156)..(156): Xaa can be any naturally occurring amino acid
  misc_feature (170)..(170): Xaa can be any naturally occurring amino acid
MDKAYVAVLSFAFLFVIHYLVGRAGRKGNGKGKGTQRLPPSPPAVPFLGHLHLVKTPFHEALAGLAARHGPVFSMRMGSRRALVVSSPECAKECFTEHDVVFANRPRFATQDLVSFGGAALAAASYGPYWRNLRRVATVQLLSAHRVACMSXSSPXEVRAMARRMGRAGXAAPGGAARVQLKRRLFEVSLSVLMETIARTKTSRAEADADSDMSPEAHEFKQIVDEIVPHLGTANLWDYLPVLRWLDVFGVRNKITAAVGRRDAFLRRLIDAERRRLDDGGGDSDSDKKSMIAVLLSLQKSEPEVYTDTMIMALCGNLFGAGTETTSTTTEWAMSLLLNHREALKKAQAEIDAVVGTSRLLAAEDVPRLGYLHRVISETLRMYPAAPLLLPHESSADCKVGGYDVARGTLLIVNAYAIHRDPLVWEDPDEFRPERFEDGKAEGRLLMPFGMGRRKCPGETLALRTISLVLGTLIQCFDWDRVDGHEIDMAAGGGLTLPKAVPLEATCKPRAAMRHLLLEL

SEQ ID NO: 51476 - protein, 139 aa, Triticum aestivum
MRGAPSRTREAPASVQTHHDTDVVVEKIDGDVKTEATPAVPEEEKKGFLEKIKEKLPGGHKKPEDAAAVPVTHAAPAPVTHAAPAPVHAPAPAAEEVSSPDAKEKKGLLGKIMDKLPGYHKTGEEDKAAAATGEHKPSA

SEQ ID NO: 51477 - protein, 179 aa, Malus x domestica x Pyrus communis
MASSMISSGTVATVSAPAQARMVAPFTGLKSSSAFPVTRKSNDITSIASNGGRVQCMQVWPPLGLKKFETLSYLPPLSTESLAKEVDYLLRKNWVPCLEFELEHGFVYRENNRSPGYYDGRYWTMWKLPMFGCTDSSQVLKELEEAKKAYPQSFIRIIGFDNVRQVQCISFIAYKPPGV

SEQ ID NO: 51478 - protein, 665 aa, Pseudomonas syringae pv. phaseolicola 1448A
MPSRRERANAIRALSMDAVQKANSGHPGAPMGMADIAEVLWRDYLKHNPANPAFADRDRFIMSNGHGSMLVYSLLHLTGYDLSIDDLKNFRQLHSRTPGHPEFGYTPGVETTTGPLGQGFANAVGFAAAEKTLAAQFNRPGHSIVDHHTYVFMGDGCMMEGISHEVASLAGTLQLKKLIAFYDDNGISIDGEVEGWFTDDTPKRFESYGWLVIRNVDGHDPEEIKTAIDTARKSDKPTLICCKTTIGFGSPNKQGKEESHGAPLGADEIALTRAALKWNHGPFEIPADIYAEWNAKEKGLAAEAEWDQRFAAYSAAFPELANDFIRRMSGELPADFAEKSAAYVAEVNAKGETIASRKASQNALSALGPLLPEILGGSADLAGSNLTIWKGCKSITGEDPNGNYLHYGVREFGMGAMMNGIALHGGFVPYGATFLIFMEYARNAVRMASLMKKRVIYVFTHDSIGLGEDGPTHQPIEQLTSLRTTPNLDTWRPADAVESAVAWKHAIERNDGPSALIFSRQNLTHQAREQQQIDAIARGGYVLRDCAAEPELILIATGSEVGLAVQAYDKLTEQGRNVRVVSMPCTSIFEAQDAAYKQAVLPLQVSARIAIEAAHADYWYKYVGLEGRVIGMTTFGESAPASALFEEFGFTLENVLSTAEELLED

SEQ ID NO: 51479 - protein, 169 aa, Triticum aestivum
  misc_feature (40)..(40): Xaa can be any naturally occurring amino acid
  misc_feature (54)..(54): Xaa can be any naturally occurring amino acid
  misc_feature (65)..(65): Xaa can be any naturally occurring amino acid
  misc_feature (74)..(74): Xaa can be any naturally occurring amino acid
  misc_feature (90)..(90): Xaa can be any naturally occurring amino acid
  misc_feature (144)..(144): Xaa can be any naturally occurring amino acid
FIDILRRAKADVLASIVGKAASEIVASRNVTMAANVLLDXCALSSKYDLISLPXGGLGGAQAYAXSDILIGVIXSLAEPYNLYGAICASXPATALEPHGLLKGKQATSYPAMWSNLTDLSVCKHRVVLDGNLITIQGPGTSMEXFSLAIAEKLFARERALELTKSMVFV

SEQ ID NO: 51480 - protein, 434 aa, Oceanobacillus iheyensis HTE831
MNKSDQHWQELVNSIGNFLAPSMAKDHPNLPVVKAEGCYYYGTDGKEYLDFTSGIAVENVGHRHPKVVQAIKDSADHLVHGPSGVIIYESILKLAQELQEIMPPKLDNFFFANSGTEAIEGGLKLAKHVTKRPYVISFTGNFHGRSIGSLSVSTSKSKYRKYQQPSWLTYQLPYALPEYLPEGQDPEVFFAEKLEKDAESLFKHQVDPEEVACMILEPIMGEGGYIIPPKSWLQKVREICDRHGILLIFDEVQTGFGRTGDWFAAQTFGVTPDIMAIAKGIAAGMPLSATVASKELMDQWPLGSHGTTFGGNPIACAAARASLSIMKEEKLLNNAKTMGDYALTKLSGLKDKYEIVHEVRGIGLMLGIELRDPETGEPDGEAVMKALNGCLDEGVLFYLCGNAGEVIRMIPPLTINKEQIDQGIDVLDKVLAQM

SEQ ID NO: 51481 - protein, 399 aa, Bacillus anthracis str. Ames
MTYTLATRMKAFQSSIFSELGAYKKEKIAAGHKMIDLSIGNPDMPPADFVREEMVHTANQKESYGYTLSGIQEFHEAVTEYYNNTHNVILNADKEVLLLMGSQDGLVHLPMVYANPGDIILVPDPGYTAYETEIQMAGATSYYMPLKKENDFLPNLELIPEEIADQAKMMILNFPGNPVPAMAHEDFFKEVIAFAKKHNIIVVHDFAYAEFYFDGNKPISFLSVPGAKDVGVEINSLSKSYSLAGSRIGYMIGNEEIVGALTQFKSNTDYGVFLPIQKAACAALRNGAAFCEKNRGIYQERRDALVDGFRTFGWNVEKPAGSMFVWAEIPKGWTSIDFAYALMDRANVVVTPGHAFGPHGEGFVRIALVQDKVVLQQVVENIRNSGIFALEKVDELVKN

SEQ ID NO: 51482 - protein, 557 aa, Shewanella sp. MR-4
MDQPWINHLPKDVPAEINVDQYSSLVDMFETAVAKYADQPAFINMGATLTYRKLEERSRAFAAYLQNELKLQKGDRVALMMPNLLQYPIALFGILRAGMVVVNVNPLYTPRELKHQLVDSGAKAIVVVSNFARTLEEVVEQTPVKSVIITSLGDQLSAPKRTLVNFVVKYIKKLVPKYDLPHALSMRETLSRGRRMQYVKPVITGDDLAFLQYTGGTTGVSKGAMLTHRNVVANVLQANGAYSPALRDGSEFVVTALPLYHIFALTVNCLLFLHKGSQNLLITNPRDIPGFVAELKKYPFTALTGVNTLFNALVNSSDFAELDFSRLKLSIGGGMAVQKAVADKWQSITKTRLLEGYGLTEASPLLTCCPYNLDGYNGSIGFPAPSTLIQVRDDAGNVLPQGETGELLGKGPQIMKGYWQRPEETAKVIDKDGWLATGDIGYMDEQGFFYIVDRKKDMILVSGFNVFPNEVEEVVALHPKVIEVAAVGVPNDASGELVKVFVVAKDKSLTADDIIKHCRAHLTGYKVPKLVEFRDELPKTNVGKILRRELRDEVKRA

SEQ ID NO: 51483 - protein, 219 aa, Leymus triticoides
  misc_feature (50)..(50): Xaa can be any naturally occurring amino acid
GRRRVEMEDRHVAKLALGGDPEVALFAVFDGHGGAAEFAAENMPKFMAEXVRKVDGGGSEEIEGAVKKCYLKTDEEFLKREESGGACCVAALLQKGGLTVSNTGDCRAVLSRAGTAEALASDHRASCEDERERIENLGGFIVNNRGTWRVQDSLAVSRGIGDAHLKQWVVADPDTRTLLVDPQCEFLVLASDGLWDKVDNQEAIDIARPLCIGNDKASR

SEQ ID NO: 51484 - protein, 221 aa, Leymus cinereus
GRRRVEMEDRHVAKLALGGDPEVALFAVFDGHGGKNAAEFAAQNMPKFMAEEVRKVDGGDSDEIEGAVKKCYLKTDEEFLKREESGGACCVTALLQKGGLTVSNTGDCRAVLSRSGTAATLTSDHRASREDERERIENLGGFVVNNRGTWRVQGSLAVSRGIGDAHLKQWVVADPDTRTLLVDPQCEFLVLASDGLWDKVDNQEAIDIARPLCIGNDKASR

SEQ ID NO: 51485 - protein, 307 aa, Oryza sativa
ALSRAEEVMFSFRKKHASRFDSDDIEQQEAKIQELRAALGPLSSSGKKYCTEACLRRYLEARNWNVDKSRKMLEESLKWRTAYRPEDIRWPEISVESETGKMYRASFVDREGRTVVIMRPAKQNTSSHEGQVRFLVYTLENAILSLPEDQEKMVWLIDFTGWTLANATPIKTARECANILQNHYPERLAIGILFNPPKVFEAFWKVVKHFLDPKSIQKVNFVYLKNEESMKILHKYIDPEVLPVEFGGKNNVVYSHEEYSKLMVKDDIKMASFWASDTKTDHVNKVINEHSVPEVTQQSSLVAAKAS

SEQ ID NO: 51486 - protein, 433 aa, Robiginitalea biformata HTCC2501
MHIVIIGNGISGITAARFIRKAADHSITVISAETDHFFSRTALMYIYMGHLTYEQTKPYEDSFWKKNRIDLVNAWVESVDPAAKTVRLSEGASIRYDKLILATGSKPNKFGWPGQDLPGVQGLYSKQDLDNLEANAPDNRTCKRAIIVGGGLIGIELAEMLRTRDIPVTFLVRENSFWSGVLPAGESAMINEHIREHHIDLRLGTNLVEILADDTGRARAVTTDKGETIDCDLVGLTAGVTPNIGFLDGSGIETGKGVLVNRFLETNHADIYAIGDCAEQREPIGNRRPVEAVWYTGRMMGEAVAQTICGNRREYKPGHWFNSAKFLDIEYQTYGWVMSGKNRGPRELHFHWRHPEKKICLTLAYDSKTRQLLGANTFGMRMRHEVFDAWLTEQRSIDAVVRDLRVACFDPEFHRDYHPLITRAFKEHEPVNA

SEQ ID NO: 51487 - protein, 629 aa, Listeria monocytogenes str. 4b H7858
MAFSLWKNHLKFNPEHPTWFNRDRFVLSAGHGSAMLYSLLHLFGYDLPMSELKNFRQTGSKTPGHPEFGHTVGVDATTGPLGQGFAMGVGMAMAEAHLGAKFNQPEFPVVDHNTYVLCGDGCLMEGISYEAASLAGHLKLGKLVVLYDSNDISLDGDLNESFSEDIELRFRAAGWQTLRVDDGNDLDALDAAIHLAKTEKSRPTLIEVKTVIGYGSPGKAGKSAAHGSPLGEKELKLAKEAYDWQMPPFELPKTVENQKEFYHSKGRASESSWLRTFNAYKQKYPALAESLQQLMDDNLDADWDAELPVFDENADKAVATREVSGIVLQELEKKLPNLFGGAADLASSNKTHLKASERFAPGNYAAKNISFGVREFAMGAAVNGMTLHGGVQAFGATFFVFSDYLRSAIRSAALMGIPSTFIMTHDSIAVGEDGPTHEPIEHLASFRAMPGLHVIRPADGNETVEAYRYAFTQKEQPTMLVLSRQNLPILPNSAAKAQTGLAKGAYILADSPLDKLDIILLASGSEVHLMTAVRDNLAKKGFGARVVSMPSFDLFDKQSPEYKESVLPKAVKNRFAAEMGASYGWHKYLGDTGQILAIDSFGMSGPGDELARRFGFTVENLTELALKQL

SEQ ID NO: 51488 - protein, 118 aa, Corynebacterium glutamicum ATCC 13032
MSDNPQEYELDWDVEKRLKLNDAGLVPAIVQADGTNEVLMMAWMDTHALAYTLATRRGTYFSRSRNEYWIKGLTSGNVQEVTGLALDCDGDTVLLTVKQTGGACHTGAHTCFDNDVLL

SEQ ID NO: 51489 - protein, 683 aa, Saccharomyces cerevisiae
MNKELASKFLSSIKHEREQDIQTTSRLLTTLSIQQLVQNGLAINNIHLENIRSGLIGKLYMELGPNLAVNDKIQRGDIKVGDIVLVRPAKTKVNTKTKPKVKKVSEDSNGEQAECSGVVYKMSDTQITIALEESQDVIATTFYSYSKLYILKTTNVVTYNRMESTMRKLSEISSPIQDKIIQYLVNERPFIPNTNSFQNIKSFLNPNLNDSQKTAINFAINNDLTIIHGPPGTGKTFTLIELIQQLLIKNPEERILICGPSNISVDTILERLTPLVPNNLLLRIGHPARLLDSNKRHSLDILSKKNTIVKDISQEIDKLIQENKKLKNYKQRKENWNEIKLLRKDLKKREFKTIKDLIIQSRIVVTTLHGSSSRELCSLYRDDPNFQLFDTLIIDEVSQAMEPQCWIPLIAHQNQFHKLVLAGDNKQLPPTIKTEDDKNVIHNLETTLFDRIIKIFPKRDMVKFLNVQYRMNQKIMEFPSHSMYNGKLLADATVANRLLIDLPTVDATPSEDDDDTKIPLIWYDTQGDEFQETADEATILGSKYNEGEIAIVKEHIENLRSFNVPENSIGVISPYNAQVSHLKKLIHDELKLTDIEISTVDGFQGREKDVIILSLVRSNEKFEVGFLKEERRLNVAMTRPRRQLVVVGNIEVLQRCGNKYLKSWSEWCEENADVRYPNIDDYL

SEQ ID NO: 51490 - protein, 1028 aa, Thermus thermophilus HB27
MPPRRDLKKILIIGSGPITIGQAAEFDYSGTQAVKALRGAGYRVVLVNSNPATIMTDPELAERTYIEPLDLEHLEGILAREAPDALLPTLGGQTGLNLAMALYEEGILQKYGVELIGAKAEAIRKGEDREAFQEAMRRIDLEVPRGQLVGSVEEGLHFAREVGFPVVVRPSFTLGGTGGGIAHDEAELVEVLSRGLTLSPVHTALVEESVLGWKEFELEVMRDHADTVVIITSIENVDPMGVHTGDSITVAPAQTLSDVEYQRMRDAAKAIIREIGVETGGSNIQFAVDPKTGRQVVIEMNPRVSRSSALASKATGFPIAKIAALLAVPYRLDELPNDITRKTPASFEPTIDYVVVKIPRFAFEKFRPLRNTLGELKDELTTQMKSVGEVMAIGRTFKEALMKALRGLERDVRALAGVRTEELEKKLYPNPDRVYAVMELLRRGMPVEELYQATRIDPWFLHQMKEIVEAEEWLKTHPPKDREDWRFYQGLGLTDRRIGELLGKGEKEVRAERKALGVVPVYKTVDTCAAEFEAYPPYHYSTYELEDEVWPSQKPKVVILGSGPIRIGQGVEFDYPTVHAVWALKEAGFETIMVNSNPETVSTDYDTADRLYVEPLTLEDVLNIVEHQKPIGVIATLGGQTPLKLAKGLEEAGVRLLGTPFSAIHQAEDREAFHALCQRLGIPQPEGRVAQSPEEALRLAPEVGFPLLVRPSYVLGGRAMQVVRDEGELKRYLEEVYAPLEERPSILLDRFLEGAIELDVDALSDGQEVMVAGIMEHVERAGVHSGDSATLLPPVHVPEEALKKVRDYTRRLALTLGVRGLLNVQYAVVGEEVYVLEANPRASRTVPFVSKAIGVPLAKLAALIAVGKTLKELGVRDLDPVPPYYAAKEVVIPWIKFPGVIPELGPEMRSTGESMGIDQDPYLAYYKAELGAGQRLPLSGQVRFIGEGLEDLKALYQEAGFALTEGQDYDLLISLVPDPELRRAVERGLPFITTREGAWWSLKAILRARESGLRVQSLQDWHQKAPRG

SEQ ID NO: 51491 - protein, 452 aa, Mycobacterium tuberculosis CDC1551
MTPRSYCVVGGGISGLTSAYRLRQAVGDDATITLFEPADRLGGVLRTEHIGGQPMDLGAEAFVLRRPEMPALLAELGLSDRQLASTGARPLIYSQQRLHPLPPQTVVGIPSSAGSMAGLVDDATLARIDAEAARPFTWQVGSDPAVADLVADRFGDQVVARSVDPLLSGVYAGSAATIGLRAAAPSVAAALDRGATSVTDAVRQALPPGSGGPVFGALDGGYQVLLDGLVRRSRVHWVRARVVQLERGWVLRDETGGRWQADAVILAVPAPRLARLVDGIAPRTHAAARQIVSASSAVVALAVPGGTAFPHCSGVLVAGDESPHAKAITLSSRKWGQRGDVALLRLSFGRFGDEPALTASDDQLLAWAADDLVTVFGVAVDPVDVRVRRWIEAMPQYGPGHADVVAELRAGLPPTLAVAGSYLDGIGVPACVGAAGRAVTSVIEALDAQVAR

SEQ ID NO: 51492 - protein, 202 aa, Corynebacterium glutamicum ATCC 13032
MTVAPRIGTATRTTSESDITVEINLDGTGKVDIDTGLPFFDHMLTAFGVHGSFDLKVHAKGDIEIDAHHTVEDTAIVLGQALLDAIGDKKGIRRFASCQLPMDEALVESVVDISGRPYFVISGEPDHMITSVIGGHYATVINEHFFETLALNSRITLHVICHYGRDPHHITEAEYKAVARALRGAVEMDPRQTGIPSTKGAL

SEQ ID NO: 51493 - protein, 458 aa, Triticum aestivum
MGVGNGSADANQQTARNEIRDETTPLLPVKVEEEGFHEFNGASFSGAVFNLSTTIVGAGIMALPASIKMLGLIPGLLMIIFVALLTEASIDMLIRCSHQGKITSYGWLMGEAYGQWGRIALQASVVINNIGVMIVYMIIIGDVLSGTSSGGIHHRGILEGWFGAHLWNSRAIVLLVTTLFVFAPLVSFKRLDSLSYTSALSVALAVVFVVITAGIAIIKVINGTVAMPKLFPEIDDLSSVWKLFTAVPVLVTAYICHYNVHSIDNELEDKTQTKPIVRTSLALCSSVYIATSFFAYLLFGDGTLDDVLANFDSNLGIPFSSVFNDVVRVSYAAHVMLVFPIVFFALRLNLDGLLFPTSRHISYDNKRFTIITISLLVVIYTAAIFIPSIWDAFQFTGATAAVLIGFIFPAMVILRDPYGIATKRDKILAVTMIVLAVVSNSVALYSDAMNIFRRKEVA

SEQ ID NO: 51494 - protein, 487 aa, Ralstonia sp. SJ98
MQTQLFIDGRFVAALSGETLATLNPHDNSEIAQVSMAGREDVDRAVQAAKKAFPAWSAMAAADRGRLLLKLADAIEANADELARLESMDTGHPIRDTRNLDVPRTAATFRYFGGMADKFEGSVIPVEASFLNYLTREPVGIVGQVVPWNFPLMFTSWKMAPALAAGNCVVMKPAELTPLSSLAIAQLMAEVGFPAGVVNVLPGFGHVAGQYIAEHPEIGKVAFTGSTAVGRKIVQASSGNLKKVQLELGGKGANVVFGDANLDAVVQGSAFGIFHNQGQACIAASRLIVHESIADDLLERFTSLARSIRIGDPLDPSTEMGPLTSQMHRDRVLSYVDVAREQGGRVLAGGKSPDAAGLAKGCYVEPTIVQAKPTDRVAQEEVFGPFVTVSTFKSDEEGLAIANGTEYGLGAGLWTRDLQRAHLFARQLKSGMVWINCYKRVNPGSPFGGVGASGYGREMGFEVMREYTQAKSVWVNVDANIPPYYPR

SEQ ID NO: 51495 - protein, 323 aa, Triticum aestivum
  misc_feature (293)..(293): Xaa can be any naturally occurring amino acid
  misc_feature (310)..(310): Xaa can be any naturally occurring amino acid
MEEHREERCWEDLLPDALGLVFRNLSLQEMLTVVPRVCKSWSRVVSGPYCWQEIDIQEWSQQQNKPDQLTRMVHTLVTRSGDSFRRISVSGLPNDSLFTFIANHARSLKTLELPRSEISDCIVEDVAQRLSNVTFLDVSSCTKIGARALEAFGKNCKSLVGLRRVMHPIDVAGKVCQHDEARAIACSMPKLRHLEIGYMLIATNAVVEIASRCRDLSFLDLRGCWGVDDKLLQDKYPGLKVLGPRVDDCYENSFLEECSDDSDDDSIYSWEEFMDDEDYFAAGSDDDEALWEXATPLKGLEVRFYGGGFXEGAFAGFDWPESP

SEQ ID NO: 51496 - protein, 500 aa, Idiomarina baltica OS145
MLKIKSTDSNRTLLSLDDSYLFDDVHDWRAQRLTEIDLKPAKQQLVIGEYKNVTEGRKVTHTLCRSRAAIEALQQPTHSFTAIVNKIRSSQWLGVTGKPITDVVNIGVGGSDLGPQMASFALKEFDDESSSSAVDVHFVSSMDGGQLYAVLPIVDPETTLFVIASKSFGTIDTFANVDTVKCWVNHVMSESAWLEHHVIGVSSNKEKMTAYGIPEHHQLSFDEGVGGRFSLWSTIGLSIAVSIGMAPFCKMLAGALAVDEHFLTVPDNDNVPVRLALNGVYLRQQKGINNLAILPYDGRLRMLPSYLQQLDMESNGKQATRDNKSLHQPTGPILWGGFGPNGQHAFYQHLHQGYDDFAADFVLVLNRSATRFPPQVAASLQQQQRLSVANCLAHRRLLWWGDKSVESPRDNYPGSHASNLLLLDELTPESFGALIAVYEHKIFIQGLLWDVNSFDQPGVEKGKKYALSVLDALSDNQSEDFDDVTNALIDYYRQHINRDS

SEQ ID NO: 51497 - protein, 279 aa, Shewanella sp. MR-4
MKLETIDYRAADSAKRFVESLRETGFGVLSNHPIDKELVESIYAEWQAFFNSDAKNEFMFNRETHDGFFPASISETAKGHTVKDIKEYYHVYPWGRIPDSLRTNILAYYEKANALASELLEWIETYSPDEVKAKFSIPLPEMIADSHKTLLRILHYPPMTGDEEMGAIRAAAHEDINLITVLPAANEPGLQVKAKDGSWLDVPSDFGNIIINIGDMLQEASGGYFPSTSHRVINPEGTDKTKSRISLPLFLHPNPSVVLSERYTADSYLMERLRELGVL

SEQ ID NO: 51498 - protein, 121 aa, Gloeobacter violaceus PCC 7421
MNAQEIIRSIEAEQMKTQLPVLHIGDTVKVNVRIREGGKERIQAFEGTIISMARAGINRTVTVRRIFQGIGVERVFLVHSPRIESMTVTRLGKVRRAKLYYLRDRIGKATRVKQKITRKAN

SEQ ID NO: 51499 - protein, 574 aa, Exiguobacterium sibiricum 255-15
MAQHIKGIGASAGIAIAKAFVMETPVFDIPTHKIEDSAAEKERFQAAIVKSKGELEIIRENTLKELGADKAEIFSAHLLILEDPEIVSQVNAKIDDEKTNAAQALDEVSQMMVMIFESMDNEYMRERAADVRDVTKRTMAHLLGITFVTPAQINEEVIIIAEDLTPSDTAQLNRKYAKGFATNIGGRTSHSAIMSRSLEIPAVVGTKVVLTEVKHGDFLILDGTEGDVIVNPSSEQIAEYEEKRSAYIAQKEEWKKLKNEKTVTADGHHVELAANIGTPNDVKGVLENGAEAVGLYRTEFLYMDAETFPTEDEQFTAYKTVLESMGDKKVVIRTLDIGGDKELSYLDLPHEMNPFLGYRAIRLCLDQTDLFRTQLRALLRASAYGKLAVMFPMIATLEEFRAAKALLLEEKANLQAEGVTVSEDVEVGMMVEIPSTAVMAKQFAKEVDFFSVGTNDLIQYTMAADRMNEKVSYLYQPFNPAILNLLNNVITEAHKAGKWVGMCGEMAGEELALPILLGLGLDEFSMSASSVLRARSLMTRLNKAECEAIVEQVLDMDTAEDVVNFLSTTFDIKK

SEQ ID NO: 51500 - protein, 399 aa, Oryza sativa (japonica cultivar-group)
MYYAIELIKLHVLAEEVDIGIVQALLMLSNLHINIVPSFGNMGALGIDLCRDLHPVVNGFLQQASWLQSAPISFQGFRPQESWMHSPNQVVGSASSHGSKSASQCPARQEENNLVNIEESSDNSQETGRRGTHVNWTEEENLRLLSSWLNNSLDSINGNDKKGEYYWRDVAAEFNGNASSNNRKRTVVQCKTHWGGVKKDIAKFCGAYSRARRTWSSGFSDDMIMEKAHALYKSENNDKTFTLEYMWRELKDQPKWRRILEEDSKNKRTKISESGAYTSSSNQETEEETSRKEKRPEGQKKAKAKLKGKGKKPAPSPLGDQPSQDFVLFNEAVKLRAEAVLKSAEATTKSAEAKKEQTRMEKYQTYLKLLDKDTANFSDAKLKRHEAVLEKLATELAEE

SEQ ID NO: 51501 - protein, 222 aa, Triticum aestivum
MADEDEYRCFVGNLSWSTTDESLKDAFSKYGKVTEAKVVMDKFSGRSRGFAFVTFDEKKAMEEAIEDMNGLDLEGRAITVDKAQPQGAGRDRNGDRDFDRDRGSRGGRDYGGGRAPRGGGGGDCFKCGKPGHFARECPDGDGGRGDRYGGRDDRYGGGRSDRGGDRSDRGGDRSDRDRSDRGGDRSDRDGDRSERGSDRYSSRSRDGGSGGDRYSRDRSGPY

SEQ ID NO: 51502 - protein, 447 aa, Oryza sativa (japonica cultivar-group)
MALLQFGGTLAPKLGEKPQLLPRSPALTRVIYADPRFLVSKSGSGGRLKHLVSPTASLQSRTSSRLFNHAPSPRFRHRRSSRFIVRADADFYSTLGVSRNASKSEIKSAYRKLARSYHPDVNKDPGAEQKFKDISNAYEVLSDDEKRSIYDKYGEAGLKGAGMGTGDYSNPFDLFESLFEGFGGMGGMGGRAARNRPMQGDDEAYNLVLNFKEAVFGVEKEIEITRLEGCNTCDGTGAKPGTKPTTCKTCGGQGQVVSSTRTPLGIFQQVSTCNTCGGTGEFSTPCNTCGGDGRVRKTKRISLKVPAGVDSGSRLRVRSEGNAGRRGGPPGDLYVFIDVLSDPVLKRDGTNILYTCKVSYIDAILGTTVKVPTVDGMVDLKIPSGTQPGTTLVMSKKGVPLLGKSNARGDQLVRVQVEIPKRLSSDERKLIEELANLNKAQTANSRR

SEQ ID NO: 51503 - protein, 594 aa, Saccharomyces cerevisiae
MSVRTSSRSNKGQNKYIEYLLQEETEAPKKKRTKKKVDSAIEKNKKSDSSQEPRKDTENVRTDEVDEADEGYVRCLCGANNENYDAAEYSHGDMVQCDGCDTWQHIKCMTDGKDTIDGLMSEDSKYYCELCDPSLYAHLETSKEAEVSEDEDYHDDVYKPVNDHDDNDADVFLDEESPRKRKRSPDSAKGIHIKSKQVKKSNGSKKRNKSIDAAKSDTAENEMPTRKDFESEKEHKLRYNAEKMFSTLFSKFIVPETIEAKLYELPDGKDVISISQEFAHNLEEELYKACLNVEFGTLDKIYTEKVRSLYSNLKDKKNLELKAHVVEGKLPLNKLVNMNASELANPDLQEFKEKRDKIILENFIVEVPDKPMYVKTHKGDELIEDIAEPQEDILYSKDSIRLHNIDSIDSDKSKIEQTHAISKEPSPSTIINEESLNCAFLYPGLGLEFTGYLNYIGASQKLRRDIFKEAIGDGKLYVEGRLPTTTAAPYLKEISCSRAILVYQLFPSNDSESKTTFADVVDSLENKGRIAGIKPKTRYEKDFYIVPSKGGEIPEILKDILGSHNDERSERFSRMKSDERTLFAFVVVKQEFIH

SEQ ID NO: 51504 - protein, 376 aa, Candida albicans SC5314
MLAARSSIRRCFSTSSTTLKSLKIGLIPGDGIGREVIPAGKAVLENLPAKHDLQFEFVNLDAGFELFKKTGTALPDETVDVLKKECDGALFGAVSSPTTKVAGYSSPIVALRKKLGLYANVRPVKSVEGIGRPVDMVIVRENTEDLYIKEERVYKKEDGTKVAEAIKRITETASTRIAKMAYEIALQREAVRKGTSGKQLHEKPSVTVTHKSNVLSQSDGLFRETCRAVYDANANEYGGIEYKEQIVDSMVYRMFREPEIFDVVVAPNLYGDILSDGAAALVGSLGVVPSANVGDNFAIGEPCHGSAPDIEGKGISNPVATIRSTALMLEFMGYPEAAATIYQAVDANLAEDKIKTPDLGGNSTTQEVIDDIIRRF

SEQ ID NO: 51505 - protein, 374 aa, Oryza sativa (japonica cultivar-group)
MHHHRDFAIEGVQGSLSELMLKLARSYHPDVNKDPGAEQKFKDISNAYEVLSDDEKRSIYDKYGEAGLKGAGMGTGDYSNPFDLFESLFEGFGGMGGMGGRAARNRPMQGDDEAYNLVLNFKEAVFGVEKEIEITRLEGCNTCDGTGAKPGTKPTTCKTCGGQGQVVSSTRTPLGIFQQVSTCNTCGGTGEFSTPCNTCGGDGRVRKTKRISLKVPAGVDSGSRLRVRSEGNAGRRGGPPGDLYVFIDVLSDPVLKRDGTNILYTCKVSYIDAILGTTVKVPTVDGMVDLKIPSGTQPGTTRLTLCRTLAVRLPLPSPVVSVRKPGGGGCAGGEEWLQQDGLLCMGGSAGGLWRWPRCSPATDPAAAAFTRDGA

SEQ ID NO: 51506 - protein, 334 aa, Idiomarina baltica OS145
MKTIDVIGIGNALVDQEFEVSEDFLAKHHLEKGMMALIEEEDQNKLIAELSTMGDLKKQCGGGSAANSLVAFAQFGGSAFYCCKVANDEAGDFYQRDLEHVGIQTNLTSQNNDGTTGRCLVMVTPDAERTMRTHLGITADLSTHELHPEAIAAAKYLYIEGYLITSEIAREAIAEAKRVARENDTKIVMTCSDPAMVKYFRDGIDEILDGGVDLMFCNREEAELLTGETDPHAAAQRLLNCASTVAITLGKEGALIADSERQIHIPGVPVQAVDTNGAGDMFAGAMLYGITQDMELEQAGRLASLAAAELVTEFGARLSKERQQQLLEKLLSYA

SEQ ID NO: 51507 - protein, 635 aa, Clostridium perfringens SM101
MDFIKVGAASPKLKISDTKYNLKEIETMILNAIEEEVKVLVFPELSISAYSCGDLFTNEKLIENCNLAIKNLVEFSKGKDILIAVGAPFLYRYSLYNCAYIILNGELLGIVPKSYIPNYSEFYEKRWFTEGFNIKGLNVDLDFQKEVPFGTDLIFSFKNLKVGFEICEDLWVTIPPSSNLALMGANLICNLSASNELVSKSSYRKSLVQNQSARTMCSYIYSSAGVHESTTDLLFSGHMIIAENGTIIKENNRFKRENDLLTGIVDLFKLNAERIKNISFRNSTFNENNDPKFIPFNLENTEIKNFDREIDKHPFLPKSQYAMEERCEEILNIQAAALAKRLEHTNLKKAVIGISGGLDSTLALLVVVKTFDMLNIPRENIITITMPGFGTTDRTYNNAVTLCKELNCDFREINIVNAALQHFEDIGHDKDIHDVTYENVQARERTQILMDLANKEGGLLIGTGDLSELALGWCTYNGDHMSMYSVNCSIPKTLVRFLVNYFANHEISNDAKEALLDILDTPVSPELLPKDKEGKIAQKTEDIVGPYELHDFFLYHFIKHGSSPERILFLAKEAFKNDYDEETLKKWLDKFIRRFFTQQFKRSALPDGPKVGSISLSPRGDWRMPSDAVYNDFLI

SEQ ID NO: 51508 - protein, 776 aa, Zea mays
MDSSRSWIFTELGQPTYCPETFPEVPFERPTPPIIFFDEEHIFEEESSSSTTATPRNPSDPKQAGGDLDSIATAALSASEEIPQSLLVIDLERATSKCIRTHAVNDVPAVHSIIKGLQLERIGLAGSAPDLDTLTTARHCGSELSCQLGSNKRDVSLRVGCDQSYEWVDPETLDRSFVVLDNACATHEVFEVLPLSFPAAWVNVGKLPTTLCWKIPWPPPVLWVNLHAGGRYITSLLEECQLVFTIFFGGVCSLAKIQWPYMVLEYLANLHVIHGKIHMHPVQVCVRSYAVMPSAKGLVAETHLHFIGTYRGVVSTAFCTEIVESADAYIFAGSIFKDYSSVGYSFLLKKAKAIIVQPERVGVGNGLSFRCLMMKEYWTEIAKKVKKNTTTYENYKRNFVPEGQALESEPNEPLRVNVLFKYIQKMMTVNSVVMAETDDSWFNCHKLKLPESCGYQFQMQYGLIGWSMGALLGYAQGANHKILSPLTALHPLVAVCYDHDIIMDAAGFGDELVVISLGADCQIIASYHRWPFGQTGTGHFSPIGGYQVRQDMVLILDVARFIPLQFFWEAMNTTNDSTLRGSMLISRKVAESSLLYTVSCRDENWKIMPKFCVEDLPSLLKAGIGACVGLVTSGLSVVSSGQGNFSVFVWDPGDSGLVTSSLSAVSSDQGKFSVFVWDPGDRGLVTYGLRVVSIARVTAIMSGTYARGAATTSSPKMRQTQFRWRAEERHDAFNNDANPQIKLILHRQRLGGKPYFKEWGMLDILGVVDELWVMWA

SEQ ID NO: 51509 - protein, 306 aa, Geobacillus kaustophilus HTA426
MEAVWGILPKTVAAALQHHLPSCRRGIEEIRIRVSRPLEVIVDGTARLLPYEVTKEDGVHLLNKLSHYSIYAVEEELKRGFMTIEGGHRVGLAGKVITEGGKVKAIRDVSSFNIRIAKEQIGIAEPLIPYVYDGRWRHTMIIGSPQTGKTTLLRDAARLISSGTRRIPAQKVAIVDERSEIAGCVKGIPQFSFGPRLDVLDACPKAEGMMMMIRSMSPDVMIVDEIGREEDSEAVLEAANAGVSVWTTVHGRNIQDVWQRPTLGPVMEQKVFERFIELTNIPHPGSIRRILDAGGTVLYERAVVHR

SEQ ID NO: 51510 - protein, 325 aa, Arabidopsis thaliana
MTSLKAVRCTCKKWNVLSKDRIICAARKEFLGFMMMDSRVCWMKFDLQGIRNNTLVDISLYKASQTVRIQPRNSFHRLDRYALGYDKNRNHKILRFVDDHLAVGEHVFGYEIYDFSSSSWRVLDVTPDWDIQFYQRGVSLNGNTYFFAQEKITEDGEYEEFEDFLLYFDFSTERFEPRLPLPFHFYVLETVSLSSVRDEQLAVLYQRLDSYEILDIWLTTKIEPSAVSWSMFLKLDMRPLTGFQFMVDGGSFFIDEEKKVAVVFDLTKHKQTVTRRYQTAYIIGQDGYFKPVSLGEAPYLGDPHELYCLPLVCPSYAPSLVQLYN

SEQ ID NO: 51511 - protein, 388 aa, Arabidopsis thaliana
MATMISNLPRDLMEEILSRVPLKSMRAVRLTCKNWHTLSITISESLAKMYISKTTRESREGESTIITLMNYKLCLTSLVVDVDPYIEHKDDTITTRLVVWNPYWGQTRQIKTRYSHHAFSGRDSTYMFNYSLGYENKNSCRSHKLLRFIDYHWNYRGLHQFFWYEIYDFDSDLWTTLDVTPHWFIVISQSGVSLKGNTYWCARKRSGGYSDHIICFDFTRERFGPLLPLPFSFIDRHHSCVILSCVSEEKLAVLFQYKDHYYKNVVEIWITAKLEAEMVSWSKFLRINTGPIIHTSFFINEEKKVAIGFNDNRKTINIIGEAGYFRELDLGEHAEPYRRRHVFSYVPSSVQIKETAPGNIKKHQSSIETRLFDRNMLRLVAFEKKVSE

SEQ ID NO: 51512 - protein, 690 aa, Zea mays
MWSLLPLLLFLSSSLLAATTIAYDLWYTECASNTNYTRGGAFQANLDALLSSLPAAAAASYGFADNFTGAAPDQAYGLAQCRGDVNASTCLACLDGAARHMAATCPGQKDAMLIYDECLLRHSNASFLGAADASVRFCAWNPQNATQPEEFRTRLGALMGNLTARAAFASPRMFAAGKAAVSPFANVYGMAQCTRDLADDDCNRCLDGVVAFIPNCCDGKQGGRVIARSCSIRFEVYSFYDALGAQEAMSPAAAPVPGGGPTNGSGHSVDGNTGSSSHTVRTALLVAIPVAVALLLLVAVFLFLCRRNRQPHKHVQVASSVHEDEEDMRSSESLLYDLSTLRAATDNFSEENKLGEGGFGPVYKGTLQGGQDIAVKRLSATSQQGQVEMKNEVVLLAKLQHRNLTSSSTLESQITYTDKTELADPARRHELGWGLRQRIIEGIGRGLLYLHEDSRLTIIHRDLKASNILLDADMNPKISDFGLAKLFSIDSSVGNTSHIAGTYGYMAPEYAMHGLFSAKSDVFSYGVLVLEIVTGRRNSYTHASGPSEDLLTFVLYWSHLLTHQLELTFFGILIVMVWTHWSRGSVQPLLEGCPDEGLRAQEVLRCIHVALLCVQEDPHDRPSMASVVVMLNSRSITLPAPAAPAYAVPGRAVTASENPPRRMSLGRQGPMAAAREPSINEASVSELHPR

SEQ ID NO: 51513 - protein, 174 aa, Triticum aestivum
  misc_feature (54)..(54): Xaa can be any naturally occurring amino acid
  misc_feature (73)..(73): Xaa can be any naturally occurring amino acid
  misc_feature (86)..(86): Xaa can be any naturally occurring amino acid
  misc_feature (96)..(97): Xaa can be any naturally occurring amino acid
  misc_feature (119)..(119): Xaa can be any naturally occurring amino acid
  misc_feature (124)..(124): Xaa can be any naturally occurring amino acid
  misc_feature (138)..(138): Xaa can be any naturally occurring amino acid
  misc_feature (142)..(142): Xaa can be any naturally occurring amino acid
  misc_feature (152)..(152): Xaa can be any naturally occurring amino acid
  misc_feature (164)..(164): Xaa can be any naturally occurring amino acid
MAPTVMASSATSVAPFQGLKSTAGLPVSRRSNGASLGSVSNGGRIRCMQVWPIXEGIKNSKTLSYLPPLNTEXLLKQVDYLDPAPXVPCLQFNKVXXLPVEHNASPGVLTMAGYWTMWXLPNVXGCTGRTQVINEVEXVKKXIPDPYVRIIXSTNAQGACVNLXAFKPTGKIRG

SEQ ID NO: 51514 - protein, 279 aa, Glycine max
MLKIPEHQVAGHKAKDGILGPLVDDFGKFYKPLQTNKDDDTRGSTELSFYTSLAAAAHDYSIRSFFPAFHGTRLLDASDGSGPHPHLVLEDLLCGYSKPSVMDVKIGSRTWHLGDSEDYICKCLKKDRESSSLPLGFRISGVKDSISSWEPTRKSLQCLSAHGVALVLNKFVSSNNINHDDHHPDCAFATEVYGAVLERLQKLKDWFEVQTVYHFYSCSVLVVYEKDLGKGKATNPLVKLVDFAHVVDGNGVIDHNFLGGLCSFIKFLKDILAVACLHK

SEQ ID NO: 51515 - protein, 1619 aa, Oryza sativa (japonica cultivar-group)
MCLPYHKNETHGGFAITGTPLMEIDHRNLQLNAQAMNALFNSLSQEEFDRVSNLETAYEIWNKLAEIHEDTSEYKDAKLHFLKIQYETFSMLPHESVNDMYGRLNVIVNDLKGLGANYTDLEVAQKMLRALPEKYETLVTMLINSDMSRMTPASLLGKINTNDMYKLKKKEMEEASSSKKCIALQAEVEDKSKSKVNEVNEDLEEEMVLLARKFNDLLGRRKERGRGSNSNRRRNRRPNKTFSNLRCFECCEKGHFASKCPSKDDDGDKSSKKKSGGYKLMKKLKKEGKKIEAFIGEWDSNEESSTSSGSEEEGGDDASSKKKKMAVVAIKEAPSLFAPLCLMAKGSSKVTSLSDSESDDDCDDVSYDELVSMFEELHAYSEKEIVKFKALKKDHASLEVLYEELKISHERLTISHEKLKEAHDNLLSTTQHGAHIDVGISCDLLDDNATCHIAHVASSSISTSCDDLMDMPSPSSSSSSCVSICDASFVVENNELKEQVAKLNKSLERCFKGKNTLDKILSEQRFILNKEGFGFIPKKGKKPSHRATRFVKSNGYASNSKAYRVYNKNKGIVEETADVQFDETNGSQEGHENLDDVGDEGLMRAMKNMSIGDVKPIEVEDKPSTSTQDEPSTSASPSQAQVEVEEEKAQDPPMPPRIHTALSKDHPIDQVLGDISKGVQTRSRIASICEHYSFVSCLEPKHVDEALCDLDWMNAMHEELNNFARNKVWTLVERPRDHNVIGTKWIFRNKQDENGLVVRNKARLVAQGVTQVEGLDFGETFAPVARLEAIRILLAFASCFDIKLFQMDVKSVFLNGEIAELVFVEQPPGFEDPKNPNHVYKLSKALYGLKQAPRAWYERLRDFLLSKDFKIGKVDTTLFTKIIGDDFFVCQIYVDGIIFGSTNEVFCKEFGDMMSREFDMSMIGELSFFLGLQIKQLKDGTFVSQTKYIKDLLKRFGLEDAKPIKTPMATNGHLDLDEGAMPPRTRHGRREPTPDPVSENEESSGDEYVQSDDENMENVQGDEMEVSDDGDDGDNNGSGNGEDDEASDDGSPLDSTIQYVLNLRNVQQYTILRHHDQFRRPNDCNDPRFHTRFQKSVYEQVYANKAFAEHKWISWRHIGETPEFENLQEMFRTVGIDRIVTMKQPFDEDLIRQFYATVWVSGDCDAMKWMSGTLRCSINRREFKELLHIRFNNGDDLHDEHTHNPFPIDHFSLFYEEGGRHTYGKVAGLRALPSVINRIVRATILPRCGNNDDIRGVAWHVIDAIIDGHRFDVINLMMKEIAISKGTIGQGIYYAPYIMRLIQSKLGKIGHNLKEHKEYKPRLQLSSPRAPRVRQPTFDQGASSSAAPPPPQGQATTRQQSAARPPPPQSVPSPRPPPSTPVSSPAAGADLHPASRGGAGVLLLPPHSHPNPSHPASASNFVSSPAACADPHPASRGGARRPPSSTASSLAGKMGPRVVFMFIIAVMLLGDTSLAFDNAVGEKISNMETSLTMKVDPQLCQICEEFATEALFYLNENETQVEIIATLHQACSKFPSFKLECTKLVDYYVSLFFTKVTSLSPEEFCESVSLCHKVTFIRLPRHEDSCDLCHEVVDEILTDLENPDVEEKPQKRTGRACFH

SEQ ID NO: 51516 - protein, 223 aa, Glycine max
RNSQRRHFSIYYLGVVNSMDTMACNKGQTVRKAKKKQVKDELDRLKQAEKKKRRLEKALATSAAIISELEKKKQKKKEEQQRLDEEGAAIAEAVALHVLLGEDSDESCKVVIDDGGCKTWNCNRTLGISLGGESACFPHLDGGRWSFERVGWVSDAYRYGCKWGAAENGEWSFSSEPFEKNVHGPLYEGAGWGPANFSADLIAAQAVSSLQIAEEADEDRILF

SEQ ID NO: 51517 - protein, 218 aa, Zea mays
  misc_feature (132)..(132): Xaa can be any naturally occurring amino acid
KKSPFLRSQAPLIPCRRSSEHAQPPRLAWSSRSRLAWSSRSRLYPRLELALGFLSQPPLLRCYLQKRVLNSSKGPAICALRAQPDKREYAIEMKNSVESTENLFIREAMATEVLIGKNDTIEGVCTFFSMDXYAPSVVLSTRTFMSVSGAKLLGSWGVDLPIRPLHTLHLYWRVKPGQEQTVSTSAGFPTFSSYGDPPVYGAPSLELPGLIKISCIRS

SEQ ID NO: 51518 - protein, 582 aa, Oryza sativa (indica cultivar-group)
MEAAGVEVNGGGGGDVVVVVPQQHEVAAKQAAAAAAAKGKSVESKGVRVVGGRIYDPENGKTCHQCRQKTMDFAASCHKIKKNNKQCTIQYCRKCLFNRYGQEAEKVANDGTWTCPKCKDICNCSFCMKKKGLPPTGILAHAAKASGCASVHHLLKKGKEAVAAAQRSTQKVRSTPVKKSPKRAIQPDAAADEPLAEGDENVCIDFNAAPVKKQKRSRKVGNGVALTKDESPDAPKEQVVLPKGTPVTSVAGAEWEPEDVGLALQFFEFCRTFAEIFQVRKGQPERILRDIAGGRGLRVVSSVIADFHITLLSIIQEGRGIKPITYSRDNDAWIVDTGKCISESIFVPEGLPLDSLSQGVSGYKNLSPSCKLSVLNFLCDESLSTEKLRSCILSETKNPSREKAHSAKEKEEPKEETIKNTDEAVLLKTEGAAVAIEEDKNGISQQKDVKEVKNADTNEKKHGGFLRTNPFMVDKKVIYWKLDDYCNNTTMMLQEVDADDLMGNKDKWFMLNEDEKKIVENYLSTRIQTISSDVFTVDLKVLYKCFKNQDYIGLNAGGEKLHNSLLIILSRFLTWLKVGGLC

SEQ ID NO: 51519 - protein, 483 aa, Nocardia farcinica IFM 10152
MVSVPELLESVPTQLWIGGPVDATGGATFPVHDPATGEVLTHVADATPEDAVRALDAAVAVQDEWAATPARTRGEILRAVFDAITARAEDFALLMTLEMGKALGESRNEVRYGAEFFRWFSEEAVRVHGRYQHAPSGTGRIIVHKQPVGPCLAITPWNFPLAMGTRKIGPALAAGCTMIVKPASETPLTMLLLARLCSEAGLPDGVLSVITTKHSSAVTKPLLDDPRLRKLTFTGSTEVGKKLVEQSANKLLRTSMELGGNAPFVVFDDADVDAAVQGAMLAKLRNGGEACTAANRFHVQRGVAEEFTDKLVEAMRSSVRLGPGTDPETTLGPLVNADQLATVTELVDDAVSAGARVRLGGEAPGGPGWFYPATVLSDVPDRARILNEEVFGPVAPVVTFDTEEQGLAAANDTRFGLVSYIYTRDLDRALRVAEGLESGMVGINRGVISDPAAPFGGVKESGFGREGGFEGIEEYLSTKYIAL

SEQ ID NO: 51520 - protein, 284 aa, Nicotiana tabacum
MRLLKVATCNLNQWAMDFDCNLKYIKESIAEAKAGGAKIRLGPELEITGYGCEDHFLELDTVSHAWDCLKELLLGDWTDGILYSFGMPVIKDSERYNCQVLCLDRKIIMIRPKMWLANDGNYRELRWFTAWKQKENLEDFHLPSEISETLSQTTVPFGYGYVQFLDTAVGAEVCEELFTPLPPHAELALNGVEVFMNASGSHHQLRKLDLRLRAFISATHTRGGVYMYSNHQGCDGGRLYYDGCSCVVVNGDMVAQGSQFSPKDVDMVFAQIDLDAVGVPAGNI

SEQ ID NO: 51521 - protein, 551 aa, Nocardia farcinica IFM 10152
MSTLADVSSDITASAAWRKLHDHHGALAQRHLREIFAEDPERGRELTLQVADLHIDYSKHRATRETLQLLVELAREAGVEAHRDAMFAGEHINTSEDRAVGHVALRLPAGRTMTIDGADAGAQVHEVLRRMGEFTDALRSGQWRGATGERIETVVNIGIGGSDLGPVMVHQALRHYADAGITARFVSNVDPADLVAELTGLNPATTLFIVASKTFSTLETLTNATAARRWLVAALGEDAVAKHFVAVSTNAERVSAFGIDTANMFGFWDWVGGRYSVDSAIGLSVMATIGKERFAEFLAGMHAVDTHFATAPLEANAPVLLGLLGIWYANFFGAESRAVLPYSNDLARFPAYLQQLTMESNGKSVRADGTPVTTATGEIFWGEPGTNGQHAFYQLLHQGTRLIPADFIGFARPTDDLPTADGTGSMHDVLMSNLFAQTKVLAFGKTAEEIAAEGTAPNLVPHKVMPGNRPSTTILAPQLTPAVVGQLIALYEHQVFVEGVIWGIDSFDQWGVELGKQQALALAALLTAAEDPAPQDDSSTDALIRWYRAHR

SEQ ID NO: 51522 - protein, 580 aa, Nitrosomonas europaea ATCC 19718
MICSICLNGCQPVLRLKSRPDEVWREAGNRKSNIDINSLAGEYKMKPLRGKALLNDPVQNKSTAFTREERERYGLQGLLPYSVTDIGKQQQRVLANLRSKNSNIEKYGYLNDLLERNQRLFYRTLIDYIGEIMPLVYTPTVGEACMKFTQIFRKPQGFYITPEDRGKILPLFENWPENDVRIIVVTDGERILGLGDLGANGMGIPIGKMALYVACAGIRPEYCMPVMLDVGTSNQILREDPLYLGYPRPRLTGQDYLSLVEEFVAAVQNKFPQALIQFEDFSSQNAFRLLDRYAGSVRCFNDDIQGTAAVTLAGIYASCRITHKPFVDLKIMLLGTGSAATGVAELLLSAFMMAGLSEAEARSRISFVDRQGLVVTVREEIKPRVRSFASEHAAMDFVGAITAIRPDVLIGATGTAGAFDEIAIRQMARCQEHPVIIALSNPTSHTECTADQAYRWSDGRAVFASGSPFAPVTLDGRTRYPAQGNNVYIYPGIGLGMVASHARLVVEHMFLATAEELANCVLPEEIERGSIYPEIARVRDVSQKIAVKVCQVARQEGLAGVDLPDDLETYVYTLMYEPGY

SEQ ID NO: 51523 - protein, 205 aa, Glycine max
MAELESPNVMPKLISFLSSLLKRVAESNDLNQQQLIHQKVSVFHGLTRPTISIQSYLERIFKYANCSPSCFIVAYVYLDRFTQRQPSLPINSFNVHRLLITSVMVAAKFMDDLYYNNAYYAKVGGITTIEMNFLEVDFLFGLGFHLNVTPGTFQAYCAHLQSEMLLMQPLNFADSSLSLGKSLKAHLCYNEDESSSHQKQQQLAV

SEQ ID NO: 51524 - protein, 458 aa, Bradyrhizobium sp. BTAi1
MSMQHVVSDPIRLTAPRRNSLTHIPGDEGWPIIGKTFEVLADPKGHVERNARKYGPVYRSHMFGEVNVVLLGPEANELVLFDQAKLFSSAHGWGHILNLLFPRGLMLLDFEEHRMHRKALSVAFKAGPMKSYLTGLDRGIAARIAQWKQTPGEMLFYPAIKQLTLDLAATSFLGTEIGPEVDAINRAFVDMVAASVAPIRKPLPGTQMARGVKGRQRIVAYFSEQIPLRRAKGDGDDLFSHLCRATDDHGALLSTQDIVDHMSFLMMAAHDTLTSSITSFIAQLAAHPEWQQKLRDEVASLGLVAGAPMASEHLEKMKLTEMAFQETLRLMPPVPSLPRRPIRDFTFKGYAIPAGTGVGVNPMFTHHMPEIWPEPERFDPLRFTDEAQRGRHRFAWVPFGGGAHMCLGLHFAYMQVKCFARHFLSNIEVSFAPGYRPNWQVWPIPKPRDGLRVMLKAV

SEQ ID NO: 51525 - protein, 289 aa, Streptococcus suis 89/1591
MVASKLQRLEETMADFYQPQVAERLNQSVLYSLQAGGKRIRPLLLLTILESFGMELKQAHYQVAACVELIHTGSLIHDDLPAMDNDDYRRGRLTNHKVYDEATAILAGDSLFLDPFGFLAQVDLPAETILALVRELSQASGTFGMVAGQVLDMAGEGQNLTLEQLQAIHANKTGKLLTFPFVAAGLIAGQSDVVINHLRQAGQLIGLAFQVRDDILDVTATFEEIGKTPQKDVLAEKSTYPALMGLEASKVFLEDSLNQAINELDQVAKQVPFSTEKIKEIIESLRING

SEQ ID NO: 51526 - protein, 215 aa, Burkholderia sp. 383
MNAPAPSSARRTKKLPPLRVGIGGPVGSGKTTLLEMLCKAMRDRYDLVAITNDIYTKEDQRLLTVAGALPEERIMGVETGGCPHTAIREDASINLEAVDRMLSRFPDADIVFIESGGDNLAATFSPELSDLTIYVIDVAGGEKIPRKGGPGITKSDLLVINKTDLAPLVGANLDVMASDTKKMRGERPYVMTNLKALEGVADVIAFIEKKGLLTV

SEQ ID NO: 51527 - protein, 452 aa, Schizosaccharomyces pombe
MLNRSLLFRNLRLARPRPFLPLVGKRFVTEKSQSQEEKDTSKITENAKEEVKRDTSSLAKESLKLLDLNGLNDESYTGDPGKGPEYTSSTMLKREKQARYAFWGFLGLTGGGLLYYGRRYGPDEKELEKQYPAAGYSPSDWWNRVKARTNNFFSYYQEPAFEKLLPDPLPEPYNRPYTLVLSLDDLLIHSEWTRQHGWRTAKRPGLDYFLGYLSMYYEVVIFTRQYLATAKPIIDKIDPYHVSISAVLTRESSKYEKGKVIKDLSYLNRDLSRVIMIDTNPESWSKQPDNAIAMAPWTGNPKDKELVGLIPLLEFIAIMDIKDVRPVLKSYQGKNIPLEYARREEKLRTKLIEDWNEKKKKGSSFLFGGRSVSEEPPKLIIDIQRERQKAAYAEFKKYIDENGPKMLEEEKAREAEQKTSIFNLLFHPEEVQQQQLEQMQQQQFSPETNASK

SEQ ID NO: 51528 - protein, 338 aa, Metarhizium anisopliae
MAPVKVGINGFGRIGRIVFRNAAEHPEIEVVAVNDPFIDTEYAAYMLKYDSSHGIFKGDIKKEADGLVVNGKKVKFFTERDPSAIPWKSAGAEYIVESTGVFTTTDKAKAHLAGGAKKVVISAPSADAPMYVMGVNEKTYDGKADVISNASCTTNCLAPLAKVIHDKFTIVEGLMTTVHSYTATQKTVDGPSGKDWRGGRGAAQNIIPSSTGAAKAVGKVIPDLNGKLTGMSMRVPTANVSVVDLTARIEKGASYDEIKEAIKEAANGPLKGILAYTEDDVVSSDMNGNTNSSIFDAKAGISLNKNFVKLVSWYDNEWGYSRRVLDLLAYIAKVDAGK

SEQ ID NO: 51529 - protein, 196 aa, Triticum aestivum
  misc_feature (188)..(188): Xaa can be any naturally occurring amino acid
NKFVQKSRLVPVRNSRDIVDPRVRDVEFASSLISLLKTIKRGIQVHEDFSGGIVSPAELLVCRFTGIKALEDEYGSAEIVKQGAEVVRTALTKAFDQLQGAYNGKIVGLVISTEEASTSLASIIDGPSSLHISRRLAEASKTNATASIAAIYLVRLSLAWITGIILLVSTLIGICLLMNMPLTRDTLXLYSNVKMD

SEQ ID NO: 51530 - protein, 386 aa, Streptomyces coelicolor A3(2)
MPMSDRHISQHFETLAIHAGNTADPLTGAVVPPIYQVSTYKQDGVGGLRGGYEYSRSANPTRTALEENLAALEGGRRGLAFASGLAAEDCLLRTLLRPGDHVVIPNDAYGGTFRLFAKVATRWGVEWSVADTSDAAAVRAALTPKTKAVWVETPSNPLLGITDIAQVAQVARDAGARLVVDNTFATPYLQQPLALGADVVVHSLTKYMGGHSDVVGGALIVGDQELGEELAFHQNAMGAVAGPFDSWLVLRGTKTLAVRMDRHSENATKVADMLSRHARVTSVLYPGLPEHPGHEVAAKQMKAFGGMVSFRVEGGEQAAVEVCNRAKVFTLGESLGGVESLIEHPGRMTHASAAGSALEVPADLVRLSVGIENADDLLADLQQALG

SEQ ID NO: 51531 - protein, 630 aa, Debaryomyces hansenii CBS767
MADITQQMNNLSVEQGSQGNGSSRSQYVPPHLRNRPSGGNGSFGGNRRGGFNNNSFGGFDNNRRGGYNNNSFGGYNNNRRGGFNNARGSGRYNTPKPGVGRWVDGKHEPAEKNERLEKELYGIDEEPTTQSSGINFDNYDDIPVEASGEGVPEPITAFTAPPLDPLLVENVKLSRFTKPTPVQKYSVPIVAAGRDLMACAQTGSGKTGGFLFPVLSESYMNGPAEVPETAGAFSSHKVYPTALVMAPTRELVSQIFDEAKKFAYRSWVRPSVVYGGADIGGQIRNLERGCDLLVATPGRLKDLLERGRVSLASIKYLVLDEADRMLDMGFEPQIRHIVQECDMPGVEDRQTLMFSATFPKEIQFLARDFLKEYIFLSVGRVGSTSENITQKILYVEDEEKKSVLLDLLSANDNGLTIIFTETKRMADNLADFLYDQGFPATAIHGDRSQYEREKALAAFKTGTAPILVATAVAARGLDIPNVSHIVNYDLPSDIDDYVHRIGRTGRAGNIGIATAFFNRNNKNIVKGLVDLLTEANQEIPDFLNKIARESAFGGKSMRGGSSRGGRGGATRDFRKQGGSYGGGASSSNWGGSSSSGGGWGSSNNGGYSGYSGRSNGSSSYGNPSASNSWW

SEQ ID NO: 51532 - protein, 510 aa, Gluconobacter oxydans 621H
MSASSTPRPVMLVILDGFGWREDESDNAVRLANTPTFDTLWATSPHAFLKTSGEDVGLPDGQMGNSEVGHLNIGAGRVVMQELPRISRSARDGSLAQNPALLEFIAALKASGGTCHLMGLISPGGVHAHQDHVVALTKIVSAAGVPVAVHIFSDGRDTAPRSGEDFIGKFLKELPDSVQIATLSGRYYAMDRDRRWERVALAVEAIRDAKGPHAKDALSALQASYASDKGDEFVLPTVLGDYAGMKDGDGILACNFRADRIRQLLDVLVLPDFTEYDSGRKVKFAAVCGMSRYSDHLAPYMSILFPKVPLDDLLGDVVAKAGRTQLRMAETEKYPHVTYFLNGGREVQFDGEERILVPSPKVATYDLQPEMSAPELTDKAVAAIESGKFDMIVLNFANPDMVGHTGSLSAAIKACETVDQGLGRINDAIVKAGGVLLVTADHGNCETMRDPVTGGAHTSHTLNVVPVILAHARGETIHDGRLADLAPTMLALMGVKQPDAMTGVSLLESA

SEQ ID NO: 51533 - protein, 411 aa, Sulfolobus tokodaii str. 7
MQEIIDEVVNKALKGEIELHEIDNFLEANAAMVARRLVIEKLTNTKLPSIGSTILDYAEIKNRNAENVIGGIQIPVGVIGPLRVNGDYAKGDFYVPLATTEGALIASVNRGAKAITKSGGARVKIIFDGMTRAPVFKLNSIEDVADFLKWIKDNFSKIKEIAESTTSHGKLMNIEPYVLGNNVWLRFVFETGDAMGMNMVTVATEKACEFIEREFGRAVCLAVSGNMCSDKKQSQVNSLHGRGKTVVAEALIPNDVIKTVLKSDSVLIHEVNLRKNWLGGARAGTMFQFNAHFANIVTAIFIATGQDVAQVVESSSGYTWTEIRDNGLYISVTLTSLEVGTIGGGTRLPTQREALSIMRVDGPGNPPGSNARKFAEIVASTVLAGELNLLAALANKELGKAHLRLGRGAKV

SEQ ID NO: 51534 - protein, 432 aa, Kineococcus radiotolerans SRS30216
MGLPSLTGGHVTVAGPIVPLVATPNVLAIVLAGGEGKRLMPLTADRAKPAVPFGGTYRLIDFALSNLVNAGYRKVVVLTQYKSHSLDRHISQGWRMSNLFGSYIASVPAQQRVGQRWYLGSADAIYQSLNLVSDERPDIVVVVGADHVYRMDFSQMVDAHIASGSPCSVAAIRQPISLADQFGVIQTAPGSNRIAEFLEKPKDPQGLEDSPHEVLASMGNYVFDADALVDAVTRDSENEGSKHDMGGDIVPDFVSRGQASVYDFKDNEVPGATDRDRAYWRDVGTLDSYFEAQMDLISVLPVFNLYNYEWPIITAQDYYPPAKFVHGWQGTYGHAVNSIVSQGTVVSGALVEKSVVSPNVRLDSWAHVSESVLMDGVQVGRHAVVQRAIVDKFVTVPDDARIGVDPEEDRARGFHVTDSGITVVGKGQTIPT

SEQ ID NO: 51535 - protein, 935 aa, Mannheimia succiniciproducens MBEL55E
MINLKIDGFDVRVDEGTTILEAAKSVGINIPTLCYLKDVSDIGSCRVCVVEVEGFEKLPTSCNTLAQEGMVIRTQTDKVVKSRRMALDLILSHHNLICFSCPSNGACELQNVAHQCGISESSFPNFRLPGIEVPHVEDNPFLGYRPDLCIHCQRCINTCANVSGCSSIKLASRGIFRAIETPFGKDWKETTCESCGNCAEACPTGAIYKKEAKSYRSWEIQRVRTTCPHCAVGCQYDLLVKDNKLVGAEGVDGPSNGGRLCVKGRFGSYKFVMSGDRLTDPLIKDRATGKFRKASWDEALDLVASKFMTLKRQYGGDSLAGFACSRSPNEDIYMVQKMVRTCFGTNNTDNCARVCHSASVEGLARTLGSGAMTNPIYDITHDVDAILLVGSNPEEAHPVIGMQIREAVRNGTKLIVVDPRDIGLTKQADIHLKLRPGTNIAFANGMCHIFIKEGLIDEKFIAEHTEGFKELKKIVKDYTPEYVAEICGIDADDLRAAARIYATAKKAPIIYCLGVTEHSTGTEGVMSMSNMAMMVGKIGREGCGVNPLRGQNNVQGACDMGASPNQYPGYQSVKDPEIRAKFEKAWGVKLPAHIGLHATDVFPAAIKGKIKGLYICGEDPVVTDPDTNHVINALKSLDFLVVQELFMTETALLADVVLPGRSYAEKDGTFSNTERRVQRVRKAITLPGNSRLDTDIICELMRRMGYNQPNLTASEIFDEMASVTPSFRGISYERLEKEPTQSLQWPCTDQYHPGTPIMHVGKFARGLGLFYPTVYTPAKELPDAQYPMMLTTGRILYHYNTRAMTGRTEGLMEIAGHSFIEINSADAKRLNIENGERVRVTSRRGTITTEARVSDKTNEGETWMPFHFADGNCNWLTNAALDQFARIPEYKVCACRIEKLPEDEAFNMKGKYITQKMVAAQWRKKMDKSIAKLVR

SEQ ID NO: 51536 - protein, 560 aa, Zea mays
MAATVRRAASSVLSRFLLTKPSPSPAASAAGNNSALLGSGAAALRHRFSTAPASAAAAAEEPIQPAVEVKHTQLLINGNFVDAASATDVCLSPGKTFPTLDPRTGEVIARVAEGDSEDIDRAVAAARRAFDEGPWPRMTAYERCRVLLRFADLIERHAEEVAALETWDNGKTLAQAAGAEVPMVARCVRYYAGWADKIHGLVAPADGAHHVQVLHEPVGVAGQIIPWNFPLLMFAWKVGPALACGNTVVLKTAEQTPLSALYVANLLHEAGLPEGVLNVVSGFGPTAGAALCSHMGVDKLAFTGSTGTGQIVLELAARSNLKPVTLELGGKSPFIVMDDADVDQAVELAHQAVFFNQGQCCCAGSRTFVHERVYDEFVEKSKARALKRVVGDPFRDGVEQGPQIDGEQFNKILRYVQSGVDSGATLVAGGDRVGDRGFYIQPTVFADAKDEMKIAREEIFGPVQTILKFSGVEEVIRRANATPYGLAAGVFTRSLDAANTLSRALRAGTVWVNCYDVFDATIPFGGYKMSGVGREKGIYALRNYLQTKAVVTPIKNPAWL

SEQ ID NO: 51537 - protein, 351 aa, Desulfovibrio baarsii
IGAAHNLLSAMLDNHIHHSNSLGIDARRVSWRRVVDMNDRSLRDIALALGGPGNGFPRQSGFDITVASEIMAIFCLATSLEDLRTRLAKIVIAQTREFEPITAKDLKADGAMTALLKDAMMPNMVQTLEGTPAFVHGGPFANIAHGCNSVMATNAGLKLADYVVTEAGFGADLGAQKFFDIKCRKTGLKPDAVAIVATVRALKMHGGVAKNELKGENLDALAKGMANLERHITNVRKYGVPPVVAINRFTDDTAAEIDLIRTSCESMGAKVIECTHWADGSAGTEELANTIVDMIENQPSDFKTLYPDDMSLWDKTRTIATEIYGADDIIADDKVRKQYEQLQGRYPGFPI

SEQ ID NO: 51538 - protein, 351 aa, Desulfovibrio piger
ITSAHNLLSAMIDNHIYWGNELGIDERRVVWRRVMDMNDRALRGMVVSLGGVANGFPRQTGFDITVASEVMAILCLANDLEDLQKRLGDIVVAYRRDRTPIYCRDIKADGAMTVLLKDAMQPNLVQTLENNPAFVHGGPFANIAHGCNSVIATNTALGLADYVVTEAGFGADLGAEKFFDIKCRKAGLKPDAAVIVATVRAMRMNGGVAKADLGAENVEAVTKGCPNLGRHIANVKSFGVPVVVAINHFVTDTDAEVQAVQDYVASQGAEAILCKHWAQGSAGIEALAQKVVSLAESGAANFAPIYPDDMGLMQKIETVAKRIHADEVLADKSVRDQLRAWEDKGYGNLPV

SEQ ID NO: 51539 - protein, 468 aa, marine gamma proteobacterium HTCC2143
MSENTLNMIKENDVKWVDLRFTDTKGKEQHVTIPVKEIDEGFFEDGKMFDGSSISGWKGINESDMILMPDDSTAVIDPFTDDTTMNLRCDIVEPTTMQGYSRDPRSIAERAEGYMRSTGIADSCLFGPEPEFFVFDDVKWHADMSGAGYEINSEEAAWSSNHSYDDGNTGHRPGVKGGYFPVPPVDSLHDLRGAMCNAMEAMGLDIEVHHHEVGTAGQCEIGVGPNTAVKKADEIQIFKYCVHNVAHAYGKTATFMPKPLVGDNGSGMHVHQSLSKDGTNIMAGDVYGGLSETALYYIGGIIKHARALNAFANASTNSYKRLVPGFEAPVMLAYSARNRSASIRIPFVPNPKARRIEVRFGDPTANPYLMFASMLMAGLDGIQNKIHPGDAADKDLYDLPAEEAAEIPTVASSLEQALAALDADRAFLTAGGVMDDDMIDAYIALKSEEVEKLNMTTHPVEFDMYYSV

SEQ ID NO: 51540 - protein, 574 aa, Oryza sativa
  misc_feature (455)..(455): Xaa can be any naturally occurring amino acid
MGKSPAKWIKSVLLGKKSAKSNSTKAKDLAKAANNKPVLSEDPPVISEPALVNSHNDGNAENCKLPNGVAVEAMGQGVENQNIVGSKAPTSPEKLSEELAAVKAQAAFRGYLARRAFRALKGIIRLQALIRGHLVRRQAASTLRVTWLIVKLQALVRGRNVRLSGASIQFVVKSGQHKFLSDKPSDAWKEKVSSNAYVRKLLSSSIGLEALHLQYDKRDPNSLYNWLERWTISQIWKSSSQPKKVADGKPQVRKASYAMETESAKLKRNVRKSSAVTVDSFQTNMTVEPEKIKRNSRKFSSSAADSVPDSQLSELEKVKRNLRKVTNSMAEASKISSSRADASKVSSSMADASKVSSSTADASKVSDSVAQIPPSLVNGISDHQDNQCEEAQQNACVSFPPETQELHSGILLEDNSHMNLLEPDLISNPETPFTSILTWEKFNDSTADAQEVEVXPLQNIDNEDNFPENGVLGKKEKPRSKEEPLSNGNLKTSKRRSSFSTKSDYPENGAQNTPVPRRKPSYMAATESAKAKLRGQNSPRLDSDSPADMNGFTRRQSLPSSTNNRAIRAEWRRW

SEQ ID NO: 51541 - protein, 352 aa, Desulfovibrio salexigens
ITSAHNLLSAMIDNHIYWGNELEIDERRIVWRRVMDMNDRALRDIVVSPGGIANGFPRQGGFDITVASEVMAILCLATNLEDLQRRLGDIIVAYRRDHTPIYCRDIEADGAMTVLLQQAMQPNLVQTLENNPAFVHGGPFANIAHGCNSVVATQTALKISDYVVTEAGFGADLGAEKFMNIKCRKAGLAPDVVVLVATVRASKMNGGVARADLGEENVSAVIEGCANMGRHIENLKQFGVPVVVAINHFVTDTEDEVEAIKAYARGHGSEAILCKHWAEGSKGTKELATRVAEIAEAGVSQFAPLYPDDLPLFEKIETIAKRIYRADEVMADKKIRQQLRDWEAADFGNLPV

SEQ ID NO: 51542 - protein, 294 aa, Nostoc sp. PCC 7120
MNKINRVAIVGGTHGNEFTGAFLVKKFQQFPEVIQKPSFETLTILGNPKAFEAGKRYIEKDLNRCFLTESLQNTNLSSYEDIRAKQIAGVLGAENKPNVDVVIDLHSTTANMGLSIILGNQDPFLLKLCAYLSDINPLVKVCYTIPEKGSNFLRSLNKLGFVIEVGAVAQGVLNAELFQKTEQLIYTILDYLEQYNRGNIPKINNLLALYKFTGTVDYPRNENGDIQGMIHPDIQFRDYEPLNPGDPLFLTLDGKAIAYEGTSTVYPIFINEAAYYEKGIAMLFTEKQLINPSS

SEQ ID NO: 51543 - protein, 539 aa, marine gamma proteobacterium HTCC2143
MTNRKDLTSWKQLESLALQKPLQLEGLFQADDQRFQNFSINACGVLFDYSKQLLSNEVREKLLSLAEECDVASWREAMFSGEVINKTENRAVLHTALRSSFAGDDASQQEVSAELEHVRVFSEAIRSGEKKGWTGQVFTDVVCIGVGGSNLGPQMVTDALSGVDSGSLRLHYISSVDAVPLVNLLASLNAERTLFVISSKTFTTSETVLNANTARRWFLQCASEEAVDVHFVAVTDSIAKAGTFGIAEENCFKMWDWVGGRFSLWSAIGLPIALYAGFDVFRELLDGASAMDQHFLDAPLSENMPVMMALVGVWNATFLNMDTLAVLPYDQNLHKLPAYLQQAEMESNGKSVNWNGEAVEYPTCPIVWGQTGINGQHAFYQLLHQGTHRVPADFIGSVHSHSDAAEHHETLLANFFAQPRALMNGVSLNEVERDLAIKGLDPLQVSELARHKVHSGNRPSSSILIDRLDAFHLGALIALYEHKIFTQGILWQVYSFDQWGVELGKVLASNVLTSVLSDAEVSDYDDSTNGLINYYKAHR

SEQ ID NO: 51544 - protein, 640 aa, Oryza sativa (japonica cultivar-group)
MDLKRRDEGAEESFVKPLQLKVKDYPLLGVHISECQIYDLENHMICYQVSNLFSFYGSLWICLVVFIPFNIFPTAIPQKRRDFTMISSQHKRRPCENKYCREYLVNICNQSAEGVAQKVWNFSKCRGMCSYRLYRKKNWEMLAEILDHAVNTLGYTSVHKLLNKGSYVVAVAEMLTSTPLEIWDLCFAQALSSMEIVMAGKACHQCRQMKRNFAVACTQVKKGVCPIKYCHRCLLKRYDENDEEVGQMEAWICPKCRGICNCSCCRRKKGQQPTGRLVHTAKKGEQGAADEESTGRSLRIENSVEELLVEGDQIKLKGNIVVNKNFDGESSLAKDKNGSILGYNSAVSSPNKKVLPRGSLVTNILGADLEVKDVGPAIQLYEFCNSFGEIFQIRKGQPEQILQDIARDQEVEIVPELIAGFHKNLLSVIKEDRGEKNSIYITNGDAWLNDLGAYINELAFMSKELHLEFVNKGTLGYNKLSPCKLHVLNLLCDEALSTVKLRKLIEEQNGRAAERRNDAKAKLRAAKAKEKELREGLKNDMKEGATPIEGNRNQLISDIKKAKEVKLTAIKEKKLGTVLRSKPLMLEDREAYWKLDGYSNNKMLLLQEFDNENFTGNDIWFEFTEDEEKTIENHAAIRDP

SEQ ID NO: 51545 - protein, 298 aa, Debaryomyces hansenii CBS767
MSRNTEKAQSSLNRFQALKNKEAGVLESNPNFRPKYVQSVDSLPQAEKWRSTIIGEISVKLTKIQDPALNEYQIRDINDSLNKLFNEKRSWEYHIKNLGGADYMHFNKDFNNAGKLSQLDSLGSHIKGYRYFGRAKELPDVKEVLMLQQKKGHANKSKHAKELEQNRLLNEQDQRIKADYYGVYDEINDGNDDIIASNERDIINQVNEVLGDEIIKPVDDINEYYVAHKAQGVDNLIEFEKNRGKKLFRKFKNNQHNDEADSNVITNFEKEVPTSDEVTKWIVNKKRAELIARLGINK

SEQ ID NO: 51546 - protein, 590 aa, Candida albicans SC5314
MGQILSQPVVEKHSDEHKDKYLAYGISCMQGWRINMEDAHATILNLYDLPLKKSLSSNSEQDEDEEDEEEEADSQDSTTTNTTKSQQQQNQKEDLQQNNDKQNSQQDIKDGDNDTQMSDSDENHHHAAPQQQHIAFFGVYDGHGGEKAAIFTGEKLHHLIKETKEFKQKDYINALKQGFLNCDQEILKDFYMRDDDSGCAATSAIITPDLIVCGNAGDSRTIMSTNGFAKALSFDHKPSNEGEKARICAAGGYVDMGRVNGNLALSRGIGDFDFKKNVDLPAEEQIVTCYPDVIQHNIDYKSDEFVVLACDGIWDCLTSQKCVECVRRGIYERKSLSIICEEIMDLCCAPTSDGSGIGCDNMSIAIVALLDYTKNETLDQWYEKIISRVEQQQQQKNDPNSLNKYGPISQPYNELYKEMYGEYYDIGQQGQGGNGRSNIGSGNGSGRGSGASGSSSGGGASINGNSIFGRSGYDDEDDDDDEEKNIERRRRDQDESNLNGGAISLQKLLASNAITNENGVIYLDTSSAQSLLAHFGVADAGAHGDEEDEEEEGEGEDVHQGLAHEEEEEEEEEKEGSKIEEISEKIDDEV

SEQ ID NO: 51547 - protein, 435 aa, Oryza sativa (japonica cultivar-group)
MAVLYAGVFLLCVSSAGARFNQATMGADQFDAAADRDVFFNWYFIFFYGSAVLGSTVLVYVQDAVSWELGFGLAATIAAAGLAALLLGARYYRRPAARGSPFTGIARVVVAAARKRKIDVAAAAAASGDLKFYYGPRSGDGDDDGGKPSDDNNFAPSDSFSFLNRAAVITDGDVDAADAAAPLRPWRVCTVRQVEDLKAVLRILPLWSSSIFLSISIGVQLNFTVLQALAMDRAIGRFHVPAASMVVSSFVAVVVSLGLIDRALLPLWRALTGGRRAPTPLQRIGVGHVLTVLSMAASAAVERRRLATVRAHGEAARDDPAWVSPLPAAWLVLPFALSGAGEAFHFPAQVTLYYQEFPPSLKNTASGMVAMIVALGFYLSTALVDAVRRATAWLPDNMNASRLENLYWLLAVLVAINFGYYLACAKLYKYQNFGK

SEQ ID NO: 51548 - protein, 249 aa, Zea mays
  misc_feature (70)..(70): Xaa can be any naturally occurring amino acid
VDPRVRTQTDMSKTMRAILIDWLVEVTEEYRLVPETLYLTVNYIDRYLSVKEISRHRLQLVGVACLLIAXYEEICPPLVEELCYITDYSYTKEEVLQMEASVLNNLKFEMTVTTAKCFLRRFVRVAQVPDKGSSLHLEFLVNYICELSLLEYSLLCYLPSMVAASSVFLAKFILMPIKNPWNSSLSYYTRYTPSELRGCVRVLHRLFRLGPGSNLPAIREKYSQHKYKFVAKKYCPQSIPTKFFQDLTS

SEQ ID NO: 51549 - protein, 593 aa, Pseudomonas fluorescens Pf-5
MTTGSALYIPPYKADDQDVVVELNNRFGPEAFTAQATRTGMPVLWVTRSKLVEVLTFLRNLPKPYVMLYDLHGVDERLRTKRQGLPGADFSVFYHLLSIERNSDVMIKVALSEGDLSLPTVTGIWPNANWYEREVWDMFGIDFAGHPHLSRIMMPPTWEGHPLRKDFPARATEFDPFSLNLAKQQLEEEAARFRPEDWGMKRSGANEDYMFLNLGPNHPSAHGAFRIILQLDGEEIVDCVPDIGYHHRGAEKMAERQSWHSFIPYTDRIDYLGGVMNNLPYVLSVEKLAGIKVPEKVDVIRIMMAEFFRITSHLLFLGTYIQDVGAMTPVFFTFTDRQRAYTVIEAITGFRLHPAWYRIGGVAHDLPRGWEKLVKDFVEWLPKRLDEYTKAALQNSILKGRTIGVAAYNTKEALEWGVTGAGLRSTGCDFDLRKARPYSGYENFEFEVPLAANGDAYDRCMVRVEEMRQSIKIIDQCLRNMPEGPYKADHPLTTPPPKERTLQHIETLITHFLQVSWGPVMPANESFQMIEATKGINSYYLTSDGGTMSYRTRIRTPSFAHLQQIPSVIRGSMVADLIAYLGSIDFVMADVDR

SEQ ID NO: 51550 - protein, 244 aa, Arabidopsis thaliana
MSTGLDMSLDDMIAKNRKSRGGAGPARGTGSGSGPGPTRRNNPNRKSTRSAPYQSAKAPESTWGHDMFSDRSEDHRSGRSSAGIETGTKLYISNLDYGVMNEDIKELFAEVGELKRYTVHFDRSGRSKGTAEVVYSRRGDALAAVKKYNDVQLDGKPMKIEIVGTNLQTAAAPSGRPANGNSNGAPWRGGQGRGGQQRGGGRGGGGRGGGGRGRRPGKGPAEKISAEDLDADLDKYHSGDMETN

SEQ ID NO: 51551 - protein, 856 aa, Oryza sativa (indica cultivar-group)
MPFCPKLWSSAAPAPAQPGSVVINGTVVVANHFGLSAPGKSTTLRLFSGTEVDHGDAESLKRIAETRKGRLSAEAALRGGKKTRHGKASTTMYQVTFFVDGEFGTPGAVAVKNGNRNDQFFLRHVRLDLAEDRSIHFDCNSWVYPYKKTTSDRVFFINTSYLPDKTPEALRLLREEELRSLRGNGRGERKDWERIYDFDYYNDLGNPDNDDHVRPVLGGTKTHPYPRRCRTGRPLSKTDGVTETRKHKLINLDYYIPPDERFNPGKLAEVLAMGVQAVTHFVIPEARSIFHGDVVNFKSTEQLRADLYGKPPQPAADARVMDELKSSVPSHKTYKQVSRIVKDNPAKFPTPQVIHYDTEAWRSDEEFAREMLAGLNPVVIKRLEVFPPNKSKITTDDIMTQIGGLTIQQAMEQKRMYILDHHDYLMPYLRRINTEGVCVYASRTLLFLRDDGALRPVAIELSLPDGGVGGSEISRVFLPASQGTQMQHLWHLAKTHVAVNDSGYHQLISHWLFTHATVEPFIIATRRQLSAMHPIHKLLDPHFKDNMQINTLARSILLNAGGLLEKTMYPGKYSMEMSSDIYAHWRFTEQSLPNDLIKRGMASRDPKARGGVSLHIEDYPYAVDGIDVWLAIEGWVRSYCDHFYHADAAVAGDAELQAWWDDVRRVGHGDRQGDAACWLDLDTVAGLVETLSTLIWTASALHAAVNFGQYGYAGYPPNRPTRCRRFVPLPGSPEMAQLEADPGRFFLETVPDRFTATLGIALIEVLSNHTSDEVYLGQRATSTWTDDGEVLLLLDRFRDELRRVEKRVEERNKDPRLVNRRGPVRVPYTLLYPDAGDVAGKEKGITGRGIPNSVSI

SEQ ID NO: 51552 - protein, 203 aa, Zea mays
  misc_feature (49)..(49): Xaa can be any naturally occurring amino acid
  misc_feature (85)..(85): Xaa can be any naturally occurring amino acid
  misc_feature (97)..(97): Xaa can be any naturally occurring amino acid
  misc_feature (153)..(153): Xaa can be any naturally occurring amino acid
MVTRNCITALLLGFLVTASPFTSRVDRAESHEDAAAVEVAEGTDLGIVXDDTHASRDGPLTPGPAVYTVVVLHQKMLENCTTGEXTALLIGLQYDGXSIMNGAAAHSTLHLPFDHDMYGQNLTVHNCFNSSTPATVQATFPYMFTARKFLQSXAYDLSCYISDDIYQHPYQNVFYNVTIDDVEGGSLLNDVAALLIALEFALL

SEQ ID NO: 51553 - protein, 360 aa, Desulfovibrio vulgaris
VAVANNLLAAYVDTSMLHKNPHRLNPFSTRLRRVVDVNDRALRHTVVGCGGRLNGLPRETGFDIVAASEVMAILGLSKSYADMRERLGRILVGRSIDRTDVTAGDMKAAGAMAVVLKEAIKPTLMQTTEGTGVLIHTGPFANIAHGNSSILADEIALRLADYVITEAGFGADMGAEKFFNIKCRVSGRTPDAAVVVATCRALKMHGSDLSVKPGQPLDPRLLEENVEWIEQGMPNLQKMIQIVKRHGIPAVVAVNRFATDTDREVDCILKGAIEAGAAGAAVSEVHARGGEGGLALARAVKEAAAQPSAFKPLYRLELPIRDKIEVLAREIYGAARVKFYDEAIKKMNAFTERGYQELPI

SEQ ID NO: 51554 - protein, 353 aa, Desulfovibrio desulfuricans
IGAANNLLAALIDNHVYWRQNDETGLDNRRITWRRALDMNDRSLRQITTSLGGVANGAPREAGFDITVASEVMAILCLAKDLKDLERRLGNVIIGFTRDRKPVLAREINAQGAMTALLKDAMKPNLVQTLEGNPAFIHGGPFANIAHGCNTLIATKTALKLADYVVTEAGFGADLGAEKFFDIKCRKGGLKPDAAVLVATIRALKMHGGVAKGDLSQENLDALEKGCVNMERHIRNMKRFGVKVVVGINRFSADTPAEIDLVKKKCASLGVKAVMSDHWAAGGAGAEDLAREVIAAAESGESNFQTLYDDSPTLWNKVQRIATDLYGASEIIADKKVRAQVRDLEADYGHFPV

SEQ ID NO: 51555 - protein, 370 aa, Oryza sativa
MATGKVIKCKAAVAWEAGEALSIEEVEVAPPQRMEVRVKILYTALCHTDVYFWEAKGQTPVFPRILGHEAGGIVESVGEGVTELAAGDHVLPVFTGECKECDHCKSEESNMCDLLRINVDRGVMIGDGKSRFTIKGKPIFHFVGTSTFSEYTVIHVGCLAKINPEAPLDKVCILSCGFSSRFGATVNVAKPKKGQTVAIFGLGAVGLAAMEGARLSGASRIIGVDLNPAKFEQAKKFGCTDFVNPKDHSKPVQVLIEMTNGGLDRAVECTGNINAMISCFECVHDGWGVAVLVGVKDDVFKTHPMNFLNEKTLKGTLIFGNYKPRTDLPNVVELYMKKELELEKFITSVPFSEINTAFDLMLKGRVSAAS

SEQ ID NO: 51556 - protein, 353 aa, sulfate-reducing bacterium 'summer lac-1'
IGAANNLLAALIDNHVYWRQNDETGLDNRRITWRRALDMNDRSLRQITTSLGGVANGAPREAGFDITVASEVMAILCPAKDLKDLERRLGNVIIGFTRDRKPVLAREINAQGAMTALLKDAMKPNLVQTLEGNPAFIHGGPFANIAHGCNTLIATKTALKLADYVVTEAGFGADLGAEKFFDIKCRKGGLKPDAAVLVATIRALKMHGGVAKGDLSQENLDALEKGCVNMERHIRNMKRFGVKVVVGINRFSADTPAEIDLVKKKCASLGVKAVMSDHWAAGGAGAEDLAREVIAAAESGESNFQTLYDDSLTLWNKVQRIATDLYGASEIIADKKVRAQVRDLEADYGHFPV

SEQ ID NO: 51557 - protein, 483 aa, Oryza sativa
MNVLASKIFPSRSNVVSEQQQSKREKATIDDAKNSSKNKNLDRSVDESVLGIILGGGAGTRLYPLTKKRAKPAVPLGANYRLIDIPVSNCLNSNISKIYVLTQFNSASPNRHLSRAYGNNIGGYKNEGFVEVLAAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLLAEQLYEVAA

SEQ ID NO: 51558 - protein, 352 aa, Desulfomicrobium baculatum
IGTAHNLLSALIDNHIYWGNKSALDMRRITWKRVMDMNDRSLRDITIGLGGPGNGFPRQNGFDITVASEIMAIFCLATDLQDLERRISNIVIGYTRDLKPVHARDVNAPGAMTVLLKDAFMPNLVQTLENNPAFIHGGPFANIAHGCNSVIATKTALKLADYVVTEAGFGADLGAEKFFDIKCRKAGLHPDAVVLVATVRALKMHGGVAKDQLGSENTDAVSRGCENLARHIRNLSQFGVPVTVAINRFVADTEGELDVIRKFCAKFDVKAFDCTHWAEGGKGTEELAKHVADVADSGQAQFHTLYDDDMTLWNKARHIARSLYGADDIIADKKVRDQFAKFEADGYGRYPV

SEQ ID NO: 51559 - protein, 323 aa, Mesorhizobium sp. BNC1
MARKSWMYSVLEAVQHEMLEDPNMVWIFELTPPVASNPGRLVINLEKQFGRNRVVNTGIDENWMASATLGAGLAGSRAATYVPYQGACMPFQVIQNHAGKLRHMTGGKASMPVVFIMEMTGQTPGFAGQHSDYEIDTYYAHIPGVKTVIPSTPYDAKGMMVSALRDPNPVVYLYPAGLRELIEEVPDEQYEVPLDKAIVRMEGSDLTIVGSGASMPEVLKAAETLKAAGMNVEAIDLRSLKPMDTETLVKSVAKTKRLLTVDQSYYTLCPGAEVIARVAENVDGARYKRVAFPDAPPPASPEMFLWMRPNADHIVGAAKKLVG

SEQ ID NO: 51560 - protein, 352 aa, sulfate-reducing bacterium BG14
IGAAHNQLAALIDNHMHWENQLNVDPRRVTWRRVVDMNDRALRSITSGLGGFHNGVVREAGFDITVASEIMAIFCLATDLKDLENRLGNIVFGYTRKNEPVTVRELNAQGAMTALLKDALQPNLVQTMENNPAFMHGGPFANIAHGCNSVMATTTALKLADYVVTEAGFGADLGAEKFFGIKCRKASLKPDAVVLVATIKALKMHGGVAKDQLGKENVKALEAGLKNLGKHLRNLSTFGVPAVVAINRFTADTAAEIAAVTKYCENFGVSAVECTHWADGGAGAEALARKVAELADSGAAQFRTLYADDLPLWDKAKRIATTIYGADDIIADKKVRQQLAQFEKEGYGHYPV

SEQ ID NO: 51561 - protein, 182 aa, Pseudomonas fluorescens Pf-5
MFKYIGDIVKGTGTQLRSLVMVFGHGFRKRDTLQYPEEPVYLPPRYRGRIVLTRDPDGEERCVACNLCAVACPVGCISLQKAETEDGRWYPDFFRINFSRCIFCGLCEEACPTTAIQLTPDFEMAEFKRQDLVYEKEDLLISGPGKNPDYNFYRVAGMAIAGKPKGSAQNEAEPINVKSLLP

SEQ ID NO: 51562 - protein, 365 aa, marine gamma proteobacterium HTCC2143
MNTPANSTASTPSEALQGLPRFDLQQWHNTAGDAAERQTMAESLCQACHDVGFFLLTNHGIDSALIDAVFDLSRNFFDLPLADRKSIDKRASRHFRGWESEGSEYTNGRPDIREQIDLWSEHEPRAKDALPAYHRLLGPNQWPSEALVPGFESALNAWFRDMGQTADELMVVLATGLGLSPDHFDKAFGTERMALTKLIRYPETPAGQFGVNAHHDAAFLTLLSPGTTPGLQIETAEGSWMDVPLVPGALVVNLGEILQSITGNYLLATPHRVITQTPRQSAAYFHGPSLDMELAPIELPARFVEAVANSPRHHGAGFMARAEETDAGVGDMSSDHRPAVYGEQLWNYFCRSYPDNVEAHYPDDV

SEQ ID NO: 51563 - protein, 372 aa, Arabidopsis thaliana
MDRLLQPPSSHSIAPSKFQSRPSPLLLHRLHSTNLSTFPSSRRLESRRISSISCFFRQNPSPDTSPGLNQSSNFLIASSQTDASKPNPGFIQRIVSSFEQRKTIPAGMVILVSAIAALLLNPILVPPAFASFQTATNSGGAAVVGGKLLRTEVLTSAWTGFFAGCLHTLSGPDHLAALAPLSIGRTRMESAAVGALWGCGHDAGQLIFGLLFLLLKDRLHIEVIRTWGTRVVGLTLLVIGAMGIKEASEMPEPCVVTLENGETDEKSLKKKKIGFATFATGIVHGLQPDALMMVLPALALPSRIAGASFLIMFLIGTVIAMGSYTVFIGSCSEALKEKVPRITEKLTWASSLVAIGLGLAIIVSQFFGFSLY

SEQ ID NO: 51564 - protein, 396 aa, Candidatus Kuenenia stuttgartiensis
MTTATSAKTTHMMSINMGPQHPSTHGVLRLILEMDGETITKAAPDIGFLHRGVEKLAEYKTYHQFIPLTDRLDYVAPFSNNLAYALAVEKLIGVEIPERAQHIRVMLCELTRISSHLLWLATHALDLGAMTVFFYCFRERETLYDIFEMVSGSRMNLSYIRIGGVAHDLPGGFLKSVEKFVNEFPSKLKEYEILLKDNPIWKKRTIGVGYISPEEAIDYGLSGPSLRGSGVDWDVRKAEPYSSYDKYDFNVPLGVHGDVYDRYRVRIEEMIQSNNIVKQALDILPKGDHIAHAPAVALPAKEAVETNMEAMIHHFKLITDGICPPKGEVYSCVEAPKGELGFYIVSDGSNRPYRLKIRPPSFVNLEALPKMVEGKMLPDVVAVIGSLDIVLGEIDR

SEQ ID NO: 51565 - protein, 356 aa, Neisseria meningitidis FAM18
MTKHIAILRGDGIGPEIVAETVRVLDKLIAQGLDAGYEYAPLGGEAYDEYGHPYPEFTQNLCRKADAVLLGAVGSPQYDNLDRPLRPERGLLAIRKDLNLFANLRPAVLYPELANASTLKPEIVAGLDILIVRELTGDIYFGEPRGIRVLENGEREGYNTMKYSESEIRRIAHVAFQSAQKRSKKVCSVGKANVLETTELWREIFEEIGKQYPDVELSHMYVDNAAMQLVRAPKQFDVIATGNIFGDILSDEASMLTGSIGMLPSASLDENGKGLYEPSHGSAPDIAGQNKANPLATILSLAMLLRYSLNDEARAQQVENAVQKVLQQGLRTSDIYEEGTKLVSCSEMGDAVLAAL

SEQ ID NO: 51566 - protein, 474 aa, Mycobacterium sp. MCS
MNAHPAGPRHAEEIHHGGAPPRPAGPDEVLRLAPNVWPRNAVRGADGVVSIAGVPVTDIAAQFGTPVFIIDEADFRSRCREISAAFGGGEYVRYAAKAFLCTEVARWIDEEGLALDVASGGELAVALHAGFPAERIALHGNNKSPDELALAVKSGVGHVVVDSMIEIERLDEIAAAAGVVQDVLVRVTVGVEAHTHEFISTAHEDQKFGLSLASGAAMAAVRRVFETDNLRLVGLHSHIGSQIFDVAGFELAAHRVIGLLRDVVAEFGVDKTAQMSTVDLGGGLGISYLPQDDPPPVADLAAKLSAIVREESAAVGLPTPKLVVEPGRAIAGPGTITLYEVGTVKDVAVASDRYRRYVSVDGGMSDNIRTSLYGAEYDVRLVSRVSDADPALSRVVGKHCESGDIVVRDAWLSGDVAPGDLLGVAATGAYCYSMSSRYNLIGRPAVVAVRDGHARLILRRETVDDLLSLEVSGQ

SEQ ID NO: 51567 - protein, 540 aa, Oryza sativa (japonica cultivar-group)
MFFHPSLVTGDECCERLAYYGIAKNLVTYLKTNLHQGNLEAARNVTTWQGTCYLTPLIGALLADSYWGKYWTIAAFSAIYFIGLVALTLSASVPALQPPKCSGSICPEASLLQYGVFFSGLYMIALGTGGIKPCVSSFGADQFDDSDPADRVKKGSFFNWFYFCINIGAFVSGTVIVWIQDNSGWGIGFAIPTIFMALAIASFFVASNMYRFQKPGGSPLTRVCQVVVAAFRKWHTEVPHDTSLLYEVDGQTSAIEGSRKLEHTSELEFFDKAAIISSDDAKSDSFTNPWRLCTVTQVEELKILIRMFPIWATTIIFNAVYAHNSSMFIEQGMVLDKRVGSFIVPPASLSTFDVISVIIWIPFYGRVLVPIARKFTGREKGFSELQRIGIGLALSILAMLSAALVELRRLGIARSEGLIHEDVAVPMSILWQIPQYFLVGAAEVFAAIGQVEFFYNEAPDAMRSLCSAFALVTVSLGSYLSSIILTLVSYFTTQGGDPGWIPDNLNEGHLDRFFSLIAGINFVNLLVFTGCAMRYRYKKA

SEQ ID NO: 51568 - protein, 300 aa, Oryza sativa (japonica cultivar-group)
MLPYATAAEAEAAVGRGLTWAEAAWFRYSAAIPDYCLYCHNVPILLLVYTLAPLPLALLELRRHLPLPHKLQPGVRHPPAAFLRCYAATARVLLLAVGPVQLASFPAVRAVGIRTGLPLPSAGETAAQVAVYLLVEDYLGYWIHRLLHTPWAYHHIHRVHHEFTAPMGYAAPYAHWAEILILGFPAFAGPAIVPCHMTTFWLWFVLRHLEAIHIHSGFKLPFDPTKYIPLYGGVEYHDYHHFVGGHSQSNFSSVFTFCDYIYGTDRGYRYHKASLSKLKEMAGNHVEKGDENGFGNGKQD

SEQ ID NO: 51569 - protein, 674 aa, Synechococcus sp. RS9916
MCGIGGVFNADRQQTVDRQLLVNMAAIQAHRGPDGFGVEVLDQAGVGFCHARLSIIDLNESRARQPFLTDDGEVLMAHNGEFYDFQRIRADLTAQGVRFSSKSDSEILLRLYQRQGLEATLPLLRGEFAFALFDRAEDCLYLVRDRFGIKPQYWAMTPEGLVFGSELKVLFAHPAVERRFTSEGLFHQLMQTMVPGTTAFAGVHQVKPGHVLKVQRMNGRLQVSESTYWDVDFPRKDQRDSSRTEADHIAAVRAALLEAVELRMVADVPVGCYLSGGIDSCSILGLASAVSQAPVKAFTIGFDDARYDESPIAREMAEATGAEQDLLRLSGQELYGHMERTIWHAERTIYNTLAVAKFLMSRHVNDVDYKVVMTGEGSDELFGGYPAFRRDMFLHGLDDLPEEERASWESLLQQSNALVKGAMLAENQVDDPDLDAVVGFTPSCLQPWLACAPLVPELLAESHATALEGYSPGKAIAEQLDGDQLDGRHALDKAQYVWIKTMLEGQILTWGGDRVDMANSMEARPAFLDHHLAAVAVQVPPELRIKGKTEKYVLREAMAGLLPEVLYKREKFAFMAPPAHTEPEKWEQMKQLANDYLSDEAIDAAGLLSKAGVRALFARHDDPSTTDAERVQLDAVINHLLGVQMLHRMFVAEDVPALARREADRLGWRVLMPV

SEQ ID NO: 51570 - protein, 199 aa, Brassica napus
  misc_feature (9)..(9): Xaa can be any naturally occurring amino acid
  misc_feature (17)..(17): Xaa can be any naturally occurring amino acid
VIALQLSAXHNVSIESXRQEMHSLHPDDSHIVVLKHNVWRVKGLIQISRSIGDVYLKKAEFNREPLYTKYRLREPMKRPILSGEPSITEHEIQPHDQFLIFASDGLWEQMSNQEAVDIVQNHPRNGIARRLVKMALQAAAKKREMRYTDLKKIERGVRRHFHDDITVVVIFLDNNVMSSAKGGSSVSIRGGGMTFPKKL

SEQ ID NO: 51571 - protein, 196 aa, Triticum aestivum
  misc_feature (16)..(16): Xaa can be any naturally occurring amino acid
  misc_feature (58)..(58): Xaa can be any naturally occurring amino acid
  misc_feature (65)..(65): Xaa can be any naturally occurring amino acid
  misc_feature (75)..(75): Xaa can be any naturally occurring amino acid
APGIPGNAPGPPPGVXVPVANGSEEMEALNLIDVLRRAGARVTVASVEDTPRIVTRPXTRLNLIXDVMLEQAAEXRFDLIVMPGGLPGALKFTSSEKLVGMLKKQAESGRPYGAICASPAYVLEPHGLLKGKKATSFPPMAHLLTDQSACEYRVVVDGNLITSRAPGTATEFALAIVEKLFGEEKAVALAKELVFM

SEQ ID NO: 51572 - protein, 483 aa, Oryza sativa
MNVLASKIFPSRSNVASEQQQSKREKATIDDAKNSSKNKNLDRSVDESVLGIILGGGAGTRLYPLTKKRAKPAVPLGANYRLIDIPVSNCLNSNISKIYVLTQFNSASLNRHLSRAYGNNIGGYKNEGFVEVLVAQQSPDNPNWFQGTADAVRQYLWLFEEHNVMEFLILAGDHLYRMDYEKFIQAHRETDSDITVAALPMDEKRATAFGLMKIDEEGRIVEFAEKPKGEQLKAMMVDTTILGLDDVRAKEMPYIASMGIYVISKNVMLQLLREQFPGANDFGSEVIPGATNIGMRVQAYLYDGYWEDIGTIEAFYNANLGITKKPVPDFSFYDRSAPIYTQPRHLPPSKVLDADVTDSVIGEGCVIKNCKIHHSVVGLRSCISEGAIIEDSLLMGADYYETEADKKLLGEKGGIPIGIGKNCHIRRAIIDKNARIGDNVKIINVDNVQEAARETDGYFIKSGIVTVIKDALLLAEQLYEVAA

SEQ ID NO: 51573 - protein, 447 aa, Oryza sativa
MAAAAAACVESPDEGVEIREVWAGNLEAEIAAIRDEVDRYPYVAMDTEFPGIVCRPVGNFRTTDEFNYANLEANVNMLKLIQLGLTLSDEGGDLPRRGTGGRRCIWQFNFRGFDPRTDPSNADSIQMLRTCGIDFDRFAAEGADPIRFAELLMSSGVVLNADVQWITFHSGYDFGYLLRLLTGRNLPDNMPAFFDLIRIYFPVLYDIKHLMRFCSNLHGGLSRLGELLDVKRVGTCHQAGSDSLLTLGCYNKIKEEVPPLSCLHPPWAQSRRLLEHRPEGSEVNERLHVSVIVLAVTVAWVPADMVQSDVIFCQRWHFLETSHAGARWETPNVGWIWAAQRRGEGLHWGVVKGDVGEALRRERRALRRLRRSHGGARHAAVRHKRSGEAHAQRRDARTAARLKHGTVHRYATELKHVTDAKVQMEANVARHKEQMEAMGKQKDAGKC

SEQ ID NO: 51574 - protein, 385 aa, Thermus thermophilus
MRGLSRRVQAMKPSATVAVNAKALELRRQGVDLVALTAGEPDFDTPEHVKEAARRALAQGKTKYAPPAGIPELREALAEKFRRENGLSVTPEETIVTVGGSQALFNLFQAILDPGDEVIVLSPYWVSYPEMVRFAGGVVVEVETLPEEGFVPDPERVRRAITPRTKALVVNSPNNPTGAVYPKEVLEALARLAVEHDFYLVSDEIYEHLLYEGEHFSPGRVAPEHTLTVNGAAKAFAMTGWRIGYACGPKEVIKAMASVSRQSTTSPDTIAQWATLEALTNQEASRAFVEMAREAYRRRRDLLLEGLTALGLKAVRPSGAFYVLMDTSPIAPDEVRAAERLLEAGVAVVPGTDFAAFGHVRLSYATSEENLRKALERFARVLGRA

SEQ ID NO: 51575 - protein, 351 aa, sulfate-reducing bacterium BG9
ITTAHNLLAAIIDNHLHHGNALGIDSRRITWRRVVDLNERALRNIVCGLGGKANGIPRETGFDITVASEMMAILCLAKDLDDMKERIGRIIVAYTYEGKPVTPKDLKVTGALTLLFKDAIKPNLVQTLENTPAFVHGGPFANIAHGCNSVSATKYALKLADYCVTEAGFGADLGAEKFLDIKCRFAGFKPSAVVIVATVRALKMHGGVPKNELAGENIVALEKGLANLTKHIENIQQFGLPAVVAINAFPTDTAAELSFVEEKCNAMGAEVALSEVWAKGSLGGQVLAEKVLAACEKPSNFSFMYDEQASIKDKIAAIATKIYGADGVNYTAAAEKTVKELTALGFDKTPI

SEQ ID NO: 51576 - protein, 199 aa, Arabidopsis thaliana
VAVFAFCLVAVTAQFAHVLWWKRRFRRRSIAGSERDAFSSRGGDLTATPPPSKELLYFFLFCLENKQFRIGSATAPPLPAAAPPVNDVASKWSINGENLLCGPSETLFTIAEDYTSESDHRTGEIDPRGSIFTEDHVKDDEVEEEVVATDISDDEVDFSHYNQTTPFSTPCASPPFYTPSPSPIRDDLSKTVREESVYG

SEQ ID NO: 51577 - protein, 360 aa, Desulfovibrio gigas
VAVANNLLAAYVDTSMLHKNPHRLNPFSIRLRRVVDVNDCALRHTVVGCGGRLNGLPRETGFDIVAASEVMAILGLSKSYADMRERLGRILVGRSIDRTDVTAGDMKAAGAMAVVLKEAIKPTLMQTTEGTGVLIHTGPFANIAHGNSSILADEIALRLADYVITEAGFGADMGAEKFFNIKCRVSGRTPDAAVVVATCRALKMHGSDLSVKPGQPLDPRLLEENVEWIEQGMPNLQKMIQIVKRHGIPAVVAVNRFATDTDREVDCILKGAIEAGAAGAAVSEVHARGGEGGLALARAVKEAAAQPSAFKPLYRLELPIRDKIEVLAREIYGAARVKFYDEAIKKMNAFTERGYQELPI

SEQ ID NO: 51578 - protein, 352 aa, uncultured bacterium
IGAAHNLLAALIDNHMHWENQLNVDPRRVTWRRVVDMNDRALRSITSGLGGFHNGVVREAGFDITVASEIMAIFCLATDLKDLENRLGNIVFGYTRKNEPVTVRELNAQGAMTALLKDALQPNLVQTMENNPAFMHGGPFANIAHGCNSVMATTTALKLADYVVTEAGFGADLGAEKFFDIKCRKASLKPDAVVLVATIKALKMHGGVAKDQLGKENVKALEAGLKNLGKHLRNLSTFGVPAVVAINHFTADTAAEIAAVTKYCENFGVSAVECTHWADGGAGAEALARKVAELADSGAAQFRTLYADDLPLWDKAKRIATTIYGADDIIADKKVRQQLAQFEKEGYGHYPV

SEQ ID NO: 51579 - protein, 317 aa, Oryza sativa (japonica cultivar-group)
MAEGEVESRDWAEMPSDALAAVFGKLDVTDLLVGAGVVCRAWRRLAAIDPTLWRRVDMSHQGDIMEVDEAVAMARAAVDRAAGTMEAFWADSFVTDGLLLYISERASSLKSLQLSMCLNVSNEGMAEAMKGFPRLEELDITFCSLYGDVCASVGKACPELKCFRLNERYTLQMDYAAPDIMDDDTEALGIASNMPKLRELQLIGNKLTNDGLMSILDHCQHLESLDIRQCYSIQMDDALKSKCSRISDLKLPHDSISDFKYRAYIFSSSAFSGSDLELDMYDDLLDVVTDDDDADFDDMDDYDDGGSDGGMYDEFDI

SEQ ID NO: 51580 - protein, 502 aa, Xylella fastidiosa Temecula1
MHNGFDALQLHANRLRGVTIPDLLAAELKRPEQYARQVGPLYFNFARQKYDCVALEALFALARNHNVTGAFQRMFCGEQVNVTEGRAVLHTALRGDLSGTSVAVAAYTAAAKVRERMYALIAGLDASEVTDIVSVGIGGSDLGPRLVVDALRPISQGRFRVHFVSNVDGAAMRRTLDMLDPSRTAGILISKTFGTQETLLNGRILYDWLGGSERLYAVTANPERAANAFDIVPTQVLPIWDWVGGRYSLWSAVGFPIALAIGSQRFEELLAGAAEFDAYALRVPLEENVAVLHGLTAVWNRNFLGCATYAVMAYDQRLALLPTYLQQLVMESLGKRVKCDGTPVDRDTVPVWWGGVGTDVQHSFFQALHQGTNIVPADFIGTIRNDDLYTENHFALNANLLAQIEVLANGQLSDNPHRVYPGGNPSTLILLDALTPQALGGLIAMYEHSVYVQSVIWGINAFDQFGVELGKHLAVQLLPALKGESVEVADPVTRAVLLRLRG

SEQ ID NO: 51581 - protein, 352 aa, uncultured bacterium
IGAARNLLSALIDNHIHWGNDKALDARRIVWRRVVDMNDRALRDVVLSLGGVANGFPRQSGFDITVASEVMAIFCLATDLEDLQARLGKVVVGYTRDREPVYARDLDADGAMSVLLKDALNPNLVQTLENNPAIIHGGPFANIAHGCNSVIATKTALKLADYVITEAGFGADLGAEKFFDIKCRKAGLKPDAAVIVATIRALKMHGGVARDALGAEDVDAVKAGLENLGRHIRNVGQFGVPALVAVNRFTSDSDAEVAAVRDFCAGLGVDAHECTHWADGGAGTEGLAEAVAAVADAGRSQFRPLYDDDMTLWEKTRTVARSIYGADDIIADKRVRDQFVQFQEQGFGSYPV

SEQ ID NO: 51582 - protein, 621 aa, Oryza sativa (japonica cultivar-group)
MEGVLLQQELPKKQFKAEHLSSWRVQQPFRAAKGAFMGSSLEAEQQSLIVRTTEPEDVDDYTGDGSVGFSGQPILKHETGNWRACSLILGTEVCERLAYYGISKSLVTYLSTRLHEGNVSAARNFTTWQGTCYLTPLIGATLADSYWGKYKTIAVFSTIYFLGMAALTFSALVPSLQPPQCFGSFCPQPTVPQYLIYFVGLYMIALGSGGIKPCVSSFGADQFDDTDPVERTKKGAFFNWFYFAINIGSLISGTVLIWVQQNCGYGIGFGIPTIFIALAIGSFFIGSQRYRYQIPGGSPLIRVCQVVIAAIHKRNVDLPVDSSVLYELHGKTSAIEGSRKLEHSSEFSFLDKAAVILSNERGGSHDPWRLCTITQVEELKILMRMFPIWATGIVFFTVCAQNSSMFIEQGMALNNQIESFKIPPATLSSLDVISIVVWVPIYETFVVPIASRLTGKERGFSELQRMGIGLFVATTAVATAALVEIKRLEIARSEDLIHSKVPVPMSILWQAPQYLLVGIGEVFTAIGQAEFFYNQSPDSMRSLCSAFALVTVSLGSYLSSFILTLVSYFTTRDDNPGWIPDNLNEGHLDRFFWLIAGLSFLNLLLFVYYAQQYKCKKAAAI

SEQ ID NO: 51583 - protein, 139 aa, Candidatus Kuenenia stuttgartiensis
MILPLVKGLLLTLKRFLNPFTCVTESYPDARPRLAKRFRGLPELQIGEDGREKCVACGLCAKVCPSQCISIEGAEDEQFRRYPSMYELDSFRCIFCGFCEEACPERAILLGDVFELATDKNSGVLDKEKLLESARKRKL

SEQ ID NO: 51584 - protein, 429 aa, Staphylococcus aureus subsp. aureus MW2
MNFSESERLQQLSNEYILGGVNSPSRSYKAVGGGAPVVMKEGHGAYLYDVDGNKFIDYLQAYGPIITGHAHPHITKAIQEQAAKGVLFGTPTELEIEFSKKLRDAIPSLEKIRFVNSGTEAVMTTIRVARAYTKRNKIIKFAGSYHGHSDLVLVAAGSGPSQLGSPDSAGVPESVAREVITVPFNDINAYKEAIEFWGDEIAAVLVEPIVGNFGMVMPQPGFLEEVNEISHNNGTLVIYDEVITAFRFHYGAAQDLLGVIPDLTAFGKIVGGGLPIGGYGGRQDIMEQVAPLGPAYQAGTMAGNPLSMKAGIALLEVLEQDGVYEKLDSLGQQLEEGLLKLIEKHNITATINRIYGSLTLYFTDEKVTHYDQVEHSDGEAFGKFFKLMLNQGINLAPSKFEAWFLTTEHTEEDIQQTLKAADYAFSQMK

SEQ ID NO: 51585 - protein, 348 aa, Gibberella zeae PH-1
MVQNKTLVYKKIPTGLPVAGEHLVTEDRPIDIESAPEGGLVLEVQYASFDPYLRGKMRDTTVKSYAPAFEINDPIVNGTLSKVIKTDNADFVEGDLVTAYLPIAEYVRVEKETIPKVSLRKVQNPHNLDLGLFLGPLGMPGLTAWSGLHEIGQPKKGETIFISSAAGAVGQIVGQIAKREGLTVIGSVGDDAKLDFITKELGFDAGFNYKKESPKDALPRLAPNGIDIYFENVGGDHLEAALNSLNNGGRIPVCGLISEYNTPAEKREGVKGLINLIAKQIRMEGFLVGHPRFGPKYYKDHQESLQKWLGDGSVKAKLFVTEGIDNAADGFIGMLEGKNFGKAVLKLR

SEQ ID NO: 51586 - protein, 271 aa, uncultured archaeon GZfos33H6
MKVEDVMSSPVITEDEDTSVTIITRDMELSEIGSVVITREDKPVGIVTDRDISIKICAKMGTPGEVTVKGIMSSPLITIGPEAPVETACELLAETDIRRLPVMENDKLVGIISVRNILAGAPEHVQRFYPAEGEFISEQLEVGDVMTLEVITVDEDTFVSKISKDMEESGIGGVVITRGGKPVGMVTDRDIASKVILEDKKASEIKAKDIMCSPLITIGPDASVEKACGIMAAKDIRRMPVMDEDKLVGIISVRNILTRSPGHVHKFYPGE

SEQ ID NO: 51587 - protein, 742 aa, Synechococcus sp. RS9916
MTTPTPSVRSQCPYCGVGCGLELLPPAQPGQAVKKDEEGNPMWTARGDRSHPSSQGQVCIKGATVGETLARGRLHQPLYRASLDQDFEPVSWEQALQTITDQIQTTLANKGADAIAMYGSGQFHTEDYYLAQKLLKGALGTNNFDANSRLCMSSAVAGYTRSLGSDGPPACYDDLDHCSVAVLIGTNTAECHPVLFQRLIKRKKRNPGSVTIVVIDPRRTDTAKAADIHLPIAPGTDLALLHGIAHLVMRENGQDVAFIDDHTENYKPFFDVVARWTPRKVARFCGIPEKRLREVAELFHRKQRVLSLWSMGVNQRREGTAVVQGLINLHLLTGQIGKEGAGPFSLTGQPNAMGGREAGGLAHLLPGYRIVTNDQHRSEVEQAWGFPQGQIAATPGLGAWQQVEAMERGDLDLWWVAATNPLVSMPELDRVKAAMQNCALVVVSEAYADSETSHYAHLLLPASQWSEKAGAMTNSERRVTYCPAYRPRHGQSRPDWEVFAEVGRRLGFEQHFSYDSAAEVYAEFSQLTEGRVCDMSGLSHELLSESGPQQWPFPRGSEPSQGAKRLYSDHQFPTPSGKARFSTDLPQGLAEPPCDTYPLVLTVGRYLGQWHTMTRTGKVKRLQTMHPEPLLEIHPEDASDLQIKDGALTAVSSRRGHLTARAKITNRIRKGSVFLPMHWGFTQDQACEVNALMHDQACPVSKQPELKACAVIAAPAVSAIKPPEQVSNQLVKLRRWFSPAAQ

SEQ ID NO: 51588 - protein, 654 aa, Coccidioides immitis RS
MAPKDMKNQKSAHPYLLPDTVGPFKPAVQGHLKKIYDSIHPQSSNSSTEESSDHFLRVVQQDDSSDLQSPAKAPVLTTLDSFMEYMSTATAMPPGAREDDLSLPMTNYFINSSHNTYLTGNQLYSEASTDVYKDVLLKGCRCLEIDVWDGDLSSSSSSDSEDVEHKKKQKQKDKNLTRMDSKKRFNLNSLSDRLDRLKKDKTGDAMRAATTSATAVAAAVPLRPEPRVLHGYTLTKEVTFRDVCYAIRDTAFVTSDLPVIVSLEVHASHEQQETMVEIMMEAWKGMLVDFTPELAAELEKSDYKHLPSPDSLRNKILIKVKWAPDHGPETDVAFSEISRPPIAATEVSILPEGDAKSAASQAVKKKPVKILHALSRLGIYTRGYTFNGFSQPEATKPTHIFSLSEATLKDAHENQRKALFDHNKNFMMRVYPSGMRVNSSNLDPSFSWRQGAQIAALNWQNCDKGMMLNKGMFARSKGWVLKPEEYRGAERTDKQESPESGRGLKSRHTVHLSIQVYAGQNIPLPKGDEHDRSFRPYVSCQLHAERPKDSIHSKSDGDESGSAKYKRRTTTCSSADPDFGGQTLQFPSAPGVIEQLTFLRVKVKDDEFGRDDLAAWACLRLDDLRQGFRFIRLFDTNGSPTSGVLLVKISKQIT

SEQ ID NO: 51589 - protein, 150 aa, Haloarcula aidinensis
ERTFVMVKPDGVQRGLIGDIVSRFEDRGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEDELVDWDQIDAPWLYE

SEQ ID NO: 51590 - protein, 115 aa, Fulvimarina pelagi HTCC2506
MSSMNEWIDNEVKSNDIVVFMKGTPSFPQCGFSGQVVQIMDYMGVEYKGVNVLTSDDLRQGIKAYSDWPTIPQLYVKGEFVGGCDIVREMFQAGELKQFFEDNGIATTAPQPAAG

SEQ ID NO: 51591 - protein, 130 aa, Brassica napus
  misc_feature (76)..(76): Xaa can be any naturally occurring amino acid
  misc_feature (78)..(78): Xaa can be any naturally occurring amino acid
MVKDKEQHPIKEKKLLVSLIWNFSTELKLISMALLVIFTLATLLPFIPSSFSLSASDFRFCISRFSSAAPVNTTTXLXVLPEKKTATELERVLDNGVIKRTFTGYGSASYNFVSMSAYRGGVNTFAVIGL

SEQ ID NO: 51592 - protein, 352 aa, uncultured bacterium
IGAAHNLLSALIDNHIHWGNAKALDARRIVWRRVVDMNDRALRDVVLSLGGVANGFPRQSGFDITVASEVMAIFCLATDLEDLQARLGKVVVGYTRDREPIYARDLDADGAMSVLLKDALNPNLVQTLENNPAIIHGGPFANIAHGCNSVIATKTALKLADYVITEAGFGADLGAEKFFDIKCRKAGLKPDAAVIVATIRALKMHGGVARDALGAENVDAVKAGLENLGRHIRNVGQFGVPALVAVNRFTSDSDAEVAAVRDFCAGLGVDAHECTHWADGGAGTEALAEAVAAVADAGRSQFRPLYDDEMTLWEKARTVARSIYGADDIIADKRVRDQFAQFQEQGFGRYPV

SEQ ID NO: 51593 - protein, 404 aa, Oryza sativa (japonica cultivar-group)
MALVQSARRAAGPAASRLFSTASVAAAGGFPVVALPKGLPRPAISSLWMVGADDTTRRFAGTAAVGGVDVNRADGDATAGEERGIGEGGGELLGRGADEARQGRRHGVEVVLLPVNKAPLITVVKARWLTHSTVEQPWDTYEADVAIDLTKHHNPATLGDKVARWTVKSLRWPVDLFFQPWDTYEADVAIDLTKHHNPATLGDKVARWTVKSLRWPVDLFFQRRYGCRAMMLETVAAVPGMVAGAVLHLRSLRRFEHSGGWIRALLEEAENERMHLMTFMEVSQPRWYERALVVAVQGAFFNAYLASYLLSPRFAHRIVGYLEEEAVHSYTEFLRDLDAGKIDDVPAPAIAIDYWRLPADATLRDVVMVVRADEAHHRDVNHYASDIHYQGHALREVAAPLGYH

SEQ ID NO: 51594 - protein, 431 aa, Burkholderia mallei ATCC 23344
MSRSAGDFATAGDASSRTVRAARDALEGRRKGVAAALPFVGPAVIASIGYMDPGNFATNIQAGAAYGYELLWVVLAANVIAMVFQAMSAKLGIVTGRNLAELCREHFPRPVVWGMWATSEIAAMATDLAEFLGGALAFGLLLHLPLIAGMAATAVLTCAILTLEKRGFRPLEAAIAALVGVIGASYLGELLIAPQDWHAAAYHLVVPQLRDGTALTLAVGIIGATIMPHTLYLHSGLTQRRTTPRDARERRLLLRFSNREVAVALGVAGFVNIAMVMMASSAFHRTAPGMADIGDAYHTLIPLLGPAAGALFLVALFASGVSSSVVGTLAGQVVMQGFLRRRVPIWVRRLVTIAPAFAIVALGCDVTRAMVLSQVVLSLVLPLPMAALLLLSSRRALLGEHALRAPTLVAASAAAAAIVALNVYLIWAAFN

SEQ ID NO: 51595 - protein, 352 aa, uncultured bacterium
SSAAHNLLSALIDNHIHWGNDKALDARRIVWRRVVDMNDRALRDVVLSLGGVANGFPRQSGFDITVASEVMAIFCLATDLEDLQARLGKVVVGYTRDREPVYARDLDADGAMSVLLKDALNPNLVQTLENNPAIIHGGPFANIAHGCNSVIATKTALKLADYVITEAGFGADLGAEKFFDIKCRKAGLKPDAAVIVATIRALKMHGGVARDALGAEDVDAVKAGLENLGRHIRNVGQFGVPALVAVNRFTSDSDAEVAAVRDFCAGLGVDAHECTHWADGGAGTEGLAEAVAAVADAGRSQFRPLYDDDMTLWEKTRTVARSIYGADDIIADKRVRDQFVQFQEQGFGSYPV

SEQ ID NO: 51596 - protein, 515 aa, Shigella flexneri 2a str. 2457T
MTDHTMKKNPVSIPHTVWYADDIRRGEREAADVLGLTLYELMLRAGEAAFQVCRSAYPDARHWLVLCGHGNNGGDGYVVARLAKAVGIEVTLLAQESDKPLPEEAALAREAWLNAGGEIHASNIVWPESVDLIVDALLGTGLQQAPRESISQLIDHANSHPAPIVAVDIPSGLLAETGATPGAVINADHTITFIALKLGLLTGKARDVTGQLHFDSLGLDSWLAGQETKIQRFSAEQLSHWLKPRRPTSHKGDHGRLVIIGGDHGTAGAIRMTGEAALRAGAGLVRVLTRSENIAPLLTARPELMVHELTMDSLTESLEWADVVVIGPGLGQQEWGKKALQKVENFRKPMLWDADALNLLAINPDKRHNRVITPHPSEAARLLGCSVAEIESDRLHCAKRLVQRYGGVAVLKGAGTVVAAHPDALGIIDAGNAGMAIGGKGDVLSGIIGALLGQKLSPYDAACAGCVAHGAAADVLAARFGTRGMLATDLFSTLQRIVNPEVTDKNHDESSNSAP

SEQ ID NO: 51597 - protein, 351 aa, uncultured bacterium
IGVAHNLLSAMIDNHIYWGNDLNIDVRRISYRRVVDMNDRALRDVATSLGGPGNGYPRQSGFDITVASEIMAIFCLATDLKDLQRRIGNIVIGTTRDLEPITCKQIGADGAMTALLKDALMPNLVQTLEGTPAFIHGGPFANIAHGCNSVMATTAGLKLADYVVTEAGFGADLGAEKFLDIKCRKTGLKPDVVTIVATVRALKMHGGVAKTELAGENVEAVKKGFVNLERHLQNIAKYNLPAVVAINKFTLDTPAEIEAIRNGCEAMGVKVIECSHWADGGEGTKELAEEVVRITEAGENNFQYLYEDDLSLYEKVEKIAKEIYRADSIACDAKVMKQFEQYQELYGKFPV

SEQ ID NO: 51598 - protein, 353 aa, Zea mays
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEEATFVDPKLRGRYCVCFDPLDGSSNIDCGVSIGTRLCFNSACFMFLYIIKDKDNVTLEDVLQPGKNMLAAGYCMYGSSCTLVLSTGTGVNGFTLDPSLGEFILTHPDIKIPKKGKIYSVNEGNAKNWDAPVAKFVEKCKYPKDGSPPRSLRYIGSMVADVHRTLLYGGVFLYPADEKNPNGKLRILYEVFPMSFLMEQAGGQSFTGKERALDLVPTKIHDRSPIFLGSYDDVEEIKALYAEQAKSSSASS

SEQ ID NO: 51599 - protein, 352 aa, uncultured bacterium
IGAAHNLLSALIDNHIHWGNDKALDARRIVWRRVVDMNDRALRDVVLSLGGVANGFPRQSGFDITVASEVMAIFCLATDLEDLQARLGKIVVGYTRDREPVYARDLDADGAMSVLLKDALNPNLVQTLENNPAIIHGGPFANIAHGCNSVIATKTALKLADYVITEAGFGADLGAEKFFDIKCRKAGLKPDAAVIVATIRALKMHGGVARDALGAEDVDAVKAGLENLGRHIRNVGQFGVPALVAVNRFTSDSDAEVAAVRDFCAGLGVDAHECTHWADGGAGTEGLAEAVAAVADAGRSQFRPLYDDDMTLWEKTRTVARSIYGADDIIADKRVRDQFVQFQEQGFGSYPV

SEQ ID NO: 51600 - protein, 351 aa, uncultured bacterium
IGIAHNLLSAMIDNHIYWGLDPQIDSRRVAWKRVVDMNDRALRNIVNSLGGVANGFPREDGFDIVVASEIMAIFCLSKDLNDLTNRLGKIVIAQDRARNSITAKDVKGPGPMSVLLKEAVAPNLVQTLENNPAFVHGGPFANIAHGCNSVIATKTALKLCDYVVTEAGFGADLGAEKFFDIKCRKAGLTPAAAVIVATVRALKMHGGIAKADLGKENVEAVKQGCANLARHLENVKKFGVPPVVAINQFITDTDAELEAVRSTAEGLGAKAIICSHWADGGAGAEELANHVVDLVDSGQAEFKPLYPDEMPLVDKVRTIVQEIYGGDDISYDSAVEKRFEELQKDYGHFPV

SEQ ID NO: 51601 - protein, 454 aa, Vibrio sp. Ex25
MEDFIASCQKPLRKSIRVNTLKISVEAFLERADAKGWKLSPVPWCDTGFWIEADESVVPLGNTAEHMSGLFYIQEASSMMPVSALFMNDESYDAVLDTAAAPGSKTTQIAALMNNEGVLVANEYAASRVKVLHANVERCGVRNAALSNFDGRVFGGWLPEQFDAVLLDAPCSGEGTVRKDEDAMKNWTQASVLDIADTQKDLIESAFHALKPGGVMVYSTCTLSTEENQQVCHHLKETFGDAVEFESLETLFENANAALTEEGFLHIFPQVYDCEGFFVARIRKLAAVEPPKVKKRMGKFPFTKASKKESVEIAQQLQSALGIELPNDSSIWLRDKDVWLFPNSLEPMIGELRFSRMGIKIAEAHKNGYRWQHQVATALATGSEANAIELTIEEAREWYMGRDVRPQTIPDGMKTGKGEVLVTYQGAVIGLGKWVSNRIKNGLPRELVRDKNLF

SEQ ID NO: 51602 - protein, 473 aa, Sulfolobus tokodaii str. 7
MPSLPKTAEEALKFLKDNKIKWVDLQFTDLPGRLHHITVPASEFTEDSFKTGFGKLDGSSIKGFTMIYESDMVLMPIPQTMAVIPWNEGIARVITQVFWGGGKGRFERDPRHIAEEAEKKQSEEGYISYFGPELEFFIFDKVDLDVATPQSGTGYKIHAREAPWARNGGFLIRYKEGYYPAPPVDQLMDIRVEAINILTDYFGFNIEATHHEVATAGQGEIDFRFSTLADTADKVQTLKYVVKNVAAKHGMIATFMPKPMFGDNGTGMHTHFSLWTKDGKNLMYDPNDEYAELSQIGRYIVGGILEHGRALSAIVSPTTNSYRRLIPGYEAPVYLVWSKSNRSAAIRIPSYYRGMEKAKRLEYRPPDPSCNPYLAFAAILMAALDGIKKKIEPGDPVDENVYHMSEERKKQLKIKELPRSLDEALDELESDNEFLKPVFNSSILNTYIDLKRDEAKTMQQYPHPMELYYYLDA

SEQ ID NO: 51603 - protein, 200 aa, Solanum tuberosum
MVKLISNSTILLSLFLFSIAAIANAQQCGRQKGGALCSGNLCCSQFGWCGSTPEFCSPSQGCQSRCTGTGGSTPTPSGSAQNVRATYHIYNPQNVGWDLNAVSAYCSTWDANKPLSWRKKYGWTAFCGPVGPRGRDSCGKCLRVTNTRTGAQTTVRIVDQCSNGGLDLDVNVFRQIDTDGNGNHQGHLIVNYQFVDCGDN

SEQ ID NO: 51604 - protein, 127 aa, Shewanella sp. ANA-3
MAEKIIIATENAPAAIGTYSQAVKVGSTVYLSGQIPLVPSTMQIVSDDFEAQVVQVFENLTAVCTAAGGTINDIVKLNIFLTDLSHFAKVNEIMSRYFSQPYPARAAIGVKQLPKDAQVEMDGVMEL

SEQ ID NO: 51605 - protein, 211 aa, Solanum tuberosum
MVKLSCGPILLALVLCISLTSVANAQQCGRQRGGALCGNNLCCSQFGWCGSTPEYCSPSQGCQSQCTGSGPDPGQGGSAQNVRATYHIYNPQNVGWDLNAVSAYCSTWDANKPYAWRSKYGWTAFCGPVGPRGRDSCGKCLRVTNTRTGAQTTVRIVDQCSNGGLDLDINVFQQIDTDGVGNQQGHLIVNYQFVNCGDNVNVPLLSVVDKE

SEQ ID NO: 51606 - protein, 349 aa, Arabidopsis thaliana
MEKPKFKTVQEVVAAGEGIPERYLQPPAVDDNGQHLNAAVPVMDIPAIDLSLLLSPSDDGREELSKLHSALSTWGVVQVINHGITKALLDKIYKLTKEFCALPSEEKQKYAREIGSIQGYGNDMILWDDQVLDWIDRLYITTYPEDQRQLKFWPDVPVGFRETLHEYTMKQHLVFNQVFKAMAISLELEENCFLDMCGENATMDTRFNMYPPCPRPDKVIGVRPHADKSAFTLLLPDKNVEGLQFLKDGKWYKAPVVASDTILINVGDQMEIMSNGIYKSPVHRVVTNTEKERISVATFCIPGADKEIQPVDGLVSEARPRLYKPVKNYVDLLNKYYIQGQRPIAASLI

SEQ ID NO: 51607 - protein, 513 aa, Synechococcus sp. RS9916
MTSSAPSRPYLEGKKLNKIEQNKANKDGLLVGSEIDKFAEMGWEQVDETDLQLRLKWYGMFWRPKTPGKFMLRLRVPNGILNAQQLRVVGSIVERYGENGSCDITTRQNLQLRGVLLNDLPEILKRLKEAGLSTIQSGFDNPRNVTGNPLAGIDPQEIVDTRPYTQELNNFLTNNEEGNSEYSNLPRKWNTAVAGAKDNFLLHNDIIFHPVENNGELGFGVWIGGVLSSQMNAYALPLNAWVKPEEICKITDAVIRPWRDNGERDKRPKGRFRMYLDQVGLEAFRSMVEENFGPLTPDPGSVFDETPRSHYGIHAQKQEGLHYAGLHVPVGRLTAEDLQDLATASLNYGNGEVRLTEDQNVILVGLPNDKLEAFQGDALVQRFPLEPGAISAGTVSCTGSSYCHFALVNTKDQAADIATKLDAELELPEELKIHWTGCPNSCGQAYMGAIGLTGTKAKNKEGVMGEGYTLTVGGSQGADPQVGELHQKAVPAEDIHGVLKQLLIEKYGAKPRS

SEQ ID NO: 51608 - protein, 183 aa, Shewanella sp. MR-4
MAMNTETLSLIKQSIKTIPNYPKEGILFRDVTSLLENAAAYKATIDLLVEQYRNKGFTKIVGTEARGFLFGAPLALELGIGFVPVRKPGKLPRATISQSYELEYGHDSLEIHTDAITANDKVLVVDDLLATGGTIEATVKLIRQLGGEVQDAAFVISLPDLGGEARLTALGLELVKLCEFEGE

SEQ ID NO: 51609 - protein, 436 aa, Streptococcus suis 89/1591
MINKHETARSLALSVLEQVFDQGAYSNIALNKALESSRLSAQDKGLATELVYGTVSRKITLEWYLAHFIEDREKLDTWIYYLLMLSLYQLVYLDKLPTHAVVNEAVNIAKRKPGTDKFVNAILRKISQSTLPNPADIKRKNKRLSVQYSVPVWLVQTLIAEYGDERAEKIFQSLHDRNKASVRVTDGQQVERLAEELGAQHSQLSPVGLVKSHGHFAGTDHFKKGLITIQDETSQLVAPTLDIQGDEIILDACAAPGGKTCHMASYLTDGKVYALDLYDHKLNLIEENAHRLGLEDKIETKGLDASRVHEEFGPDTFDKILVDAPCSGIGLIRRKPDIRYNKASMDFDSLKTIQLQILDSVCQSLKIGGIITYSTCTIIAKENQEVIQEFLQNHPNFEQVTLEHPQTDIMVDGCLLITPEQYKTDGFFIGQLRRKS

SEQ ID NO: 51610 - protein, 434 aa, Oryza sativa (japonica cultivar-group)
MDPQGGGGSRLSAAGRGGNKRGGKQLGLKRSSAPAPSPATAQPPLPASSPPEAPSPATVQPPTPSSSPAVAAPSSSPAVPMSTMPPWPPQGAGWGSVPPNFAFLQGNQQGPSSWLYPTEGFVNFLQQNCLPQPQEGENFHLVGQTTNTMSTPPPTPQAAANNTVQIDIHEDAINDASAKKRSLRYWTHDEEERLASAWLNASKDPIHGNEKKGDTFWKEVTDEFNRKGNGKRTREINQLKVHWSRLKSSIGEFNDYWTKVTQMNTSGYDDDMLEKEAQQMYANTFGKPFALVHWWKILRKEPKWCAMIEKDKNKAEVVDIPDEQKRPIGREAAQAERNGKRKKDSMSEGIVILGDNIEKIIKVTQDRKLEREKVTEAQIHISNVNLKAAEQQKEAKMFEVYNSLLTQDTSNMSEEQKARRDKALQKLEEKLFAD

SEQ ID NO: 51611 - protein, 126 aa, Staphylococcus epidermidis ATCC 12228
MKIINSDKVPEALGPYSHATVINGFVFTSGQIPLTLDGTIVSDDVQEQTKQVLENLTVVLKEAGSDLNSVVKATIYISDMNDFQQINQIYGNYFVEHQPARSCVEVSRLPKDVKVEIELIGKVKEL

SEQ ID NO: 51612 - protein, 352 aa, uncultured bacterium
IGVAHNLLSALIDNHIYWGNALELDSRRIAWRRVLHMNDRALRSIVNSLGGVANGFPREDGFDITVASEVMAIFCLARDLKDLEARLADVVIGYKRDRTPVRAGELNAQGPMTVLLKDALAPNLVQTLENNPAFIHGGPFANIAHGCNSVMATTTALKLADYVVTEAGFGADLGAEKFFDIKCRKAGLRPRAAVVVATVRALKMHGGVSRDKLGEENVAAVKNGCSNLARHLQNMRRFGVPAVVAINRFTADTEAELEVVRQTAEQLGAKAILCNHWAEGSAGTEALAQHVVEMIERGDDAFVPLYPDDMPLVDKVTTIATQLYGADGIVCDKRVESQFEELEAAGFGNLPV

SEQ ID NO: 51613 - protein, 351 aa, uncultured bacterium
IGIAHNLLSAMIDNHIYWGLDPQIDSRRVAWKRVVDMNDRALRNIVNSLGGVANGFPREDGFDIVVASEIMAIFCLSKDLNDLTSRLGKIVIAQDRARNSITAKDVKGPGPMSVLLKEAVAPNLVQTLENNPAFVHGGPFANIAHGCNSVIATKTALKLCDYVVTEAGFGADLGAEKFFDIKCRKAGLTPAAAVIVATVRALKMHGGIAKADLGKENVEAVKQGCANLARHLENVKKFGVPPVVAINQFITDTDAELEAVRSTAEGLGAKAIICSHWADGGAGAEELANHVVDLVDSGQAEFKPLYPDEMPLVDKVRTIVQEIYGGDDISYDSAVEKRFEELQKDYGHFPV

SEQ ID NO: 51614 - protein, 448 aa, Lactococcus lactis
MSQATEYIKEVRANLAQRDGNQAEFLEAVDNFLATITPVFEAHPEYIEANILGQITEPERAFQFRVPWVDDAGKVQINRGFRVQFNSAIGPYKGGLRFHPSVNLSVVKFLGFEQIFKNSLTGLPIGGGKGGSDFNPKGKSDGEVMRFAQSFMTELQKHIGPDIDVPAGDIGVGGREIGYLFGQYKRLNGFSGGILTGKGLSYGGSLVRPEATGFGLLYYVDAMLKAHRDDLSGKKIKLSGAGNVAIYAIQKATELGAKIVTVSDSDGYIYDERGIDYKVVQQIKEVERGRISEYAKRVSTAEYSKGSVWEAPIDCDVALPCATQNEIDVDGAKLLISSGVQVVAEGANMPSTPEAIKAYRQAGLLYGPAKAANAGGVAVSALEMSQNSQRLAWSFADVDQRLQKIMQDIFQKSADAAKQYNLGDDYVAGANIAGFLKVADAMYAQGIV

SEQ ID NO: 51615 - protein, 352 aa, uncultured bacterium
IGAAHNLLSALIDNHIHWGNDKALDARRIVWRRVVDMNDRALRDIVLSLGGVANGFPRQSGFDITVASEVMAIFCLATDLEDLQARLGKVVVGYTRDREPVYARDLDADGAMSVLLKDALNPNLVQTLENNPAIIHGGPFANIAHGCNSVIATKTALKLADYVITEAGFGADLGAEKFFDIKCRKAGLKPDAAVIVATIRALKMHGGVARDALGAEDVDAVKAGLENLGRHIRNVGQFGVPALVAVNRFTSDSDAEVAAVRDFCAGLGVDAHECTHWADGGAGTEGLAEAVAAVADAGRSQFRPLYDDDMTLWEKTRTVARSIYGADDIIADKRVRDQFVQFQEQGFGSYPV

SEQ ID NO: 51616 - protein, 352 aa, uncultured bacterium
IGAAHNLLSALIDNHIHWGNDKALDARRIVWRRVVDMNDRALRDVVLSLGGVANGFPRQSGFDITVASEVMAIFCLATDLEDLQARLGKVVVGYTRDREPVYARDLDADGAMSVLLKDALNPNLVQTLENNPAIIHGGPFANIAHGCNSVIATKTALKLADYVITEAGFGADLGAEKFFDIKCRKAGLKPDAAVIVATIRALKMHGGVARDALGAEDVDAVKAGLENLGRHIRNVGQFGVPALVAVNRFTSDSDAEVAAVRDFCAGLGVDAHECTHWADGGAGTEGLAEAVAAVADAGRSQFRPLYDDDMTLWEKTRTVARSIYGADDIIADKRVRDQFAQFQDQGFGRYPV

SEQ ID NO: 51617 - protein, 402 aa, Zea mays
MATKRSVGTLGEADLKGKKVFVRADLNVPLDDAQKITDDTRIRASVPTIKFLLEKGAKVILASHLGRPKGVTPKYSLKPLVPRLSELLGVEVVMANDCIGEEVEKLAAALPEGGVLLLENVRFYKEEEKNEPEFAKKLASVADLYVNDAFGTAHRAHASTEGVTKYLKPAVAGFLMQKELDYLVGAVANPKKPFAAIVGGSKVSSKIGVIESLLAKVDILILGGGMIYTFYKAQGYSVGKSLVEEDKLELATSLIEKAKAKGVSLLLPTDIVVADKFAADAESKIVPATAIPDDWMGLDVGPDATKTFNEALDTTKTVIWNGPMGVFEFEKFAAGTEAIAKKLAELTTTKGVTTIIGGGDSVAAVEKAGLADKMSHISTGGGASLELLEGKTLPGVLALDDA

SEQ ID NO: 51618 - protein, 338 aa, Aspergillus oryzae
MATPKVGINGFGRIGRIVCSYSIASGDVDVVAVNDPFIETHYAAYMLKYDSTHGRFQGTIETYDEGLIVNGKKIRFFAERDPAAIPWGSAGAAYIVESTGVFTTTEKASAHLKGGAKKVIISAPSADAPMFVMGVNNKEYKTDINVLSNASCTTNCLAPLAKVINDNFGLVEGLMTTVHSYTATQKTVDAPSAKDWRGGRTAAQNIIPSSTGAAKAVGKVIPSLNGKLTGMSMRVPTANVSVVDLTCRTEKAVTYEDIKKTIKAASEEGELKGILGYTEDDIVSTDLIGDAHSSIFDAKAGIALNEHFIKLVSWYDNEWGYSRRVVDLIAYISKVDGQ

SEQ ID NO: 51619 - protein, 163 aa, Streptomyces rishiriensis
MCPAGPTASDGSDEAVMSEPTKPEVDVPEGDAPTELTIRDLIVGDGVEVKPGMVVRVHYVGVTFESGKEFDASWDRGQPFKFAVGSGKVIKGWDRGVRGMNVGGRREIIVPPRLGYGNQSPSPLIPPSSTLVFVVDLLDAYSSATGWSNAQRGHGVIPGRAEP

SEQ ID NO: 51620 - protein, 540 aa, marine gamma proteobacterium HTCC2143
MSRILRLGKIARVVTRFRLDTFVDKSQLPTSLAILFSIAPWRLFPIPDQTRGARLRQVLEELGPIFVKFGQMLSTRRDLLPDDIIDELAKLQDQVPPFPSQQAVDIIEGALGKSVDDLFAQFSSQPMASASVAQVHAATLFSGEEVVVKVVRPGIELTILQDIKLLFTLAELIEKYFPDGRRLRPVDVVNDYQITILDELDLQREGGNTSQLRRNFVDSDLLYVPEVYWDFTNRQVLTMERIHGIPVTDVKALEQQNTNMQALAERGVEIFFTQVFRDSFFHADMHPGNIFVSKQNPEKPQYIAIDCAIIGSLSESDQYYMARNLLAIFQRDYRLVAELHIECGWIPAETHVHEFESVMRSVCEPIFEKPLAEISFGQLLISLFETARRFEMEVQPSLVLLQKTLLNIEGLGRELYPQLNLWDTAQPFLEKWIKDRYAPSGVYKRLRKHIPAFLEQLPHLPETLLESLNQPKQLPANNDQAQRLQRLEQALESQRNRSSYLIIGLIALLAITNPHVNAALAQLPVPGWAAIIILLLWLRR

SEQ ID NO: 51621 - protein, 513 aa, Francisella tularensis subsp. holarctica
MKTIMIKTTSSSGEDYYKNIFSAICDKDGFMTKTDILDILVESGISNDDPRITKLIAKLNKFCDIDKIDFDTFQEITFENIGLIEKAINKGFIIPNFKDFKKEIEAIYNETKKNETGRNANYIPQLARVDPNLFAVAFCSVDGQIITLGDYLQPYCVQSTAKTITYCIATEENGEDKVHQHVGREPSGITFNAIALNKYDLPHNPMINSGAIMMCSLIKPEWNIADRFEYITNVWQDLAGGEPIGFDNAVYHSEKETADRNYALAHFMKEVGAFPEGTNIHTALDFYFQTCSIQVNAKKMAKIMASIANGGVCPFTSKKIFSPTTIRNCLSMMYSCGMYDFSGEYAFSVGLPAKSGVSGALAIAIPNVGGFAIFSPRLDPNHNSVRGVEFSKRLIEKFSFHNYDHITHCDKINPVENRMVVESNLTFELIWAASAGDLSEIKRAVALGVDINKGDYDKRTALHLAAAEGHEDIVKYLIRKGADINAIDRWGKKPLDDAIMNNNISIIELLDRT

SEQ ID NO: 51622 - protein, 142 aa, Glycine max
  misc_feature (66)..(66): Xaa can be any naturally occurring amino acid
HSAYDKAAQYFNIKLWRVPVNKNFQADVKAIRRHINKNTILIVGSAPGFPHGVIDPIEIIWQFLPXELGHLASSFGICFHVDLCLGGFVLPFARELGYHIPPFDFSVKGVSSISVDVHKYGLAPKGTSVVLYRNHEIRKARQ

SEQ ID NO: 51623 - protein, 139 aa, Brassica napus
MRTPSYTMEINNFSQRNAPIRSNLFRSYSCNWYVTVYPKGNGINTHMSMYLDVANSLALYQGWGRRAKFRFVIVNQSNVARSKRLATSHTFNKTWPNLGFKKALRLTKLQEEMFLVNDKLKVEVYVYVYDIMGILDTHV

SEQ ID NO: 51624 - protein, 500 aa, Zea mays
LARSAEGTAAAAAAINAWNGVAQLLPLLGGALADKWLGRYRTIVIASLLYILGLGMLAFSTFLSSGSGHQCTAAGGQICAPSGLKVTFFYVSLYIVAVAQGGHKPCVQAFGADQFDQTDPKETVSRSSFFNWWYFGMCAGTAVTLVLLSYVQDNIGWGLGFGIPCAVMAAALAVFLLGTRTYRYYVTAGQGLFARAGEAFAEWRSRRKAGQLVQDSQELDPPAADAPRFSAGVDVEEQAAVRNNGGLVKEAKAIIRLFPIWAACLLYAVAYSQSSTFFTKQAATLDRRIGRHVQVPPAALQSFISVTIVVIIPIYDRVLVPVSRRYSGKPSGITMLQRIGTGMFLSLLSMVIAALVEKHRLRVAGDAGLVDKPKVPVPMSLWWMVPQYVLFGAADVFTMVGLQEFFYDQVPDKLRSLGLALYLSIFGVGSFISSALVSVIDRVTTDRGGSWFSNNLNRGHVDYFYWLLAALSAVELLAYVFFAVTYKYKNRGAVHATVDG

SEQ ID NO: 51625 - protein, 486 aa, Triticum aestivum
  misc_feature (141)..(141): Xaa can be any naturally occurring amino acid
GFPRGPSAKRPHSREGGAHPVPNQSHPSAAARTAAPAMADAVKQPLLHHQPYPYAYPSYAASASSPALPSVPHSGTATPTPGGGGGGAASSFAGGRRFPGGLDVPNLKKRGGGTRSWIRVEGRHGPPVQTLEVDKATMMRXRCELPARDLRLLDPLFVYPSTVLGRERAIVVNLEQIRCVITADEVLLLNSLDSYVFQYAAELQRRLLQRAEGDELPFEFRALELALEAACSFLDAQAAELEIEAYPLLDELTSKISTLNLKRVRRLKSRLVALTRRVQKVRDEIEQLMDDDGDMAEMYLTEKKMRMESSSVFGDQSLATFNAAAAGTSVSAPVSPVSSPTESRKLEKTYSLCRSRHDSVKSSDNSVTEHIEELEMLLEAYFVVIDSTLNKLTSLKEYIDDTEDFINIQLDNVRNQLIQFELLLTTATFVVAIFGVVAGVFGMNFETDVFSIQNAFQWVLIITGVVGAFIFCFFVWFFKYKRLMPL

SEQ ID NO: 51626 - protein, 363 aa, Glycine max
MATLKSVCFRGSTFPVCPSNFTNTRNTRSSCWRPTQAAVKSNFHLPMRSFELKNRTSPEDIKALRLITAIKTPYLPDGRFDLEAYDDLVNMQIGQGAEGVIVGGTTGEGQLMSWEEHIMLIAHTVNCFGGKIKVIGNTGSNSTREAIHATEQGFAVGMHAALHINPYYGKTSLDGMVAHFQSVLSMGPTIIYNVPARTGQDIPPHVIQTLAESVNLAGVKECVGNDRIKQYTDDGIVVWSGNDDQCHDARWGYGATGVVSVASNLVPGLMRELMFGGVNPTLNSKLLPLIDWLFHMPNPIGLNTALAQLGVIRPVFRLPFVPLPVDKRIEFANLVKEIGREHFVGNKVVEVLDDDDFFLVSRY

SEQ ID NO: 51627 - protein, 199 aa, Triticum aestivum
  misc_feature (96)..(97): Xaa can be any naturally occurring amino acid
  misc_feature (99)..(99): Xaa can be any naturally occurring amino acid
  misc_feature (124)..(124): Xaa can be any naturally occurring amino acid
  misc_feature (127)..(127): Xaa can be any naturally occurring amino acid
  misc_feature (134)..(134): Xaa can be any naturally occurring amino acid
  misc_feature (141)..(141): Xaa can be any naturally occurring amino acid
  misc_feature (153)..(153): Xaa can be any naturally occurring amino acid
  misc_feature (160)..(160): Xaa can be any naturally occurring amino acid
  misc_feature (166)..(166): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYLIRSKWVPCPSSSAKGXXCXSFFVERPTAIAPGVTLRWAPGIGSXCWXKLPLCVXVAPDGHXQVINEVEGARRXPDAYVRXIIGFDXMRQVQCGDVHRLKPPGCEESGKAYNGSLTTRHI

SEQ ID NO: 51628 - protein, 252 aa, Streptococcus suis 89/1591
MKRNVLITGASSGIGKAIAYVFAANGDNIIITGRRLDKLEEIKQDIEKQYHVQVSVHSFDITNMEQTIVNCQKILEEVGQIHILVNNAGLALGLDKFQDYDLTDMMTMIDTNIKGLLTVTRQLLPQMVENNEGHIINIGSTAGIYAYAGAAVYAATKSAVKVLSDGIRIDTIDKNIKVTTLQPGIVETDFSQVRFHGDKERAATVYQGIDALQANDIASCTLFVANQPAHVQISDITIMATKQATGFTIHRD

SEQ ID NO: 51629 - protein, 656 aa, Staphylococcus epidermidis ATCC 12228
MAKDTFYITTPIYYPSGNLHIGHAYSTVAGDVIARYKRMQGYDVRYLTGTDEHGQKIQEKAQKAGKTELEYLDEMISGIKNLWSKLEISNDDFIRTTEERHKQVVEKVFERLLKQGDIYLGEYEGWYSVPDETYYTESQLVDPVYENGKIVGGKSPDSGHEVELVKEESYFFNINKYTDRLLEFYDENPDFIQPPSRKNEMINNFIKPGLEDLAVSRTSFDWGVRVPSNPKHVVYVWIDALVNYISSLGYLSDDETLFNKYWPADIHLMAKEIVRFHSIIWPILLMALDLPLPKKVFAHGWILMKDGKMSKSKGNVVDPNVLIDRYGLDATRYYLMRELPFGSDGVFTPEAFVERTNYDLANDLGNLVNRTISMINKYFHGELPAYQGPKHELDEKMEAMALETVKSFNDNMESLQFSVALSTVWKFISRTNKYIDETQPWVLAKDENQREMLGNVMAHLVENIRFATILLQPFLTHAPREIFKQLNINNPDLHQLDSLQQYGMLSEAITVTEKPTPIFPRLDTEAEIAYIKESMQPPKSIKQSDEPGKEQIDIKDFDKVEIKAATIIDAENVKKSEKLLKIKVELDNEQRQIVSGIAKFYRPEDIIGKKVAVVTNLKPAKLMGQKSEGMILSAEKDGVLTLISLPSAIPNGAVIK

SEQ ID NO: 51630 - protein, 689 aa, Oryza sativa
MRRRGDQCDDDEIDAAALGVAHRVVGRQQTFLGRPFSLAYLLSIFFPSAGAATARGDGMSVLSFALQGSSTARHGWYNIVCGVAIARYSGLVLVGSHVANVALDQSESYPLTRRSGHKRECHQVAVMASSALICDTEQWKGLQAHYDFVFRHACGGEQAHVGAIQKTHLRDLMDDAERCKAMTAEYEGIFLDYSRQRATGETMEKLFKLAEAAKLKEKIEKMFSGDKINSTENRSVLHVALRAPRDEVIKSDGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPAILPYSQALEKFAPHIQQLSMESNGKGVSIDGVQLSFETGEIDFGEPGTNGQHSFYQLIHQGRVIPCDFIGVVKSQQPVYLKGEIVSNHDELMSNFFAQPDALAYGKTPEQLHSEKVPEHLISHKTFQGNRPSLSLLLPSLSAYEIGQLLSIYEHRIAVQGFLWGINSFDQWGVELGKSLASQVRKSLHASRMEGKPVQGFNSSTASLLTRYLAVEPSTPYNTTTMPKV

SEQ ID NO: 51631 - protein, 459 aa, Mycobacterium sp. MCS
MTLTNETTLPNGLSVDDARAEAARAYELDRKHVFHSWSAQAEISPMVITAAQGSYIWDGEGRRLLDFSCQLVNTNIGHQHPKVVAAIQAQAAKLCTVAPQHANDARSEAARLIAERTPGELNRIFFTNGGADAVEHAVRMARLHTGKYKVLSRYRSYHGGTETAINLTGDPRRWPNDHGNAGVVHFFGPFLYRSQFHATTEAEESARALAHLEDIVRLEGPSTIAAIVLESIPGTAGIMVPPPGYLAGVRDICDRYGIVMIADEVMAGFGRSGKWFSIDHFDVTPDLLTFAKGVNSGYVPLGGVAIGPAIAETFAHRPYPGGLTYSGHPLATAAAVATINAMEEEDIVGNAARIGAEVLGPGLAELAARHPSVGEVRGTGVFWAIELVANPQTREPLAPYGASSAAMNAVVAACKANGLLPFANFNRIHAVPPCTVTADEVREGLAILDQALDVADSHL

SEQ ID NO: 51632 - protein, 309 aa, Yersinia pestis KIM
MRHAARDVGFFYLTGHGIDTSLLRQIQILSRQFFALSDEEKLSIAMIRSPHFRGYNRAASEFTRGQPDWREQFDIGAERTPLPQIAGAPSWTRLQGPNQWPTALPELKPVLLQWQEEMTRMSLRLLRAFALALDLDEQAFDALYGDKPNEHIKLIRYPGREATQSGQGVGAHKDSGFLSFLLQDTQRGLQVEVEEGQWIDAVPREGTFVVNIGELLELASNGYLRATVHRVETPPAGIDRLSIAFFLGARLDAVVPLYPLSAALAAEARGPASDPHNPLFRDVGLNYLKGRLRSHPDVAERYYSDALCS

SEQ ID NO: 51633 - protein, 351 aa, uncultured bacterium
IGVAHNLLSTMIDNHIYWGNELGIDARRITWRRVVDMNDRSLRDIAAGLGGPGNGFPRQTGFDITVASEIMAILCLATDLEDLQRRIGSIVIGTTRDLEPITCQQIGADGAMTALLKDALMPNLVQTLEGTPAFIHGGPFANIAHGCNSVMATNAGLKLADYVVTEAGFGADLGAEKFLDIKCRKTGLSPSVVTVVATVRALKMHGGIPKDKLGTEDVEAVRKGFCNLERHLQNIAKFGLPAVVAINRFTLDTAAEVDAIRKGCEAMGVKVIECTHWADGGEGTRALAEEVVKIIDSDAADFKYLYNDDATLFEKVETVAKEIYRANGISCDAKVIKQFEQFQEKYGKFPV

SEQ ID NO: 51634 - protein, 138 aa, marine gamma proteobacterium HTCC2143
MTETSLHDTGNEEFLDQVLWNSDGLIPVIAQDYLNNDILMVAWMNREALVLSVAEQRAVYWSRSRKRLWRKGEESGNVQSIKEIRIDCDEDVIILKVEQLGGIACHTGTRSCFYRKLDNGVWKTVEKVIKDPKEMYTK

SEQ ID NO: 51635 - protein, 145 aa, Zea mays
  misc_feature (137)..(137): Xaa can be any naturally occurring amino acid
MALLRPHLHRFHSNTLRHSAYPSADAGGGLVVYPTYGRHRCSAIAIDAPSSLTGVTPIRWGYTSVQGFRDEMEDDIVIRSDAVDSFSYAAVFDGHAGSSSVKFLREELYKECVGALQAGSLLNGGDFAAIKEALIKXFESVDRNL

SEQ ID NO: 51636 - protein, 419 aa, Euglena gracilis
MKSKRQALSPLQLMEQTYDVVNFHPGGAEIIENYQGRDATDAFMVMHFQEAFDKLKRMPKINPSFELPPQAAVNEAQEDFRKLREELIATGMFDASPLWYSYKISTTLGLGVLGYFLMVQYQMYFIGAVLLGMHYQQMGWLSHDICHHQTFKNRNWNNLVGLVFGNGLQGFSVTCWKDRHNAHHSATNVQGHDPDIDNLPPLAWSEDDVTRASPISRKLIQFQQYYFLVICILLRFIWCFQCVLTVRSLKDRDNQFYRSQYKKEAIGLALHWTLKALFHLFFMPSILTSLLVFFVSELVGGFGIAIVVFMNHYPLEKIGDPVWDGHGFSVGQIHETMNIRRGIITDWFFGGLNYQIEHHLWPTLPRHNLTAVSYQVEQLCQKHNLPYRNPLPHEGLVILLRYLAVFARMAEKQPAGKAL

SEQ ID NO: 51637 - protein, 352 aa, uncultured bacterium
IGAANNLLAAMIDNHIYWGNALGFDSRRVTWRRVVDMNDRALRTITNSLGGISNGFPREDGFDITVASEVMAIFCLAKDLQDLQTRLGNIVVGYTRDRKPILAKQLDAHGAMTALLKDALMPNIVQTLENNPAFIHGGPFANIAHGCNSVMATTTALKLADYVVTEAGFGADLGAEKFFDIKCRKAGLKPSAVVIVATVRALKSHGGVTKQDFGKENVAAVEKGFANLGRHLENIAQFGVPAVVAINRFITDTDAELAAISKACKAHGAEAILCTHWADGSKGTQKLAKKVVEIVESGTAKFKPLYPDNMKLVDKIRTIAQKLYHADDIAADKKIRSQLEDYETAGYGKYPV

SEQ ID NO: 51638 - protein, 445 aa, Vibrio sp. Ex25
MRSTWSEQSKEDNPMTKSSELYQKAQQTIPGGVNSPVRAFNGVGGSPLFIERADGPLIFDADGKAYIDYVGSWGPMILGHNHAVIREAVIDAAQRGLSFGAPTELEIAMAELVSELVPSMEQIRMVSSGTEATMSAIRLARGFTGRDKIMKFEGCYHGHADSLLVKAGSGALTLGQPSSPGVPADFAKHTLTATFNDLDSVRELFAANKGEIACIIVEPVAGNMNCIPPVEGFHEGLREICDQEGALLIFDEVMTGFRVALGGAQAHYNIKPDLTTLGKVIGGGMPVGAFGGRKEVMQYVAPTGPVYQAGTLSGNPVAMAAGYACLNLLKEEGNEKRLASKTKQLADGFKSLAEKHGIPLVVNQVGGMFGFFFTDQEKVTCYEDVTKCDVERFKRFFHLMLKHGVYLAPSAFEASFTSLAHGSKEIDATLEAADRCFATLAEEAK

SEQ ID NO: 51639 - protein, 87 aa, Glycine max
  misc_feature (52)..(52): Xaa can be any naturally occurring amino acid
MAALMISFPAVTTVNRAGAGMDVPFTGLKYMDGFPSMMSNIDITFIVSNGGXVQCMLDRSPYGKKKFETLFHLPDLDDAQLVKEVLF

SEQ ID NO: 51640 - protein, 352 aa, uncultured bacterium
IGAAHNLLAALIDNHMHWENELNIDPRRVTWRRVVDMNDRALRSITSGLGGYHNGVVREAGFDITVASEIMAIFCLATDLKDLENRLGNIVFGYTRKNEPVTVRQLNAQGAMTALLKDALQPNLVQTMENNPAFMHGGPFANIAHGCNSVMATTTALKLADYVVTEAGFGADLGAEKFFDIKCRKAGLKPDAVVLVATIKALKMHGGVAKDQLGKENVKALEAGLKNLGKHLRNLSTFGVPAVVAINHFTADTAAEIAAVTKYCENFGVSAVECMHWADGGAGAEALARKVAELADSGAAQFRTLYADELPLWDKAKRIATTIYGADDIIADKKVRQQLAQFEKEGYGHYPV

SEQ ID NO: 51641 - protein, 352 aa, uncultured bacterium
IGAAHNLLAALIDNHMHWENQLNVDPRRVTWRRVVDMNDRALRSITSGLGGFHNGVVREAGFDITVASEIMAIFCLATDLKDLENRLGNIVFGYTRKNEPVTVRELNAQGAMTALLNDALQPNLVQTMENNPAFMHGGPFANIAHGCNSVMATTTALKLADYVVTEAGFGADLGAEKFFDIKCRKASLKPDAVVLVATIKALKMHGGVAKDQLGKENVKALEAGLKNLGKHLRNLSTFGVPAVVAINHFTADTAAEIAAVTKYCENFGVSAVECTHWADGGAGAEALARKVAELADSGAAQFRTLYADDLPLWDKAKRIATTIYGADDIIADKKVRQQLAQFEKEGYGHYPV

SEQ ID NO: 51642 - protein, 427 aa, Xylella fastidiosa Temecula1
MSSHYKSSSHMAKETLLYAQSGGVTAVINATAAAVITEARSHRIKVLAARNGILGALREDLIDTSKESITAIRALTHTPGGAFGSCRFKLKSLEADHEKYERLLEVFKAHNVRWFLYNGGNDSADTALKVSQLAKTFDYPLHCIGVPKTIDNDLAITDASPGFGSAAKYTAVSICEAARDVAAMAETSTKVFIYEAMGRHAGWLAAAAGLAGQGQEEAPHIILLPERTYDETAFLAKVQQVVDRVGWCVVVASEGIRSNDGRFVADAGGTTDAFGHTQLGGVAAYLANRVKQALGLKVHWTLPDYLQRSARHIASKTDWEQAQAVGKAAVHYALEGMNAVMPVIVRTSDTPYRWKIEPAALTKIANHEKTLPASFLRRDGFGISERARTYFEPLIRGEAPMPYERNGLPRHVHLKNQSVQKRLPAWE

SEQ ID NO: 51643 - protein, 211 aa, Vibrio sp. Ex25
MSVKAAEVSSLAERINWEKVDGLVPAIVQDFQSSQVLMMGYMNQDALAKTGETGQVTFFSRTKERLWTKGETSGNVLQLVNMQLDCDNDTLLMKVNPIGPTCHLGNTTCWDVDPQEESQMVWLHQLEQLLAARKSADPDSSYTASLYARGTKRISQKVGEEGVEVALAATSGDKAELVCESADLIYHLMVLLQDQGLSMNDVVNKLKERHK

SEQ ID NO: 51644 - protein, 352 aa, uncultured bacterium
ITSAHNLLSAMIDNHIYWGNALEIDLRRVTWRRVIDMNDRALRQIVGPLGGVANGFPRETGFDITVASEIMAILCLASDLEDLQKRLGDIIVGYRRDRSPVYCRDIKADPAMTVLLKDAILPNIVQTLENNPAFLHGGPFANIAHGCNSLIATKTALKLADYVVTEAGFGADLGAEKFLDVKCRIGGLKPDAIVLVATVRALKMNGGVARQDLSEANPAAVRAGAVNLQRHIENVKKFGITPTIAINHFYMDSDEEIAVIEEMGKKYGAEAVVCKHWAEGGAGAEDLAQIVAAKADAGAPDFKPLYPDAMKLADKIRTVAVEIYRAGSVTIPAVIEKQLKQWEDMGYGAYPI

SEQ ID NO: 51645 - protein, 1320 aa, Ralstonia metallidurans CH34
MATTTLGVKLDDASRERLKRVAQSIDRTPHWLIKQAIFTYLEQVERGHLPHEAGAGATADTDGADAGDATQADAAPQPFLEFAQSVQPQSVLRAAITSAYRRPETECVPVLLEQARLPQAQADAAIKMARALAARLREQKVGSGREGLVQGLIQEFSLSSQEGVALMCLAEALLRIPDKATRDALIRDKISGANWQSHLGQSPSLFVNAATWGLLLTGRLVATHTEAGLSKALTRIIGKGGEPLIRKGVDMAMRLMGEQFVTGETISEALANARKYEEEGFRYSYDMLGEAAMTEADAQRYLASYEQAIHAIGQASRGRGIYEGPGISIKLSALHPRYSRAQHERVITELYGRLKSLTMLARQYDIGINIDAEEADRLEISLDLLERLCFEPELAGWNGIGFVVQGYQKRCPFVIDYLIDLARRSRHRLMIRLVKGAYWDSEIKRAQVDGLEGYPVYTRKVYTDVSYVACARKLLSVPDAIYPQFATHNAHTLAAIYQIAGQNYYPGQYEFQCLHGMGEPLYDQVVGPVADGKFNRPCRIYAPVGTHETLLAYLVRRLLENGANTSFVNRIADETIALDDLVADPVAVVETMHKTEGVLGLPHPRIPQPRALYGKSRANSAGIDLSNEHRLASLSSALLAGTSETPRAEPLLGAAVAGTDATSEPVLNPADRRDVVGQVSEATPAETEAALVAAVNVAPIWQATPPEVRAAALERAADLMEAQMQSLMGIIMREAGKTFSNAIAEVREAVDFLRYYAVQVRASFSNDTHRPLGPVVCISPWNFPLAIFTGQVAAALAAGNPVLAKPAEQTPLIAAAAVRLLRDAGVPAAAVQLLPGRGETVGAALVGDARVKGVMFTGSTEVARLLQRNVASRLDAAGRPIPLIAETGGQNAMIVDSSALAEQVVGDVVTSAFDSAGQRCSALRVLCLQEDVADRILEMLKGAMGELTLGNPDRLSTDVGPVIDEEARGNILRHIEAMRAKGRRVHQADPGAADTPACRHGTFVPPTLIELDSIAELKREVFGPVLHVVRFPRTALDKLIDQINGTGYGLTLGVHTRIDETIAHIVDRADVGNLYVNRNVVGAVVGVQPFGGEGLSGTGPKAGGPLYLHRLLSVCPQDAVARAVRASDATGGVAAAPVSPELAALKAWAQASLPEVAEACDRLAAASPSGLGVTLPGPTGERNTYSLLPRERVLCLAQQESDLVLQLAAVLAVGSEALCVDTAQTRALSERLPAAVQSRVRMVSDWTSTDTAFDAVLHHGDSDQLRTVCEQVATRTGPIVGVQGLAHGEPNIALERLLIERSLSVNTAAAGGNASLMTIG

SEQ ID NO: 51646 - protein, 475 aa, Nostoc sp. PCC 7120
MSASSNSSKIKFGTDGWRGIIADDFTFPNVRKVTRAIASYLETAYTKDRPVLIAYDTRFLADQFAQTAAQVLADLGWNVKVTDRDCPTPVIAYNARHLNSAGALMFTASHNPAPYCGIKYIPDYAGPATPEITDTIVANIESASDELPSGKPSGTISTFDPKPDYLQFIYTLLDIERIKSAQLKVKYDALYSTSRGYLDEVLLESGVQLESFHTWRDVLFGGGMPEPKGEQLVELVEAVRRDHADLGLATDGDSDRFGIVDELGNVLTPNTVLLVLARHLIKNKGKTGAIVRTVATTHLLDNFAAKYGLTIYETAVGFKYIGEKMRETAVLIGGEESGGLSIIGHIPEKDGVLADMLIAEAIAYEGKPLSQLVKEAIAEADGPLYNNRLDLHLTEAHKVAVIDSFTKNPPSEVAGIKVKEVGRKDGIKLYLEEGSWVLLRPSGTEPLVRVYLETNSPEKLSKLEQELESAIAKLG

SEQ ID NO: 51647 - protein, 357 aa, Vibrio sp. Ex25
MSKQQKILFIDRDGTLIVEPPVDFQVDRLDKLKLEPFVIPSLLSLQDAGYRLVMVTNQDGLGTDSYPQADFDAPHNMMMEIFESQGVKFDDVLICPHFEEDNCSCRKPKLGMVKEYLQGGKVDFQNSVVIGDRQTDLQLAENMAIRGIQYNPETMGWKQILKDLTVKARIAEVIRTTKETDIKVAVNLDEQGGNDISTGLGFFDHMLDQIATHGGFQMVCKVEGDLHIDDHHTVEDTALALGQALKEALGDKRGIGRFGFSLPMDECLAQCALDLSGRPYLKFDAQFSREQVGDLSTEMVVHFFRSLTDTLACTLHLSSAGNNDHHIIESLFKAFGRTLRQAIKVEGTELPSSKGVL

SEQ ID NO: 51648 - protein, 318 aa, Ralstonia metallidurans CH34
MAIDPQLLSYYRQMADLYANEPIPEDAAARRSRFEDVAARSRQPDTEEISVTDLAIPVDGAALTVRLFRPANVEQPRLIVYFHGGGWVVGSPETHHTVAALLAADTQCVVASVDYRLAPEYAFPTPCDDAVAAVQWLAASRESLGVHPDFLAVAGDSAGAHLAAAAARVVNEQRRAHIVQAQLLIYPVAAPLLTTESYRAFANGPGLTRDEMAWYWTQFIGAEELAKGAEQDDPRIHLMASPPAMLPPASVVLVAANDVLRDDGLAYANFLVRHDAPVITIEASGMTHGFARLQPDAPRAREWMRRAAEAFTGVFDDL

SEQ ID NO: 51649 - protein, 188 aa, Aspergillus oryzae
MPAYHSVFLQDQGIPVIGNFPVLPLRTRTRGPAYTLPPLPPNVPDTEIAVDSESYDCVDEILSLFRANVLFRNFEINGPADRMLIYGTLFISECLGKVRPNMTALEAGKALNNVALDNFAIPGDASFPLNQAFEPPRDRQDAETLRAYLSQVRQEIAIRLHARLYPGGVGPSKWWLSFAKRKFMGKSF

SEQ ID NO: 51650 - protein, 148 aa, Pisum sativum
MGFTDKQEALVNSSSEFKQNLPGYSILFYTIVLEKAPAAKGLFSFLKDTAGVEDSPKLQAHAEQVFGLVRDSAAQLRTKGEVVLGNATLGAIHVQKGVTNPHFVVVKEALLQTIKKASGNNWSEELNTAWEVAYDGLATAIKKAMKTA

SEQ ID NO: 51651 - protein, 144 aa, Vicia faba
MGFTEKQEALVNSSSQLFKQNPSNYSVLFYTIILQKAPTAKAMFSFLKDSAGVVDSPKLGAHAEKVFGMVRDSAVQLRATGEVVLDGKDGSIHIQKGVLDPHFVVVKEALLKTIKEASGDKWSEELSAAWEVAYDGLATAIKAA

SEQ ID NO: 51652 - protein, 154 aa, Lupinus luteus
MGALTESQAALVKSSWEEFNANIPKHTHRFFILVLEIAPAAKDLFSFLKGTSEVPQNNPELQAHAGKVFKLVYEAAIQLQVTGVVVTDATLKNLGSVHVSKGVADAHFPVVKEAILKTIKEVVGAKWSEELNSAWTIAYDELAIVIKKEMNDAA

SEQ ID NO: 51653 - protein, 146 aa, Phaseolus vulgaris
MGAFTEKQEALVNSSWEAFKGNIPQYSVVFYTSILEKAPAAKNLFSFLANGVDPTNPKLTAHAESLFGLVRDSAAQLRANGAVVADAALGSIHSQKGVSNDQFLVVKEALLKTLKQAVGDKWTDQLSTALELAYDELAAAIKKAYA

SEQ ID NO: 51654 - protein, 487 aa, Arabidopsis thaliana
CNHNLRRHNKLRSNINTHTHIYIYIYIVRKKEAMGDHHDFINSGSWWKVSSSSSPSSSSSMRASSIESGGSAVFHDKLHHHSLATDHHLQMIGLGLSSQSPVDQWNQSLLRGDSKAETSFGVMLQENLNLDATSNANANTTSSTSSYQLQESDSSHHHQALWRDPQSDFKPQILTSGGNRGFFLDHQFSPHGSSSTDSSTVTCQGFAVDNSSNAMYAATTTTPNSSSGMFHHQQAGGFGSSDQQPSRNHQQSSLGYSQFGSSTGNYDQMASALPSTWFLRSSPPPKPHSPLRFSNNATFWNPAAAGNAGAPPPHDASSNFFPALQPPQIHPQSFDEQPKNISEIRDSSSNEVKRGGNDHQPAAKRAKSEAASPSPAFKRKEKMGDRIAALQQLVSPFGKTDAASVLSEAIEYIKFLHQQVSALSNPYMKSGASLQHQQSDHSTELEVSEEPDLRSRGLCLVPVSSTFPVTHDTTVDFWTPTFGGTFR

SEQ ID NO: 51655 - protein, 325 aa, Synechococcus sp. RS9916
MQWHEHEVWFPNSSTGRLGGTSRQQAMTRPGTIGASTALVGLLGDPVHHSLSPAMHNAALQAMGLDWVFLALPTPAEQLATVIQGLHAVKCRGLNVTIPHKQSVAGLCRELSPLAERLGAVNVLVPQSDGGWFGTNTDVEGFYRPLKEAEPDWSQRSALVLGCGGSARAVVAGLTELGCSRIQIAGRRQPVLDEVIAACGNWSPQLEPLLWSSDAALQDALDQCDVVVNTTPVGMASPTDPSAALASPLSDSLVNRLKPGSWVYDIIYTPRPTQLLKLAEAQGCRTLDGLEMLVQQGAAALRLWTGQDDVPVAAMRDAALQRLAA

SEQ ID NO: 51656 - protein, 196 aa, Brassica napus
  misc_feature (170)..(170): Xaa can be any naturally occurring amino acid
MDPCPFIRLTISNLALKLPLAAKSSSSAVHPSSSPCFCKIKLKNFPPQTDAIPYIPLETTQFPEIQTLAATFHLSSSDIKRLASRSIFASKPSLKIFIYTGSAGAACGVNSGGLLAEVSVPLDLAGTQSKPCVFHDGWIAVGKGAGTGKASSAAQFHLNVKAEPDPRFVXQFDGEPECSPQVVQSQGSIPQPVITC

SEQ ID NO: 51657 - protein, 516 aa, Streptococcus suis 89/1591
MTKQDVQKIIVLDYGSQYNQLISRRIREFGVFSELKNHKITAEEVRAINPIGIVLSGGPNSVYAENAFDIDPEIFELGIPILGICYGMQLITHKLGGKVVPAGEAGNREYGQSNLQLKTESALFAGTPEEQLVLMSHGDAVTEIPADFHLVGLSADCPYAAIENTERRIYGIQFHPEVRHSVYGNDILKNFAFGICGAKGDWTMENFIETEIEKIRQTVGDKKVLLGLSGGVDSSVVGVLLQRAIGDQLTCIFVDHGLLRKNEGDQVMEMLGGKFGLNIIRVDAAKRFLDLLAGVSDPEKKRKIIGNEFVYVFDDEASKLTDVEFLAQGTLYTDIIESGTDTAETIKSHHNVGGLPEDMQFKLIEPLNTLFKDEVRALGTALGMPDEVVWRQPFPGPGLAIRVMGEITEEKLQTVRESDAILREEIAKAGLDRDVWQYFTVNTGVRSVGVMGDGRTYDYTIAIRAITSVDGMTADFAKLPWDVLQKISVRIVNEVDHVNRIVYDITSKPPATVEWE

SEQ ID NO: 51658 - protein, 222 aa, Prochlorococcus marinus str. MIT 9515
MSIFVGNLPFRAEREDILELFTPYGEVMNCSLPLERDTGRKRGFAFVEMADEALETTAIEGLQGTELMGRPLRINKAEPRGGGGQRRGGGGGRGGGYGGGGNGGGYGGGGNGGGYGGGGNGGGYGGGGNGGGYGGGGNGGGYGGGGNGGGYGGGGNGGGYGGGGYGGGYSEPASNYANKSSGAEGWEDRSYGNSSENSEFENGRSRRKRSVINNSEISQEGN

SEQ ID NO: 51659 - protein, 352 aa, uncultured bacterium
IGAAHNLLSALIDNHIHWGNDKALDARRIVWRRVVDMNDRALRDVVLSLGGVANGFPRQSGFDITVASEVMAIFCLATDLEDLQARLGKVVVGYTRDREPVYARDLDADGAMSVLLKDALNPNLVQTLENNPAIIHGGPFANIAHGCNSVIATKTALKLADYVITEAGFGADLGAEKFFDIKCRKAGLKPDAAVIVATIRALKMHGGVARDALGAEDVDGVKAGLENLGRHIRNVGQFGVPALVAVNRFTSDSDAEVAAVRDFCAGLGVDAHECTHWADGGAGTEGLAVAVAAVADAGRSQFRPLYDDDMTLWEKTRTVARSIYGADDIIADKRVRDQFVQFQEQGFGSYPV

SEQ ID NO: 51660 - protein, 351 aa, Arabidopsis thaliana
MKLTVKTLKGSHFEIRVLPSDTIMAVKKNIEDSQGKDNYPCGQQLLIHNGKVLKDETSLVENKVTEEGFLVVMLSKSKSGGSAGQASVQTSSVSQPVSATTSSTKPAAPSTTQSSPVPASPIPAQEQPAAQTDTYGQAASTLVSGSSLEQMVQQIMEMGGGSWDKETVTRALRAAYNNPERAVDYLYSGIPQTAEVAVPVPEAQIAGSGAAPVAPASGGPNSSPLDLFPQETVAAAGSGDLGTLEFLRNNDQELGKQNPQLLRLIQENQAEFLQLVNEPYEGSDGEGDMFDQPEQEMPHAINVTPAEQEAIQRLEAMGFDRALVIEAFLACDRNEELAANYLLENSGDFED

SEQ ID NO: 51661 - protein, 352 aa, uncultured bacterium
IGAAHNLLSALIDNHIHWGNDKALDARRIVWRRVVDMNDRALRDVVLSLGGVANGFPRQSGFDITVASEVMAIFCLATDLEDLQARLGKVVAGYTRDREPVYARDLDADGAMSVLLKDALNPNLVQTLENNPAIIHGGPFANIAHGCNSVIATKTALKLADYVITEAGFGADLGAEKFFDIKCRKAGLKPDAAVIVATIRALKMHGGVARDALGAEDVDAVKAGLENLGRHIRNVGQFGVPALVAVNRFTSDSDAEVAAVRDFCAGLGVDAHECTHWADGGAGTEGLAEAVAAVADAGRSQFRPLYDDDMTLWEKTRTVARSIYGADDIIADKRVRDQFVQFQEQGFGSYPV

SEQ ID NO: 51662 - protein, 73 aa, Glycine max
  misc_feature (23)..(24): Xaa can be any naturally occurring amino acid
  misc_feature (47)..(47): Xaa can be any naturally occurring amino acid
  misc_feature (58)..(58): Xaa can be any naturally occurring amino acid
WDIQQVNNSAYECHRNHEGLGSXXCYKTILKDESIVETRFMHDKVAXDDSSEAPLVVXTPTKVSSISKSGKTH

SEQ ID NO: 51663 - protein, 227 aa, Triticum aestivum
  misc_feature (174)..(174): Xaa can be any naturally occurring amino acid
MAVDYGSREERWSLAGATALVTGGSKGIGHAMVEELAGFGARVHTCSRNAAELEECRRRWEEKNLQVTVSVCDVSIRGSREKLMETVRETFNGKLDILVNNAGQLLFKPTAECTAEEYSNLMTTNLESSFHLSQLARPLLIHASIAGGGSIINMSSIGGSIGFAGSVIYAITKXDTEYLKKEHSKTPLGRSGKPMEIASAVSFLSMPAASFITGQVICIDGGRTISK

SEQ ID NO: 51664 - protein, 179 aa, Triticum aestivum
MQRNGVMECSVCHSKVVAGTPRSISRAYDKHKSKISSKQRVLTFLLVSGDCVLVGLQPILVFMCKVDGKFQFSPISVNFLTEVTKVFFAMIMLMIESRKQKVGEKSLLSVSTFVQAARNNVLLAIPALLYAINNYLKFIMQVYVHPSAGTPLRLCNVLVFSPVNILVLLIFTKATVIWM

SEQ ID NO: 51665 - protein, 352 aa, uncultured bacterium
IGAAHNLLSALIDNHIHWGNDKALDARRIVWRRVVDMNDRALRDVVLSLGGVANGFPRQSGFDITVASEVMAIFCLATDLEDLQARLGKVVVGYTRDREPVYARDLDADGAMSVLLKDALNPNLVQTLENNPAIIHGGPFANIAHGCNSVIATKTALKLADYVITEAGFGADLGAEKFFDIKCRKAGLKPDAAVIVATIRALKMHGGVARDALGAEDVDAVKAGLENLGRHIRNVGQFGVPALVAVNRFTSDSDAEVAAVRDFCAGLGVDAHECTHWADGGAGTEGLAEAVAAVADAGRSQFRPLYDDDMTLWEKTRTVARSIYGADDIIADKRVRDQFVQFQEQGFGSYPV

SEQ ID NO: 51666 - protein, 87 aa, Arabidopsis thaliana
TLEHALKKLCKKGVSWGPAGGVSIGTENGIERIRGTKDWKNPMLAGAAPGAVLSPVGKKAKAPIVMDAILGGGLAAASQLVNNHYFC

SEQ ID NO: 51667 - protein, 476 aa, Zea mays
MAQPHLVLPSPRPLLPAAATPSRRAVAVRAALSTASPPAKAAAGAEAVRSIRARQIVDSRGNPTVEVDLVAGDGRLHRSAVPSGASTGIYEALELRDGDKAVYGGKGVLQAVRNINEVIAPKLVGVDVRNQSDVDAIMLDIDGTQNKSKLGANAILGVSLSVCRAGAGAKGVPLYKHIQELAGIKEPVMPVPAFNVINGGSHAGNNLAMQEFMLLPVGAATFAEALRMGSEVYHVLKGIIKAKYGQDACNVGDEGGFAPNVQDNREGLVLLMDAIEKAGYTGKIKIGMDVAASEFLTKDGNYDLNFKNQPNDGAHILSAQHLGDLYRDFVKDFPIVSIEDPFDQDDWSSWASLQSSVDIQIVGDDLLVTNPKRIADAIDKKACNALLLKVNQIGTVTESIQAALDSKAAGWGVMVSHRSGETEDNFIADLAVGLASGQIKTGAPCRSERLAKYNQLLRIEEELGNVRYAGEAFRSP

SEQ ID NO: 51668 - protein, 279 aa, Photobacterium sp. SKA34
MKLEAVDYTAENAKQLFVESLRETGFGVLKNHPIQQNLVQKIYDKWYDFFNSEEKTAFHFNVETQDGLFPTEVSETAKGHTQKDIKEYFHYYPWGQCPAELKQDIQQYYQEANELATELLSWVEQYSPNDVSAKYTQSLSSMIEGSEKTLLRILHYPPLQGDEELGAIRAGAHEDINLLTILPAANEPGLQVQAKDGSWIDVPCDFGHLIINIGDMLQEASGGYFPSTTHRVINPEGADKTKSRISLPLFLHPKPDVVLSEKYTAHEYLMERLRELGVI

SEQ ID NO: 51669 - protein, 272 aa, uncultured archaeon GZfos34A6
MKNIYGIIGDPVAHSLSPVMHNAAFKKLGLDAVYIAFCVPLEELGDAIRGAKSLGISGLNVTIPLKEKALSFVATEEVAKKIGAINTIDFSSTPTGYNTDGIGALMVLEETVGEVRGKNVLIIGAGGAARAISFYLDASGAMVTLANRTEGRSAQLASNLRNANSISLGAELKNQIRDSDILINATSVGMHPNEDATLITADLMHPDLVVFDIVYNPIETKLLKEAKRAGVKKTVNGVKMLVYQGAASFNLWTKKDPPVEVMENAVKAALIR

SEQ ID NO: 51670 - protein, 162 aa, Oryza sativa (indica cultivar-group)
MATIPCSVGKQQLRVPRTVTCHVLSSDTLAAVTLEACQDDHAEHVPESKNFNESSPQIEKPNDSIPPLVLAGLHACGDLSVNMLRLFVSCEQVKALISIGCCYNLLSEECHEDTNTCPGFPMSKAAKLSNLVLRKSTRDLGCQTFYFGGGPYLKVLSIQKTQ

SEQ ID NO: 51671 - protein, 494 aa, Photorhabdus luminescens subsp. laumondii TTO1
MKRLHDIEKEMLPVESYKMLIGGQWVDSVSKATTKSYNPATGELLAEYASGNAEDVDLAVSAAKKAFHAWSQTSAIERQSALLKIADLLEAEQKRFAILESLDTGKPLNESLYMDLPASIDQFRYFAGVIRSHTDEASVLDTNTLSLVIREPIGVVGQVIPWNFPLLMAAWKLAPALAAGNTIVINPATLTSITLLELGRILDKVLPAGVVNIVTGRGSVVGQAILDHEDVEKVAFTGSTKVGYTVAEAAAKKLIPATLELGGKSANIIFPDANMKKAVKYAAKAILLNQGQACESGSRLFLHKDIHDEFLKSLKTEFESIQVGDPLEKETQMGSQVSQEQMEKILEYVEIAKKEGATIFTGGKRITEKGYDEGFFIQPTIITDVTNDMRVAREEIFGPVLAVIPFSEEEDVIRMANDSDYGLAGAVWTQDIDRALRVAKAVRTGRMWINTYHELPAHAPFGGYKKSGIGRETHKMMLDAYTQVKNIYIKTSEE

SEQ ID NO: 51672 - protein, 609 aa, Oryza sativa (indica cultivar-group)
MAAATPASGGGGYSCETAEQTREWMEAIAAFLRLHRPLLEAHVVNFFKEHWPSSLRDFVLTAKSLVLPREQKSPRSLLPDLHVASINTVLAQGMNSKKKHEVGCLMQIETLAGLVHAITKSCGAKTVIDVGSGQGYLAQALSFEYQLPVVAIDASSHHASVTNTRAERIKKYYAAKCVGKQQLRVPRTVTCHVLSSDTLAAVTLEACQDDHAEHVPESKNFNESSPQIEKPNDSIPPLVLAGLHACGDLSVNMLRLFVSCEQVKALISIGCCYNLLSEECHEDTNTCPGFPMSKAAKLSNLVLGKSTRDLGCQTFYFGGGPYLKSAERWRSLTKDIALQNFDIHAFRAAFQMVLEKHFPEVSRSNPSIGRQGKALRRQRLRKVMESPMAMAETDALSYSTQKEQIMTKDDPLPTGPNNFKEVHVDFLPELSTGFVDSAVSGAAVVPDDIYLDKSQKFTLFKDFTVSGLGRLGCDFVENVSLLEIWKDVQPFTEFIGPFWCLRVALGPLVETYILLDRICSQMAVRMTVPVLPMMDQHQGGHSEPSRLFPSPNPYPDLYTRRCHAKQQAKSDGTGGNRRAVLGRAKEGEKWGEEQGGMAIGAVCVSLCQM

SEQ ID NO: 51673 - protein, 374 aa, Prochlorococcus marinus str. MIT 9515
MADFYQILGVSRDADANTLKSAYRKLARQYHPDVNKDPGAEDKFKEIGKAYEALADPETRARYDQFGEAGIGGAAGMPDMGDMGGFGDLFETFFNGFGGQSSQGGRSQRRGPQQGDDLRYDLNIDFKDAIFGQQREIKIPHLETCDICRGSGAKKGTGPINCTTCGGSGQVRRATRTPFGNFTQVAECPTCNGVGQVISDPCASCGGNGVKQVRKKLRINIPAGVDSGTKLRVSGEGNVGLKGGPPGDLYVFIKVKSDPNLKRDGINIYSEISVSYLQAILGDTLDIMTVDGKVNLKIPSGTQPNSTLSLENKGVPRLGNPVARGNHQVLVKVKLPTRITDEERNLLENLASKYSEHNSNSNSGLFSKLFGKES

SEQ ID NO: 51674 - protein, 744 aa, Gluconobacter oxydans 621H
MDLHLTVQRSLAPEPGCSLEHAVMTSCDREPIHRPDAIQPYGLLLVVDSTSLKIIGGAGDIEGRLAPDWLGRPLADILKIPESRLHDEKRPSLSDLRVAGLKDETFSILRHAQGTHLLIELEPVEAHNLLTWDIFGEIDSTADRFERCPDTTSVCRQGAAIFRRLTGFDRVLVYRFMEDGTGRVVGESRNDAFPSLMNHHFPASDIPTQARALYLRNRIRVIPDITYEAAPIRPPEAGLAGLDLSDVQLRSVSPIHLQYMANMGTRASASVSLVVDGVLWGLIACHNATPRCLSEDIRAACRTLAGVMSRQLRNKEELVTYQERLRLRNAMEFVTSHFEVRHPIESNLRSFMGELQSLFPCNGFAVISDQTITGTGVLPDAENLHRLHDWLRLGTNGGIFVSTMLGKDYPPAAEWPERSAGLLAITLPFRTPTCLIWSRVEIIQTIEWAGNPHKDTTEGSDVLRPRASFRTWEQTIRGHSTRWTSEQKQAARRLRRVLIADYQTQQLRELNATLAATLEERESLLRQKDFLIREVNHRVQNSLQMVASFLKLQARSASNEETTTALTEAQHRIAAIGLVHRRLYRDEHFGIVDLGRYLEELMEELCSSLGGDWQEQLHLSLFPIMISADRAINIGLVLTELVINASKYAYDGKAGPLHVGLAQTSDRLVLTVSDQGECTPQLKGTGFGTRMMNAVVNSLSGTLTYTTLTPGLEAVMTLPLDSILPSEADASTEAALSQPPYPYP

SEQ ID NO: 51675 - protein, 340 aa, Prochlorococcus marinus str. MIT 9515
MTLRVAINGFGRIGRNFMRCWLSRGSYTNIEVVGINVTSDPKTNAHLLKYDSVLGKLDGVDIQYTDDTFVINNKTIKCFSDRNPMNLPWKDWGVDLVIESTGVFNTDVGASKHLEVGAKKVILTAPGKGSGVGTYVVGVNADQYNHSDYDILSNASCTTNCLAPVVKVLDQTFGINKGLMTTIHSYTGDQRILDNSHRDLRRARAAATNIVPTSTGAAKAVALVYPEMTGKLTGIAMRVPTPNVSAVDFVFESSKSVTSEEVNNALKESSLSSMKGIIKYGDEPLVSSDYAGTNESSIVDADLTMSIGDNLVKVLAWYDNEWGYSQRVVDLAEIVAKKWE

SEQ ID NO: 51676 - protein, 569 aa, Xylella fastidiosa Temecula1
MSQTRPWLQHYPSGISIEIDTNAFRTIADVFNTSVIKYRHCPAYTNFGKTLTYGEVDLLTKQFASYLLNVLKLKKGDRIALMMLNCLQYPVATFGALCAGLTVVNVNPLYTARELKHQLVDAGSTVLVVMDNFCTTVQQIIADTPIKQVITTELGDLLDFPKRSLINFAVKHIKKLVPEYQLPRSIRFREALALGSKHSMPPIHIASDDLAFLQYTGGTTGTPKGAMLTHRNMVANMQQVSQWLQTNNSLKEGCETVLTALPLYHIFVLTANSLVFMKIGGCNHLISNPRNMRTFVKELQRVRFTVITGVNTLFNKLLNTPGFDKLDFSSLKIALGGGMVIQRSVAEQWKQVTRVPLIEAYGLTEASPAACINPLNLQEHNGSIGMPIPSTDVCIKDDTNTVLPIGEMGELCIKGPQVMKGYWQRPEETSEVLDADGWLHTGDIVKMDKQGFLYIIDRKKEIILVSGFNVYPKEIEEVIAMIPGVAEVAAVGVPDEQSGEVVKVVIVKKDPMLTAEEVKAHAATNLTRYKLPRIIEFRATLPKTDVGKILRRELRDAAPASNTFTAQPK

SEQ ID NO: 51677 - protein, 351 aa, uncultured bacterium
IGVAHNLLAAMIDNHIYWGNELGIDVRRVSYRRVVDMNDRALRDVATALGGPGNGYPRQSGFDITVASEIMAIFCLATDLDDLQRRIGNIVIGTDRDLNPITCKQIGADGAMTALLKDALMPNLVQTLEGTPAFIHGGPFANIAHGCNSVMATTAGLKLADYVVTEAGFGADLGAEKFLDIKCRKTGLKPDVVTIVATVRALKMHGGVAKTDLAGENVDAVKKGFVNLERHLQNIAKFGLPAVVAINKFTLDTPAEIEAIRSGCEAMGVKVIECSHWADGGEGTRELAEEIVSIIDKGESNFKYLYEDDMPIQEKVETVAKEIYRADGITFDAKVAKQFELFQERYGNFPV

SEQ ID NO: 51678 - protein, 350 aa, Brassica napus
  misc_feature (120)..(120): Xaa can be any naturally occurring amino acid
  misc_feature (178)..(178): Xaa can be any naturally occurring amino acid
  misc_feature (191)..(191): Xaa can be any naturally occurring amino acid
MQLTLPPLLERPPGQVATAPLSGFFLTSLSPSQPSLQKQTLRSSPTVACLPSSSSSSSSSSSSRSVPTLIRNEPVFAAPAPIITPYWSEEMGSEAYEEAIEALKKLIIEKEELKTVAAAXKVEQATAALQTGTSSDKKAFDPVENIKQGFITFKKEKYETNPALYGELAKGQSPKYMXFACSDSRVCPSHXLNFQPGEAFVVRNIANMVPPFDKVKYCGVGAAIEYAVLHLKVENIVVIGHSACGGIKGLMSFPLDGNNSTDFIEDWVKICLPAKSKVISELGDSAFEDQCGRCEREAVNVSLANLLTYPFVREGLVKGTLALKGGYYDFIKGAFELWGLEFGLSETSSV

SEQ ID NO: 51679 - protein, 352 aa, uncultured bacterium
IGAAHNLLAALIDNHMHWENQLNVDPRRVTWRRVVDMNDRALRSITSGLGGFHNGVVREAGFDITVASEIMAIFCLATDLKDLENRLGNIVFGYTRKNEPVTVRELNAQGAMTALLKDALQPNLVQTMENNPAFMHGGPFANIAHGCNSVMATTTALKLADYVVTEAGFGADLGAEKFFGIKCRKASLKPDAVVLVATIKALKMHGGVAKDQLGKENVKALEAGLKNLGKHLRNLSTFGVPAVVAINRFTADTAAEIAAVTKYCENFGVSAVECTHWADGGAGAEALARKVAELADSGAAQFRTLYADDLPLWDKAKRIATTIYGADDIIADKKVRQQLAQFEKEGYGHYPV

SEQ ID NO: 51680 - protein, 250 aa, Yersinia pestis KIM
MATPPLCSHDQESRMSNQQNDAKRAAARRVIQDFVFDGMTLGLGSGTTSHFFVRELGQHVAKGLQLTCTTTSRATSEVARDVGIELSDPNEMNEIDLTIDGPDEIDRRFNMIKGGGACLLWEKIIAHASKRMICICDETKIVNCLGQFPLPVEIVPFAWKQTERRVERVLAEQGLHHVPIIRRMGGGHPVITDSGNFILDCHCGAIITAPEPLEIELNRIPGVVENGLFTREATGMVVGYFDGSSYVQLR

SEQ ID NO: 51681 - protein, 376 aa, Paracoccus pantotrophus
MKMKAAVLFEQGLPAPYAISQPIQIEEVELDGPGEGEVLIEVVAAGLCHSDLSTIENLRPRKVPTVIGHEAAGIVREVGAGVRRLKVGDHVVATFVASCGCCRYCIDHRANLCTASWTSRAEGTLQSGARRLKFGKGDLHHYTGLSTFAEYAVVSESSLVSIRKDVPLEVAALFGCAVVTGVGAVFNTAALRPGQSAAVVGLGGVGLNALLGAVAAGAYPVIAIDMNPEKLELAKSLGASHAVLASDPNMAEQVKDLTNGGVDFAFEAAGSIPAVHTAYQCLARGGTVISSGLPDPTKTYAYNHAPLVSDEKSIRGSYMGGCDPRRDVPRYLNLYLAGKLPVDRLRSGDLTFEQINQGFDALALGKVVRQTLRPHQ

SEQ ID NO: 51682 - protein, 352 aa, uncultured bacterium
IGAAHNLLAALIDNHKHWENQLNVDPRRVTWRRVVDMNDRALRSITSGLGGFHNGVVREAGFDITVASEIMAIFCLATDLKDLENRLGNIVFGYTRKNEPVTVRELNAQGAMTALLKDALQPNLVQTMENNPAFMHGGPFANIAHGCNSVMATTTALKLADYVVTEAGFGADLGAEKFFDIKCRKASLKPDAVVLVATIKALKMQGGVAKDQLGKENVKALEAGLKNLGKHLRNLSTFGVPAVVAINHFTADTAAEIAAVTKYCENFGVSAVECTHWADGGAGAEALARKVAELADSGAAQFRTLYADDLPLWDKAKRIATTIYGADDIIADKKVRQQLAQFEKEGYGHYPV

SEQ ID NO: 51683 - protein, 518 aa, Paracoccus pantotrophus
MPSPLARWCARPCARINKPLRNMEKKMTTQYKLYIDNQFVAPDGDDYFPAVNPYTGETHAMVPQASDAQVAAAVAAARRAYETVWSKTNGLERAKLMIRLADLLEANAERMGILETTDNGKVIRETGAQMLFAARAYRFFAGTADKIFGQTIPLDQKDVFDFTRREALGVCVLITAWNSPMGLLSNKLAPALAAGNCVIIKPSEHASCTTLEFAKLVDEAGFPPGVINIVTGDYRVGQALTRHGRVDRVSFTGSPEVGRKIAADAGERLIPVTLELGGKSPNIIFEDADLDKAVVGALAGIFAATGQTCIAGSRLLVQRGVYDEVVRRLAERAKTIKLGNPLDKTTEMGTAANEPQFKRILGKIDAAKAEGATIVTGGKAASGDGLEKGFFIEPTIFRDVSNKSELAQEEVFGPVLAVIPFDTEEEAVAIANDTKYGLASGVWTTNLSRAMRMVRAINAGTVWVNTYRAAQVMAPFGGFKDSGFGKERGVMALEEFLQTKNVMIDFSLEERDPFALKM

SEQ ID NO: 51684 - protein, 220 aa, Oryza sativa (japonica cultivar-group)
MAAMLLRLHPCPLLFPPPPPHPHLRRQLAVYSIPKSSFRSAAAAARARNPPRLASVGGAERRRVGDDYDEEEEDLGQALERTRQLVECAMFASVAGLAYFLSNSLAIENYFSCFFPLPIVISSLRWGLEAGRKTAVATVLLLFTLSGPVKASTYLASTSILHFDSCVSGRRFHLSLQSFKNLSNCIFILKLTAIDVTINMETLLPYKVKVEISILSLRQR

SEQ ID NO: 51685 - protein, 350 aa, uncultured bacterium
ITSANNLLAALIDNHIYWGNELGLDPSKVSWRRVMDMNDRALRQIVVGLGNNGQTREDGFDISVASEVMAAFCLATSLKNLEERLGNIIIGQKFDKTFATAKEVLAAPAMTALLRDAFQPNLVQTLEHTPTIIHGGPFANIAHGCNSVIATDTAMKIADYVVTEAGFGADLGAEKFLNIKCRQADLHPDAIVVVATVRALKMHGGVPKTGLDKENVQAVRDGLANLVCHVENVQKFGVPAIVAINHFTSDTEAETAVIKEACEKLGVPCHFCDHWANGGAGAESLAREVVQMADSGRAKFAPLYPDELPLETKLRTVAKEIYRAKDIDLQPMAQKKLALFEAEGYGNLPV

SEQ ID NO: 51686 - protein, 249 aa, Xylella fastidiosa Temecula1
MRPKIVAGNWKLHGSHAFAQALVAQVAAGLPLPGVSVIILPPLLYLSDLAQRFKGEGLAFGAQNVSHHDKGAYTGEVSAAMVADVGAHYTLVGHSERREYHHEDSELVARKFAAALSAGLRPILCVGESLPQREAGQAEVAIAMQLAPVLALVGPQGVARGLIAYEPVWAIGTGRHADPSQVQAMHAFIRGEIARQDARIGDSLLILYGGGIKPCNAAELFSQQDVDGGLIGGASLVADDFLAIARATV

SEQ ID NO: 51687 - protein, 351 aa, uncultured bacterium
IGAANNLLAAMLDNHIKQGNSLKIDSRRITWRRVLDLNERALRAIVCGLGGKANGVPRENGFDITVASEMMAILCLANDLKDLKERLARIIVAYTYDGKPVTAGDLKAQGAMTALLKEALKPNLVQTLEHTPAFVHGGPFANIAHGCNSVIATKMAMHFADYVVTEAGFGADLGAEKFLDIKCRMADLKPDAVIIVATVRALKYNGGVAKQDLNQENLEALEKGLPNLLKHVENITQVFKLPAVVAINKFPLDTEAELTLVKSKCQELGAVALSEVWAKGSLGGQVLAEKVLAACEKPSNFSFIYDEQAPIKDKIAAIATKIYGADGVNYTAAAEKTSKELTALGFDKTPV

SEQ ID NO: 51688 - protein, 359 aa, Acinetobacter sp. ADP1
MSKQILILAGDGIGPEIVGAAEQVLTKVNEKFELGLTWEHGLLGGSAIDAHGEPYPAVTSEQAKKADAILLGAVGGPKWDTIERSIRPERGLLKIRSELNLFANLRPALLYPQLADASSLKPEIVAGLDILIVRELTGGIYFGQPRGIRELENGEKQGYNTDVYSESEIKRIAKVAFELAALRGSKVCSVDKANVLEVTELWKQTVTELQQAQYPNIQLSHMYVDNAAMQLVRAPKQFDVIVTGNLFGDILSDEAAMLTGSIGMLPSASLDENGKGMYEPCHGSAPDIAGQNVANPLATILSVAMMLRYTFREEAAAKAIEDAVGQVLDQGLRTADIMSEGMQRVGTVEMGQAVVAALA

SEQ ID NO: 51689 - protein, 472 aa, Gibberella zeae PH-1
MALNLTTSRRALSSLKPLTRAAFVGARGYATAEPDLKATLREAIPAKRELLKKVKAHSNKVLGEVKVENTLGGMRGLKAMVWEGSVLDANEGIRFHGRTIKDCQKELPKGKTGTEMLPEAMFWLLLTGQVPSVNQVRGFSRELAEKAQIPEFVSKMLNDFPKDLHPMTQFAMAVSALNYESKFAKAYEQGINKADYWEPTFDDCISLLAKLPTIAAKIYQNAYRGGGALPAEVDLEQDWSYNFAAMLGKGGKENENFQDLLRLYLALHGDHEGGNVSAHATHLVGSALSDPFLSYSAGLQGLAGPLHGLAAQEVLRWIIQMKEAIPSNYTEQDVNDYLWSTLNSGRVVPGYGHAVLRKPDPRFEALMDYAAARPEIANDPVFQLVEKNSRIAPEVLKKHGKTKNPYPNVDSSSGVLFHHYGFHETLYYTATFGVSRGLGPLAQLIWDRALGLPIERPKSINLEGILKQVEGQ

SEQ ID NO: 51690 - protein, 774 aa, Medicago truncatula
MVSVFFVLVTILLSINHSEQLQSSHTQTLLRIQQQLNFPSALSNWNNSTDFCNTDSNSSLTVVCYEDTITQLHIIGEGKTPPLPKNFSIDSFVTTLVKLPSLKVLTLVSLGIWGPLPGKIARLSSLEIVNMSSNHLYGSIPVELSSLLNLQTLILDDNMFSGQVPTVSALTVLSLKNNLFNGSLPNSVSNLENLRIISLSHNKLYGVVPDLSHLRNLQVLELDDNAFGPQFPKLGNKLVTIVLRNNMFRSGIPADVSSYYQLERFDISSNTFVGPFQPALLSLPSIAYLNISRNKLTGMLFGNLSCNSELEVVDLSSNLLTGSLPKCLVSNSIDRTVLYARNCLETTKQNQQPPPSCHTEALAVGILPDRKKKKQVSKVVLALGIVGGTLGGVALVLLILFIVRRGNARSKMKNPPTRLISENAASGYTSKLLSDARYISQTKKFGALGLPTYRSFSLEEIEAATNNFDTASLMGEDSYGEMYRGQLKNGSIVVIRCIKMKKRYSTQNFMHHMELISKLRHRHLVSALGHCFKCSLEDSSVSKIFLVFEYVPNGTLRSWTSDGHTGRSLNWTQRIGAAIGVAKGIQFLHTGIVPGVYSNNIKIEDILLDHNLVAKISSYNLPLLSNIGKVRRGNSSDGSKHSSINKRGKHEDKCDIYDFGVILLEIILGRTIKTTNDAEAFKDLLQTSLGADEDARRSIVDPAIRKACLEQSLKTMTEICVRCMIKEPAERPSIEDVLWNLQFAAQVQDAWRGDSQSSEGSPGSPLGPQRTAFH

SEQ ID NO: 51691 - protein, 86 aa, Brassica napus
MADIGKGTSVAGCNDRCGCPSPCPGGESCRCRMSAASGGDQEHNMCPCGEHCGCNPCTCAKTQTSAKGGKAFCTCGEGCTCASCAA

SEQ ID NO: 51692 - protein, 422 aa, Medicago truncatula
MSILSSRTSSRSVTETVNGSHKFVIKGYSLAKGMGVGKHIASETFTVGGYQWAIYFYPDGKNPEDNSAYVSVFIALASEGTDVRALFELTLLDQSPNCKHKVHSHFDRSLESGPYTLKYRGSMWGYKRFFKRAQLEASSFLKDDCLKINCTVGVVVSSIDCSKLTTIHVPESDIGSHFGMLLENEEGSDVTFSVGGERFHAHKLVMAARSTAFETEFFNSMEEDDRDVVVTDMEPKVFKALLHFIYRDTLIEDEEFFMSSSSFLPSISETFAAKLLAAAEKYDLPRLKLMCESVLCKDISIDSVAYILALADRYHATELKAICLQFSAENLVAVMQSDGFEYLKENCPLLQSELLKTVAGGEEEFSGEGKCRSVWAQVSDGGETNDRSVRQQTWENGVERGQNLWVNLSDGVNNDRSPGQEA

SEQ ID NO: 51693 - protein, 261 aa, Brucella melitensis 16M
MTVTGHTRVFAIIADPVHHVRTPQALNALFAARGYDGIVVPAAVPASGLKYAAAALRAFGNWGGFIVTVPHKTEMPAFCDRLTPRAQAAGAVNVIRREADGSLTGELLDGVGFVRGLANAGHDVKGRSVYLAGAGGAASAIAFALAEAGVVRLTVVNRSSEKAGQLVARLKEHFPAGMFVSQGTPAGHDIIVNGTSLGLKEGDALPVDPQYLRPEMLVAEVIMSPEVTPLLQIAKDSGCSIHPGKAMLDGQLAEMFDFFTR

SEQ ID NO: 51694 - protein, 765 aa, Anabaena variabilis ATCC 29413
MRIDLESPNINVTSLKEAPIHLSGQIQPHGVLLVLEEPDLKILQVSNNTWSILGIKTEDILQKKLEDLLDSFQIERIQAGLSSGNLEFINPTKIWIRKKGDDYAVFDAVFHRNTEGFLILELEPAITQENIPFLSFYHLAKASINQLQKTANLRDFCQIIVQEVRKVTDFDRVMLYKFDDDGHGSVIAEEKLDSLEPYLGLHYPESDIPKPARKLFISNSIRVIPNAQAQAIQMIPSVNPVSDRPVDLTNSILRSAANCHLEYLHNMGVGASLTISLIKDNKLWGLIACHHLSAKYVSYELRKACEFLGRVIFAEISAREETEDYDYRMNLTHIQSLLVEYMSQEDNFVDGLVKHQPNLLDLTSAQGAAVCFGDHCTLIGETPKAEDLVFLVQWLKNNVEEEVFYTDSLPQVYPDAERYKNVASGLLAIPISQRNYVLWFRPEVIQTVNWGGDPNQPFEVNKLDGNVRLCPRKSFELWKETVRLTSLPWRYVEIKAALELRKAIVNIVLRQADELAQLAQDLERSNAELKKFAYVASHDLQEPLNQVANYVQLLEMRYQDELDADANEFITFAVEGVSLMQTLIDDVLAYSKVDTQAIAFQLTEVEKALDKALGNLRQRIAETGATITHDPLPTVMAGSTQLMQLFQNLIANAIKFHSQEAPQIHIGAERLEDEWLFSVRDNGIGIDPQFSDRIFVIFQRLHTRDEYHGTGMGLAICKKIIECHRGRIWVESQLGEGATFYFTIPVGGRERERRNGRKTQNNLFS

SEQ ID NO: 51695 - protein, 421 aa, Brucella melitensis 16M
MPVEVVLPALSAGMEDAVIARWLKAEGDAVSKGDLIAEVETDKATMELEAEVDGRIGQLLVKDGARANVNQVIALLLKEGEDASAMAGFAVGSSPVAVAEAETPVAASPVPAAPAVSAPASGEVRHKASPLARRLAAELGVSLDGLAGSGARGRIVRIDVERAAASKPVPVAAAAAPVAAPAEVSSKAIPVGIGEYEAVPHTSMRRTIARRLLEAKTTVPHFYLNVDCEIDALLALRSQINEKREGSARISVNDFVIKASAAALRRVPDANVIWTDEALLKLKDVDIAVAVATEGGLITPIIRSADQMSLGAISAQMKSLAARARENRLKPEEFQGGGFSISNLSMYGVKSFSAIINPPQSAILAVGAGERRPIERNGELAFATMMSVTLSVDHRAVDGALGAQLLAAFKAGIEDPMSLLV

SEQ ID NO: 51696 - protein, 414 aa, Arabidopsis thaliana
MASIVLRSRLLPRLAKLRSRNLRCFSAEASSTNSTSRYSGVTSTQSMFSDFPPPNQPPPPPPPQVEAAAAAATGKERKGLKYLGYALLWALTGATAATGYASFAYTIDEVNEKTKAFRESATKTPVIKSSGIDVIDKYQTKLYSAAMTGSARAIDKYLELREIVEEQVKGFTEPLSEKLLPDLHPAEQHVFTLVLDLNETLLYTDWKRERGWRTFKRPGVDAFLEHLGKFYEIVVYSDQMEMVKSQLYVLPVCEKLDPNGYIRYKLARGATKYENGKHYRDLSKLNRDPKKILFVSANAFESTLQPENSVPIKPYKLEADDTALVDLIPFLEYVARNSPADIRPVLASFERKDIAKEFIDRSIEYQKAFFLPYRINAKSVGSVPLRVSYLYAGESKDNWDKVDSGGVKGSKIYV

SEQ ID NO: 51697 - protein, 462 aa, Streptomyces avermitilis MA-4680
MKAQDGMYIDGAWRPAAGPDMIEVVNPADEQVIGRVPAGTPEDVDAAVRAARAALTAWAATPPAERAARISALRDVLVARQDEIAETVTAELGSPLSFSQSVQVGLPILVAGSYAELAATYAFEERVGNSTVHHEPVGVVGAITPWNYPLHQIVAKVAPALAAGCTIVLKPAEDTPLTAQLFAEAVHEAGVPAGVFNLVTGLGPVAGQALAEHEDVDLVSFTGSTAVGRQIGATAGAAVKRVALELGGKSANVILPSADLAKAVNVGVANVMANSGQTCSAWTRMLVHAERYEEAVELAAAAAVKYADRIGPLVNAKQRARVRGYIDKGVAEGARLVAGGPESTEPQGYFVSPTVFADVTPEMTIAKEEIFGPVLSVIRYEDEEEALRIANGTVYGLAGAVWAGDEAEAVAFARRLDTGQVDINGGRFNPLAPFGGYKQSGVGRELGAHGLAEYLQTKSLQF

SEQ ID NO: 51698 - protein, 359 aa, Streptomyces avermitilis MA-4680
MVRAAVLPAVGAPLEITGIELPEPGPGQVRVRLAAAGVCHSDLSLSDGTMRVPVPAVLGHEGAGTVVSVGEGVTQVSPGAGVVLNWAPSCGRCHACSLGEVWLCADALTGAGTVYARRTDGSDLYPGLNVAAFAEETVVPAACVLPVPDGVPLTDAALLGCAVLTGYGAVHHSAKVQPGETVAVFGVGGVGLATLQAARIAGASKIVAVDVSPEKESLARRAGATDYLVASENTAREIRGLTDKQGVDVAVECVGRAVTIRTAWDSTRRGGRTTVVGIGGKDQQVVFNALEIFHWGRTLSGCVYGNSDPAKDLPVLAEHVRAGRLDLGALVTERIALDGIPAAFDNMLAGKGGRALVVF

SEQ ID NO: 51699 - protein, 423 aa, Oryza sativa
  misc_feature (10)..(10): Xaa can be any naturally occurring amino acid
MVEGPKFAGXMMGGVVGGAGGHDDIGGNFCDMAYYRKLGESSNMSIDSLNSLQTSTHGGGSVAMSVDNSSVGSSDSHTRMLNHPGLRGHVAANYSVGHSIFRPGRVSHALSEDALARALMDPRYPTETLKDYEEWTIDLGKLHMGMPFAQGAFGKLYKGTYNGEDVAIKLLERPEADPERAGLMEQQFVQEVMMLATLRHPNIVKFIGACRKPMVWCIVTEYAKGGSVRQFLMKRQNRSVPLKLAVKQALDVARGMAYVHALGFIHRDLKSDNLLISGDKSIKIADFGVARIEVKTEGMTPETGTYRWMAPEMIQHRPYDQKVDVYSFGIVLWELITGMLPFANMTAVQAAFAVVNKGVRPAIPQDCLPVLSEIMTRCWDPNPDVRPPFTEVVRMLEHAEVVILSTVRKARFRCCISQPMTTD

SEQ ID NO: 51700 - protein, 458 aa, marine gamma proteobacterium HTCC2143
MKKWECIVCGWVYDEAKGDPESGLAPGTRWEDVPDDWICPDCGVGKDDFEMIEMTEAETDVPHHQAEDSADHITAPVIILGTGLAGYGLAKEFRKHDKETPLILISSDDARAYSKPMLSTGYTKNTEASTLTQADGGTMARQLNASVWTMTEVVAIDTDKQFIKVGDAATSIHYSKLVLALGAEPIAPPIKGDGLDHVYTINDLLDFDDFRKSVKKTGAKKICVIGGGLIGCEYTNDLLNGGFAVETVDPLDYCLPTLLPEVAGKAVQRALEEKGAKFHFGPLVTEVNKAEDGVAVKLNNGKIIDADLVVCAVGVRPRTALAAASGIAVNRGIVANKLLETSAKNVYTLGDCAEVAGHVLVYVAPLMAGAKALGKTLAGEETSVSYGVMPITIKTPACPVVVNPAPRNTEGVWSIEQDGNNVVGEFRDSQGKLLGFALTGDGTKEKMRLQKELPPVMP

SEQ ID NO: 51701 - protein, 435 aa, Xylella fastidiosa Temecula1
MNQIRQAPAASASNATESKQEIRNYTMNFGPQHPAAHGVLRLILEMDGETVVRADPHIGLLHRGTEKLAESKPFNQSIGYMDRLDYVSMMCNEHAYVRAIETLIGIQAPERAQYIRTMFDEITRILNHLMWLGSNALDLGAMAVMLYAFREREELMDVYEAISGARMHAAYYRPGGVYRDLPDTMPKYKESRWHKGKALKRLNAAREGSMLDFLEHFTDTFPQRIDEYETLLTDNRIWKQRTVGVGVIEPDVAKAWGMTGVMLRGSGIAWDLRKKQPYAKYDAVDFDIPLGTCGDCYDRYLCRVAEMRESNRIIKQCVQWLKMNPGQVMVENCKVAPPKRESMKDDMEALIHHFKLFSEGYCVPAGETYSAVEAPKGEFGCYLISDGANKPFRVHLRAPGFAHLSSMDAVVRGYMLADVVAMIGTYDLVFGEVDR

SEQ ID NO: 51702 - protein, 313 aa, Rhizobium leguminosarum bv. viciae 3841
MSRPFQVLGFGALAIDDIIYVDRGLTAGKGKVTKRATDHGGNVATALVAVARLGGQAGFIGWLGDETTADVAGSELERDGVDISLAPRHADAAPIRSVITVAPDGDRFIAYDDDVLHGTSDALPDDVLMRAPVLLIDGYATHSESVVARARALGLAVIADIEWTVGAATDRILAVADHLVLPLAFGKEYTGEGDPTMILDKLWSKDRSAVVLTDGERGAYLRQRADVTRWHVPAYQVQAVDTTGAGDCFHGAYALALARGKSPLDCVAYATAAAAISVTARGGRRGLPDHQTCLTWMAAENAPAPLPMPGYQK

SEQ ID NO: 51703 - protein, 857 aa, Arabidopsis thaliana
MENGNSSSDNKSSHKPIRCKAAVSRKAGEPLVMEEIMVAPPQPFEVRIRIICTALCHSDVTFWKLQVPPACFPRILGHEAIGVVESVGENVKEVVEGDTVLPTFMPDCGDCVDCKSHKSNLCSKFPFKVSPWMPRYDNSSRFTDLNGETLFHFLNVSSFSEYTVLDVANVVKIDSSIPPSRACLLSCGVSTGVGAAWETAKVEKGSTVVIFGLGSIGLAVAEGARLCGASRIIGVDINPTKFQVGQKFGVTEFVNSMTCEKNRVSEVINEMTDGGADYCFECVGSSSLVQEAYACCRQGWGKTITLGVDKPGSQICLDSFDVLHHGKILMGSLFGGLKAKTHIPILLKRYLSNELELDKFVTHEMKFEEINDAFQLLLEGKCISDFPEDFIFGAATSAYQVEGAAHEDGRGPSIWDTFSEKYPEKIKDGSNGSIASDSYHLYKEDVGLLHQIGFDAYRFSISWSRILPRENLKGGINQAGIDYYNNLINELLSKGIKPFATIFHWDTPQSLEDAYGGFLGAEIVNDFRDYADICFKNFGDRVKHWMTLNEPLTVVQQGYVAGVMAPGRCSKFTNPNCTAGNGATEPYIVGHNLILAHGEAVKVYREKYKASQKGQVGIALNAGWNLPYSESAEDRLAAARAMAFTFDYFMEPLVTGKYPIDMVNYVKGGRLPTFTAKQSKMLKGSYDFIGRNYYSSSYAKDVPCSSENVTLFSDPCASVTGEREGVPIGPKAASDWLLIYPKGIRDLLLYAKYKFKDPVMYITENGRDEASTGKIDLKDSERIDYYAQHLKMVQDAISIGANVKGFFAWSLLDNFEWATGYAVRFGLVYVDFNGGRKRYPKKSAKWFKKLLNEKKKN

SEQ ID NO: 51704 - protein, 145 aa, Casuarina glauca
EALLKQSWEVLKQNIPGHSLCLFALIIEAAPESKYVFSFLKDSNEIPENNPKLKAHAAVIFKTICESATELRQKGQAVWDNNTLKRLGSIHLKNKITDPHFEVMKGALLGTIKEAVKENWSDEMCCAWTEAYNQLVATIKAEMKE

SEQ ID NO: 51705 - protein, 201 aa, Oryza sativa (japonica cultivar-group)
MARRLWHVVRAVLFMLRKGMSKRKLAMDLHLLLHRGKIAGNKALGKIMNTTTATASHGHGHAADAASTAAGEAAAAAPFSCGRALDPALAVYDPRGAGLGAATSSWANGAHAVAPTPSPALWRTSFGGRSPAPVRQLRITDSPFPIRDDGGEDAGAGLVDLEAEEFINKFYEQLRTQQQSLATATPDYYAGYSRPVTGVAY

SEQ ID NO: 51706 - protein, 339 aa, Escherichia coli K12
MKSILIEKPNQLAIVEREIPTPSAGEVRVKVKLAGICGSDSHIYRGHNPFAKYPRVIGHEFFGVIDAVGEGVESARVGERVAVDPVVSCGHCYPCSIGKPNVCTTLAVLGVHADGGFSEYAVVPAKNAWKIPEAVADQYAVMIEPFTIAANVTGHGQPTENDTVLVYGAGPIGLTIVQVLKGVYNVKNVIVADRIDERLEKAKESGADWAINNSQTPLGEIFTEKGIKPTLIIDAACHPSILKEAVTLASPAARIVLMGFSSEPSEVIQQGITGKELSIFSSRLNANKFPIVIDWLSKGLIKPEKLITHTFDFQHVADAISLFEQDQKHCCKVLLTFSE

SEQ ID NO: 51707 - protein, 528 aa, Prochlorococcus marinus str. MIT 9515
MGKNLLKKERDPSILILDFGSQYSELIARRIREANVFSLVVSNFISTKEIQDINPQGIILSGGPNSVYEDNAPKCDQNIFNLGIPVLGICYGMQLMVKELGGTVTPANNRSEYGRAPIKIDFESDLLSSVKDKSIMWMSHGDSINHLPNGFIKIAHTENTLHAAISNKEKKLFGVQFHPEVIHSEYGMTVIKNFVYSISKCKADWNTETFLEETIPRIKEQVGDKKVLLALSGGVDSSTLAFLLNKAIGKQLTCMFIDQGFMRKGEPEFLMEFFAKKFHIKVEYINARERFLHKLNGVTDPEEKRKIIGGEFIRVFEEESHRLGPFEYLAQGTLYPDVIESAGTNLDPKTGERIAVKIKSHHNVGGLPKDLQFKLVEPLRKLFKDEVRKLGNALGLPDEIIKRHPFPGPGLAIRILGEVSIEKLNCLRDADWIVRDEIKKAGLYNDIWQAFAVLLPVKTVGVMGDKRTYAWPVVLRCVSSEDGMTADWSRIPYETLERISNRIVNEVAQVNRVVFDITSKPPGTIEWE

SEQ ID NO: 51708 - protein, 191 aa, Synechococcus sp. RS9916
MSIFVGNLPFRAEQEDIIELFAAHGEVTNCALPLERDTGRKRGFAFIEMADEAMETAAIDALQGVELMGRPLRINKAEPRGSAPRRGGGGYGGGGGGYRGGGGGYGGGGYRGGGSEGGGYGGGSGARGWEDRSYGGGGGGYRGGGGGYGGGGGQGTDYDDGRSRRRRGGASQGDSYGGGGDSYGGYGGAEG

SEQ ID NO: 51709 - protein, 335 aa, Pichia angusta
MTANVGINGFGRIGRLVLRIALSRDDINVIAINDPFIAPDYAAYMFKYDSTHGKFKGTVTHEGKYLVINGKKIEVFQERDPANIPWGKEGVDYVLDSTGVFTTIEGAQKHIDAGAKKVIITAPSKDAPMFVVGVNHEEYTPDIKILSNASCTTNCLAPLAKVINDIFGIEEGLMTTVHSITATQKTVDGPSHKDWRGGRTASGNIIPSSTGAAKAVGKVLPALAGKLTGMSMRVPTTDVSVVDLTVNLKKPTTYEDICATMKKAAEGPLAGILGYTDEAVVSSDFLTDSRSSVFDAKAGILLTPTFVKLVSWYDNEYGYSTRVVDLLQHVAKVSA

SEQ ID NO: 51710 - protein, 73 aa, Triticum aestivum
QDVRRELKIKAFVVLESAQNMDIVVQRSLTERACPECNHHKLEYYTKQLRSADEGQTIFYECPECGHTFNENT

SEQ ID NO: 51711 - protein, 322 aa, Streptococcus pyogenes M1 GAS
MVTVSKEQHLDMFLKMERIREFDSRINKLVRRGFVQGMTHFSVGEEAANVGAVAHLSYDDIIFSNHRGHGQSIAKDMDLNKMMAELAGKATGVSKGRGGSMHLADFEKGNYGTNGIVGGGYALAVGAALTQQYKGTNNIAVAFSGDGATNEGSFHESVNMAATWKLPVIFFIINNRYGISMSINNATNTPHLYTRAEAYGVPGFYCEDGNDVMAVYETMGKAVEHVRGGNGPAIVEVESYRWFGHSTADAGKYRTKEEVDEWKEKDPMIKYRTYLTSEGIATDDELDAIQAQVKKEVDDAYEFAQNSPDPELSVAFEDVWVD

SEQ ID NO: 51712 - protein, 332 aa, Streptococcus pyogenes M1 GAS
MSETKLMALREAVNLAMTEEMRKDENIFLMGEDVGVYGGDFGTSVGMIEEFGPKRVKDTPISEAAISGAAIGAAITGLRPIVDVTFMDFLTIMMDAIVNNGAKNNYMFGGGLITPVTFRVASGSGIGSAAQHSQSLEAWLTHIPGIKVVAPGNANDAKGLLKSAIRDNNIVLFMEPKALYGKKEEVNQDPDFYIPLGKGDIKREGTDLTIVSYGRMLERVLQAAEEVAADGINVEVVDPRTLIPLDKELIIESVKKTGKLMLVNDAYKTGGFIGEIATMITESEAFDYLDHPIVRLASEDVPVPYARVLEQAILPDVEKIKAAIVKMANKGN

SEQ ID NO: 51713 - protein, 548 aa, Oryza sativa (japonica cultivar-group)
MKRVSSHVSIASEAEINLDLSRLLIDKPRLTLERKRSFDEQSWSELSHRQNDGFDSIMHSPAFPSGFDSPFSLGTLGDPHPLVNEAWEALRKSVVYFRGQPVGTIAAVDHASEEVLNYDQVFVRDFFPSALAFLMNNETDIVKNFLLKTLHLQSSEKMVDRFKLGAGAMPASFKVDRNRNRNTETLVADFGESAIGRVAPVDSGFWWIILLRAYTKYTADTSLAESPECQNCMRLILNLCLSEGFDTFPTLLCTDGCSMIDRRMGIYGYPIEIQALFYMALRCALQMLKPDGEGKDFIEKIGQRLHALTYHMRNYFWLDFPHLNNIYRYKTEEYSHTAVNKFNVIPDSIPDWVFDFMPCRGGYFLGNVSPAMMDFRWFALGNCIAIISSLATPEQSVAIMDLIEERWEELVGEMPLKICYPAIENHEWRIITGCDPKNTRWSYHNGGSWPVLLWLLTAACIKTGRPQMAKRAIELAESRLLKDGWPEYYDGKLGRFIGKQARKFQTWSIAGYLVARMMLEDPSTLMMISMEEDRPVKPTMRRSASWNA

SEQ ID NO: 51714 - protein, 469 aa, Streptococcus pyogenes M1 GAS
MAFEIIMPKLGVDMQEGEIIEWKKQEGDTVNEGDILLEIMSDKTNMELEAEDSGVLLKITRQAGDTVPVTEVIGYIGAEGESVDTIASSEKTTEIPVPASADAGPAVAPKENVASPAPQVAATAIPQGNGGKVRATPAARKAAAEMGIDLGQVPGTGPKGRVHKEDVENFKGAQPKASPLARKIAADKGIDLATVSGTGFNGKVMKEDIMAILEAAKPAEAKAPAAKEEKVVDLPEGVEHKPMSAMRKAISKGMTNSYLTAPTFTLNYDIDMTEMIALRKKLIDPIMAKTGLKVSFTDLIGMAVVKTLMKPEHEYMNASLINDANDIELHRFVNLGIAVGLDDGLIVPVIHGANKMCLSDFVLASKDVIKKAQTGKLKAAEMSGSTFSITNLGMFGTKTFNPIINQPNSAILGVGATIPTPTVVDGEIVSRPIMAMCLTIDHRLVDGMNGAKFMVDLKKLMENPFELLI

SEQ ID NO: 51715 - protein, 587 aa, Streptococcus pyogenes M1 GAS
MAVEIIMPKLGVDMQEGEIIEWKKQEGDTVNEGDILLEIMSDKTNMELEAEDSGVLLKITRQAGETVPVTEVIGYIGAEGESVEVSSPAASDVNVARTTEDLEAAGLEVPKAPAQAASAAPKAALADDEYDIIVVGGGPAGYYAAIRGAQLGGKIAIVEKSEFGGTCLNVGCIPTKTYLKNAEILDGIKIAAGRGINLASTNYTIDMDKTVDFKNTVVKTLTGGVQGLLKANKVTIFNGLGQVNPDKTVTIGSQTIKGRNVILATGSKVSRINIPGIDSKLVLTSDDILDLREMPKSLAVMGGGVVGIELGLVWASYGVDVTVIEMADRIIPAMDKEVSLELQKILSKKGMKIKTSVGVSEIVEANNQLTLKLNNGEEVVAEKALLSIGRVSQMNGLENLNLEMDRNRIKVNDYQETSIPGIYAPGDVNGTKMLAHAAYRMGEVAAENAMHGNTTRKANLKYTPAAVYTHPEVAMVGLTEEQAREQYGDVLIGKNSFTGNGRAIASNEAHGFVKVIADAKYHEILGVHIIGPAAAEMINEAATIMESELTVDELLLSIHGHPTFSEVMYEAFADVLGEAIHNPPKRK

SEQ ID NO: 51716 - protein, 107 aa, Rickettsia rickettsii
MLENKNFKFIENEIKNNKVVLFMKGIKKSPACGFSGTVVAILNKLGVEFRDINVLFDAELREDLKKFSDWPTFPQLYINGELVGGCDIARELYQSGELEKMLKAYTR

SEQ ID NO: 51717 - protein, 334 aa, Aspergillus oryzae
MSRYAEAHANPQGPGDARPTALQIVKDTEMEGKLAGKSAVITGVSSGIGLETVRAIAATGAFLYLTARDLNKAKTALDDIFKPEQMELIHMDQSSLESVRNAAKTILSKTDKVSLLINNAGIMALPELRLSMDGYELQFATNHLSHFLLFNLLKPAMLAASTPEFQSRVVNVSSDSHRHHGINASDNYNFQKGGYEPWTAYSQSKTAVIYMANELDRRYGSRGLHATSVHPGMIATNLGQYLTPEQIEQLLQNTRWNSLWKSFEQGAATTVWAAVGREWEGNGGKFLAGCAEAVRGPEGTEDYVGTFVNHTYKPEDEARLWKDSLEMVGLSDDK

SEQ ID NO: 51718 - protein, 277 aa, Oryza sativa (japonica cultivar-group)
MPFPRRDIEAAGAGSGSGDDDSPAAKRGKPEAAGARPSLTRTEAAAAASVLVLFLVGIFCVFRAAPRREFEQILRLPRSLADVRLLKDNLAVYARDYQANFILGYCSIYIFMQTFMIPGTIFMSLLAGALFGVVKGGILVVFTATAGASSCYFVSKLIGRPLISWLWPEKLRYFQSEIAKRKEKLLNYMLFLRITPTLPNTFINMASPIVDIPFHIFFAATLIGLIPASYITVKAGRALGDLRSLRELYDSKTLVILFLIGTVAVAPTILKRKRIYE

SEQ ID NO: 51719 - protein, 470 aa, Rhizobium leguminosarum bv. viciae 3841
MRPYFQERGYDMLDRSNELAAWDRDHFFHPSTHMGGHARGETPTRVVAGGEGVYITDTTGRKSLDAFAGLYCVNVGYGRQKIADAIAEQAKNLAYYHAYVGHGTEASITLSKMIIDRAPTGMSRVYFGLSGSDANETNIKLIWYYNNILGRPEKKKIISRWRGYHGSGVMTGSLTGLALFHNAFDLPRAPVLHTEAPYYFRRPDRSMSEEQFSQYCADKLEEMIIAEGPETIAAFIGEPILGTGGIVPPPKSYWQKIQTVLDKYDILLVADEVVTGFGRLGTMFGSDHYDMKPDVITIAKGLTSAYAPLSGTIVSNKIWQVLVQGSDQLGAIGHGWTYSAHPICAAAGIANLELIDELGIVENAGTTGAYFRSELEKAVSGHRNVGEVRGDGLMAAVEFVDDKDDRTFFDAGRKIGPQVASALLERGVIGRAMPQGDILGFAPPLCLTREEADIVVKAAADAIETVFKNI

SEQ ID NO: 51720 - protein, 419 aa, Arabidopsis thaliana
MKCFYFSKDKTQDDEAKTRKFGSATMARGGSGSEFNSDTSTATSITSSLHVLSETHSNNLKVFVLDDLKTATKNFSRSLMIGEGGFGGVFRGVIQNPQDSRKKIDIAVKQLSRRGLQGHKEWVTEVNVLGVVEHPNLVKLIGYCAEDDERGIQRLLVYEYVQNRSVQDHLSNRFIVTPLPWSTRLKIAQDTARGLAYLHQGMEFQIIFRDFKSSNILLDENWNAKLSDFGLARMGPSDGITHVSTVVGTIGYAAPEYIQTGHLTAKSDVWSYGIFLYELITGRRPFDRNRPRNEQNILEWIRPHLSDIKKFKMIIDPRLEGNYYLKSALKLAAVANRCLMVKAKARPTMSQVSEMLERIVETSSDGAPSGLPLMKSLTPKDAFEASRRERVKRRFVELLIGENGCPNLPTWSHKLVTSI

SEQ ID NO: 51721 - protein, 445 aa, Ustilago maydis 521
MAIQKIQARMVIDSRGNPTVEVDLTTEKGLFRAAVPSGASTGIHEAVELRDGDKSSWMGKGVSKAIDNVNNVIAPELIKSGLPVTSQKEIDDFLIKLDGTPNKGKLGANAILGVSIAVAKAGAGEKGVPLYKYLAELSGVKAPYVLPAPAMNVINGGSHAGNALAFQEFMIVPTGAKSFTESIKIGTEVYHNLKKVINTKYGIDATNVGDEGGFAPNVQSADEALEILTEAIKKAGYEGQVHISLDVASSEFYKDGKYDLDFKNPNSDSSKWLTGKELADVYLGFIKKYPITSIEDPFDQDDWEAWSHLRANAGITIIGDDLTVTNPLRIKTAIEKKACNGLLLKINQIGTISESIQAAQLSQSDNWSVMVSHRSGETEDVTIADLVVGLGVGIIKTGAPCRSERTAKYNQLLRIESLEPSAVYAGIDGFTQGETAPKLITNKSA

SEQ ID NO: 51722 - protein, 170 aa, Ralstonia metallidurans CH34
MSDKGTDTKDKEKKAGKKKTASDRIEVRQSGVHGKGVYAIGQIAEGERVIEYKGEHISWKEALKRHPHDPNDPNHTFYFSLDDGDVIDAKFGGNRARWINHACDPNCEAREKKGRVFIHALRDIEPGEELFYDYGLVIDARYTKKLKQEYECRCGSPKCRGTMLAPKDKK

SEQ ID NO: 51723 - protein, 417 aa, Oryza sativa (japonica cultivar-group)
MLHLRNHLLPLLHAATSTASSSPLHLTHRLLSTAARSPFSVEHYLIATCGLTAAQARRASPKLSRLNSSSNPDAVLALLSSSAAGLDSLSLSRADLAAVVAAEPRLLRARPGTIARRIASLRGRANLSAPQIRSFLMSGGAAHLASSDVSPKLAFWVPFLGSFDMLLKILRRCNAILATDVDRVVRPNVALLGECGLGVCDIVQMTQTAAWLLTFNPERLKIVVRRAEELGVPTSSWAFKDAVCTVARNNEGTIAARMEFLRGTLGCSMDKLRSAISRKPSILGFSEKTLRGKIEFLLTKVQLETEYILQRPVMLTLSLDKRLAPRHYVLQALVEKGLIKNDVDYYSCVCFGNEHFVARYIDRHEDALPGLTDAYAAVHAGKSPAQSLTQHLKTDRYRSDGEATYVLRNQPVGMEDK

SEQ ID NO: 51724 - protein, 323 aa, Escherichia coli O157:H7 EDL933
MNLEKINELTAQDMAGVNAAILEQLNSDVQLINQLGYYIVSGGGKRIRPMIAVLAARAVGYEGNAHVTIAALIEFIHTATLLHDDVVDESDMRRGKATANAAFGNAASVLVGDFIYTRAFQMMTSLGSLKVLEVMSEAVNVIAEGEVLQLMNVNDPDITEENYMRVIYSKTARLFEAAAQCSGILAGCTPEEEKGLQDYGRYLGTAFQLIDDLLDYNADGEQLGKNVGDDLNEGKPTLPLLHAMHHGTPEQAQMIRTAIEQGNGRHLLKPVLEAMNACGSLEWTRQRAEEEADKAIAALQVLPDTPWREALIGLAHIAVQRDR

SEQ ID NO: 51725 - protein, 623 aa, Musa acuminata
MEVTEFLTSALVNQTIAEVLDYLRVTKFKVDSPEEEAGRALLDLLRRTDSSEDVEFKAFHIAASRQDGSEFKENGKAGSESIIIDTNRARSTSSSSNNDAPSIRGEAPIDIRQAAVPPEEFCCPISSRLMYDPVVIASGQTYERKYIEKWFDEGHDTCPKTRRKLVNLAVVPNSCMKDLIANWCRRRGISVPEPCSDCSPADFCSWEPSHSYSISSLKNVSAALLDGSVRHYFLQNDHSNVSVLSSDASYCSDSSQISGIKSTQDNQTHLFSWSDDYQQHQSFSNFNHEMFLRFFYRLLELPIDVQDKAVKKVKFLLESDEEICCAMLANGFAEALISFLKNAREEANVRAIRAGNQLFLAFLNENWVKISSLTEDALQLLVSFLDSDIRMEVLMLMQKLAQNPSCRSSIMAPGVVAPIIKSLDSEDTGLLELSLKILLDLSADEDVKSSILSSGCITTLASFLTDGRLAHLCLKIIQNISRHEEGATTVVKAKACLAAIVELLDTGSKEEQEHAVDILYAICSKSYENCLLVMDEGVIPALVDINVNGNVKGQEIATRLLHLLRDVRRSDRFVNSYIKPESIPEPTVTVVQHSADRVPLSRSLGKVGKKLRFFSKSGSSTPC

SEQ ID NO: 51726 - protein, 510 aa, Glycine max
MGSDNHQNLEFLKEIGLGSSNIGSYINGQWKATGSSVTSVNPSNNQSIAQVTEATLQDFEEGLRACSEAAKTWMTIPAPKRGEIVRQIGEALRAKLDPLGRLVSLEMGKILPEGIGEVQEIIDMCNYGVGLSRQLNGSIIPSERPDHMMFEVWNPLGIVGVISAFNFPCAVLGWNACIALVCGNCVVWKGAPTTPLITIAVTKLVAEVLERNKLPGAIFTSFCGGADIGQAIAKDTRIPLVSFTGSSKVGLMVQQTVNERFGKCLLELSGNNAIIVMDDADSNWLYVYFGCCCGSTGQPVYTWPCRRLFLHESIYTDVLDQLVEVYKQVKTGNPLEKGTLVGPLHTRTSVENFQKGISVIKSQGGKILTGGSVLESGGNFVQPTIVEISPDAPVVKEELFGPVLYVMKFQTLDEAIALNNSVPQGLSSSIFTQRPGTIFKWIGPRGSDCGIVNANIPTNGAEIGGAFGGEKATGGGREAGSDSWKQYMRRSTCTINYGSELPLAQGINFG

SEQ ID NO: 51727 - protein, 377 aa, Synechococcus sp. RS9916
MADFYDLLGVSRDADADTLKRAYRRLARQYHPDINKEPGAEDRFKEIGRAYEVLSDPQSKARYDQFGEAGLGGAAGMPDMGDMGGFADLFETFFSGFGGAGGGAAGRQRRNGPQQGDDLRYDLTIDFDQAVFGQEREIRIPHLETCTTCNGSGAKSGSGPTTCSTCGGVGQVRRATRTPFGNFTQVAECPTCNGTGQVIADPCNACGGQGVTQVRKKLRINIPAGVDSGTRLRVAGEGNAGLRGGPAGDLYVFLTVKPHPHLRRDGLTVLSDVKVSYLQAILGDTIEVETVDGPTSLEIPPGTQPNAVLTLENKGIPKLGNPVARGNQRVTVAVQLPTRLNDDERTLLEQLAGHHSARGVQHHHHKSGLFARLFGQG

SEQ ID NO: 51728 - protein, 648 aa, Musa acuminata
MSSPPPSPSATPPSTSPPPPTSLSPPPASNSPPPAPNAPPPTPPSPPPASPPPPTPPPPADVPPPPVVTSPPPPAPPPPSVSPPPPALSPPPASTPPRPPSASPPPAAAPPPPPPSATPPPTNSPPPPPSATPPPTISPPPPGSQSPPAPAPSNSTGGTPPAPPKPPSPPSPSPSASHRAPAYPISPSSNGSGIPTSDVGQKSGQSSGDGGMKAGPAVAVALVTAVVLLGLLGAITWIVRRKRRKPPANYESGFAMSSPYQSSVMSESSHQRSPSAPLVHHHNHHKSGSLASESMVASTIGSATSWFSYEELYEITNGFSPQNILGEGGFGCVYKGCLSDGREVAVKQLKVGSGQGEREFKAEVEIISRVHHRHLVSLVGYCISDIQRLLVYDYVPNGTLESHLHGKGGPAMDWATRVKVAAGAARGIAYLHEDCHPRIIHRDIKTSNILLDNKFEAQVSDFGLARLAMDACTHVTTRVMGTFGYLAPEYASSGKLTERSDVFSFGVVLLELITGRKPVDGTRPLGDESLVEWARPLLAHAIETGEFGELPDSRLEDAYDDTEMFRMIEAAAACTRHSAAMRPRMGKVVRVLDSLSDVDLHNGVKPGQSEVFNVGQTADIRLLQRLAFGSQEFSSEYSQSNWSRQSDL

SEQ ID NO: 51729 - protein, 245 aa, Malus x domestica
  misc_feature (227)..(227): Xaa can be any naturally occurring amino acid
RGSNIELTVTILNSELPALNDAAAATAWVQKNVQPYSADVRFKYIAVGYEIRHYSAEVGSLLPAIQNIHSAIVAANLQGQIKVSTAIDTTLVANPFPPSDGVYDAANQFIQPVIDFLVNSGAPLLVNVYPYFSYIDNPSIDLAYALFTSQGVVVPDGTRYPSLFDALLDAQYAALEKAGAPNMEIVVSESGWPSEGGDQATPQNAATFCQNLINHVTSTTGTPKRPXKATETYLFAMFDESNSRG

SEQ ID NO: 51730 - protein, 82 aa, Brassica napus
MCPLRFLLVFFSAVLAGYFAWKTVSSSSPELIGDDDDSPVELNEKQGLCFRKRMENGFWVFVDMASGKYLWRNLKEMRDKSH

SEQ ID NO: 51731 - protein, 498 aa, Rhizobium leguminosarum bv. viciae 3841
MTAVFARPAYHDALSRLADRHLLRDLAYVGGRWIAGQSGKSFEVTDPASAATLAWVASLGADETAVAINAASEACAAWRAMLPQGRAAILRKWFELMLAAKEDLALIMTLEQGKPIAESRGEIDYAASFVEWYAEEGKRLNAESVTSHLPGAEMIVRREALGVVGIVTPWNFPSAMLTRKVAAALAAGCTVVAHPSSETPLSALALAELGERAGVPAGVFNVVTGHAATIVGRMCADTRVRAMSFTGSTGIGRLIAAECAPTLKRLVMELGGHAPLIIFDDADIEKAVEIAVNAKFATSGQDCLAANRIFVQRRIADAFTKAFADRIAELKVGAGLEDGAEIGPLMHERAVAKVEEQVADALGHGARLVTGGRRHKAGRLFYEPTLLSDVPADALIMREETFGPVAAIAAFDTEDEVIARANDTEYGLVAYIVTENGARQMRLGRALEYGMVAVNRVKITGAPIPFGGWKQSGLGREGSRHGLEAFTELKYLCIDTAA

SEQ ID NO: 51732 - protein, 152 aa, Prochlorococcus marinus str. MIT 9515
MIKERTFLAIKPDGVQRGYIAEIIGRFEKKGFKLVGLKQLIPSKQLAQDHYGVHRERPFFKDLVNFISSGPVVAMIWEGEGVILSARKIIGATKPLEAEPGTIRGDLAIDIGRNIIHGSDGEETAKFEINLWFDQHEICDWETSDSEWRVES

SEQ ID NO: 51733 - protein, 513 aa, Staphylococcus epidermidis ATCC 12228
MEMAKEQELILVLDFGSQYNQLITRRIREMGVYSELHDHEISIEEIKRMNPKGIILSGGPNSVYEEGSFTIDPEIYNLGIPVLGICYGMQLTTKLLGGKVERANEREYGKATINAKSDELFFGLPSEQTVWMSHSDKVIEIPEGFEVIADSPSTNYAAIEDKKRRIYGVQFHPEVRHTEYGNDLLRNFVRRVCNCTGEWTMENFIEIEIEKIRQQVGNRKVLCAMSGGVDSSVVAVLLHKAIGEQLTCIFVDHGLLRKGEGDMVMEQFGEGFDMNIIRVNAQERFMSKLKGVSDPERKRKIIGNEFVYVFDDEAAKLTDVDFLAQGTLYTDVIESGTKTAQTIKSHHNVGGLPEDMEFELIEPINTLFKDEVRALGIELGIPEHLVWRQPFPGPGLGIRVLGEITEDKLEIVRESDAILREVIREEGLERDIWQYFTVLPGIQSVGVMGDYRTYDHTVGIRAVTSIDGMTSDFARIDWEVLQKISSRIVNEVDHVNRVVYDITSKPPSTIEWE

SEQ ID NO: 51734 - protein, 422 aa, Staphylococcus epidermidis ATCC 12228
MKNFILSVQHLLAMYAGAILVPIIVGTSLKFSAEEIAYLVTVDIFMCGVATFLQANKVTGTGLPIVLGCTFTAVAPMILIGQTKGLDVLYGSLLISGILVVLIAPFFSYLVKFFPPVVTGSVVTIIGINLMPVAMNYLAGGEGAKNYGDTKNLILGGVTLLIILILQRFTKGFLKSIAILIGLAIGTALAGIFGMVDIKQVGDAHWFGFPVPFRFSGFGFDVSSILVFFIVAVVSLIESTGVYHALSEITGRKLERKDFRKGYTAEGLAIILGSIFNAFPYTAYSQNVGLVSLSGAKKNNVIYGMVILLLICGCIPKLGALANIIPLPVLGGAMIAMFGMVMAYGVSILGNINFQNQNNLLIIAISVGLGAGISAVPQAFKGLGEQFAWLTQNGIVLGAISAIILNFFFNGIKYKQTEENVK

SEQ ID NO: 51735 - protein, 473 aa, Pediococcus pentosaceus ATCC 25745
MHNFIKNFIKKENPAIYEDKDSHLTRTLVVKDFLALGVGTIVSTSIFTLPGVVAAQHAGPAVVLSFLAAAVVAGLVAFAYAEMASAMPFAGSAYSWINVILGKGFGWVAGWALLAEYFIAVAFVASGLSANFRGLLSSIGIQIPKQLANPLGTNGGIIDITALIVVIAVALLLAHGTTGAARIENALVVLKVVAILVFIIVGLSAIHIQNYLPFIPKYHTNPDGTSFGGWKGIYSGISMIFLSYIGFDSIAANAGEAKNPEKTMPRGILGSLIIAVILFIAVSLVLVGMFHYTNYANNAEPVGWALRHAGHGVIAGVIQAIAVIGMFTALIGMMMAGSRLLYSFGRDGMLPKWLGQVNPKGLPNHALSLLTIIGIIIGSMFPFAFLAQLISAGTLIAFMFVSLGIYVLRPREGKDIAIPSFKMPLYPVLPALAFLGSLAVFWGLDAQAKLYSLVWFIIGIIVYTFYGARHTTD

SEQ ID NO: 51736 - protein, 332 aa, Anaplasma phagocytophilum HZ
MEVITVREALRLAMEEEMERDQSVFLMGEEVGEYQGAYKISQGLLERFGPQRVVDTPISEHGFTGLAVGAAFCGLKPIVEFMSFNFSMQAMDQIVNSAAKTNYMSGGQLGCPIVFRGPNGAAAGVAAQHSQCFASWYSHVPGIKVVAPYFAADCKGLLKSAIRDPNPVIFLENEIAYGHSHEVTEEQLSKDSLVELGKAAIVREGKDVTIITFSLQLKYALEAAEILLKDNISAEVIDLRTLRPLDTEAILKSVKKTNRVVTVEEGWPFCGVGAEITALIDECAFDDLDAPVTRVTAKDVPLPYAANLESLALPGVEDIVSAVHKVCNYSIA

SEQ ID NO: 51737 - protein, 472 aa, Anaplasma phagocytophilum HZ
MFLFTKDLLDYVEKHGIKFIDWRFTDLLGRWYHITHSTNFLDPGVFTAGVAFDSSSVPGWQPIEASDMLLVPDISTAFVDPFSAQATLSVICNVVCPGDRTDYSRDPRYTARKAHHYLVSKSIADKCFFGPEVEFFVFDRVRFAAESHNSFFKLTSVESSSGASKRFDSSHGYGLKERGGYLCSSPMDSSHDMRSEVLSMLDEVGVKPLLHHHEVASSQCEVGFHHNELVAAADSVQKCKYVLRNVVGSYGKSVTFMPKPVVGDNGSGMHCHQSLWKDGNNIFAGDNGTAGLSDTCLYYIGGILAHGKALNAFANPSTNSYKRLVPNFEAPTWLAYSHGNRSAAVRVPFVPSNSVAARRIEVRFPDPLANPYLCFASQLMAGLDGIKNKIMPPEVQGRSLYDMSEDEVRGLSSVCFSLEEALEALDKDRGFLVEGGVFTNDQIDAYIKLKRQEAHELRIHPHPVEFSNYYAL

SEQ ID NO: 51738 - protein, 421 aa, Photobacterium sp. SKA34
MPKLNLHRPDYVTSMLGQLSSSQLHQRLDPIVAPLTKKLPRNPYVSDRIIAKRWEVLNNINSQTVLYDTETQQQQHCYEKNIENFIGSVKLPLGVAGPLKVNGLFASGEYFVPLATTEAALVASYHRGALLISEAGGASAILLNEGVTRAPGFAFDSLVQASKFITWVTTQYDTFKTIAESTTRYGKLSDINLSMEGNHVYLVFEYLTGDASGQNMVTISTNAVFEYILANTPIKPVEAFLDCNLSGDKKATAQTLRSVRGKKVTAEVHLSRELVKKYLHTTPEKMVDFGKMTTVGGALSGTIGVNAHYANALAAFYIACGQDAACVAESSVGITRMELNQQDGLCVSVTLPNLMIGTVGGGTHLPSQKACLELLGLYGSGQSQALAEVCAALCLAGELSIIGAFCSGHFAKAHHRLARKV

SEQ ID NO: 51739 - protein, 708 aa, Anabaena variabilis ATCC 29413
MSALWTYFFNSAPFIPHGHCYLWQTDLVWLHIISDGLIAVAYYSIPATLFYFVRKRQDLPFYWMFLLFSGFIVACGTTHIMEVWTLWYPTYWVSGFLKAITAIISVFTALALIPLVPKALILPSPAQLERANKDLQNEIGERLKVEAELRKYQNHLEELVNIRTNEITNANEKLQQEIHERQRIVEILRESEERYRYLAEAIPQLVWTADANGECDYFNQNWCDYTGLTLEESLGSGWLAALHLEDLERSYETWSKAVETGTLYENEYRFKRAADGSYRWLLGRGLPLKDHQGRVVKWFGTCTDIHEQKQILEERARLLELEQTARAEAETANRIKDEFLAVLSHELRTPLNAILGWSKLLQERKLEPARTFQALATIERNATLQVQLIEDLLDISRILQGKLVINITKVNLVIVILTALETMRLAAESKLIQVSTNFPSKMGQVMGDSARLQQVVWNLLSNAVKFTPKGGKIEVSLEKVDGYAQIVVSDTGKGIKPEFLPYVFDYFRQADSSSTRRFGGLGLGLAIVRKIVEIHGGTVTAQSLGEEQGASFTVRLPILPEEDGNVTYEQHRSTSSITSSLPLEGIKVLVVDDDADSRDFLTFILEQEGAEVTLAASALEVLQLLPEIKPDVLVSDISMPDMDGYTLIRQVRTWTAEQGGAIPAIALTAFARQYDREQAFQAGFQLHLPKPLNAEEFFAAVVELVNGQ

SEQ ID NO: 51740 - protein, 328 aa, Escherichia coli O157:H7 EDL933
MSHVELQPGFDFQQAGKEVLAIERECLAELDQYINQNFTLACEKMFWCKGKVVVMGMGKSGHIGRKMAATFASTGTPSFFVHPGEAAHGDLGMVTPQDVVIAISNSGESSEITALIPVLKRLHIPLICITGRPESSMARAADVHLCVKVAKEACPLGLAPTSSTTATLVMGDALAVALLKARGFTAEDFALSHPGGALGRKLLLRVNDIMHTGDEIPHVKKTASLRDALLEVTRKNLGMTVICDDNMMIEGIFTDGDLRRVFDMGVDVRQLSIADVMTPGGIRVRPGILAVEALNLMQSRHITSVMVADGDHLLGVLHMHDLLRAGVV

SEQ ID NO: 51741 - protein, 313 aa, Brucella melitensis 16M
MSHGEAPLKIFVFGSVNVDVSARMAALPRPEQTVNASGYGIGLGGKGANQAVAVAKLGGAIRFVGAVGHDAFGELALKQMREFGLDTGSVRVIDDVDTGMAIIQVEETGQNTIAVCAGANARWSSADIDAYGADIAKARITLLQREVPHEANLAVAKAVRAAGGTVLLDPAPVGDASQMADLIALSDIISPNETEAAEITGIEPTDLASAEAAGRKLLERGPKIVILKLGSRGALLVTADEVKHFTPFKVKVVDTVAAGDSFNGGFAVAFSQARPLHDCVRYGSAAGAIAVTRVGAGAAAPTAREVEELIGRA

SEQ ID NO: 51742 - protein, 154 aa, Arabidopsis thaliana
MPVPLAPYPTPPAPALAPSYNTPPANGSTSGQSQLVCSGCRNLLMYPVGATSVCCAVCNAVTAVPPPGTEMAQLVCGGCHTLLMYIRGATSVQCSCCHTVNLALEANQVAHVNCGNCMMLLMYQYGARSVKCAVCNFVTSVGGSTSTTDSKFNN

SEQ ID NO: 51743 - protein, 393 aa, Malus x domestica
MSQVRETETPEDRVVAIMSKLPPKSLMRFKCIRKSWCTLINNPSFVAKHLSNSVDNNFSSYTCILLNRSQVHVFPDKSWKHEVLWSMINFFNDRVSRTLYYNVEDLNIPFPRDDHEHILIHGYCNGIVCVISGKNILLCNPATREFRQLPDSFLLLPSPLGGKFELETDFGGLGFGYDCRAKDYKVVRIIENCEYSDDERTYYHRIPLPHTAEVYTMATNSWKEIKIDISSKTYPCSCSVYLKGFCYWFTRDGEEFILSFNLGDERFHRIQLPSRRESGFEFYYIFVCNESIASFCSLYDRSQDSKSCEIWVMDDDGVKSSWTKLLVAGPFKGIEKPLTLWKCDELLMIDTDGRVISYNSGIGYLTYLHIPPIINRVIDSQALIYVESIVPVK

SEQ ID NO: 51744 - protein, 506 aa, Musa acuminata
MDVTGTTFLFASFLVLLLLLLRKHSYSRRGNARLPPGPFKLPLIGSLHHVLGPLPYRSLAALSEKFGAVMLLKLGEVPTLVVSSPEAAAEIMKTQDVSFASRPMISSVRIIAYGDKSPVFAPYGSYWREVRKMSILELLSVKRVLSFRSIREEEVLNFVRSMDLSSNSGSTVNLSSKFALMTNDIAARAIIGRKCKYQKQFLQVINRALEASGGFSLADLFPSSSLVSLLSGIPLKLPRLHREMDAILSSIIQEHRERNSTEQVEEDLVDVLLKVQREGSVPFAFTDVAVKAIILDLFGAGGETTATTLEWIMSELMRNPGAMKRVQQEVRETVGGKGRVREEDINEMKYLRMIIKETLRLHPPLPLLLPRECQEPREILGYQIPEKTRVLVNVWALGRDPRHWDDAAMFKPERFDRGSSTVDFKGNNFEFIPFGAGRRMCPGIAFGMASVELPLASLLYHFDWELPARDGVKPNELDMTENFSLTCRRRSELCLRAIHRNPCPMY

SEQ ID NO: 51745 - protein, 413 aa, Brassica napus
MAVSAFRVTQLPLLHQSQVTVARAARSKKMIGGRRNLKGFVISAQYSQSQDLFTSRLQSRIENLPKLVEDIVQTSINTGPRGALRLVQGVQAFLGVGGEWLNDLSKSTRVSGALPTEMQLGLLSPLYLRKLFERMGATYIKLGQFIASAPTLFPPEYVEEFQNCFDKAPPVPFEEIRKILQEELGRPIQSVYEYVDPTPLASASIAQVHGARLRGSQEDVVIKILKPGIEDFLVADLNFIYVVARIFEFLSPEFSRTSLVGIVKDIRESMLEEVDFNKEAQNIESFKRYLESMGLSGQASAPRVYKHCSSRRVLTMERLYGVPLTDLDSIRSLVSSPENSLITALNVWFGSLLSCESFHADVHAGNLWLLRDGRIGFLDFGIVGRISPKTWDAMEVFLASIATEEYESMASAL

SEQ ID NO: 51746 - protein, 393 aa, Malus x domestica
MSQVRESETLEDRVVEILSRLSPKSLLRFKCIRKSWCTLIISTSFVAKHLSNSLDYKHSSSTCILLNRSQFHIFPDQSWKHEVLWSMINLSIDSDVHNLHYDVKSLNIPFPRDDHNHVHIHGYCNGIVCLIEGDNVLLCNPSTREFRLLPDSCLLVPHPEGKFELETTFHGIGFGYDCKAKEYKVLQIIENCVYSDDEQTYQHCIAFPYTAEVYTTAANFWKEIKIDISSTTHPYPFSVYLKGFCYWFARDGEECILSFDLGDEIFHRIQLPSTIESGFKFCGIFLYNESIISYRCRYDPSEDSNLFEMWVMDGYEGVKSSWTKLLTVGPSKGIEYPLTLWKCDELLMVASGRRVTSYNSSTENLKDLHIPPIMHQVTGLQALIYEESLVPIK

SEQ ID NO: 51747 - protein, 341 aa, Streptomyces avermitilis MA-4680
MLGCVIHGRGDLRVDELPEPAAGPGQALVAVRYGGVCGSDLHYWRHGGVGDFRLREPMVLGHEVVGTVLSYGPGAAGPAPGTAVAVHPATPCGVCPECADGRANVCRDTRYLGSAARMPHVQGGFAARVVVPAAQVRALPEGLDLRRAALAEPLSVALHAVRRAGPVAGRPVLVTGAGPIGCLVVAAAKAAGAGRVTVTDLLPRALSYAAGVGADDVVRADDPADAGWPDSVDVAVEASGVAAGLDTCLRLVRRGGVVVQLGMLPPGQTPFAGNLVVSREIELRGAFRFADEFDEALTLLAREPAFDSLISAVVPLEEAESAFALAADRGEACKVLLDFGV

SEQ ID NO: 51748 - protein, 506 aa, Musa acuminata
MDVTGTTFLFASFLVLLLLLLRKHSYSRRGNARLPPGPFKLPLIGSLHHVLGPLPYRSLAALSEKFGAVMLLKLGEVPTLVVSSPEAAAEIMKTQDVSFASRPMISSVRIIAYGDKSPAFAPYGSYWREIRKMSILELLSVKRVLSFRSIREEEVLNFVRSTDLSSNSGSTVNLSSKFALMTNDIAARAIIGRKCKYQKQFLQVLNRGLEASGGFSLVDLFPSSSLVSLLSGMSLKLPRLHREMDAILSSIIQEHRERNSTEQVEEDLVDVLLKVQREGSLPFAFTDVAVKAIILDLFGAGGETTSTTLEWIMSELMRNPGAMKRVQQEVRETVGGKGRVREEDINEMNYLRMIIKETLRLHPPLPLLLPRECQEPREILGYQIPEKTRVLVNVWALGRDPRHWDDAAMFKPERFDRGSSTVDFKGNNFEFIPFGAGRRMCPGIAFGMASVELPLASLLYHFDWELPERDGVKPNELDMTENFSLTCHRRSELCLRAVLRNPCPMH

SEQ ID NO: 51749 - protein, 207 aa, Brassica rapa subsp. pekinensis
WFQGTADAVRQYLWLFEEHNVLEFLVLAGDHLYRMDYEKFIQAHRETDADITVAALPMDEKRSTAFGLMKIDDEGRIIEFAEKPKGEQLKAMKVDTTILGLDDERAKEIPFIASMGIYVVSKNVMLDLLRDQFPGANDFGSEVIPGATDLGLRVQAYLYDGYWEDIGTIEAFYNANLGITKKPVPDFSFYGRSAPIYTQPRYLPPSK

SEQ ID NO: 51750 - protein, 552 aa, Candida albicans SC5314
MSTITLTRESHKNPSKFRINHQDELDILGPNRKDRYAINDKLPTITTSSKLAIIGAGFGGMAGAIKTMEKYDEHDIQIFERHDNFGGTWYANTYPGCASDIPALWYSFSFALTSNWSRIQPPQYEMEEYILRVAEKFKLKEKTRFQTEINKVEWDDVNGEWTLYAHDVKTGQRIIHKSKLLLACQGGLVHPLHFDAKGLENFKGPYMHSALWDHSVDFRGKKVVVIGNGCSANQTVPALLNDPQYNVGSLTQISRSKHYIMRPLPKLIYTLYRLFSFNYFTMYFFRLMFIFFSELKVPLFKGEGIISNYVRKLTTEASVSYIKEVAPEKYHDKLIPDYKIGCKRLIFDYNYVPSLKDPRIDIKTERIDKVVEDGILLESGEHIEADIIVACTGYNLSKSHFNFEIVGRKGADITQLWKEEGASAYRTLLIKHCPNLWTIGGTNSITGHASVVMGIENGVDYFLKTAKPVFQGKAKSVQVKDEAYDNWLTTLQKEINKSVFGTPFGGCVSWYSGAKVNSISYPWSQLHYWWKTQFPTYRDLNYEPLDENKKRR

SEQ ID NO: 51751 - protein, 316 aa, Sorghum bicolor
MVVPVIDFSKLELDGAERAETLAQIANGCEEWGFFQLVNHGIPLELLERVKKVCSDCYRLREAGFKASEPVRTLEALLDAERRGEEVAPVDDLDWEDIFYIHDGSQWPSDPPAFKETMREYRAELRKLAERVMEAMDENLGLDRGTIKAAFSGDGRHEPFFGTKVSHYPPCPRPDLITGLRAHTDAGGVILLFQDDKVGGLEVLKDGQWTDVQPLAGAIVVNTGDQIEVLSNGRYRSAWHRVLPMRDGNRRSIASFYNPASEATISPAAVATSGGEAYPKYMFGDYMDVYVKQKFQAKEPRFEAVKAAAPKSSPAA

SEQ ID NO: 51752 - protein, 459 aa, Yarrowia lipolytica CLIB122
MIPLRTARVARTSVSSMVQKRFASDLKGALKEAIPAKLELFKKVKSEYSQKSLGDCKVENLLGGMRGLKCMLWEGSVLDADEGIRFHGKTIKECQEVLPKAVEGGEMLPESMLWFLFTGKVPTEEQVRGLSRELAEKGEVPEFVNKMLDNLPPTLHPMTQFSMAVSALNHDSKFAKAYERGIPKSEYWEYTFDDSIDLIAKLPQIAAKIYQNSYLGGGPLPGKIDLNRDWSYNYAAMMGKGDETGFVDLLRLYFALHGDHEGGNVSAHATHLVGSALSDPYLSYSAGLQGLAGPLHGLAAQEVLRFILDMEKNVPKGYSNEDLVKYLWSVLKSGRVIPGYGHAVLRKPDPRFEALMNFANSRQEIRDDPVFQLVSRTSEVATGVLTEHGKTKNPHPNVDSSSGVLFHHYGIHETLYYTVTFGVSRALGPLPQLVWDRILGLPIERPKSLSLEEIIKVAK

SEQ ID NO: 51753 - protein, 464 aa, Bacillus licheniformis ATCC 14580
MVNEKKISSGFIYFFGAFAGILFGYDIGVMTGALPFLQNDWNLQDNAGVIGWITSSVMLGAIFGGALAGQLSDRLGRRKMILISAIIFVVGSILSGIAPHNGILFLIVSRVLLGLAVGAASALVPAYMSEMAPARLRGRLSGINQTMICSGMLLSYIVDFLLKDLPETMAWRLMLGLAAVPALILYVGMLKLPESPRFLIKNNKLDEARKVLSYIRSNKGEIDSEITQIQETAREEAKANQNASWATLLSNKYRFLLIAGVGVAAFQQFQGANAIFYYIPLIVEKATGNAASSALMWPIIQGVILVLGSLIFLVIADKFNRRTLLTVGGTIMGLSFILPAILNILIPNANPMMMVVFLSIYVALYSFTWAPLTWVIVGEIFPLVIRGRASGLASSFNWIGSFLVGLLFPVMTASMSQEAVFAIFGVICLLGVVFIRTRVPETRGRSLEEIEKNGENKRVDGKSA

SEQ ID NO: 51754 - protein, 258 aa, Acinetobacter sp. ADP1
MCIVALAWQVFDQIPLCLLSNRDEFYARPTTQLHLWENTPIIAGRDLQSGGTWMGITASGRWAVVTNFRDGHDKKIYDTSRGTLVEDFLLSDLAPIRFAKQLEQRQQHYAGFNLFMGDQSQAVYMSNRGEAPQVLAKGVYVVSNGLMSEHWEKTAHLRKRFTQEFVPMLQAEIAEHDLEYTAWDILEDERKVIPELLPSTGIHPDMEELLSSTFIQSPVYGTRCSNFLRLMKRRWIWAEKTQWGDHAGEMMRMDIQIQ

SEQ ID NO: 51755 - protein, 149 aa, Oryza sativa
MALKNFLVLGVFLAALLMFSLDDVAHARELTEANESEGKNVKPTGGPGVEDQKWGGGYYPGGGYGYGGGYGGEYGRPGYGGGYGGGYGHPGYGGGYGGGYGRGYGGGYGGSGGGYGGGYGGGYGGGYGGGGGYGGGYGGAAPYPYPPPG

SEQ ID NO: 51756 - protein, 493 aa, Ralstonia metallidurans CH34
MTKRQASTATTTKTTAKARRRASEVSAEPVVERVPRRKRSVRPTTREADFVVIGAGSGGVAAARRAASHGARVILVERDAIGGTCVNRGCVPKKMLSYGANWASILSTCLSHTGGKEDWRDASVRVNAEVARLNASYAQRLNEAGVEILHGDARLSGADEVVVGNEIIRTRKTLIATGAHPLALPVPGGELASSSDDVFTWQTVPASIAVIGGGYIAVEMASILSRYGVKVDLLVRGDRLLPKFDHDIAAALAEALAAKGVRLHFRADVTMLSQANGATEVCYTQQNNPGRTQTVRAQAVLAAIGRRPSIAELGLDALGVQLGERGGICVDRQFRTTVRSIHAIGDCMDRNLHLTPVAIAQGRWLADRLFGKRGDIADFDFVPTAVFSEPAIGAVGLTEAQAIEAAGGRADRVRTEIKRFVSLENRFGGVAQPSVFKLVFNARSGRVLGAHLMDNAAPEIIQTFAVALRLGVKDAHLKTTMPLHPTVAEELFG

SEQ ID NO: 51757 - protein, 354 aa, Magnaporthe grisea 70-15
MPTELEELVGFIAHPNPQIRQVAAENLVPYSTTDVSLFKIEEFKPVKNLKILVRDHPKIAEHIIKILVNLSADQEILENLAKDEKFLEAIFARIVDPEEPNANLIAMLLANLAKSDSIKDPLLAKKQPASETLGSDDLVINQLFDLFVKGADGSYNKHANYDYLAYLFADLSKHADVRRHMLTAQKYDGVVPITKLRVFTNEETTASDVRRRGVASTIKNVAFDVDSHPRLLDDGEINVLPYLLLPIMGDEDYDEEDMLEMLPDLQLLPPGKKREPDSNIVQTHLETLSLLTTTRKGRDLMREVKVYPIIRETHLRVNDEEVREACDRLVQVLMREEGEDASEEDEDDRIVEIE

SEQ ID NO: 51758 - protein, 136 aa, Triticum aestivum
HYRTSLYKKAGWYRSGIPGIPSTHASAQLAGAPAAAAAKKRSGVTYVEGMNAYSGLKGLNKVTMLGVRKSADYKFARIVASLSPAGKRRGGSFGAQCNAAGEIFQIAVVMNALTLVGVAVGFVLLRAEAAFEESEE

SEQ ID NO: 51759 - protein, 109 aa, Musa acuminata
MDNGDLTQDLSKLNRDPSRILYISGHALESSLQPENCVPIKPWTLENDDTALLDLIPFLEYVAVHRPADIRPVLASYHGHDIASEFIERSKEHQRRMQDQKQHGRFWRR

SEQ ID NO: 51760 - protein, 178 aa, Streptomyces avermitilis MA-4680
MEQVHTPHVVVVMGVAGTGKTTIGPLLAARLGVPYAEGDDFHPPANIAKMSAGVPLDDVDRLPWLDAIGAWAHSRAGLGGVVSSSALKRSYRDRLRAAAPGVVFVHLTGDRELIEDRMSHRQGHFMPTALLDSQFATLQPLAADEAGVAVDVTGGPEEISERAVTALRALEPASQPAK

SEQ ID NO: 51761 - protein, 537 aa, Pinus taeda
MANGIKKVEHLYRSKLPDIEISDHLPLHSYCFERVAEFADRPCLIDGATDRTYCFSEVELISRKVAAGLAKLGLQQGQVVMLLLPNCIEFAFVFMGASVRGAIVTTANPFYKPGEIAKQAKAAGARIIVTLAAYVEKLADLQSHDVLVITIDDAPKEGCQHISVLTEADETQCPAVKIHPDDVVALPYSSGTTGLPKGVMLTHKGLVSSVAQQVDGENPNLYFHSDDVILCVLPLFHIYSLNSVLLCALRAGAATLIMQKFNLTTCLELIQKYKVTVAPIVPPIVLDITKSPIVSQYDVSSVRIIMSGAAPLGKELEDALRERFPKAIFGQGYGMTEAGPVLAMNLAFAKNPFPVKSGSCGTVVRNAQIKILDTETGESLPHNQAGEICIRGPEIMKGYINDPESTAATIDEEGWLHTGDVEYIDDDEEIFIVDRVKEIIKYKGFQVAPAELEALLVAHPSIADAAVVPQKHEEAGEVPVAFVVKSSEISEQEIKEFVAKQVIFYKKIHRVYFVDAIPKSPSGKILRKDLRSRLAAK

SEQ ID NO: 51762 - protein, 303 aa, Streptomyces avermitilis MA-4680
MRQVTRKGLMTVAAATGVLAATGGYAHADSGAYGSASHSPGVLSGNSVQVPVHVPVNVCGNTVNVVGLFNPAVGNQCANGGGGGHHDGGGHHGGGGHHGGGYGDSPSGGGGHHGGGGHQGGGYGDGPSGGGGGGGGSQAGGHTGDSPGVGSGNHVQVPVDVPVNVCGNNVTVGGLGNAAGGDACADTPGGGHATTPPGGGGGTTPPGGGGGGTTPPGGGGGGTTPPGGGGGTTPPGTPGHPGQPGGDSSAHPNHPGGQSVTQPEGTAQLAHTGSDMPLGLLVPAGAGALLGGALLYRRARSAA

SEQ ID NO: 51763 - protein, 225 aa, Brassica napus
  misc_feature (123)..(123): Xaa can be any naturally occurring amino acid
  misc_feature (190)..(191): Xaa can be any naturally occurring amino acid
MGETTTDSEHGIMLGFEDPMRIDPRRDRFPCCIVWTPLPFITWLVPFIGHVGICREDGVILDFAGPNFVCVDNFAFGAVSRYIQINKAKESSLSSGSCLFNEEGDTHEKEPTWDDALRKGTQXYQHYSYNILTCNCHSFVANNLNRLAMRSGGWNVVNLAVLVFLKGRWVSKTAMVKSLLPTVIIYAIGXXLGGWTFIASCCVLACLLTGWFIMGTYCFKKLIQL

SEQ ID NO: 51764 - protein, 104 aa, Zea mays
MSWRGKVFKGLVKGGTNRHRGGISADNIRGITKPEIRRLARRADVKRISLLIYEETRRVIKIFLENVIRDAVTYTDHARRKTVTVMDVLDALKRQGRTLYIFRG

SEQ ID NO: 51765 - protein, 122 aa, Phragmites australis
YTSNKFPTDYIPTVFDNFSANVVVDGTTVNLGLWDTAGQEDYNRLRPLSYRGADVFVLVFSLVSRASYENIMKKWIPELQHYAPGVPIVLVGTKLDLREDKHYLLDHPGLTPVATAQGEELR

SEQ ID NO: 51766 - protein, 448 aa, Clostridium perfringens str. 13
MEVKKYVDNLMEDLKKNNPGESEFLAAAEEVLYSLVPVLEKNPKYMEEGILERIVEPERVIMFRVPWVDDAGNVRVNRGYRVQFNSAIGPYKGGLRFHPSVNLSIIKFLGFEQIFKNSLTTLPIGGGKGGSNFDPKGKSDREIMRFCQSFMSELYRHIGPNTDVPAGDIGVGGREIGYMFGQYKKLKNSVDAGVLTGKGLTYGGSLARKEATGYGLVYFVDEMLRDNGQTIEGKTVVISGSGNVAIYATEKVQELGGKVVALSDSSGYVYDENGIDLEVVKEIKEVKRGRISEYVNYVKTAKFTEGFRGIWNVKCDIALPCATQNEIDKSSAKTLIDNGVIAVGEGANMPSTLEAQKLFVDNKILFAPAKAANAGGVATSALEMSQNSLRMSWTFEEVDAKLKDIMKNIYYNSRNAASEYGHDGNLIVGANIAGFKKVADAMLDHGII

SEQ ID NO: 51767 - protein, 353 aa, Yarrowia lipolytica CLIB122
MTVRDWANRGQTYVNARAPNLLGRFRSTDDEDENNPSTELATDTTSAYGSTAASVVTMANSKPDDVSLYATSSHHHEYFTGSAWIHPVYTKEQMDALEVNHRKTETFSDRVALRAILLMRIIFDLCTGYKHPKEGEAHLPKFRMTTRQWLDRFLFLESIAGVPGMVAGMIRHLHSLRALRRDRAWIESLVEEAYNERMHLLTFLKLQKPSVQMRTGLLIGQIIFYNLFFISYLISPATCHRFVGYLEEEAVITYTRCLEDIDAGRLPELASMEVPDIARTYWHMEDDCTMRDLIQYVRADEAKHCEVNHTFGNLHQTSDRNPFALVIDNGRPQPSKDLTTFRSVGWRRDEIAN

SEQ ID NO: 51768 - protein, 489 aa, Frankia sp. CcI3
MSRAPHVRSVAAPPSTAKTSDIKTSDRVPGSGEGPVEAIRRLRADPLTRLNELARAHGPVVRLASWPVSAFLVTDPDAIADALVSGHRAYAKGAVRRGAGSRRTVVQPLALLLGQGLLTSAGDTHRQQRRLLQPLFHKQRIAGYADAFAAIADKTADGWRDGQRLDVHTEMTEMTLAIVARTLFDVDLDSHVVDVIRAALDQNMPAARRAQLPGFTTLERLPLPAPRRRRDARNALDRVVHDLIADRRATGATGNDLLSLLLTARDADTGASMDDSQVRDEALTLLLAGHETTANALTWTFHLLGRDPEVLATLQAELDRVLGERRPTIDDLPQLPYTNAVISEAMRLYPPVWAMGRHLVEDRDVAGYRLPAGSTLVFSQWVVHRDERWWPRPELFDPIRWTGPDTADEPADAGPKMRPRFAYFPFGAGPRQCIGNTFAITEGVLALAAIARRWSFTPVPGLPVTPQPLVTLRPKDGLPMIAHGRYPNR

SEQ ID NO: 51769 - protein, 393 aa, Rhodopirellula baltica SH 1
MPEVSSASNHRFQPSSNRQRVNMHPWIADRTASFDSSGIRKVFDLAAKLKDPINLSIGQPDFDVPEEIQDATVDAIRSGKNAYSPTQGIAPLREKLLAEINAKYPGQNRDVFVSSGTSGGLVLSLLSMINPGDEVIFLDPYFVMYPALVSLCGGIPVTVDSYPDFRLDPAKIEAAITPKTKMILVNSPANPTGVTASEQDLRDVGDLAAKHNIALLSDEIYSRFFYDGDFASPAATNPDTIVIDGFSKSHAMTGWRVGYVHGPPEIIATMLKIQQYSFVCSPQPAQWGALRAMEISLDGHIDDYRRKRDFMVEQLSPHFELTSPGGAFYLFPKAPGTEGGTAFVERAIADGLLIIPGKIFSSRDSHFRVSFAASDDTLRRGAERLIKLAGDNR

SEQ ID NO: 51770 - protein, 341 aa, Clostridium perfringens str. 13
MDKKTAIDWNNLGFSYMKTDYRYISHYKDGKWDEGKLVTDNKLSISEASTALHYGQQCFEGLKAYRTKDGKIQLFRVDENAKRMNKSCDKLLMPEIPVEKFIDACMQVVKANERFVPPYGTGATLYIRPFMIGVGDNIGVKSAPEFIFSVFCLPVGAYFKGGMKPVNFMIADYDRAAPKGTGAAKVGGNYAASLKAHEIAAKKGFADCIYLDPATHTKIEEVGAANFFGITKKGEFVTPYSESILPSITKYSLMQIAKDYLKMPVSERDVLIDNLDEFAEAGACGTAAVITPIGGIEYKNKLHVFHSETEVGPITKKLYDLLSGMQFGDVEAPEGWIFEVK

SEQ ID NO: 51771 - protein, 183 aa, Arabidopsis thaliana
MPSSSEEIVSAGESSEIEEAVASLTMSSNKILLTSSDGESFEIDEAVARKFLIIVHMMEDNCAGEAIPLENVTGDILSKIIEYAKMHVNEPSEEDEDEEAKKNLDSWDAKFMEKLDLETIFKIILAANYLNFEGLLGFASQTVADYIKDKTPEEVREIFNIENDFTPEEEEEIRKENAWTFNE

SEQ ID NO: 51772 - protein, 297 aa, Escherichia coli O157:H7 EDL933
MATNLRGVMAALLTPFDQQQALDKASLRRLVQFNIQQGIDGLYVGGSTGEAFVQSLSEREQVLEIVAEEAKGKIKLIAHVGCVSTAESQQLAASAKRYGFDAVSAVTPFYYPFSFEEHCDHYRAIIDSADGLPMVVYNIPALSGVKLTLDQINTLVTLPGVGALKQTSGDLYQMEQIRREHPDLVLYNGYDEIFASGLLAGADGGIGSTYNIMGWRYQGIVKALKEGDIQTAQKLQTECNKVIDLLIKTGVFRGLKTVLHYMDVVSVPLCRKPFGPVDEKYLPELKALAQQLMQERG

SEQ ID NO: 51773 - protein, 463 aa, Legionella pneumophila str. Lens
MDLFRKKDIKGSPDSESHLAKCLSVFDLTFLGVGAIIGAGIFVLTGIVAATISGPAVIFSYVVAGFACAFAALSYAELAASIGGCGSAYGYAYAGFGELIAWIVGWDLLLEYSIAVSAVSIGWSGYANDFLMALKIFIPTHLLHGPADGGDLNILAILIIAVLTTLLIVGVKSSSRFNNIMVLVKLLVIFIFIAIAFGEVKVENWSSFMPYGWAGVMKGASIIFFAYVGFDAVSTAAEEAINPQRDLPIGIIASLAICTVIYILVSGLLTGIAHYTTLNVSSPISHVLLVLGYKTAAGLVGVGAIAGLTTVMLVLFYGLTRVFLAMSRDGLLPRFLSKTNEHTKTPIRIILLCGILMASLASVTPIGTLAELVNIGTLFAFIVVCGGVLYLRRTHPDMERPFKTPFMPYVPILGIISCFYLILNLPWVTILRFIIWMLVGIAVYFAFSRTNSALSVEGDCAAE

SEQ ID NO: 51774 - protein, 447 aa, Solibacter usitatus Ellin6076
MGQPILAAAAFQAASPFTLGTPPTARPSSKPLYALPQSGPTNRPWAFPAPPKSQLYILGPMRIFALFLCALACAAATPEYSGELIFPLEKWHNHSSSVVELPNGDLLVCWFHGSGELTADDVLIQAARWNHTTKQWSAPFTLADTPGFPETNPVLFLDSHQRLFFAWPLIVAHKWETALMKYRISTDYQQPSGPPKWEFQDNIVLIPKDIAALTKEFAGAEAAGTGPRADRAKKQIEHAEDEYFSRMGWFTRTHPLELPSGRILMPMYSDGYSYGIMAISDDGGYTWTASQPIVGEGCIQPSVVRKKDGSLVAYLRDNGPPPKRAHISYSKDDGVTWTRARDTEIPNPGTSLENIRLRNGNWIMVYNDLEQGRYSLVAAMSDDEGATWKWKRHLDGSPSGARTSQYHYPSVIQARDGAIHVTYSYFTPEGKAIKHVRFNEDWVKAGD

SEQ ID NO: 51775 - protein, 667 aa, delta proteobacterium MLMS-1
MAPTRKDLANAIRALSMDAIQQANSGHPGAPLGMADIAQVLWNDFLKHNPANPSWPDRDRFVFSNGHGSMLLYSVLHLTGYQLTIEDLKNFRQLHSPTPGHPEYGYTPGVETTSGPLGQGIANAVGMAIAERTLAAQFNHPGHAIIDHHTYVFLGDGCLMEGISHEACSLAGTLGLNKLIAIYDDNGISIDGEVDGWFTEDIPGRFEAYGWRVIPAVDGHDPEAVKQAIEQARAEEQRPTLICCKTIIGCCSPNKQGKEICHGAPLGDEEIELTRKEMNWPHPPFVIPEEIAAAWNARQRGDQAEAAWRDRLAAYRQQFPAQAAELERRLAGELPANWPQQATDFIAASEEKAAKVASRKASQLTLEGYGPLLPELIGGSADLAGSNLTIWSGSRDIKQQADGNYIYFGVREFAMVAIGNGLALHGGFIPYTATFLIFSDYARNAIRMAALMKQRAIFVLTHDSIGLGEDGPTHQPIEQAASLRLIPNLHVWRPCDAVETAVAWKAGVERVDGPSALLLSRQGLPHQSRTAQQSADIARGGYVLLDCQGQPETILLATGSEVELAMAAARQLNEQGRKIRVVSLPCLELFAAQDEAYRQQVLPDSVEHRVAIEAGCTAGWYKYVGRRGQVIGLDRFGESAPAEQLFELFGFTVEKVVAAVVSVHQGQ

SEQ ID NO: 51776 - protein, 390 aa, Oryza sativa
EIIDMCDYAVGLSRQLNGSIIPSERPNHMMMEVWNPLGVVGVITAFNFPCAVLGWNACIALVCGNCVVWKGAPTTPLITIAMTKIVASVLERNNLPGSIFTAFCGGADIGQAISLDTRIPLVSFTGSTKVGLMVQQQVNARFGKCLLELSGNNAIIVMDDADIQLAVRSVLFAAVGTAGQRCTTCRKLLLHESIYRTFLDQLVEVYKQVRIGDPLENGTLLGPLHTPASRDAFLKGIQTIRSQGGKILYGGSAIESEGNFVQPTIVEISPSAPVVREELFGPVLYVMKVQNLKEAVEINNSVPQGLSSSIFTKRPDIIFKWIGPHGSDCGIVNVNIPTNGAEIGGAFGGEKATGGGREAGSDSWKQYMRRATCTINYGSELPLAQGINFG

SEQ ID NO: 51777 - protein, 341 aa, Glycine max
  misc_feature (180)..(180): Xaa can be any naturally occurring amino acid
  misc_feature (213)..(213): Xaa can be any naturally occurring amino acid
  misc_feature (237)..(237): Xaa can be any naturally occurring amino acid
  misc_feature (239)..(239): Xaa can be any naturally occurring amino acid
GSPKASLNVNKEQEEVLRSKPSILALIDELDKLRQPLATALSEELQINDTSSQNPHHETEIENETLAESSGSIEPNSNSRNDVVVEDLLNFLYFGSLFDVKSDFVSTMLTRTHERGCCLTYDYVIDDATDLLGEKDLDSISALRGLLVSRPADSSFSHKSVLHCCVEHAKLWLAKSEQPXVPDADVTYAALREESETRLCLRKCFTTTPEMKXPVEVAAAAAGGNYVSFHVPVHGCXVXKKTEAENAGEVVSVQHEQTNQQVDLEYNERDVEAKDQQSYPRRGYQNHRGGRGGGGRRGYSNGRGGRSGGRGGYQNGRNQYYCLNTIKLEREGGKESPGGFI

SEQ ID NO: 51778 - protein, 515 aa, Glycine max
MASMAAIGSLNVPRSASSRSSFVGRKSVPRSLSFSASQLCGDKIPTDSVLLAPKIGRSPVIVTPKAVSDSQNSQTCLDPDASRSVLGIILGGGAGTRLYPLTKKRAKPAVPLGANYRLIDIPVSNCLNSNVSKIYVLTQFNSASLNRHLSRAYASNMGGYKNEGFVEVLAAQQSPENPNWFQGTADAVRQYLWLFEEHNVLEFLVLAGDHLYRMDYEKFIQAHRETDADITVAALPMDEARATAFGLMKIDEEGRIIEFAEKPKGEQLKAMKVDTTILGLDDERAKEMPYIASMGIYVVSKNVMLDLLREKFPGANDFGSEVIPGATSIGMRVQAYLYDGYWEDIGTIEAFYNANLGITKKPVPDFSFYDRSSPIYTQPRYLPPSKMLDADVTDSVIGEGCVIKNCKIHHSVVGLRSCISEGAIIEDTLLMGADYYETEADKRFLAAKGSVPIGIGRNSHIKRAIIDKNARIGENVKIINSDNVQEAARETDGYFIKSGIVTVIKDALIPSGTVI

SEQ ID NO: 51779 - protein, 659 aa, Anaplasma phagocytophilum HZ
MQYSTQLTEMASAIRLLSVDAIQNAASGHPGMPLGMADVAAVLFSKFLRFSVQNPNWINRDRLVMSNGHGSMLIYSILHLLGYISIDDIKKFRQLHSITPGHPEYGCTPGIEATTGPLGQGLGCAVGMAIAERMLAQRFGGDLIDHYTYVMAGDGCLMEGISHEAASLAGHLGLGKLIVLFDDNGISIDGKISLASSDNVAARFASYGWDVWEVDGHDFGHVYAAIASARETNRPSIIACKTIIGKFMRSKENTSAAHSWPFTPADAQEVRESLGQGESKAFEVSTDASALWKEVRERAELEYESWLSKSEQCDKIGELNAATTKGVPESVFEGLDEHFRDLGFAEATRKSFGRALEFFSQRVNNLVGGSADLTSSNNTKASWMKPITKEDFSGSYIHYGIREHAMAACMNGMALHAGVIPYGGTFLVFSDYCRPAIRLSALMALQAIYVMTHDSIGVGEDGPTHQPVEHLASLRAIPNLYVFRPADAVEVLECWEIALKLTKSPSLFVLSRQNVEPMRSELGRENRSGRGAYILREFEGDLRVTIFATGTEVGVAMAACDILHKTYGVGTRVISMPCWRLFDQQEKKYISGLLDNNSLKVAVEAGSSVGWHKYIGRDGIFIGLDEFGASGKCEDLYAHFGITKENLVSKVLARLHPAV

SEQ ID NO: 51780 - protein, 439 aa, Prochlorococcus marinus str. MIT 9303
MPALSSTMTEGKIVEWLKQPGDKVGRGESVLVVESDKADMDVESFQDGYLAAVLMPAGRSAPVGETIGLIVESEAEIAAVQANAPAAPASDPAPLKAAAKVVDDHAPASTPAPVVESPPVAAPPPVTSQAVESDKRIVASPRAKKLAAQMGVDLAKLRGSGPHGRIQAEDVQLAAGQPISVPQVAEGNASFATTHATSAGVAHAVSSPVGQSFGAPGETAAFNNLQQAVNRNMEASLAFPCFRVGYTITTDQLDAFYKQVKPKGVTMTALLAKAVALTLVRHPQVNAAYSTAGMVYPEQVNVAIAVAMDDGGLITPVLQNADRTDLYEMSRQWADLVKRSRSKQLQPEEYSTGTFTLSNLGMFGVDRFDAILPPGTGAILAVAASRPAVVAGKDGSIGVKRQMQVNLTADHRVIYGADGAAFLKDLAELIETRVESLAL

SEQ ID NO: 51781 - protein, 310 aa, Zea mays
MKKLYQGGHAPRPGLRGFGPTGALANLGEGKPKQQHELRVCHPAATPNSNVLADESLPPPPTHPPTPARRLRLAFRRAVGWHLTPQGRGPVRRESEAEALSQSREMKKLCQGGKKGRRVHPAPADADAAVALPAAVLALASALTAEEQEVLAYLLSCGGAAVVGGRPRRRRGPHPPEMGCACFGCYKSFWARWDASPNSHLIHRIIDAVEDGGPPRRTHRRRRGGGRRGGDGGAGMGMDMDMGHRRHGEYEGAGDDEEEEEVGGSSMDSDVDGDDASVASEGDCSFGDAEKSTVGRLVRFIGEKVWGAWN

SEQ ID NO: 51782 - protein, 882 aa, Francisella tularensis subsp. tularensis SCHU S4
MRGVFMSKFVYAFSEGNKSMRDLLGGKGANLSEMLNSGLPVPDGFTVTTEACLKYYDDRQKLSNEVKEQIFAHIKDLEKRTGKTFGGGNNPLLVSVRSGARVSMPGMMDTVLNLGLNDTVAQAMVAKTNNEQFVYDSYRRFIMMFADVVMDCEKKPFDKVLEDKKAKRKVKNDCDLPAQDYKDIVTEYKKIYKDLVGKDFPTDPIEQLLAAVEAVFKSWNAERAIIYREINNISNNWGTAVNVQEMVYGNSGNNSGTGVAFTRNPSTGENELFGEYLINAQGEDVVAGIRTPAHISTLKDKMPEVFNDFVKIAKNLEKVYKDMQDMEFTIEDGKLFMLQTRNGKRTAKAALKIAVDMAKEGLITNEETVMMVEPHLLEQLLHPKFDEKALASKRPLGSALGASPGAASGRIYFDVESLLAAKARGEEKTILVRIETSPEDIAGMNACNGILTLRGGMTSHAAVVARGMGKCCVSGLESARIDEEKKTITFERGQVFTEGDYLSLDGTKGTVYRGIIKTVDPEVTKDFEDFMKFVDSVRKLRVRCNADTYKDASIARAFGAEGIGLCRTEHMFFEEDRISYVRQMILAKDKKERQRALDKLLPVQQQDFEELFEAMDNLAVTIRFIDPPLHEFLPHEVDEIDDLAREFNISYSELEARIEALSEVNPMMGHRGCRLAVTYPEIIEMQTKAIIYAAISSKRMGIEVKLELMIPLVSTLGEFKLLSGIVREVADTILKREKIDIDYKVGVMLETPRGAIGAGMLAAAGSEFFSFGTNDLTQMTFGFSRDDANKFIKDYLEKGILSFDPFARLDIKGVGKLMQIAKEGVKAVNPNAKMGICGEHGGEPYSVGFCHDLDLDYVSCSPFRVPIARLAAAQAKIYADRR

SEQ ID NO: 51783 - protein, 295 aa, Francisella tularensis subsp. tularensis SCHU S4
MIDKIWKNGEIISYQDAKVGINTHSLHYGSSVFEGIRAYDTPNGIGVLKLREHMQRFMYSMNVLGMTCKYTLDELCQAVLDTVKASGKKSCYIRPLAYFAEGGVNVLPAKDHPVDITIYCIDMGKYMAADKVDIKVSKYIRIHPRSTVCDAKIGGHYVNSILASRETLGTHYHESLLLDADGFVAEGAAMNVFFVKDNEVITTPLGTILDGITRRLIIQIAKDLEYKVTERLFKVDELINADEVFFCGTAAEITPVASIDDNKLKRSDYTITNQIKEVFEKLKQGQVYKEALTYI

SEQ ID NO: 51784 - protein, 315 aa, Clostridium perfringens str. 13
MNKVFCIGELLIDFIGKDIGKGLKNGVNFEKKAGGAPANVGAAVCKLGGESYFLGQVGNDSFGEFLVDMLKNIGINTEMTKMDGYTTLAFVAIDEKGERDFEFHRGSDGEYSFNNIDLSKIEKDDIIHFGSATGFLKGELKNTYFKLLEIGRKNGNFISFDPNYRDMLIKEEGIEEFKEDCKKFISSCDFLKLSDEEIKLLTEEEDLERGVEKLHSLGAKIIAVTLGGKGTLLSNGIHSEIVPSIKINQVDSTGAGDAFVGAVLKKVSELKDKKNLDLNSWREIISYGNKVGALTCTNYGAIDAIPNEEDLMKYI

SEQ ID NO: 51785 - protein, 416 aa, Zea mays
  misc_feature (330)..(330): Xaa can be any naturally occurring amino acid
MMAEGPNFAGMIGGHDNGGDFCDMAYYRKLGEGSNMSVDNLNSMQTSTHGGSIAMSVDNSSVGSCDSHTRMLNHPGLKGPVVGNYSVGGHSIFRHGRVSHALSDDALAQALMDPRYPTETLKDYEEWTIDLAKLHMGMPFAQGAFGKLYRGTYNGEDVAIKLLERPEADPERAGLMEQQFVQEVMMLATLRHQNIVKFIGACRKPVVWCIVTEYAKGGSVRQFLAKRQNRSVPLKLAVKQALDVARGMAYVHGLGFIHRDLKSDNLLISGDKSIKIADFGVARIEVKTEGMTPETGTYRWMAPEMIQHRPYDQKVDVYSFGIVLWELITXGMLPFANMTAVQAAFAVVNKGVRPAIPQDCLPTLAEIMTRCWDPNPDVRPPFTEVVRMLEHAEMEILSTVRKARFRCCMSQPMTTD

SEQ ID NO: 51786 - protein, 1062 aa, Lactobacillus johnsonii NCC 533
MPKRTDIHKIMVIGSGPIIIGQAAEFDYSGTQACLALREEGYEVVLVNSNPATIMTDTTIADKVYIEPLTVESISRIIRQEYPDAILPTLGGQVGLNMALSLAKTGILDELNIELLGTRLSSIEQAEDREKFKELCKELGEPVPPSTTVNTVEEALEFGDRIGYPIIVRPAFTMGGTGGGICNNHEELAKIAKNGLELSPVTECLIEKSIAGYKEIEFEVMRDHDDNAMIVCCMENFDPVGIHTGDSIVFSPSQTLSDKEYQMLRDCSLRLIRALKIEGGCNVQLALDPNSFDYDVIEVNPRVSRSSALASKATGYPIAKMAAKIAIGMTLDEIKNPVTRTTYAEFEPALDYVVCKIPRWPFDKFSKADRTLSTQMKATGEVMAIGRTAEEAMQKAVRSLEIDEKDLYSETAHHASDEEIEQKLVKAQDDRLFYLAEAFRRGYSLEDVHELTKINFYFLDIVSHMVEMEKNIQENKDNLETLRLAKKYGFSDATIATLWNESIDQVRDLRKKNGIIPVYKMVDTCAAEFESKTPYFYSTYDGENESHKSGKKSVIVIGSGPIRIGQGVEFDYATVHCVKALQKMGYEAIVINSNPETVSTDFSISDKLYFEPLTLEDVLNVCDLEKPEGVIVQFGGQTSINLAAGLKDHGIKILGTSVKDLNRAEDRELFDQIIKKLKLNQPKGLTATTHEGVIKAAEELGYPVLVRPSYVLGGKAMEIVYNKSELEEYLHDHVDIAADHPILVDDYLDGRECDVDAICDGQDVLLPGIMEHIEHAGVHSGDSMAVYPPQNFTDEVKDKIMDVTRKLALTLNCVGIMNIQFIVRNGEVYVIEVNPRASRTVPFLSKITGIEMAQVATRVIMGESLAQQGYSDGLAPEPEMISVKAPVFSFSKLADVDSYLGPEMKSTGEVMGSDHTFAKALYKAFAGAKMQLPENGNVLLTIEDKDKEKILPIAKRFARIGYRIFATKGTADFLKNNGLHVDLVTKVHESENADDNILNELREGRIDLVINTMGHDIEKNSDGFIIRQMAIQQNVPLLTALDTADALLTSLENRSFATDALK

SEQ ID NO: 51787 - protein, 241 aa, Oryza sativa (indica cultivar-group)
MDMGAMSDPERMFFFDLACQNAKVTYEQNPHDADNLTRWGGALLELSQMRNGPESLKCLEDAESKLEEALKIDPMKADALWCLGNAQTSHGFFTSDTVKANEFFEKATQCFQKAVDVEPANDLYRKSLDLSSKAPELHMEIHRQMASQASQAASSTSNTRKIWHNFHMVDFKIYVDNDPTFSIPAKNPYPSQARDSEILWQSRKKKDSDFWYDVFGWVVLGVGMVVWVGLAKSNAPPQAPR

SEQ ID NO: 51788 - protein, 136 aa, Glycine max
  misc_feature (56)..(57): Xaa can be any naturally occurring amino acid
  misc_feature (67)..(67): Xaa can be any naturally occurring amino acid
  misc_feature (73)..(73): Xaa can be any naturally occurring amino acid
  misc_feature (81)..(81): Xaa can be any naturally occurring amino acid
  misc_feature (105)..(105): Xaa can be any naturally occurring amino acid
  misc_feature (111)..(111): Xaa can be any naturally occurring amino acid
  misc_feature (119)..(119): Xaa can be any naturally occurring amino acid
SRFDRSLLKISLKKRGGGVGAGKGGKGLGKGGAKRRRKGLPDNIQGITKPAIPRLXXRGGVKRISGXGGGETXGVLKIFLXNVIRDAVTYTEHARRKTVHGMDVXYALKRXGRTLYGVXGGGLGLFLGLDLCFAWL

SEQ ID NO: 51789 - protein, 389 aa, Clostridium tetani E88
MDVKEMALKLHSEKKGKLEVVGKISVKNREDLALAYTPGVAEPCVHISKDKNKVYEYTTKGNMVAVVTNGTAVLGLGNIGPEAALPVMEGKALLFKEFANVDAFPICLDTEDPEEIIRTVKLMAPGFGGINLEDIKAPECFYIEERLKKELDIPVFHDDQHGTAIVVLAGIYNALKIVDKKLEEAKILINGAGSAGIAICKLLLNAGACNIVMCDINGSLVEGDENLNPAQKEIAKVTNKEKEKGKLVDVIKDKDIFIGVSGPKILTKEMVSTMAKDSIVFAMANPEPEILPDEAKAGGARVVATGRSDFPNQINNVLVFPGIFRGALDVKAREINEEMKIAAARGVANLIKEEDLNEEYIIPDPFNKEVAESVSKEVRRIAKEMNICK

SEQ ID NO: 51790 - protein, 507 aa, Zea mays
MGRPQPARAGAINIEACARPIAVDHRISLPYYFRIAGSLLRQANIYRNESNLLDLYVILLRYSSLLCETIPKHRDYHAFKLREKAFFDKLIDIIKELETLKPVVQRQVVEHNRGSTVEFNTNSLNGNYGTTRRIEQCTPSSYTPQTFVGSSNGALQKPFHAGRQVASLSSVQKQFMNLPYPKEETLARHSILGPNGLNGRWNGPVTGIKVQYPSNFELTQNGITSLVPSILNQDDLHGSNTAPAPPPPSSSSNDNDNMKSVLSLDDGRWSVPAEEHTPLPSANLEEELFQLNIKQPSPPPVLAEVQRPISPSRVADPTPGLPTSGTARFQNLHVPIKLMECFLRVAESNTKRSLETCGVLAGTLKNRTFYVTTLIIPKQKSTSDTCEATNEEELFEVQDTYSLFTLGWIHTHPTQSCFLSSIDVHNHYSYQVMLPEAIAIVMAPTDTRKHGIFHLTDPGGMGVIHDCQERGFHPHKAPLDGSPIYEQCSHVYMDTDIKFDMIDLRQR

SEQ ID NO: 51791 - protein, 294 aa, Picea abies
MEQYEKVEKIGEGTYGVVYKARDRLTNETIALKKIRLEQEDEGVPSTAIREISLLKEMQHGNIVRLQDVVHSEKRLYLVFEYLDLDLKKHMDSCPELAKDPRLIKTFLYQILRGIAYCHSHRVLHRDLKPQNLLIDRKTNALKLADFGLARAFGIPVRTFTHEVVTLWYRAPEILLGSRHYSTPVDVWSVGCIFAEMVNQRPLFPGDSEIDELFKIFRVLGTPNEETWPGVTSLPDFKSAFPKWPAKDLATVVPGLEPAGIDLLSKMLCLEPSKRITARSALEHEYFKDLGFVP

SEQ ID NO: 51792 - protein, 170 aa, Acinetobacter sp. ADP1
MIVIAMGVCGTGKSLIGELLSARLACEFLDGDTLHSAANKSKMSQGIPLTDEDRLPWLQAIRQAIEAKQKMGQTAVFTCSSLKRMYRDILRGDDQNVQFIYLKGSFELLQQRLAERAGHFFDPSLLQTQLDTLEEPDVNEAIIVDITLTPKQIIEQITQKLGISNSVCRG

SEQ ID NO: 51793 - protein, 243 aa, Rhodopseudomonas palustris CGA009
MRAHQIMTRQLVTIGPEASIVDAANAMIDNHVSGLPVVDDDGKLIGIISEGDFIRRAEIGTQRKRGRWLRMLLGPGTCAGDFVHEHGRKVGEVMTQHPYTISEDTSIETIVKLMEKHHVKRFPVMRGDLLVGIVTRKNLLRAVADLARQAPEPNAADDKIRDKIISEIERNDWRPFGLSVLVRDGVVHINGVITEERSRQAAVVVAENVCGVREVHDHLCWVDTMSGFYLNSPEDDRAAKKAS

SEQ ID NO: 51794 - protein, 937 aa, Yarrowia lipolytica CLIB122
MASIIDGNSIAKNIRERLHTEIADVQQTNPRFQPSLVIIQVGDRPDSSTYVRMKLKAADEAAIKCELKKLDENVSQHELLREITHLNEDPSVDGVLVQLPLPKHIDETTITNAVAADKDVDGFGPLNIGELAKRGGNPSFVACTPKGVMELLKVAGIDVAGKTAVVLGRSDIVGAPVSYLLRNADATVTVVHSKTANIPEIVKTADIVVAAIGQPGFVKGEWLKPGAVVIDVGTNYIPDDTKKSGQRLVGDVDFESAKNVASHITPVPGGVGPMTVAMLLDNVVLSAKRQAEKLTARSITPLPLKKENPVPSDFAISRAQEPKHITEVAAEIGVLPSELEPYGAYKAKVQLPILDRLAHRKNGKYVLVTGITPTPLGEGKSTTTIGLVQALGAHLGKMAFANVRQPSMGPTFGIKGGAAGGGYAQVIPMDEFNMHLTGDIHAISAANNLLAAAIDTRMFHESTQKDAALYKRLVPAKKGVRTFTRGMQTRLKKLGIDKTNPDDLTEEEIAKFVRLDIDPETITWRRVVDCNDRHLRGITVGQAPTEKGRTRETGFDISVASECMAILALANDLEDMRERLGNMVIGSSKNGDPVTCDDIGAGGALTALMKDAIKPNLMQTLEGTPVFVHAGPFANISIGANSVLADKMALKLAGTEPNESDDKAGFVVTEAGFDFTMGGERFFNIKCRSSGLAPDVVVIVATVRALKSHGGGPEVKAGAPLPKEYTEENVELLREGCKNLGKHIENARQYGLPVVVAINEFVSDTAAEHDVIREEALKYGAEDAVVAKHWAEGGAGAVDLAQAVVDASNKIDKDFKLLYEADTTAEEKLNTIAQKMYGAKDVELSELARKKIDAYTKQGFGNLPICVAKTQYSLSHDPTLKGVPTGFTVPIRDVRASVGAGYLYALAAEIQTIPGLPTHCGFMNVEVNDKGEIEGLF

SEQ ID NO: 51795 - protein, 359 aa, Oryza sativa (japonica cultivar-group)
MDGGGVDGYEMEMVRNRKVVLRRYVTAGYPTVDDMEVVSSTMMPRVPLGTMAPAVMVKNIYLSCDPWMRGRMTKHDDATAEIAEDFVLGEAMVNFGVSKVVDSTHPVFAAGDLVWGLCGWEEYSLITQPETLHKINHPDLPLSYYTGVLGVTGLTAYAAFFEVGKPKKGETVFVSAASGAVGQIVGQLAKIAGCYVVGSAGSDEKVTLLKTKFGFHDAFNYKKESNDLTGALRRCFPDGIDIYFDNVGGATLDAALVNMRRGGRVVVCGMISQYNLQEPEGVHNVIQILSKTIRVEGFAVFNHFGLYPMFEDEMARYLKEGKVTVLQDVVKGIEKASEALIGMFSGRNVGKLLVAVADE

SEQ ID NO: 51796 - protein, 259 aa, Zea mays
LPVRLTLSSGTAVGVAQAALSFCQTGQWSGGVTAVTSALPGARVRIEVSGHLCVKCPCNLVSRCGDLVKVASERSQGLGQAGDVSAKKRGPRARQKSLELYADGGYQLRIRRLEGAYLCRTGRGKVSLAAITLDDYLPMRSTEVKNRTSTDDITRLRLITAVKTPYLPDGRSRIKVISNTRRNSTIEAVHATEQGFIVRMHDVLHINPYYGKTSAEGMISHIEAILPMDPTIIYNVPSRSAQDIPPEVIVAISGYSNMS

SEQ ID NO: 51797 - protein, 527 aa, Neurospora crassa
MFGGGSSSAASKSVSGSASDSGSSGKDRSSSKSPSPEKEAPGNGGASPKSIKSADQSTAGDTQIGNGSPPSAGSSSDSKKKRSSGVSGRASSLIAQAKNTLFTQVANRNSGDMSTDSKNSNQTSLQKLGKQDQALAVPQGQHNNAAGESLPGPRSTFKVGVWEDRNKKCRRTMEDTHAFLYNFLHTPAPTDNGYFAIFDGHAGTFAADWCGKKLHIILEDIIKKNPNAPIPELLDQTFTTVDTELEALPLKNSGCTAAVASATRQRVLYTANVGDARIVLCRSGKALRLSYDHKGSDENEGKRIANAGGLILNNRVNGVLAVTRALGDTYIKDLVTGHPYTTETVIQPDWDEFMIIACDGLWDVCSDQEAVDLVRDIQEPVIAAKKLVDHALSRFSTDNLSCMIVRFDKQALLENQNNKDSAIGVEGDATTAAGTVTESEKIVTATKQKIAEGSTPAVGISASNFGRGHDPTPLEDGEKKPFVPTTIEGSVEEEPVVLSDSPEATPDGSVTAMKLDSLPEAKKSLDA

SEQ ID NO: 51798 - protein, 467 aa, Musa balbisiana
MEAKSTGRFTLGKQSSLAPDRDDGELQALRSGDLDGLQVPEEVDANIRLMYLANEGDLAGIEETLASGVDVNFRDIDDRTALHVAACQGFADVVQLLLDRGAQVDPEDRWGSTSNFITIAPAKQPLADAVHYKNHEVIKLFEKHGAKLRVTPMRVENAREVPEYEIDPSELDFTNSVNITKGTFIIAKWRGIQVAVKKFNDDVMADEDKLWDFFIFCRRAFRDELALLQQIRHPNVVQFLGAVTQSSPMMIVTEYLRKGDLRAYLNRKRTLRPSSAVLFALDIARGMNYLHEHKPEAIIHRDLEPSNILRDDSGHLKVADFGVSKLLKVAKTVKEERPLTCLDTACRYVAPEVFLNEEYDTKVDVFSFALILQEMIEGCPPFSYKQDNEVPKAYVSKQRPPFRAPPKQYAHGLKELIEHCWSENPADRPTFREIIDRLSKIQNHIAQKRRWKVSLFNFYLGLQLFSL

SEQ ID NO: 51799 - protein, 452 aa, Brucella melitensis 16M
MRDSNFLIENNARHLWHPMAHPAEMQANPPRIVNGGEGVEVIDIHGKKVLDAVGGLWNVNLGYSCEPVKKAIRDQLDSLPYYSTFRGTTNSPLIELSYELAEFFKEDGLTRAFFTSGGSDSVETALRLARQFHKINGQPERTKFVSLKKGYHGTHFGGASVNGNANFRRNYEPLLPGVFHLAAPYPYRNPFNMDDPAAIAAAIARQFEDEIAFQGADTIAAFIMEPVLGAGGVIVPHESFMPLMREICDRHGILLIADEVITAFGRTGAWTGSRGWGVKPDMMTTAKAITNGYFPFGAVMISDKVASVFEANKNSLGAIGHGYTYSGHPVGAAAALATLKETARANTAANAGARGVELMAGLNQLKEKHELVGDVRGKGLMAALELVSDREKKSAAAKTVVQKVYDVAYEEGVMVRTSGANVIISPPLVITPADVNRIVSALDAGLSAAKGQ

SEQ ID NO: 51800 - protein, 295 aa, Sorghum bicolor
MAAATAAAASTMSLPPISQLRQQQHGAGAVVVFRRRARDARRRRYVVPTARLFGPAIFEASKLKVLFLGVDEESNNKHGHPTTPSPTSPPLPLLPRTYTLTHSDVTASLTLAVSHTINRAQLQGWYNRLQRDEVVAEWKKVRGRMSLHVHCHISGGHFLLDLIAGLRYYIFRKELPVVLKAFVHGDGDLFSRHPELEDAPVWVYFHSNLTRFNRVECWGPLRDAAAPPAEDDSTAPAAASNKDGQMPPVGEWPYRCPQQCDCCFPPHSLIPWPNERDMAAAAADASSAAGQAQQQ

SEQ ID NO: 51801 - protein, 549 aa, Musa balbisiana
MDNDNDNDAYVVATSSLKLSMPDSDLYKDARISPVSLTYYGLCLLEGNYSVKLHFAEIKITNDGYGSLGKRIFDIYIQGNLVWKDFNIRDEANGSGNAIIKSTNVMVTDKLEIHLYWAGNGTQSLPVRGTYGPLISAISVEPNFSLSSGRHTKIIVGIIVSVSCLIFLLLSILWKKGWLGGQTAKDREMRALDLRTGRFTLRQIKMATRNFSASNKIGEGGFGPVYKGLLPDGTIVAVKQLSSKSKQGNREFLNELGMISALQHPNLVKLHGCCIEGNQLLLVYEYMENNSLARALFGSEEYQLKLDWSTRKNICIGIAKGLAYIHEESRLKVVHRDIKATNILLDKDLNAKISDFGLARLDEEENTHISTRIAGTVGYMAPEYATRGYLTEKADVYSFGVVTLELVSGTSVMSFRKEGSMHLLDWVQILREEGKLEKFVDPRLGTDFNMEEAILLINVGLLCINSSPVPRPPMSAVVSMLVEAQTSTVDATPEQIFSTDDFEIQVSGKRYPSSGDSQTKSFLVEGSVHGSTTSSSDLYPLNLDSLYRN

SEQ ID NO: 51802 - protein, 326 aa, Desulfitobacterium hafniense Y51
MASVTIKSANSAISFPELLIVEERLRESFLRAGDTIKDSCLLLLDSGGKRLRPLLTLQSAQCFGPLNSAALDAAVAAELIHMASLIHDDVIDHSDRRRGIPTINSQRGNQVAVLAGDYVFAEAFRILANKHLLTSMSYLVDAIQSMCDGEIQQAEQRCDLAVEPSQYFQRIAQKTGILLASCCCSGAASAGANQEAVEALGQYGMNLGYAYQIIDDILDFTGNPQVTGKPAAADLLNGYITLPVIYLLDKPLYGPWAREMLQARDLSPANVQRIIQALISSGALNEAFTTALRCAQTAVQALSSLPPSPSKTFLSELTHTILYRQA

SEQ ID NO: 51803 - protein, 453 aa, Myxococcus xanthus DK 1622
MALRVAIIGAGPSGLAQLRAFESAARKGAEIPEIVCFEKQEDWGGLWNYTWRTGLGRYGEPVHGSMYRHLWSNGPKEALEFADYSFDEHFGRPIPSYPPREVLYDYIRGRVEKCDVRKYIQFNTIVRWLSWSEETRKFTVVVDDLAKREVREESFDRVVNATGHFSTPNVPFFEGIDSFPGRVLHAHDFRGAEEFAGKNLLLIGSSYSAEDIGVQCHKLGAKSVTISYRSAPMGFRWPMGMKEVPLVKRFEGNRAHFADGTSATLDAVILCTGYQHKYRFLPNALRLESHNRLYPPGLYKGVFWQGQPELAYLGMQDQYYTFNMFDAQAWLVRDVIMGRTALPSAEEREADIAAWVEREEGIQDSFGAVDFQTAYIRDLLDRTDYPGFSVEKVAELLKQWLRDKQEDILGYRDRTFTSIVTGTRATPHRRKWMDELDDSAESFLAEAPERRTG

SEQ ID NO: 51804 - protein, 504 aa, Brucella melitensis 16M
MSKLDDNVAKAKTYLARFEKGVLNRIGGEDVAAADGATFETISPVDLKPLATVALGKAADIDRAARAAKAAFPEWAAMSGDARKKLLHKIADAIVARAEEIAFVEFMDTGQSLKFMAKAALRGAENFRFFADRAPEARDGKTLRGPGQVNMTTRVPIGPVGVITPWNTPFMLSTWKIAPALAAGCTVVHKPAEFSPLTARLLVEIAEEAGLPKGVWNLVNGFGEDAGKALTEHPDIKAIGFVGESRTGSLIMKQGADTLKRVHFELGGKNPVVVFADADLERAVDAAVFMIYSLNGERCTSSSRLLVEASIYEKFTALVAEKAKRIKVGHPLDPETVVGPLIHPVHEKKVLEYIEIGRSEGATVAAGGAKFAGPGGGCYVSPTLFTAAHNGMRIAQEEIFGPVLTAIPFKDEAEALALANDVKYGLTGYLWTNDVTRAFRFTDALEAGMIWVNSENVRHLPTPFGGVKNSGIGRDGGDWSFDFYMETKNIAFANAAHAIAKLGG

SEQ ID NO: 51805 - protein, 606 aa, Delphinium 'MagicFountains dark blue'
MDSCACIETQWPADELLVKYQYISDFFIALAYFSIPLELIYFVQKSAFFPYRWVLMQFGAFIVLCGATHLINLWTFSMHSKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRTGMNLQLSHTLRHQIPVGSTVSTNLPIVTQVFNSNQAIKIPHTCPLARIGPTAGRYVPPEVVAVRVPLLHLSNFQINDWPELSAKSYAVMVLMLPTDSARKWHDHELDLIEVVADQVAVALSHAAILEESMRARDMLMEQNIALDMARREAEMAIRARNDFLAVMNHEMRTPMKAVIALSSLLLEIELTPEQRVMIETVLKNSNLLAALINDVLELSRLEDGSLELDIRTFNLHGIFREVLNMIKPITAVKKLSLTLMLSPDLPVVAVGDEKRLMQIMLNVVGNAVKFTKEGYVSVIASVAKAESLREWQAPEIFMVSSDSHFHLCVQVKDSGCGISPQEIPHLFTKFTQLRSGQNRSNDGAGLGLALCKRFLNLMEGHIWVDSDGTDKGCTVTIIVKLGICEGQPEPSNLQVVSRPRLS

SEQ ID NO: 51806 - protein, 355 aa, Solanum lycopersicum
MGKGGSDENMAAWLLGVNTLKIQPFNLPALGPHDVRVRMKAVGICGSDVHYLKTMRCADFVVKEPMVIGHECAGIIEEVGGEVKTLVPGDRVALEPGISCWRCNLCKEGRYNLCPEMKFFATPPVHGSLANQVVHPADLCFKLPDDISLEEGAMCEPLSVGVHACRRANVGPETNILVLGAGPIGLVTLLAARAFGAPRIVIVDVDDYRLSVAKKLGADDIVKVSINIQDVATDIENIQKAMGGGIDASFDCAGFNKTMSTALGATRPGGKVCLVGMGHHEMTVPLTPAAAREVDVIGIFRYKNTWPLCLEFLRSGKIDVKPLITHRFGFSQEEVEEAFETSARGGDAIKVMFNL

SEQ ID NO: 51807 - protein, 311 aa, Brassica napus
MAMAAAVIVPLGILFFISGLVVNLLQRSGCLGSALAVMKKSSKFLPVIGWSMWFSEYLFLERNWAKDESTLKSGLQRLNDFPRPFWLALFVEGTRFTEAKLKAAQEYAASSELPVPRNVLIPRTKGFVSAVSNMRSFVPAIYDMTVAIPKTSPPPTMLRLFKGQPSVVHVHIKCHSMKDLPESEDEIAQWCRDQFVTKDALLDKHIAADTFAGQKEQNIGRPIKSLAVVLSWACLLTLGAMKFLHWSNLFSSWKGIALSALGLGIITLCMQILIRSSQSERSTPAKVAPAKPKDNHQSGPSSQTEVEEKQK

SEQ ID NO: 51808 - protein, 606 aa, Delphinium 'MagicFountains dark blue'
MDSCACIDTQWPADELLVKYQYISDFFIALAYFSIPLELIYFVQKSAFFPYRWVLMQFGAFIVLCGATHLINLWTFSMHSKTVAMVMTIAKISTAVVSCATALMLVHIIPDLLSVKTRELFLKNKAEELDREMGLIRTQEETGRHVRMLTHEIRSTLDRHTILKTTLVELGRTLGLEECALWMPSRTGMNLQLSHTLRHQIPVGSTVSTNLPIVTQVFNSNQAIKIPHTCPLARIGPTAGRYVPPEVVAVRVPLLHLSNFQINDWPELSAKSYAVMVLMLPTDSARKWHDHELDLIEVVADQVAVALSHAAILEESMRARDMLMEQNIALDMARREAEMAIRARNDFLAVMNHEMRTPMKAVIALSSLLLEIELTPEQRVMIETVLKNSNLLAALINDVLELSRLEDGSLELDIRTFSLHGIFREVLNMIKPITAVKKLSLTLMLSPDLPVVAVGDEKRLVQIMLNVVGNAVKFTKEGYVSVIASVAKAESLRDWQAPEIFMVSSDSHFHLCVQVKDSGCGISPQEIPHLFTKFTQLRSGQNRSNDGAGLGLALCKRFLNLMEGHIWVNSDGTDKGCTVTIIVKLGICEGQPEPSNLQVVSRPRLS

SEQ ID NO: 51809 - protein, 657 aa, Haemophilus somnus 2336
MSLGKPYPLGCTECCMEGIAGFNFAIYSSQASAVELCIFNKNSVQETCYSMYCTENIWHIWVTELEYGTEYGFRIHGVDGSLSNPNKLMLDPYAKAVVGKPDLSCVENRAWFLLEDERDNAHLAPKALIESSSFDWEEDILPQTPWSESIIYELHVKGFTQLREDIPEAIRGTYAGLAHQNVIAYLKELGVSAVELLPINYHLDEPHLQEKRLQNYWGYSPLAMFAVESKYWSNQADTTPLTEFKSMVKALHKAGIEVILDVVFNHSVESEKYFPTFSQRGIDDRTYYWQDEAGNYINLTGCGNTLNLSIELGRKWIIDCLCYWVEECHVDGFRFDLASVLGRETPDFNANALLFKEIEQVSILQKVKFIAEPWDIGMGGYQVGNFPAYFAEWNDRFRDDMCRFWLWKSGELGVFAERFAGSSDIYRCQGKLPHNSVNFITAHDGFTLHDLVSYNQKHNWANGEDNRDGRSENYSYNHGMEGYKEGNSLVEEARYLSRSALLLSLLLSNGTPMLLAGDEFGNTQYGNNNAYCQDNETTWLKWQYFEQDLFNLVKQVIALRKQIPSLQRDNWWQESNVSWLNIDAEKMSLDEWHNKESKALQILLDSKYLFVINAKTSSQKFLLPQGNWEILCYSKVVHLENKQLEMTDLAFGVLQKK

SEQ ID NO: 51810 - protein, 463 aa, Lactobacillus johnsonii NCC 533
MSLPIEFVEKYKNLLGEEESSKFFTAINSPSKKGFRLNPLKNNYQDVQYSLKEPIEFTKDGYYGEISGRDSEWTGGYVYSQDPSAMYPAVSLNVKPGDKVLDLCAAPGGKSTALASLLDNTGLLVANEISKSRAKDLRENLERWGATNVVVINESPDRLSKKLPHFFDKILVDAPCSGEGMFRKDPAATQYWSPDYVLTCQTRQKEILSEAMKMLKPGGEIVYSTCTYSPEEDEEIVAWLVENYPLEIEPLKLYSGMSAGRPDWSKSNMPELKETVRLWFQNGVGEGQFVAHLKNIEENQEISTKAKKRKNKRQKKSTITRLNKDEISVVAKVLDNFALPSSLENWQNEVLQSNGHVFVPALDPDMLTELHVLNNGVELGLLKKKRFEPSHQLAEVLGQKEQKQLINFEDKVDYERYIHGETIKVDSNLRGFVLVAYQDHIFSFGKIGNDQILKNFYPKGLRK

SEQ ID NO: 51811 - protein, 1491 aa, Nostoc punctiforme PCC 73102
MNNGKLRIYELAKELNLDSKKLLAICEKLKIAVKSHTSAIPESDAERIRLAISKLTAKSSKTKTTSEDWGYTFIASAIDSFIRHLEGEAALKSYSDFRERRDRANELMYECVGKKPSLFYVRRKGAGKEAREEIWDLTIATDSDDFPLPARLEKLRKTLGFRAAVQKDGRDGIKVLSAQLLQPSRGHADSYAMPCRLRLLANHQHHLDIPPATLKRIATAPVCGENVPTEDQLKAWKAFLQIEEKIAKARQFCVRYVSHNYNFKRRISFEIDVNSATLDGFYQNSLEVDNFWERARRTKNEDLKLFETAPVGKNWISGRQLGTVEEVDTNRCIISLRLERDLAEFMATERYKLPATGFLCFEAVGDIQQIQRKKKALDDLNNGYTQNPYLGNFLFDASQARQIKTTVELQPQDLLLSSANPGQKAAVEKVLAAKDLVLIQGPPGTGKTTVIAEICYQIALRGGRTLIASQANLAVDNALSRLVHNSVIRAVRKGRAEKVGEEGQPFLEDQVIGRWLENTAYDCENNITQRLENIKIFSQLLASSQRFTPYLQAEEEFSQQQTKFNKNKLKVETNFKNQEKSYNETVEKQNNVESLIAGLENILNTAPINWESPEVTDFLPLLKPYTEGNSLVEEFLANVRQTIKYTDELGLARPALGAFGLAVWLRETVATEISGFKSAFTSAQEASQAILEVAASVEVVKQNFALLNQVQPDYQKYLAKLQKLQQTIQIWENRQREIDYIISAVKEWKSTAPSHLYQTLKDCQQSGLPLTENLVDLPLGLLMFANTLKLAIVPKIYKINLPEWELLTKAIAYEIDGGFTDRRGKQHNFSYFLQENFSQIPMVLSKGDRTQWQETYQQFSNYQLLNPKQRKLLVENTQVFLIRMQRTYGASWEWNNIDSTLTKLTQELLDTILVNARQCVLKVKTETEQQLQYLQRQLNELQKNEISQQQISITQAEVEKAQQDANLQLGRVINILQELNQQNIPTQLRTLTEKYLATQSNIWEHPQEFSNQVNSWVTSISQLENLISSLEPFAVLEIIKNSLHEHLSKLQEETETALQQLQKLQISLREIEEKLQPQPSDRLIEERNWWLTEWQRTPDKFKPENYPADLFNIELLRGINIQFESWQKELEKEENYLKKYQNFVQDWIGKLRQPNERDRDDLRRIYLDNANVVGITCVQAASRGFSEEFKSFDVVIIDEVSKCTPPELLIPALKGKKLVMVGDHRQLPPMLDTSTLEEVAQTIGNTRDELQFLEESLFKSQFESADESIKQMLTTQYRMHPFIMGAINQFYDGKLESGILEPDTKRAHHLAGEIIQESQHLIWVKTPIENQFLEQRNGTSYFNTPEIDAIELLCQQFETTWASKVANAEPKKEIAVITFYGAQLRKIDERLQSELFPSLEIRTGTVDRFQGMERPVVIVSMVRNNSKGDVGFAKKPERVNVAFSRAQELLIIVGCHKLFTHQSGKVGSMYSEVSNIVSTHEGFVDVSRLFS

SEQ ID NO: 51812 - protein, 473 aa, Synechococcus elongatus PCC 6301
MPETAQEVLQLIQEKGIQLVDLKFIDMPGIWQHLTLHVSQIDENSFVEGVPFDGSSIRGWKAINESDMTMVPDPTTAWIDPFMKEPTLSMICTIYEPRTNTPYERCPRAIAQKAVDYLKASGIGDTAYFGPEAEFFIFDDVRFDQAENKSYYYVDSIEGRWNSGREEEGGNLGYKPRYKEGYFPVAPTDTSQDMRSEMLLTMADCGVPIEKHHHEVATGGQCELGFRFGKLIEAADWLMTYKYVIKNVGRRYGKTITFMPKLLFNDNGSGMHTHQSIWNDGQPLFAGDQYAGLSQMALWYIGGILKHAPALLALTNPTTNSYKRLVPGFEAPVNLAYSQGNRSASVRIPLSGTNPKAKRLEFRCPDATSNPYLAFAAMLCAGIDGIKNQIDLGEPLDVDIYDLSPEELAKIPSTPGSLKDALKALEADHDFLTVGGVFTEDFIQNWIEYKLDNEVIPISLRSHPYEFALYYDC

SEQ ID NO: 51813 - protein, 143 aa, Acinetobacter sp. ADP1
MAVERTLSIIKPDAVGKNHIGEIIARFEKAGLKPVAMKYKHLSQAEAEGFYAEHKERGFFADLVAFMTSGPVVVSALEGENAVLAHREILGATNPKEAAPGTIRADFATSIDENAAHGSDSVASAEREIAYFFAADEIFPRTR

SEQ ID NO: 51814 - protein, 429 aa, Nostoc punctiforme PCC 73102
MKKVLSIILGGGAGTRLYPLTKLRAKPAVPVAGKYRLIDIPVSNCINSEIFKIYVLTQFNSASLNRHIARTYNFTGFNEGFVEVLAAQQTPENPNWFQGTADAVRQYLWLMEEWDVEEYLILSGDHLYRMDYRQFIQRHRDTGADITLSVIPIDERRASDFGLMKIDDSGRIIDFSEKPKGEALTQMQVDTSVLGLTKEQAQKQPYIASMGIYVFKKEVLFKLLRESVERTDFGKEIIPDASKDYNVQAYLFDDYWEDIGTIEAFYHANLALTQQPQPPFSFYDEHAPIYTRARYLPPTKLLDCQITESIIGEGCILKNCRIQHSVLGVRSRIESGCVIEESLLMGADFYQASVERQCSLIENDIPVGIGTDTIIRGAIIDKNARIGHDVKIVNKDNVQEAERENQGFYIRSGIVVVLKNAVIPDGTII

SEQ ID NO: 51815 - protein, 173 aa, Rhodopseudomonas palustris CGA009
MIGFGWLEALLRVGRKLFVKPETQLYPEQKPKLYPRARGRIVLTRDPDGQERCVACNLCATVCPVGCIDLAKAVADDGRWYPEYFRVNFARCIFCGFCEDACPTAAIQLTPDYELSEWRRDALVYEKHDLLISGEGKVRGYRYWSVAGKAIPGKDKGEAEHEAPPVNLKGLLP

SEQ ID NO: 51816 - protein, 362 aa, Triticum aestivum
  misc_feature (9)..(9): Xaa can be any naturally occurring amino acid
TRRNPAFHXEKIKRMLPVFSTCGEEMVARWENSMSTEGLSEIDTCPEFQNFTGDVIARTSFGSNYQEGKKIFELQGELAKRLMQAFQTFFIPGYWFLPTKNNRRMRAIDHEIRMIMRGIIGKKERAIKNGEASSNDLLGLLLESNMQQSNGKAGQGMSIDDIIEECKLFYFAGMETTSVLLTWTLIVLSMHPEWQEQAREEVLHHFGRTTPDYEHLSRLKIVTMILYEVLRLYPPVTYLTRRTYKATELGGIKYPTGVTLILPLLFIHHDPDIWGEDASEFNPQRFADGISSAAKHPSAFFPLGGGPRICMGQNFALLEAKMALSTILQRFSFALSPSYTHAPYTVMTLQPQPGAPHASEKI

SEQ ID NO: 51817 - protein, 666 aa, Bacillus thuringiensis serovar konkukian str. 97-27
MSHSIEQLSINTIRTLSIDAIEKANSGHPGMPMGAAPMAYTLWTQFMKHNPNNPTWFNRDRFVLSAGHGSMLLYSLLHLSGYDVTMDDLKNFRQWGSKTPGHPEYGHTAGVDATTGPLGQGIATAVGMAMAERHLAAKYNRDAYNVVDHYTYAICGDGDLMEGVSAEASSLAAHLQLGRLVVLYDSNDISLDGDLNRSFSESVEDRYKAYGWQVIRVEDGNDIEAIAKAIEEAKADEKRPTLIEVRTTIGFGSPNKSGKSASHGSPLGVEETKLTKEAYAWTAEQDFHVAEEVYENFRKTVQDVGETAQAEWNTMLGEYAQAYPELANELQAVMNGLLPEGWEQNLPTYELGSKAATRNSSGAVINAIAESVPSFFGGSADLAGSNKTYMNNEKDFTRDDYSGKNIWYGVREFAMGAAMNGIALHGGLKTYGGTFFVFSDYLRPAIRLAALMQLPVTYVFTHDSIAVGEDGPTHEPIEQLAALRAMPNVSVIRPADGNESVAAWRLALESTNKPTALVLTRQDLPTLEGAKDDTYEKVAKGAYVVSASKKETADVILLATGSEVSLAVEAQKALAVDGVDASVVSMPSMDRFEAQTAEYKESVLPKAVTKRFAIEMGATFGWHRYVGLEGDVLGIDTFGASAPGEKIMEEYGFTVENVVRKVKEML

SEQ ID NO: 51818 - protein, 108 aa, Glycine max
MSRPMEEDAAGKNEEEEFNTGPLSVLMMSVKNNTQVLINCRNNKKLLGRVRAFDRHCNMVLENVREMWTEVPKTGKGKKKAQPVNKDRFISKMFLRGDSVIIVLRNPK

SEQ ID NO: 51819 - protein, 532 aa, Arabidopsis thaliana
MAATGSGRSQFISSSGGNRSFSNSPLIENSDSNQIIVSEKKSWKNFFAYLGPGFLVSIAYIDPGNFETDLQAGAHYKYELLWIILVASCAALVIQSLAANLGVVTGKHLAEQCRAEYSKVPNFMLWVVAEIAVVACDIPEVIGTAFALNMLFSIPVWIGVLLTGLSTLILLALQKYGVRKLEFLIAFLVFTIAICFFVELHYSKPDPGEVLHGLFVPQLKGNGATGLAISLLGAMVMPHNLFLHSALVLSRKIPRSASGIKEACRFYLIESGLALMVAFLINVSVISVSGAVCNAPNLSPEDRANCEDLDLNKASFLLRNVVGKWSSKLFAIALLASGQSSTITGTYAGQYVMQGFLDLRLEPWLRNLLTRCLAIIPSLIVALIGGSAGAGKLIIIASMILSFELPFALVPLLKFTSCKTKMGSHVNPMAITALTWVIGGLIMGINIYYLVSSFIKLLIHSHMKLILVVFCGILGFAGIALYLAAIAYLVFRKNRVATSLLISRDSQNVETLPRQDIVNMQLPCRVSTSDVG

SEQ ID NO: 51820 - protein, 655 aa, Clostridium perfringens str. 13
MRRNFNSKEFNDKYYYDGELGAIYNKEETIFRVWSPEAKSLELLLYRDGNTESLIERDLLHKKSNGLWEIVKKGDLNGVYYKYHIVGEDFEHDFVDPYCKALGVNGYRAMVIDLKKTNPKGWENEKKPSLENPLDSILYEMHIRDFSIDKSSGVSLENRGKFLGIIEENTKVPGTEVKTTLDHLKELGITHVHLLPSFDFGTVDEERLDEEQYNWGYDPVNYNVPEGSYSKNPYKGEVRIKEFKEMVLKLHRAGIRVIMDVVYNHTYSGENSNLNLSYPGYYHRQDDFGNFSNGSGCGNELASERLMVRKYMVDSLKYWAKEYHIDGFRFDLMALHDIETLKEIREELNKIDPSILIYGEGWNGGDSPLPKEEACFKCNISKFDKLQIAAFSDDMRDGIKGHVAHLKEGGFVNGGEDFEESIKFGIVASTYHEGVDYNKVNYSDSPWANEPYQTVNYCSAHDNNTLHDKLKIVCENASEEEIIEMNKLSAAIFLTSQGIPFIHSGEEFLRTKTNEKGEFIENSYNSNDFVNKIDWTRKVKYMDLFKYYKGLIELRKEYPLFRLESNKEIREKISFIESELGIKKKGIVAYRLKDHNNEFIVVFNSNNNEVKINLPKGLWGVMVNNKFSGKEIRDEARDFYDIIRKSACVLKKLSD

SEQ ID NO: 51821 - protein, 420 aa, Methanosarcina mazei
MRSHLVKPGSVYDGIEPGELGETTESVQDRVRQLESRNSFLEEQCSQIESEKRYLENQKIKYEREIRKLQSELDRMKTSPLIIGTVIDVIKNDRIIVRSSNGPQFLVNVSQYIDEKKLLPGAKVALNQHTLAIAEVIPSTEEPFVAAMEVIESVEVDYDQIGGLDEQIQELQEAVELPLTSPERFARIGIEPPKGVLLYGLPGTGKTLLAKAVAHRTNATFIRVVGSELVQKYIGDGSKLVREIFEMARKKAPSIIFIDELDSIAARRLNETTGADREVQRTLMQLLAEMDGFDKRKNIRIIAATNRPDVLDPAILRPGRFDRLVHVPMPGIEARGKILKIHCEKMTLAEDIDFKKLAKATEGMSGADLKAIATEAGMFAVRRDKELVEMEEFLEAVEKVSMAADTQKMMPSNLPETMFV

SEQ ID NO: 51822 - protein, 1016 aa, Musa balbisiana
MLTSEMMGVAALRVIASKLEKKWDFSVDPCSQTNGWVVPGRSDMPVFTDNVTCDCNRTSNICHVTSIKLKGQNLTGTLPPEFSKLPFLTDIDLTWNYLNGTIPAAWASLPLVHLSLLGNQVSGPIPEEFAKMITLEELVLEGNQLQGPIPAALGKLANLKRLLANGNYLSGELPESLGNLKNLIMFLIDGNQISGKIPNFIGNWTQLQRLDMQGTAMEGPFPPSFSALKSLKELRVSDLKGGIGSFPQLQNMRNMTKLVLRNLSISGELPDYIGEMKALNSLDVSFNNLSGPIPGSYAALTSSLNFMYLSNNNLNGKIPDWILNSAQKFDISYNSFTGSPAPAICQRGRCWCNLTAPFYRTLSCLRRNLPCSGESRNYNLFINCGGPKMRIDDIEYEGDILDLGTSEFYDPESGKWAYSSTGDFVDNQNPKFITANTTALDITKPELYMTARLSPLSLKYYGLCLYKGNYTVNLHFAEIMFTDDETYSSNGRRLFDVSIQGQKVLKDFNIAKEANGTGKEIIKSFTIMVDGTLEIHFYWAGKGTNSVPLRGVYGPLISAISVTPNFKIDTGENKLTIGTILAIVAAACIIVLLILCLIFLYIRRKNSKNNDVQQASYLVDCLKKLTPKPVVELYSMVNSICLLYPYVLMVMIYSPQSSSKLRGLELQTGQFSLRHIKAATKNFHPANKIGEGGFGPVYKGVLPDGSEIAVKQLSSKSKQGNREFVNEIGVISALQHPNLVKLYGCCIEGNQLLLIYEYMENNSLARGLHGPEGYQLRLDWQTRWKICLGIARGLAYLHEESRLKIVHRDIKATNILLDKDLNAKISDFGLAKLNEEENTHISTRIAGTLGYMAPEYAMRGYLTDKADVYSFGVVTLEIVSGMSNTKYRPEEDCVYLLDWAYVCHEKGNLLELVDPALGSSFSTEEALQMLKLALLCTNISPTLRPNMSAVVSMLEGKTPIELLSVQSSITKGDDLRFKAFEKLSRDSQTEINSTDWPWPDSSVSAQSTKGDTSLLH

SEQ ID NO: 51823 - protein, 384 aa, Oryza sativa (japonica cultivar-group)
MEEVVVLIIGAGPAGLATAACLTLQHVAYAIIERESCTASLWRHRTYDRLKLHLAKEFCELPHMAYPSGTPTYVPRESFVEYLDSYTDRFGIQPRYDTSVESATYDQGKKHWAVLAQDTDTGVVARLTARFLIMATGEKSAASIPLVPGLAGFEGEAIHSSAYKSGNGYTGKSVLVVGAGNSGMEIAYDLATHGAHTSIVVRSPVHIMTKELIRFGMTMVQNLGLSVTIVDPLLVMAAKLIFWDLSKHGIMRPKMGPLLLKSQTGKSAVIDVGTAKLITRGVIDVLEGILKINANNVEFHCGRQIPFDAIVFATGYKSTVNTWLKNGESMFRNDGFPKKKFPNHWRGENGLYCAGFARRGLVSIAMDAKNIVDDIRATMYQVSC

SEQ ID NO: 51824 - protein, 451 aa, Arabidopsis thaliana
MPGFDRISELPESLISQILLHLPTKASVKTSVLSTRWKNLWLNVPGLDLNCRDFPFQNNNEKLLIDFIDRFLQFNNESRLQKFKVDYSRDKIIKFSDRIGDAISRGIRVLDVESNTYYRDADDCIDYPCIEFMPLNLYSCKTLVSLKLSYSGLEDPGFVYLPCLKFMHLREVRWDSSGTMNLEKLVSGCPVLEELIYLHDDKLVVTRVRSRSLKRFSIPFRHKLSLFRRVTQTFEIDAPGLEYMSLKADHFDRIVVKNLTSLFMIDLDIKFIVGFGWMFDPEDLPKRNEIRDFLTGISSVRHMVISHNTVKALDLYSKVGLIPKFNNLSRVEAAFPSSLLQFLPAFLESFPNLKHLILETECPVEVMEKFELVNVPRCFVSTLEHVEIKGLFDWGEQDMKIASYFLENSAVLKKLILSFMGCPQHYSESDIYEELNKLTKRSPRCQIIIRC

SEQ ID NO: 51825 - protein, 380 aa, Musa balbisiana
MDSVSPVTLDLNKEEGHCSNSAVVFDTSFLRRQAKIPESFVWPRSERPHPLEELEVPVVDLRGLFEGDEASISRAAEASRAACVRHGFFQVINHKVDAKVSGDALDAAGDFFKLPLSTKLRARRQPGSAWGYVGAHADRFASKLPWKETLTFGYDYGERGDGVVDYFTSKLGEGFEPMGRVYRRYCEAMKELSLSIMELLGISLGVGREYYRQFFEDGSSIMRCNSYPPCQEPELALGTGPHCDPTALTILLQDQVGGLQVFTEGKWQAVRPVRSAVVINIGDTFMALSNGRYKSCLHRAVVNSERERLSLAFFVCPRGDRVVRPPRELLLLLEEEEEAVPRAFPDFTWTELLEFTQTHYRADTTTLQSFSRHRFLASSP

SEQ ID NO: 51826 - protein, 430 aa, Desulfitobacterium hafniense Y51
MGFQDQRSKEAFARANGVLPGGVNSPVRAFKSVGREPIFIAKGQGARLWDIDGNSYLDYVLSWGPLILGHAHPVVVGAIKAAAERGTSYGAPTEIETECAEEVIKAFPSMEMVRMVSSGTEATMSALRLARGVTGRNKIIKFEGCYHGHGDSLLIKAGSGALTFGVPTSPGVPSSVASQTIVAQYNDLEGLKEIFKECGEDIAAVILEPVTGNMGVVLPQPGFLAGLRTLTQDYGSLLIFDEVMTGFRVSYGGAQGRYQIDPDLTCLGKVIGGGLPVAAYGGKRKYMEQVAPSGPIYQAGTLSGNPLAMAAGLATLKLLQQEGVYEGLEKKTTRLAEGLQSIAQELGFPIWVNSVGAMFSAFFTDQPVIDFKSACSSDVERFGSFFRGMLERGIYLAPSQYEAVFLSAAHTDADIDYTLEQARDVLKSLG

SEQ ID NO: 51827 - protein, 509 aa, Vitis vinifera
MNPLALIFCTALFCILLYHFLTRRSVRLPPGPKPWPIVGNLPHLGPVPHHSIAALAKTYGPLMHLRMGFVDVVVAASASVAAQFLKTHDANFSNRPPNSGAKHIAYNYQDLVFAPYGPRWRMLRKICSVHLFSGQALDDFRHIRQEEVLALMRALAREGQTPVKLGQLLNVCTTNALGRVMLGRRVFGDGSGGEDPKADEFKEMVVELMVLAGVFNIGDFVPALEWLDLQGVASKMKKLHARFDAFLGAIVEEHKISGSAGSERHVDLLSTLISLKDNADGEGGKLTDVEIKALLLNLFTAGTDTSSSTVEWAIAELIRHPEMMAQAQQELDAVVGRGRLVTDLDLPKLTYLQAIVKETFRLHPSTPLSLPRMAAESCEINGYHIPKNATLLVNVWAIARDPEVWEEPLEFRPNRFLPGGERPNADVRGNDFEVIPFGAGRRICAGMSLGLRMVHLLTATLVHAFNWELPEGQVAEKLNMDEAYGLTLQRAAPLMVHPRPRLSPQVFGK

SEQ ID NO: 51828 - protein, 349 aa, Streptococcus pyogenes M1 GAS
MKAATYLSTGNLQLIDKPKPVIIKPTDAIVQLVKTTICGTDLHILGGDVPACKEGTILGHEGIGIVKEVGDAVTNFKIGDKVIISCVTSCHTCYYCKRGLSSHCQDGGWILGHLINGTQAEYVHIPHADGSLYHAPDTIDDEALVMLSDILPTSYEIGVLPSHVKPGDNVCIVGAGPVGLAALLTVQFFSPANIIMVDLSQNRLEAAKTFGATHTICSGSSEEVKAIIDDITNGRGVDISMECVGYPATFDICQKIISVGGHIANVGVHGKPVDFNLDELWIKNITLNTGLVNANTTEMLLNVLKTGKIDATRLITHHFKLSEVEKAYETFKHAGANNALKVIIDNDIS

SEQ ID NO: 51829 - protein, 556 aa, Aspergillus nidulans FGSC A4
MSVQTVSIQPFGDQKPGTSGLRKKVKIFQQENYTESFLTSIFLSIPEGAQDAFLVIGGDGRYYNSDVIQKIAKIGAAYGVKKLIVGQNGILSTPAASNLIRKRKATGGILLTASHNPGGPDNDFGIKYNLTNGAPAPEQVTNKIYEVSKSLTSYKYIDLPEVDTTTVGTRSYGPLEVEVVHSTEDYVSMMKEIFDFDLIRSFLKKHPDFKVLFDGMHGVTGPYGIDIFVNELGLPSSSTMNCIPKPDFGGGHPDPNLVYAHELVEAVDKNGIHFGAASDGDGDRNMIYGANTFVSPGDSLAIIAHHAKLIPWFQKHGVDGLARSMPTSGAVDRVAKAQGLQSYEVPTGWKFFCNLFDNKKMSICGEESFGTGSNHIREKDGVWAIVAWLNVIAGVAEQKPNETPSIASIQAEFWETYGRTFFTRYDYENVDSDGANKLIAALSEKAVDNKSSFVGSTISGRKVVDSGNFAYTDLDGSVTKNQGLYVKFDDGSRLVVRLSGTGSSGATIRLYVEKYEGDKSKYQMATQDYLKDNVGLALELLKFKEFVGREEPDVKT

SEQ ID NO: 51830 - protein, 509 aa, Vitis vinifera
MNPLALIFCTALFCILLYHFLTRRSVRLPPGPKPWPIVGNLPHLGPVPHHSIAALAKTYGPLMHLRMGFVDVVVAASASVAAQFLKTHDANFSNRPPNSGAKHIAYNYQDLVFAPYGPRWRMLRKICSVHLFSGKALDDFRHIRQEEVAVLTRALARAGQTPVNLGQLLNVCTTNALGRVMLGRRVFGDGSGGEDPKADEFKEMVVELMVLAGVFNIGDFVPALEWLDLQGVAAKMKKLHARFDAFLGAIVEEHKISGSAGSERHVDLLSTLISVRDNADGEGGKLTDVEIKALLLNLFTAGTDTSSSTVEWAIAELIRHPEMMAQAQQELDAVVGRGRLVTDLDLPQLTYLQAIIKETFRLHPSTPLSLPRMAAESCEINGYHIPKNATLLVNVWAIARDPEVWEKPLEFRPSRFLPGGERPNADVRGNDFEVIPFGAGRRICAGMSLGLRMVHLLTATLVHAFNWELPEGQVAEKLNMDEAYGLTLQRAAPLMVHPLPRLSPQVFGK

SEQ ID NO: 51831 - protein, 510 aa, Streptococcus pyogenes M1 GAS
MENHKNEFTFSNKSIIAYVWRGVVVGIIAGVIVSLFRLLIEVTADWVIEWYRYAHINSLLLLPILSVSLLAVLFVGFLVKSDSDIKGSGIPHVEGELKGLMSPDWWSVLWKKFLGGIMAISMGFMLGREGPSIQLGAMSAKGLAKFLKSSRLEKRVLIASGAAAGLSAAFNAPIAGLLFVVEEIYHHFSRLIWITALVASLVANFISLNIFGLKPVLAMSEAMPFLGLNQYWLLLLLGLFLGCLGYLYEIVILNFNKLYVILGSWLHLPDYFYGIIMVFLILPIGYYLPQLLGGGHGLILSLSNQQLPLMTIFFYFIIRFIVSMFSYGSGLPGGIFLPILTLGALAGLLFGQIASQLGLLNQSFLSLFLILGMAGYFAAISKAPLTGMILVTEMVGDLKPLMAIAVVTFVSYLVMDLLNGQPIYEAMLDKMAMKHPTNLVEPTLIELTVGDKIAGKYVKELKLPENVLITTQIHHQKSQVVSGNTRLLSGATIFLVVNEADTGFVREVLM

SEQ ID NO: 51832 - protein, 395 aa, Oryza sativa (indica cultivar-group)
MEGGGGGGHGHHGGGGGGHGHHGGIGGGEAQIKGTLTHGGRYVQYNVYGNLLEVSSKYVPPIRPVGRGACGIICAAVNAQTRQEVAIKKIGNAFDNQIDAKRTLREIKLLRHMDHDNALVVISIKDIIRPPRRENFNDVYIVYELMDTDLHHLLRSNQPLTDDHCQYFLYQVLRGLKYVHSANVLHRDLRPSNLLLNAKCDLKIGDFGLARTTNETDFMMEYVVTRWYRAPELLLNCSEYTAAIDIWSVGCILGEIVTREPLFPGKDYVHQLRLITELIGSPDDSSLGFLRSDNARRYVRSLPQYPKQQFRARFPTMSSGAMDLLERMLVFDPSKRITVDEALCHPYLASLHEIYDEPVCPAPFSFDFEQPSLTEEDIKEIIWREALKFNPEPIH

SEQ ID NO: 51833 - protein, 509 aa, Vitis vinifera
MNPLALFFCTALFCVLLYHFLTRRSVRLPPGPKPWPIVGNLPHLGPVPHHSIAALAKTYGPLMHLRMGFVDVVVAASASVAAQFLKTHDANFSNRPPNSGAKHIAYNYQDLVFAPYGPRWRMLRKICSVHLFSGKALDDFRHIRQEEVAVLTRALARAGQTPVNLGQLLNVCTTNALGRVMLGRRVFGDGSGGEDPKADEFKEMVVELMVLAGVFNIGDFVPALEWLDLQGVAAKMKKLHARFDAFLGAIVEEHKISGSAGSERHVDLLSTLISVRDNADGEGGKLTDVEIKALLLNLFTAGTDTSSSTVEWAIAELIRHPEMMAQAQQELDAVVGRGRLVTDLDLPQLTYLQAIIKETFRLHPSTPLSLPRMAAESCEINGYHIPKNATLLVNVWAIARDPEVWEKPLEFRPSRFLPGGERPNADVRGNDFEVIPFGAGRRICAGMSLGLRMVHLLTATLVHAFNWELPEGQVAEKLNMDEAYGLTLQRAPPLMVHPRPRLSPQVFGK

SEQ ID NO: 51834 - protein, 508 aa, Vitis vinifera
MAIDTSLLLEFAAATLLFFITRFFIRSLLLKSSRKLPPGPKGWPLVGALPLLGNMPHVALAKMAKRYGPVMFLKMGTNSMVVASTPGAARAFLKTLDINFSNRPPNAGATLLAYHAQDMVFADYGARWKLLRKLSNLHMLGGKALEDWSQVRAVELGHMLRAMLELSQRAEPVVVPEMLTFSMANMIGQVILSRRVFETKGSESNEFKDMVVELMTTAGYFNIGDFIPSIAWLDIQGIQRGMKHLHRKFDRLLTKMMEEHTASAHERKGNPDFLDVIMANQENSTGEKLTITNIKALLLNLFTAGTDTSSSVIEWSLAEMLKNPSILKRAHEEMDQVIGRSRRLVESDLPKLPYLQAICKESFRKHPSTPLNLPRVSTQACEVNGYYIPKNTRLSVNIWAIGRDPDVWESPEEFRPERFLSGRNTKIDPRGNDFELIPFGAGRRICAGTRMGIVLVEYILGTLVHSFDWKMPDEVEINMDEAFGLALQKAVSLSAMVTPRLHQSAYAV

SEQ ID NO: 51835 - protein, 143 aa, Rickettsia rickettsii
MALTLKYFFKPKVTINYPYEKSPISPRFKGEHALRRYEHGEERCIACKLCEAICPAQAIVIEADEREDGSRRTTRYDIDMTKCIYCGLCQEACPVDAIVEGPNFEFASLTHTALIYDKERLLQNGDRWEQALASKLHKDYEYR

SEQ ID NO: 51836 - protein, 335 aa, Clostridium tetani E88
MVKVAINGFGRIGRNVFKVLIEKYSSELEIVGINDLTDAKTLAHLLKYDSLYGKFNGTVEAKENAIAINGKEIKIFAERDPKNLPWKEEGVDIVLECTGLFTDATKAKAHIEAGAKKVIISAPAKNEDVTIVLGVNEEKYNSEEHNIISNASCTTNCLAPFAKVLDQEFGIVEGLMTTIHSYTNDQKILDAPHKDLRRARAAAESMIPTTTGAAKAVALVLPQLKGKLNGMAVRVPTPTVSMTDLVCTISKEATAEEINAAFKKASETDMKGILGYSEEPLVSVDYRGDARSSIVDGLSTMVMGNRLVKVVSWYDNEWGYSTRLADLAKYVADRL

SEQ ID NO: 51837 - protein, 191 aa, Candida albicans SC5314
MFKTTLTKPLTFKSARFFSTTPRAWGTKVFFNTSINGEKQPPITFELYDDVTPITAENFRVLCTGEKGVGYKGSIFHRIIPQFMLQGGDFETGKGYGGYSPTHNNDKFNDENFIKKHDRPGLLSMANAGPNTNGSQFFITTVPCPWLDGKHVVFGEVVDGFDVVKKIESCGTSSGTPSASVVIEESGEAEK

SEQ ID NO: 51838 - protein, 401 aa, Clostridium tetani E88
MVYVAFNKKTIEDIDVKGRKVLVRCDFNVPLKDGKITDENRLMGALPTIKYIMEKGGKVILCSHLGKPKGEPKQELSLAPVAKRLSELLNKEVLFPADNEVVGENAKKAVENMKDGDVILLQNTRYRKEETKNEETFSKELASLADIFVNDAFGTAHRAHCSTVGVTEFVATSVCGYLIQKELKFLGNAVENPQRPFISILGGAKVSDKINVINNLLEKVDTLIIGGGMSYTFQKAQGYTIGSSLLEEDKIDYAKEMIEKAKEKGVKLLLPVDNVAAEKFAEDAEAIITEDQNIKEGYMGLDIGPKTSKLYSQEVQSAKTVVWNGPMGVFEFEKFAKGTIEVAKAMAESQATTIIGGGDSAAAVNQLGFGDKMTHISTGGGASLEFLEGKELPGIAALNDK

SEQ ID NO: 51839 - protein, 581 aa, Rhodopseudomonas palustris CGA009
MSAFELVTELSARFKDAVLGEQMTADRFPTVWIRPDATIDVHRFLRQEIDRPFKMLVDLWAIDETARKHRDGLPPSGITIASHLMSHERNADIRIKIALDAEYPRAKSIGSVFPNAPWYEREAYDMFGVEFEAQPHSLRILLPPGWEGHPMRKTQPGRATERPLFNMTASLFDAKEHALAADPEKFGLPTHRDGVELMILNYGPHSMATHGVFRIVLALDGEEIVAARPDIGFHHRGAEKMAERQTWHNFLPYTDRVDYLGGVMGEMPYLQAVEKACGIKVPDRALTVRIMLSEMFRIMNHLLFYGTMAQDTGAMSPVFYMFTDRERGYRVIESITGARMHPGFFRIGGLSMDLPDGWDRLVREFLDWMPSRLDDYEGMVLRNEIFRARTKGIAAYDTAMALDWGVTGPGLRATGYAWDVRKARPYAGFENFDFEIPVGHAGDCYDRTVVRVEEIRQSLKIIRQCVDNMPSGPIKADHPLTTPPPRERMLHDIETMIHHFVSTSWGPVLPPGEYTGQVETVRGLTQFALISDGEPSSYRTRIRTPSFAHLQMISAVAPGMMVADLVAYLGSIDYVMSDVDR

SEQ ID NO: 51840 - protein, 255 aa, Clostridium tetani E88
MKGVYGLRKAIIAGNWKMHNTIDESVKLVEELIPKVKEAECEVVVCPPFICLPKIREITEGTNIKVGAQNMYFEEKGAFTGEVSPLMLEKLNIDYVIIGHSERRQYFKETDQTVNKKLKAAFEHNLIPILCVGETLDEKENGVTEEVVSKQVKLGLFELKEEQVEKLVIAYEPIWAIGTGKTATSEEANEVIALIRSTVKSLYGDKVAESLRIQYGGSVKPSTIKEQMSMSDIDGALVGGASLKANDFSAIVNYK

SEQ ID NO: 51841 - protein, 102 aa, Arabidopsis thaliana
MGRKKGLPEFEESAPDGFDPENPYKDPVAMVEMREHIVREKWIQIEKAKILREKVKWCYRVEGVNHYQKCRHLVQQYLDSTRGVGWGKDHRPISLHGEFNGG

SEQ ID NO: 51842 - protein, 513 aa, Clostridium tetani E88
MNKKPVMLMILDGFGITNHEDGNAVKMANKPNFDKLLREYPHTQLKASGLNVGLPEGQMGNSEVGHLNIGSGRVIYQELTRITKDINDGVFFENTEINYAIDEAIKNNSSLHLLGLLSDGGVHSHIDHLKAILKLAKDKGLNRVYVHAFLDGRDVPPSSAKEYIINIENYMKELSVGQIATLAGRYYAMDRDKRWERVELAYNALVYGTGELSNSAVEAIEKSYKDNTTDEFVLPTVILKDGKPTGTIKDEDSIIFFNFRPDRARQITRALNDKDFDGFERKRLKLNFITMTQYDKTIENVRIAYKPQSYKNTLGEYVSSLGLNQLRIAETEKYAHVTFFFNGGVETPNKGEDRALIPSPKVATYDLKPEMSAFEVKDEVINRIESNKYDMIILNFANPDMVGHTGVFDAAKTAIEVVDKCVGEISDKILEKEGTVFITADHGNSEQMIDYSTGKPMTAHTTNEVPFVYVSKDAKDKRLKSEGILADIAPTMLTEMGVKIPEEMTGRNLIEGK

SEQ ID NO: 51843 - protein, 431 aa, Clostridium tetani E88
MKNYIEIIDVSARQVLDSRSNPTVEVDVILEDGTTGRAAVPSGASTGIFEAVELRDGDKSVYNGKGVLKAIENVNTIIAEELVGMNVLDQIAIDKTMIELDGTDNKGKLGANAMLGVSLACAKAAAEYLGLSLYQYIGGVNAKVLPVPMMNIINGGEHADNNVDLQEFMIMPAGASSFSEALRMCSEVYHSLKSLLKAKGYDTGVGDEGGFAPNLNSNEEAIQVIVEAIEKAGYKPGVEIFIALDPASSEIFEDGKYNLKGEGKVLTPQEMVDYYANLVAKYPIISIEDGMAEEDWEGWRLITERLGTKIQLVGDDLFVTNTDRLTMGIERGVANSILIKLNQIGTLTETLNAIEMAERAGYTAVVSHRSGETEDTTIADLVVAVNAGQIKTGAPARSERVAKYNQLLRIEDELGEMGEYRGLKAFYNIKK

SEQ ID NO: 51844 - protein, 234 aa, Triticum aestivum
  misc_feature (98)..(98): Xaa can be any naturally occurring amino acid
  misc_feature (115)..(115): Xaa can be any naturally occurring amino acid
  misc_feature (165)..(165): Xaa can be any naturally occurring amino acid
  misc_feature (178)..(178): Xaa can be any naturally occurring amino acid
MASSSDPWMKEYNEASRLADDISSMIADRGSLPQSGPEIMRHTSAIRRKITILGTRLDSLGVIVWARIPPKSITDKEMHKRQDMLSSLKSKAKQMATXFNMSNFANKEDLLGQSXKADDMSRVAGLDNQGIVGLQRQIMKEQDEGLEKLEETVLSTKHIALAVNXEELTLHTRLIDDXLEDHVDITNSRLQRVQKRLAILNKRTKGGCSCMCLLLSVVAIVILAVIVWLLVKYL

SEQ ID NO: 51845 - protein, 522 aa, Glycine max
MAGGGFTSGGGAGDFEAKITPIVIISCIMAATGGLMFGYDVGVSGGVTSMPPFLKKFFPTVYRKTVEEKGLDSNYCKYDNQGLQLFTSSLYLAGLTSTFFASYTTRRLGRRLTMLIAGVFFICGVVLNAAAQDLAMLIVGRILLGCGVGFANQAVPVFLSEIAPSRIRGALNILFQLNVTIGILFANLVNYGTNKIKGGWGWRLSLGLAGIPAVLLTLGALFVVDTPNSLIERGRLEEGKTVLKKIRGTDNIELEFQELLEASRVAKEVKHPFRNLLKRRNRPQLVISVALQIFQQFTGINAIMFYAPVLFNTLGFKNDASLYSAVITGAVNVLSTVVSIYSVDKVGRRILLLEAGVQMFLSQVVIAIILGIKVTDHSDDLSKGIAILVVVMVCTFVSSFAWSWGPLGWLIPSETFPLETRSAGQSVTVCVNLLFTFVIAQAFLSMLCHFKFGIFLFFSGWVLVMSVFVLFLLPETKNVPIEEMTERVWKQHWFWKRFIDDAADEKVAHVSNGNGFDPTSRL

SEQ ID NO: 51846 - protein, 205 aa, Pseudomonas syringae pv. tomato str. DC3000
MNSQPLRVGIGGPVGSGKTALTLALCLALRERYNLAVVTNDIYTREDADFLVRNEALAPERIIGVETGGCPHTAIREDASINLEAVDQLNRRFEGLDMIIVESGGDNLSATFSPELSDLTIYVIDVSAGDKLPRKGGPGICKSDLLVINKIDLAPLVGASLEMMDSDTRKMRGEKPFVFSNQKTGQGLEQIIAFIERQGLLTTAA

SEQ ID NO: 51847 - protein, 304 aa, Rhodopirellula baltica SH 1
MPSIETQSTSPPPLRIPHREASAHKGNFGRVLLIGGSRGMAGSIALSSIAALHTGSGLVAAAVPDCILDCVAGFHPALMTIGLGDDGEKFADPAWQSLKDRLSAQAAIGCGPGMTTGSGGATIVEGLLAKKDLPLVLDADALNIIAQNDWLSDGRFERSKADAACVLTPHPGELQRLTGASAKDVDAQVEAAAELACRLGLTIVVKGGPSHVAYQNGDGGKQVWQNTTGNPGMATAGCGDVLTGIVTSLLGQGLSGPDAAKLGVWIHGRCGDEAAARWSHAGMTSLHALDALALVADEMTQPAD

SEQ ID NO: 51848 - protein, 310 aa, Arabidopsis thaliana
MKQISSGEVWRWNKEVEMNSIRDCLKHCSSIAIDTEFPGCLKETPMDASEEIRYRDMKFNVDNTHLIQLGFTLFDRRGFAKTWEINLSDFDEHKCFKNDKSIAFLKSNGLNLDKIREEGIGIDEFFRDFSQILTEKDGKITWVNFQGSYDNAYLVKGLTGGKPLPETKEEFHETVQQLLGKFVFDVKKIAESCSGLSSQFGLQRIADVLQMKRVGKAHHAGSDSELTARVFTKLTFDLLNSRKQSVRRVDHQQFQLEQQQHQQFMMTRCYIPIPMPIPRPRPVMFAAHHQNPYFGGGYFRMPVQGMNYVL

SEQ ID NO: 51849 - protein, 175 aa, Musa balbisiana
MAGHGALRRPPAASSAPHQGFTSRALLLLLTVLPLALASFAFVLQWRGGVDDLTSRWPAADAQRFPVMDSNNNSHLGSSASDCADILGRSSSPSFPYYRGWNFNLGKDRKPKVLGVSQFFLFVEGKAAKPHLSAVLEAIPGVKLMYRTRELEEKQAKRLHLSCIKVHSSMNSFSS

SEQ ID NO: 51850 - protein, 301 aa, Musa balbisiana
MESDSIECVSSIDGIDEEATSLPHHSSKSHGAAAPPAGIVPSTSVHELLECPCQNGHTLCSTCKTRVHNRCPTCRQELGDIRCLALEKVAESLELPCKYYSLGCPEIFPYYSKLKHESQCNYRPYSCPYAGSECSVVGDIPCLVTHLRDDHKVDMHTGCTFNHRYVKSNPREVENATWMLTVFNCFGQYFCLHFEAFQLGMAPVYMAFLRFMGDENEARNFSYSLEVGANGRKLIWEGTPRSIRDTHRKVRDSHDGLIIQRNMALFFSGGERKELKLRVTGRIWKEQQNNDAGVCMPNLCS

SEQ ID NO: 51851 - protein, 150 aa, Glycine max
MAEQTFIMIKPDGVQRGLIGEVISRFEKKGFYLKGLKLQNVEKSFAEQHYADLSSKPFFAGLVEYIVSGPVVAMVWEGKSVVATGRKIIGATNPLASEPGTIRGDFAVDIGRNVIHGSDSVESARKEIALWFPEGIAEWRSSQHNWIYEA

SEQ ID NO: 51852 - protein, 604 aa, Saccharomyces cerevisiae
MAELSEQVQNLSINDNNENGYVPPHLRGKPRSARNNSSNYNNNNGGYNGGRGGGSFFSNNRRGGYGNGGFFGGNNGGSRSNGRSGGRWIDGKHVPAPRNEKAEIAIFGVPEDPNFQSSGINFDNYDDIPVDASGKDVPEPITEFTSPPLDGLLLENIKLARFTKPTPVQKYSVPIVANGRDLKACAQTGSGKTGGFLFPVLSESFKTGPSPQPESQGSFYQRKAYPTAVIMAPTRELATQIFDEAKKFTYRSWVKACVVYGGSPIGNQLREIERGCDLLVATPGRLNDLLERGKISLANVKYLVLDEADRMLDMGFEPQIRHIVEDCDMTPVGERQTLMFSATFPADIQHLARDFLSDYIFLSVGRVGSTSENITQKVLYVENQDKKSALLDLLSASTDGLTLIFVETKRMADQLTDFLIMQNFRATAIHGDRTQSERERALAAFRSGAATLLVATAVAARGLDIPNVTHVINYDLPSDVDDYVHRIGRTGRAGNTGLATAFFNSENSNIVKGLHEILTEANQEVPSFLKDAMMSAPGSRSNSRRGGFGRNNNRDYRKAGGASAGGWGSSRSRDNSFRGGSGWGSDSKSSGWGNSGGSNNSSWW

SEQ ID NO: 51853 - protein, 322 aa, Desulfitobacterium hafniense Y51
MKQLWLFNQINSDLQRVEKELHAYIKTDFPILDQSAVQLLEAGGKRLRPAFTLLAGKFYGYPIDRLLPVAMALELIHMATLVHDDVVDASMTRRGRPTVKAKWGNVVSIATGDYLLAKALELLAQINHPEVSKILAEVSVEMSQGEIQQIKASNDVNQNLKQYYYRIKRKTAMLISASCKLGALVSAAPRREVWALGAYGHALGMAFQIVDDVLDVTAEASELGKPVGGDIRQGIMTLPLILALHQSGERERLHELLVKPEKDEDDVREAIKMIKDSGAIADSMHYVDLYISKANSYLQELPNVPTRKALVDLAYFVKERKF

SEQ ID NO: 51854 - protein, 949 aa, Musa balbisiana
MAMACLFSSAKMAAVWCMVILGFAMAAVRVHCQSTDTLGFISIDCGIAAGSTYVDPTTNIPYVSDTQYIDAGVNQNISAAYVTNFMGRRYLNVRSFPNGTRNCYTINSITPDSKYLIRASFFYGNYDGLGSQSRLFDLYVGVNLWKTINITDPGSGYRTDVITVAASDSFSVCLVNTGHGTPFISGLDVRPLKEILYPAVNASRSLVLTRRLNMGPTDTFIRYPDDSHDRIWDPFNNIPFWAEISTNSTVENFVDDKFEAPSAVMQTAVIPVNSTKLMMSWEPEPGDVNEYYVVMYFSEFLTLTGNMSRQFYVYLNGHLWYAKPFTPDYLFSDAIFGTNPTEGYHQYNVTIQALDNSTLPPILNAMEVYSRMSDVNVPSDAGDVDAMMAVKAWYKIKRNWMGDPCSPKALAWDGLNCSSSLSNPPRITALNLSSSGLTGEIATSFASLTAIQILDLSHNNLTGTIPAILAQLPSLKILDLTNNNLAGSVPSPLLTKAQNGELVLRLALCLKDQVACRFSQQSVDLYNDRIESNPSLCGNGTSCEITPTTKKKKLSTPIIVIICLAPLLLLLVVVSIIWRLRKPPSKGNSVEPQNEETLKRVKEHQDGLLQLENRQFTYMELKSITNNFERVIGKGGFGTVYHGCLEDGTQVAVKMRSQSSSQGTKEFLAEAQHLTRVHHRNLVSMVGYCKDEPCLALVYEFMAQGTLQDHLRGSQPPLLRGGRALSWRQRLQIAVQAAQGLEYLHKGCKPPLVHRDVKTGNILLSESLEAKIADFGLSKAFQSEINNTHVSTAVMGTPGYLDPEYYATNQISEKSDVYSFGVVLLELLTGQPPVITAAGNAHIAHWVRQRLARGNIEDVVDGRLQGESDVNSMWKCADVALRCASPVAHQRPDMAEVVTQLKESLQLENPYDSRTESLYAEAASDVSQNSALEIERVAAMSMADRPSAR

SEQ ID NO: 51855 - protein, 540 aa, Arabidopsis thaliana
MKSRKKVVVGVSGDRISGLPDALICHILSFLPTKEAASTTVLAKRWKPLLAFVPNLNFDDSIYFHPRARRNKYSKSYESFMSFVDSVLALQAKTKTPLKRFHVKCEDVVDQSWVLEWIPKVLKRGVLDIDLHITSSRNYCENSSFYSLPSKIFVSKALVWLKIQFQDGVRIDVKRGVSLPKLKTLHLDYFKIEPSKLNKLLSGCHALEELVLANLMWADSSGYKVCPVTVSIPTLKRLKFCRSEDFYEGEFHFYEDYDEENINEGVSLSFDNPNLVYLEYSDVIVDKYKQVSFDSLVEANLRLRKTPDQDETDKVNVTKLLMGIHNVKILYLSDDTLEVLSCCRERIPVFDNLLELTIKTTPYVGWKSLPPLLKSCPSLETLVFEGLHHKYTKRCGDKDGCLCKYENHWGTKKKKNVRTCLSSSLVKVLKILKFGETFEDENEDGLDVDHDDYDDEDAVSCDEVGGVVEEQIEHVKHFLETMPVLKQVILYYNTPKDEDVMKVFKKLEKLPRVASANCNVQISSKNLSLSSTSTKRGTLL

SEQ ID NO: 51856 - protein, 226 aa, Brassica napus
  misc_feature (8)..(8): Xaa can be any naturally occurring amino acid
IRFYCLQXNPVSGASLMARAAIKSHAPALYSLSVIQFNGSGGTKSDKNLRAGVALCARSAYLDHVDALRELGHCLQDGYGVPRDVAEGRRLLIQANARELAGSLRSYLSLKSGDETLTELNGLPVQEIRPVNRFLKDWFDSGRVVLAEGLRMCSHGGCGRPETRSHEFRRCSVCGKVNYCSRGCQALDWRVKHKMECAPLDLWVEAAAVGVGDEDVDAVEVENHAA

SEQ ID NO: 51857 - protein, 618 aa, Chromobacterium violaceum ATCC 12472
MCGIAGFFSRRPVNPAVPQAMLDELHRRGPDDASRLLLDSELNPADGGAIHNAMLHARLAIVDPRPVANQPMASDDGQVWICYNGEVYDWEIGKAELEAGGAVFRTHSDTEFILRGYQAWGIEGLLERLRGMFAFAILDKRCEKVHLARDRMGEKPLLYSLQDGDFAYGSLVRAVLPFLPADKRAFSPAAIDAYLAHRYIPSPATVFSHINRLENGYRLEFDLNTRQLTKQRYWQPKAESGDWLPELDRAVAMRTVADRPLGVLLSGGIDSTVIASRLAIQQLTQFSSFTAAFPGSTLDESGDAADSARRMGLPNVRVDMPENLAADFERIVADLDQPFADPSSFPTWYLAREVTKHVKVVLVGDGGDELLAGYKRMGKHLRTRWRQNIRLPLPIKPQLDSKRGKLATELAMDWKSAYSLRFSGFTPGQRSFLQGGRKLEKLCHWRAPDDIGPEPGDGSPGLHQLLELDFANYLPDYILQKSDLCTMAHGLEGRAPLLDHGFYQRLLSTSAAERYTRPAKLIFRRAIHPALPTDFFQRKKRGFNPPLSGWLKTSLAPRFDGLGSRLAEASGGQLDAGAVDAFARAYRDGAGHLAEQMLQLLILDESLTQLRRLCRELG

SEQ ID NO: 51858 - protein, 419 aa, Xanthomonas oryzae pv. oryzae KACC10331
MRWRVCALLLAATTINYVDRQVLGVLAPFLQTQIGWNEIQYGYIVTAFQATYALGLLCSGAVIDRFGTWLGYALAIGVWSLAAMGHALATSVVGFAIARFFLGLGESGNFPAALKTVAEWFPRRERALATGIFNSGSNIGAIVAPLLVPLIATAWGWQSAFLFTGVLSATWLAVWWFRYHSPEQQPGLSAAELAHIRSDAHEPVQRRLSWLQVLRHRQAWAFVLCKLITDPIWWFFLFWLPKFLHAQYGLSLLQLGAPLIEIFVLADIGSIAGGWVAGRFIARGWSVNRARKTAMLICAISVVPIVFAARADNLWLAVALIGLATAAHQGWSANLFTLPSDMFPRHAVATVVGIGGFAGAVGGMLIATFIGFLLQATGSYVPVFLMAGSAYLLALAVVHTLVPRLEPAQWHADPAPASS

SEQ ID NO: 51859 - protein, 88 aa, Glycine max
AKEEEGGEEKIKCSSKHCGSCCGGYVADCVAVCCCPCAVLHCCAMAIVKGPSLVGRKCLGLGKNKNKNNNIKRVQEGCEDGVDVDVVV

SEQ ID NO: 51860 - protein, 694 aa, Acidovorax sp. JS42
MAGSTSALTAPLILALVCGLIAVAYGLWARSWILSKDAGNARMQEIAGAIQMGAAAYLARQYKTIAFVGIVLAILIAAFLDGTTAVGFVIGAVLSGACGFIGMNVSVRANVRTAQAATQGMGPALQVAFRGGAITGMLVVGLGLLGVTAFAWFLVGNGRLTPTASLPALLNPLIGFAFGSSLISIFARLGGGIFTKGADVGADLVGKVEAGIPEDDPRNPAVIADNVGDNVGDCAGMAADLFETYAVTLIATMVLGALLVGAAPVAAVTYPLALGAVSIIASIIGCFFVQAGPGMRNVMPALYRGLAIAGVLSLVAFWFVTAWVIPDNALGGTGAQMRLFGACATGLVLTAALVWITEFYTGTQYSPVRHIAQASTTGHGTNIIAGLGVSMRSTAWPVIFVCAAIIVSYTLAGLYGVAVAAMSMLSMAGIVVALDAYGPITDNAGGIAEMAELPSSVRDITDPLDAVGNTTKAVTKGYAIGSAGLAALVLFADYTHKLESFGQAIRFDLSDPMVIVGLFIGGLIPYLFAAMAMEAVGRAAGSVVVEVRRQFSEIPGIMEGTAKPEYGRAVDMLTSAAIKEMIIPSLLPVAVPIIVGLALGPKALGGLLMGTIVTGLFVAISMCTGGGAWDNAKKFIEDGHHGGKGSDAHKAAVTGDTVGDPYKDTAGPAVNPLIKIINIVALLIVPLVVKFHAG

SEQ ID NO: 51861 - protein, 951 aa, Rhodococcus sp. RHA1
MSDLIQGPASQPDSATPGAGAAQPSNPSATPGSDARVRVIREGVASYLPDIDPDETTEWLESFDGLLDRSGPTRARYLMLRMLERAGEKHVALPALTSTDYVNTIPTENEPWFPGDEETERRYRAFIRWNAAVMVTRAQRPGVGVGGHISTYASSAALYEVGFNHFFRGKDHPGGGDQIFIQGHASPGIYARAFLEGRIPAERMDGFRQEHSHADQGGGLPSYPHPRLLPDFWEFPTVSMGLGPMNAIYQARFNHYLHDRGIKDTADQHVWAFLGDGEMDEPESRGLAHVAATEGLDNLTFVVNCNLQRLDGPVRGNGKIIQELESFFRGAGWNVIKVVWGREWDALLHADRDGALVNLMNVTPDGDYQTYKANDGGYVREHFFGRDPRTKELVANLSDQDIWNLKRGGHDYRKIYAAYAAAMAHKGQPTVILAHTIKGYTLGKHFEGRNATHQMKKLTLDDLKNFRDLQRIPISDAELEKDPKMPPYYHPGPDAPEIQYMLDRRRALGGFLPQRRTSPAPLPMPPDSTYDVVRKGSGKQQVATTMALVRIMKELLRDKEIGKRIVPIIPDEARTFGMDSWFPSLKIYNRNGQLYTAVDADLMLAYKESEIGQILHEGINEAGSTASFTAVGTSYATHGEPMIPLYIFYSMFGFQRTGDGLWAAADQMARGFVLGATAGRTTLTGEGLQHADGHSLLLASTNPAAVAYDPAFSYEIAHIVKDGLRRMYGGTDGVDGFGGEDIFYYITLYNEPYSQPAEPADLNVDGLLKGMYLFKKSQASGPKAQILVSGVTMPEGLRAQELLADEWGVAADVWSVTSWGELRRDGIESERQALRDPGTDAPLPYVTQALSDAAGPFVAASDWMRAVADQIRQWVPGSYTTLGTDGFGFSDTRPAARRYFNVDAESIVVAVLSALAGEGTLDRSKAVEAANRYRIDDVRAAAVSYTDTGSA

SEQ ID NO: 51862 - protein, 440 aa, Arabidopsis thaliana
MDRFSNLPDDVIYHIVSFLSAKEATCLKFVSKNFQNLVTIKRNVVFHHWESFKNFVDGLLAEPASYRIKRFSLKLVSMDFAQYNIVNDCLCNVLKRGVLDLELDINVKEDYILPSDVFTCKTVVRLKLGCGFVIDILPKNALLPALKTLILDSVRFYASDGCAFTRLLSASPVLEELVIDRLNWEHWKGSRFVSSPTLKRLTLRRKEWEPEPETWTDFESVSFDTPSLAYLKYKDVIPYGYPIVNLNSIVEARLTLPREVEYDYWLNRSADPSNLIRGLKNVEILSIKVLHTMDLLFYNFKEAVPVFENLIHLSVTSEADFCWDPLQILLEKSPNLKTLTIEGPLHYNFYEKLDLEAVCECLLGYSFLLSCPIKVLKITEFVGDIGEIVQMKHVLGKLPCLELLEVHVQARRDDKKLQIMADLLMLPRTSSKCKVKVHFS

SEQ ID NO: 51863 - protein, 521 aa, Oryza sativa (japonica cultivar-group)
MPAASSLVVGVAFTAAVAVAVAAAVARRAWRHRGLRLPPGPPGWPVVGNLLQVVFAGKPFIHYIRDLRREYGPIVKLQMGVRTLVVISSAELVHEALVEKGREFATRPAESPIRSIFSSGKFTVNSAVYGPEWRSLRRNMVSGMLSAARLREFRPARLRAMERFVARVRAEAAASRDGASVWVLRNVRFAMFCVLLDMTFGLLDLDEGARRARRRRHEARGARRGGAHRRLPPVPPPLPVAAAPPGGRAPPRADRHGAPAHQPGAAPSSAACGPARRPTPPSRRQYSYLDSLLDLRVEGRDAVPTDEELVTLCAEMINGGTDTTATAIEWAMARVMDNPSIQARLHGEIMQRVGDARPVDDRDTEGMPYLKAFVKELLRKHPPTYFALSHAAVEPGSKLAGYDVPVDANLDIFLPTISEDPKLWERPTEFDPDRFLAGGETADITGSAGVRMIPFSAGRRICPGVGMGTAHIALMVARMVQAFEWRAHPSQPPLDFEDKVEFTVVMKRPLLAMVTPRKLSF

SEQ ID NO: 51864 - protein, 525 aa, Pinus taeda
MSFDKLLQALPPPLPLPAILIATFIFFFSCWILHQSQRNERLPPGPYPWPIIGNFHQVRLPLHRTLKNLAEKYGPILFLRFGSVPTVVVSSSEKAKHFLKTHDLIFASRPPTSVGKYFFYNFKDIAFSPYGDHWRKMRKICVLELLTSKRIESFKHVRQEELSAMIHSIWEESESGRIAVNVSKAISTSLANILWRILARKKFSDNDLGADGKGFADLVVEVSIAVGSLNIGDFIPYLDCLDLQGIKRALKKANARFDAFAEKMIDEHINASTIRNGEADAGCHVKDIIDVLLEMAKNDNTGAKVTREIIKAITYELFSAGMETSANVLEWAMSELLRHPHAMKKLQQEIESVVGQQGTVKESDLASIVYLHCVVKETLRLYPSLPLALPHESLEAVTVGGYYIPKKTMVIMNLWAIGRDPSVWGADASEFKPERFMQMEENGIDLSGGQSDFRMLPFGAGRRTCPGSAMAILTVEFTLAQLLHTFDWRVEGDPSELDMKEACATKMPRQTPLLAYPRLRLPRCP

SEQ ID NO: 51865 - protein, 294 aa, Aquifex aeolicus VF5
MFQGSIVALITPFKEGEVDYEALGNLIEFHVDNGTDAILVCGTTGESPTLTFEEHEKVIEFAVKRAAGRIKVIAGTGGNATHEAVHLTAHAKEVGADGALVVVPYYNKPTQRGLYEHFKTVAQEVDIPIIIYNIPSRTCVEISVDTMFKLASECENIVASKESTPNMDRISEIVKRLGESFSVLSGDDSLTLPMMALGAKGVISVANNVMPREVKELIRAALEGDFRRAREIHYYLHDLFKVLFIETNPIPVKTACWMLGMCEKEFRLPLTEMSPENENKLREVLKKYNLPLKN

SEQ ID NO: 51866 - protein, 566 aa, Neurospora crassa
MASMFAQSGSGTLFLGGQKISGADIRDQNVIATQAIANVVKSSFGPSGLDKMMVDDIGDVTVTNDGATILSLLDVEHPAGKILVDLAHQQDKEVGDGTTSVVLIAAELLKRGNDLMKNRIHPTTIITGYRLALREAVKYMKEHISIKVENLGRESLLSIAKTSMSSKIIGADSDFFANMVVDAIQAVKTTNNKNETKYPVKAVNILKAHGKGVTESMLIKGYALNCTVASQAMTTRVTDAKIACLDINLQKERMKLGVQITVDDPQQLEAIRARESGMIIERVEMILKAGANVILTTKGIDDMVLKLFVEKGAMAVRRCKKEDLRRIARATGATLLSTLSDLNGDEKFEPSYLGHAEEVVQERISDDECILIKGTKVHSSASIILRGPNDFTLDEMERSVHDSLCAVKRTLESGSIVPGGGAVETALHIYLEEYAGTVGSREQLAIGEFAQSLLVIPKTLAVNAAKDASELVAQLRSRHALSQRIQEGEANEDEKIVARKKAYKNYGLDLMKGKVVDEIKAGVMEPSMSKITQLKSAVEACISIMRIDTLIKLDPEQRAEDDGHDH

SEQ ID NO: 51867 - protein, 348 aa, Musa balbisiana
MESDPPGIQPRRARDEDPTTAASSSAEIPAPTGLVAKPVEARGRCLWRKGGAAAVSWGAASTVGRRKEMEDAVAVAPAFMALTCERVGGCAAPPGSGEVSHVRFFGVYDGHGGAQVADYCAKRVHEVVAEEWDRIQNPECWKRRWETAFHDGFKRVDNEVIDEAVAPDIIGSTAVVVVISGCQIISSNCGDSRALLCRGNQRIQLTIDHKPDREDELMRIESLGGRVINWQGCRISGVLAVSRSIGDRYMRPWVIPVPEISFMSRSEDDDCLILASDGLWDVMSIEEVGDMACRHFRWQRRNGLVDGVSPAQAVADHLTELAYQKNSSDNISVVVVDLKSRSRRRPRQ

SEQ ID NO: 51868 - protein, 165 aa, Oryza sativa (indica cultivar-group)
MPVPLAPYPTPPVPFTPPNGAQSQLVCSGCRNLLMYPAGATSVCCAVCSTVTAVPAPGTEMAQLVCGGCHTLLMYIRGATSVQCSCCHTVNLAMEANQVAHVNCGNCRMLLMYQYGARSVKCAVCNFVTSVGEHWDPGDLYNLSDCHPKLMSAWQQLAVMACDAF

SEQ ID NO: 51869 - protein, 134 aa, Zea mays
VTENGKQERHLVATVGKYSVVWNFLQVKNSHHECYQYQEGLKTCYCYKVIPKDESIVASRFMHDSSGTQSLSFGSFRTKITYSDCYAASKGTKEFQIYHTTSREEKIRELPFNNTSPKGIALRKSELKTVLPPR

SEQ ID NO: 51870 - protein, 330 aa, Chromobacterium violaceum ATCC 12472
MKSLEIHLIRRPTGMPSADLFALEEVALPKLQTGQALIENLYLSVDPYMRECMDLEEEWPLHTPLEGRSIGRVIDAGSSGLNVGELVFHREGWRSHAAVAAEELRVLKEYPGVSASAFLSIMGGTGLTAYVALSRIAKLQAGEDIFVSAAAGGVGSAIAQLARLMGAGRLIGSTGSAAKARYLTETLDYDFAIDYHSQDLSQALGEAAPEGFDIYIDNVGGKHQEAAIRHIRDHGRIAWVGAVGQYNHAESPELARNLYDIVGKSLRLEGFLVRNYRHLQDELEAFVVPHLQSGRLQPQQTVREGLENMAQAFVDMLAGANLGKMLIKLA

SEQ ID NO: 51871 - protein, 379 aa, Nicotiana tabacum
RPPAGQVIRCKAAVAWEAGKPLEIEEVEVAPPQKSEVRLKILFTSLCHTDVYFWEAKGQTPLFPRIFGHEAGGIVESVGEGVTDLKPGDHVLPVFTGECQQCRHCKSEESNMCDLLRINTDRGVMIHDGQTRFSKDGKPIYHFVGTSTFSEYTVVHSGCVAKIDPQAPLDKVCVLSCGISTGLGATLNVAKPTKGSTVAIFGLGAVGLAAAEGSRIAGASRVIGIDLNPSRFNDAKKFGVTEFVNPKDYDKPVQQVIAEMTDGGVDRSVECTGNVNAMISAFECVHDGWGVAVLVGVPNKAMRFKTHPMNLLNERTLKGTFFGNYKPKTDLPSVVGKYMNKELELEKFITHQVPFSEINKAFEYMLKGEGLRCMITMEH

SEQ ID NO: 51872 - protein, 556 aa, Zea mays
MCTPMSPWMGRLRSHHATPQSFPKRRPPSQTKNPEEKEELQTWKKHTARKKTARGRHAGAAAQQPRAFLRGSSRLAGRDYEHPIMIDDDVNEECKSRADQSAITPLRRSPRFHLEDKSLSKSLLPPNRCETSPNRKTKNAHRKDKNQESLKGNRGSAGFPPRKDISDVSNKKSDKQELKPIHCKVQTGKRKRGTERRLLSKKQSCQDPGPLPAYRQEIASCNESRKSTHRRIENDPSTEVKLKVGDVRLANIDENINKPSGTQREGIEIFCGPDDWTKEQDMALRKAYFSARPSPHFWKRVSKMVPGRSAEDCFNRIYTDLSTPTPIAPRPRASKTTFSPIGNFTLSDPKPPNILEPTVGMRKSAKQKSLVAQKTVRHLLQKHCRIDQAQEADHFSVFESSPSALQLNLSFDNSPGTPDSYMNSDSLGKHSGRSSARKKPFSRLRTKPSEPSPGVLKPIKNVILHERYIDKLARREGAKRPRRRAPAGSKAADSGKSLSEQQAGSLKAAKNALISEATDFISSFKTLQANSLAHAVENSEDEIECDASDCSHDDKE

SEQ ID NO: 51873 - protein, 372 aa, Zea mays
MPKKGTKSKKEKVDDVPNEQENKLPDYLELQRTRVVCNADAPIHTQGFQYSGAFAAMGIDNSVSVDKFCKNFKIEINRLTEDYMEFDMIGIDASIANAFRRILISEVPTMAIEKVFMADNNSVIADEVLSHRLGLIPLDADPRLFEYISENDVPNERNTIVYKLHVSCPKNSQRITVKSSELEWLPEGSQLSMSAPAQSGDKQKTFTSFSQSQKEILEKPLGVKFKDITIARLGPGQAIELEAHAVKGTGNVHAKWSPVATAWYRMLPEVVILKEVEGPQAEELVNKCRVNVFDIEDLANGGKRAVVARPRACTLCRECVMGPNEKQVELRRVRDHFIFTIESTGSMPPEVLFTEAVKILEEKCARVISELS

SEQ ID NO: 51874 - protein, 518 aa, Pinus taeda
MDVNILTMFVTVSALALACSLWIASYLRNWRKKGVYPPVVGTMLNHAINFERLHDYHTDQAQRYKTFRVVYPTCSYVFTTDPVNVEHILKTNFANYDKGTFNYDIMKDLLGDGIFNVDGDKWRQQRKLASSEFASKVLKDFSSGVFCNNAAKLANILAQAAKLNLSVEMQDLFMRSSLDSICKVVFGIDINSLSSSKAESGPEASFAKAFDVANAMVFHRHMVGSFWKVQRFFNVGSEAILRDNIKMVDDFLYKVIHFRRQEMFSAEKENVRPDILSRYIIISDKETDGKVSDKYLRDVILNFMVAARDTTAIALSWFIYMLCKHQHVQEKLLEEIISSTSVHEDQYSTECNDIASFAQSLTDEALGKMHYLHASLSETLRLYPALPVDGKYVVNEDTLPDGFKVKKGDSVNFLPYAMGRMSYLWGDDAKEFKPERWIQDGIFHPKSPFKFPAFQAGPRTCLGKDFAYLQMKIVAAVLVRFFKFEAVKTKEVRYRTMLTLHMNEDGLNVQVTPRLNSD

SEQ ID NO: 51875 - protein, 348 aa, Salmonella enterica subsp. enterica serovar Paratyphi A str.
MTVRIAINGFGRIGRNVVRALYESGRRAEITVVAINELADAAGMAHLLKYDTSHGRFAWEVRHEREQLFVGDDVIRILHERTLADLPWRELGVDVVLDCTGVYGNQEHGEAHIAAGAKKVLFSHPGSNDLDATVVFGVNQNQLRAEHRIVSNASCTTNCIIPVIKLLDDAYGIESGTVTAIHSAMNDQQVIDAYHSDLRRTRAASQSIIPVDTKLAAGITRIFPQFNDRFEAIAVRVPTINVTAIDLSVTVKKPVKASEVNQLLQKAAQGAFHGIVDYTESPLVSIDFNHDPHSAIVDGTQTRVSGAHLIKTLVWCDNEWGFANRMLDTTLAMAAVDFRLDASASTKL

SEQ ID NO: 51876 - protein, 271 aa, Triticum aestivum
PASEIKAYLGDLIEQVCTKKQAGTGPEFPGISSTHASEAAVSKNTRAIMINTPHNPTGKMFTREELEFIADLCKENDVLLFADEVYDKLAFEADHISMASIPGMYERTVTMNSLGKTFSLTGWKIGWAIAPPHLTWGVRQAHSFLTFATSTPMQSAAAAALRAPDSYFEELKRDYGAKKALLVDGLKAAGFIVYPSSGTYFVMVDHTPFGFDNDIEFCEYLIREVGVVAIPPSVFYLNPEDGKNLVRFTFCKDDDTLRAAVDRMKAKLRKK

SEQ ID NO: 51877 - protein, 197 aa, Zea mays
HEDDADADVSMAAIISLGLIGAGTNNARIAAMLRNLSSYYYKEAAHLFCVRIAQGLVHLGKGLLTLSPYHSDRFLLSPMALGGLVTVLHACLDMKSTILGKYHYILYIIVLAMQPRMLLTVDEDLKPLSVPVRVGQAVDVVGQAGRPKTITGFQTHSTPVLLAAGERAELATEKYIPLTPVLEGFVILKKNPEYHEE

SEQ ID NO: 51878 - protein, 562 aa, Bacillus cereus G9241
MTTTTTVKSDIEIAQEASMKKIQEIAADLNILEDELEPYGHYKGKLSLDIFKRLQNEKDGKVVLVTAINPTPAGEGKSTVTVGLGQAFNKIGKKTVIALREPSLGPTMGLKGGAAGGGFSQVVPMEDINLHFTGDIHAITTANNALAAFIDNHIQQGNTLGIDTRKIVWKRCVDLNDRALRNVVIGLGGPVQGVPREDGFDITVASEIMAVFCLATDIQDLKARLSRIVVAYNFANQPVTVKDLGVEGALTLLLKDALKPNLVQTLENTPAIIHGGPFANIAHGCNSVIATTMAAKLGDYVITEAGFGADLGAEKFLDIKARAAGIKPEAVVIVATIRALKMHGGVAKDQLKEENVDALAKGMENLQKHVETIQSFGVPFVIAINKFITDTDAEVAYLQEWCNERGYAVSLTEVWEKGGQGGVDLAEKVLKEIEKGENNYAPLYELELPLEEKIRTIAQTVYGAKDIEFAPKARKQLAQYEGEGWSNLPICMAKTQYSLSDDATKLGRPSDFIVTIRELKPSIGAGFIVALTGTMLTMPGLPKQPAALQMDVNEDGKAVGLF

SEQ ID NO: 51879 - protein, 221 aa, Arabidopsis thaliana
MDSLATDPAFIDSDVYLRLGLIIEGKRLKKPPTVLSRLSSSLERSLLLNHDDKILLGSPDSVTVFDGRSPPEISIAHYLDRIFKYSCCSPSCFVIAHIYIDHFLHKTRALLKPLNVHRLIITTVMLAAKVFDDRYFNNAYYARVGGVTTRELNRLEMELLFTLDFKLQVDPQTFHTHCCQLEKQNRDGFQIEWPIKEACRANKETWQKRTPDSLCSQTTAR

SEQ ID NO: 51880 - protein, 309 aa, Zea mays
  misc_feature (118)..(118): Xaa can be any naturally occurring amino acid
  misc_feature (157)..(157): Xaa can be any naturally occurring amino acid
  misc_feature (178)..(178): Xaa can be any naturally occurring amino acid
  misc_feature (231)..(231): Xaa can be any naturally occurring amino acid
MASDGSGVVTVYGSNGAELLEPSKQPKSATFSVKVGLAQMLRGGVIMDVVTPEQARLAEEAGACAVMALERVPADIRAQGGVARMSDPGLIRDIKRAVTIPVMAKARIGHFVEAQILXRAVGVDYVDESEVLTPADDAHHINKHNFRVPFVCGCRDXSAEGAPQGVREGAAMIRTQGXRAGTGNVVEAVRHVRSVMGDVRALRSMDDDEVFAYAKRIAAPYDLVMQTKQLXATPADAALMMQLGCDGVFVGSGIFKSGDPARRARAIVQAVTHYSDPTILADVSTGLGEAMVGINLNDPKVERYAARSE

SEQ ID NO: 51881 - protein, 488 aa, Prochlorococcus marinus str. MIT 9303
MAGRLNQQNQRVRPNSNEDQVVQQVKEHFERTLIEVGGTVAGSVAALEHQPHNKALNYGEVFLRDNVPVMIYLLTQKRYKEVKQFLSVCLDLQSTTYQTRGVFPTSFVEEQGELIADYGQRSIGRITSVDASLWWPILCWLYVKRSGDKNFGTNQKVQRGVQLMLDLVLHPTFEGTPVLFVQDCSFMIDRPMDVWGAPLEVEVLLYACLRSCIELMELSRKNHVSRLLDQRLLLTRQWVHDLRQFLLKHYWVTSKTMQVLRRRPTEQYGDNQHQNEFNVQPQVVPDWLQDWLENRGGYLIGNIRTGRPDFRFYSLGNSLACLFGLLTAPQQRALFRLVLHNRQHLMAQMPMRICHPPMEGAEWQNKTGSDPKNWPWSYHNGGHWPSLLWFFGASILLHERRHPEADVLLMGEMRALLEECYWSQLNQLPRQKWAEYFDGPTGTWVGQQSRTYQTWTMVGFLLLHHLLRVCPDDVLWLDLDELLPTHEV

SEQ ID NO: 51882 - protein, 378 aa, Oryza sativa (japonica cultivar-group)
MAASGVKRPPRPAPASSGGKLFVIFELNMEEVPRVRKLILALAVFLPALLYSQLQPPPPKICGSPGGPPITGTRTRLKDGRYLAYLESGVPKEQAKYKIIFVHGFDSCRYDALPISPELAQELGIYQLSFDRPGYAESDPNLASTEKSIALDIEELADNLQLGPKFYLMGFSMGGEIMWSCLKHISHRLAGVAILAPVGNYWWSGLPSNMSWHVWNQQLPQDKWAVWVSHHLPWLTYWWNSQKLFPASSVIAYNPALFSEGDKLLLSKFAFRTYMPQIRQQGEYGCLHRDMTVGFGKWSWSPLELEDPFAGGEGKVHLWHGAEDLIVPVSLSRYLSEKLPWVVYHELPKSGHMFPLADGMADTIVKSLLLGDQPPQAS

SEQ ID NO: 51883 - protein, 2220 aa, Magnaporthe grisea 70-15
MAARVFPPASARIVDSASDNKLICLELEDGSAYQGYSFGAPKSIAGELVFQTGMVGYPESVTDPSYRGQILVITFPLVGNYGVPSRETMDELLGDLPAHFESSQIHIAGLVAASYSGEDYSHYLATSSLGTWLKEQGIPAMYGVDTRGLTKHIRNHGSMLGRMLLQRASATESGNELFVTKFATPDWSQYFETVDWVNPNKKNLVAEVSIKAPKLYKPPQNVALKHPSGRPIRILCLDVGMKYNQLRCFLKRGVEVLVCPWDYDVSKGAGTEYDGLFLSNGPGDPSVVQDTVKRISAAVAANKTPIFGICLGHQLLARASGATTIKMKFGNRGHNIPCTSMVTGKCHITSQNHGFAVDAATLPTGWKELFVNANDGSNEGIMHVDQPHFSVQFHPESTPGPRDTEFLFDVFINTVVKCAADSSLLQKPVSFPGGTLEENERLHPRVHVKKVLVLGSGGLSIGQAGEFDYSGSQAIKALKEEGIYTVLINPNIATIQTSKGLADKVYFLPVNADFVRKVIKYERPDAIYVTFGGQTALSVGIQLKDEFEELGVKVLGTPIETIITTEDRELFARSMESIGEKCAKSASASSVDECMRVVKDIGFPVIVRAAYALGGLGSGFANNEAELLDLCNKALAASPQVLIERSMKGWKEIEYEVVRDAQDNCITVCNMENFDPLGIHTGDSIVVAPSQTLSDEDYNMLRTTAVNVIRHLGVVGECNIQYALNPFSKEYCIIEVNARLSRSSALASKATGYPLAFIAAKLGLGIPLKEIKNSVTKVTCACFEPSLDYVVVKMPRWDLKKFTRVSTLLGSSMKSIGEVMSIGRSFEEAIQKAIRAIDFHNLGFNETKALMSIDDELQTPSDQRLFAIANAMASGYTVDKIWEMTKIDKWFLNKLKGLSDFAKTMSGFSKDNISGRPDLLLEAKRLGFSDRQLAKFWSSNELAVRSLRLEAGITPFVKQIDTVAAEFPAFTNYLYLTYNATEHDIALDDHGVMVLGSGVYRIGSSVEFDWCSVRAIRTLRQQGYKTIMVNYNPETVSTDYDEADKLYFENINLETVLDIYEMEAANGILGAMGGQTPNNIALPLHRYGAKILGTSPEMIDTAENRFKFSRMLDRIGVDQPTWKELTSFEEAKKFCQAVSYPVLVRPSYVLSGAAMNTVYSEADLESYLKQAAEVSREHPVVITKYIENAKEIEMDAVAKDGKVVGHFVSEHVENAGVHSGDATLILPPQDLEKTTIERIEEATRKIAGALNVTGPFNIQFIAKDNDIKVIECNVRASRSFPFVSKVMGVDLIEMATKAIMSVPFEAYPEEERTSSAVACKVPQFSFSRLSGADPVLGVEMASTGEVACFGRDKYEAYLKALLSTGFKIPKNNILLSIGSYKDKKEMLPSVANLQRLGYKLFATAGTADFLQEHGIPVQYLEALGSEDDGQKSDNKYRRPANYMSKGYQTRRMAVDYQIPLVTNVKNAKILVEAIARHFELEVGLRDYQTSHRTMILPSLINIAAFVPGIVSLGSKDLSTVTRASVAAGFSMIRVMPVGVDGAITDAKSLKVAQQNAKSDTYCDFNLSVSATSSNSDQISQVMAEVGSLFIPFNHLSDNISKVAAVTAHFDSWPAHKPIITDARTTDLASILLLASLHNRRIHVTCVTSKDDIRLIELSKQKGLKVTCDVSVYCLYLSQKDYPDCQQLLPTYEDQQALWEHMSTIDVFSIGSLPYQLAHTLSHDTDAAVGIADVLPLLLTSVSEGKLTMDDIKSRLHDNPMEIFELHEQVGTSVEVELNRSYTLPKSTNWSPFAGRQVRGSVQRVTFEGKVVCLDGQALPVLAMGKDMSTHNALPSLPMSPPLKAAQQIPESPVIRRQSMLSSGPRPLLRPRYIDSAMSALSPTVNKSAVDTEIPSQSIPPAVSTSSLGELLSAPSRFKNQHVLSVHEYKRSDLHHLFTVAQEMRLGVQRDGVLDVLRGRVLCTLFYEPSTRTSASFDAAMQRLGGRTIAIATSHSSVQKGETLQDTLRTVGQYGDAVVLRHPQEQSVDIAQKFSQVPVINGGNGSKEHPTQAFLDLFTIREELGTVQGLTITFVGDLLYGRTVHSLANLLRHYEVRIQLVSPKSLSLPAYVRNQLVERGQLLCESETLTQEIVARSDVLYCTRVQKERFPSAEAYEAVKGAYRIDNAMLRQAKANMIVMHPLPRNDEIAEEIDFDQRAAYFRQMRYGLYCRMALLALVMS

SEQ ID NO: 51884 - protein, 182 aa, Glycine max
MGASDDNNNNFLQVVFNNFDVLALPLVTLVYPLYASIKAIETKSTTDDQQWLTYWILYSILTIFELTFAKVLELLPIWLFAKLIFSCWLVLPHFNGAAVVYRNYIRPFYMNPQIPIPQGSQIWYFPQKKSLFNEPDDVLSAAERYMEEHGTEAFERLISKNDRQARARRNGNYMIFDDDYIY

SEQ ID NO: 51885 - protein, 262 aa, Arabidopsis thaliana
MPSKLLPVLVCYVFLFPFASSSDYSGVSLPSSSPKVSVGLYYESLCPYCSSFIVNHLAKLFEDDLISIVDLHLSPWGNTKLRSDNVTAVCQHGAFECFLDTVEACAIDAWPKVSDHFPFIYCVEKLVTEHKYDKWETCYEKLNLNSKPVADCLSSGHGNELALHYAAETNALQPPHKYVPWVVVDGQPLYEDYENFISYICKAYKGNKVPGACTKYATGNFIRSVKLKRSPLVSWKGVNKMWDVLERITTSLSSYIDITGLL

SEQ ID NO: 51886 - protein, 569 aa, Nicotiana tabacum
MELVVDSGVRKMEGEAMTRNETLICAPIMADTVDQMLNLMQKAKISGADLVEVRLDSLKSFNPQSDIDTIIKQSPLPTLFTYRPTWEGGQYAGDEVSRLDALRVAMELGADYIDVELKAIDEFNTALHGNKSAKCKVIVSSHNYDNTPSSEELGNLVARIQASGADIVKFATTALDIMDVARVFQITVHSQVPIIAMVMGEKGLMSRILCPKFGGYLTFGTLEVGKVSAPGQPTIKDLLNIYNFRQLGPDTRIFGIIGKPVSHSKSPLLYNEAFRSVGFNGVYMPLLVDDVANFFRTYSSLDFAGSAVTIPHKEAIVDCCDELNPTAKVIGAVNCVVSRLDGKLFGCNTDYVGAISAIEEALQGSQPSMSGSPLAGKLFVVIGAGGAGKALAYGAKEKGARVVIANRTYERARELADVVGGQALSLDELSNFHPENDMILANTTSIGMQPKVDDTPIFKEALRYYSLVFDAVYTPKITRLLREAHESGVKIVTGVEMFIGQAYEQYERFTGLASSKGTFQENYGWILRARSLSLFNAALLVTFPPKSLHSCVIAMVLDSSALPFVLRRN

SEQ ID NO: 51887 - protein, 291 aa, Musa balbisiana
MTDHVKWTSVESKTSTNAAPISSSSSSRSPSMASSSGAGTAVEHKRARDIRKHPVYRGVRMRAWGKWVSEIREPRKKSRIWLGTFATPEMAARAHDAAVLSVKGAPAAAAVLNFPELAGSLPRPASLSPRDVREAAARAAAMDMPRANAAALVVEDDELEEIVELPRLGQDLFGSAHLAGEFVFHDSISTASGALSFGASSKCPSCLLLHVLLLPSTAQLTRKERRNSVLLLARNRCKSISCLSPKRLSSRRNSWCSSRGTNSREQTAAIIPRLAFCSSLEDPTIIADAFH

SEQ ID NO: 51888 - protein, 1064 aa, Clostridium perfringens str. 13
MFDSVKRKLVCYDDNEYYIEISPLTNTIRATLCCKGAIEAYLVGDFNNWEKSENFKLNWGLDTNDGRVKMIKDITFPCGLKKGEYKYGYIIITLDGKEIYVDNLNEEKNDFYFLWEPFEESLEIKSSRDFISTRYPVELIAVKNSFYGNITIEEAVLSLENSLKGVTLENGFLKINEEVAPGTKIIVKAYDSLNDMTAYKEIEVREEGEKGTFVQFLKNDGLYYGENFSWNIWGFGENSSGKEFNLNIKTDLGVGTFVDEEKFIVRKRTWGCNWVNDWNEQTYTFYLGKKDRNLFCIYENNKILTSLKTAIEETTPKIQVALMDHKNTIKAYLSHKPLIGVKYGLYINGIKAKGVSTIVRENEKEVLITNLPSDIDPSDLLEVRASSMFSSCKVIVRDYLNDYYYGGNDLGVRFSEENISLRLWAPTAKKVELLIYEDYKSLRENPLRKYDMNREKENGTHLIKVPRKENEGKYYLYRLYFNDLSKEGKHINKITYAVDPYAVSVGVNGEKGALVDLFSKECVPEGWNKYNKPKLINKEDSIIYEMHIRDFTINENSGVSERLRGKFLGAVEEGTFYINKENGNKVKTGLDHLKELGITHVHLLPVFDFASVNEEISNDENNRNWGYDPKNFNAIEGSYSTDPYTPSRRIIEFREMIKRFHDNGIRVILDMVYNHMYETSNMDNIVPLYYFRSDKLGKYTNGSGCGNEMASEKPMVRKFILDSILHWIKNYHIDGLRFDLMELIDLDTMKEIVKRSEEIDEKILIYGEPWKGGDSPLSNGTYKGSQKGLGFSIFNDDFRNALRGNNDPSNGFINGEQHNKNKAWQVIEGIKGSINSITYKPMESINYLEAHDNYTLWDQIVKSQNHSVEKGHYRDFNEENILDNFYVKEDLLGASILFTSQGIPFIQSGAEILRSKDGDHNSYKSPDSINALNWAEKEKYIDVFNYYKDLISLRKNHSAFRMKKPEDIIENLEVYFYDNNDTSGVIIAHYKNNANEDLWKDIVVIYNGTTIDDYNVISSMPKSSNGFWNIAVKNGGVNQLGIERVSEDEIPKIKSHSMMILYDE

SEQ ID NO: 51889 - protein, 380 aa, Schizosaccharomyces pombe
MVQTAALHGPKPMDSSHIKVTNVKELKPLPEWKSLKFGENFTDHMLIMKWNREKGWSTPEIVPFGKLCFHPASSVFHYGFECFEGMKAFRDEKGVPRLFRPIKNAERMLSTGTRISLPSFDPAELAEIIRKFVAHENRWVPDQRGYSLYIRPTFIGTDEALGVHHCDNAMLYVIASPVGPYYSSGFKALSFVAPKKSVRAWPGGTGHYKLGGNYAPSVLPQKEAAKKGYAQILWLYGDEDYITEVGTMNCFTVWINKNGEKEIITAPLDGMILPGVTRDSILEICRERLAPKGWKITEGKYSMKEVAQASKEGRLLEVFGAGTAALVSPVKAINYKGTEYEIPMPEGQEAGPITSEISKWILDIQYGKEPNNPWSVPALP

SEQ ID NO: 51890 - protein, 537 aa, Aquifex aeolicus VF5
MSKKVVILGSGPNRIGQGIEFDYACVHAVFSLQEEGYYAVMVNCNPETVSTDYDTADKLYFEPIVFEHVMDIIEREKPEGVILQFGGQTPLKLALPLQKNGVKILGTKPESIDKAEDRELFRELIIELGLKQPPSGTARTKEEALKIAKEIGFPVLVRPSYVLGGRAMRIVYDEEELKEYLEEAVSVSHERPVLIDKFLDNSIELDVDAVSDGKDVLIGAVMEHIEEAGVHSGDSATSIPPYSLSKEIVEEVKEQTRKLAVALEVKGLINVQYAVQNNEVYVLEVNPRASRTVPFVSKSIGYPLAKIATKVAIGKSLREILPEVFERLEKGEAHFASDFLPKEKKIFSVKEVVFPWKRFPEVDPILGPEMKSTGEVMGIDKEFGLAYYKAQLSAGYRLPEKGNLFISVADRDKPKILELAKEFEKLGFGIYATSGTYKFLKEHGVNAKRVLKVSEGRPNVVDMIINGEIHLVINTPSGKREKSDAYYIRRACVQFNVPYYTTMRAGYAVLEAIKSIKKLKEEGKGLSVHSLQEIYNI

SEQ ID NO: 51891 - protein, 186 aa, Brassica napus
MGSMGQKVKWSWSSALIGAASAAAATSLLSAKPKDPTFHLISIDLTSLKLNLPVLDAELMLTVHVTNPNIAAIHYSSTTMSILYDGTVLGTAEVKAGSQPARSCQLLRLPARLDGMELAQHARRFFADVAKREMKLQAKLDIEGAAKVLWWDHSFRVQVDSFVTVDPVFLDIIGQDNRSQNDLFLA

SEQ ID NO: 51892 - protein, 150 aa, Brassica napus
VNPRYIPSLKATFTFPQSLGVLGGKPGASTYIVGVQEDNGFYLDPHDVQQVVTVNKETLDVVDTSSYHCNVLRYVPLESLDPSLALGFYCRDKADFDDLCHRASTLAEESKGAPLFTVTQTHSLVNHHSSCEFVEDREEEHGEEDDWQLL

SEQ ID NO: 51893 - protein, 453 aa, Musa balbisiana
MESKSTGRFTLGKQSSLAPDRGCSDDSSYGDGFRFPDDVDANIRLMYLTSEGDLEGIEEILASGVDVNFRDIDGRTALHVAACQGFADVVRLLLDRGAQPLADAIHYNNHEVIDLLEKHGAKLSIIPMHVKNAREVPEYEIDPSELDFTHSVNITKGTFRLATWRGIRVAVKKYGEDVLVDENKLWVGRAFRDELALLQQIRHPNVVQFLGAVTQSSPMMIVTEYLPKGDLRAYLKHKGALKPSSAVRFALDIARGMNYLHEHKPEAIIHRDLEPSNILRDDSGNLKVADFGVSKLLKVAKTVREERSLTHLGTACRYVAPEVFCNEEYDTKVDVFSFALILQEMIEGCPPFCYKQDNEVPKAFVSKQRPPFGAPPKLYVHGLKELIEECWSENPADRPTFKDIIDRLLNIQNYIDRKRHWRVSFLNFYLMMHFFSFWSSYYLAHKKQLLFSL

SEQ ID NO: 51894 - protein, 587 aa, Chromobacterium violaceum ATCC 12472
MSIILHGVAIGGGIAIGRAHLISRSMDDVAHYLLEDDEIPAEKTRFDEAVKATRKELEMLWGSIPENAPAELGAFLSLHIMLLGDVTISREPREIIEKQRCNAEWALKLQCDHLVEQFDAIEEDYLRERKNDVLQVIERIFTNLDGDSPQLPAPEDLVEDHILVAHDLSPADMVYFKDSNFAAFVTDVGGATSHTAILGRSLDLPSVIALHHARELIREDEMIIVDGEQGVVIINPDALVLAEYRRRLRAWRGARRKLSSIRKSNAVTRDGTVIELLANIERPQDVEEVRESGVVGIGLFRSEFLFLGRDTLPTEDEQYEAYRHVATAMKGMPVTIRTMDLGADKSPKWLNHCQAENPALGLTGIRLCLAEPLMFRAQLRALLRAQLRALLRASVHGRIRVLFPMLNSLPELRQAIAQFEYAKEELRDEGIGYADDVEVGAMIEIPSAALVAGSLAKHVDFLSIGTNDLIQYTLAIDRNDDTVSHLYDPIHPAVLKLILHTIKTGTKANLPVSVCGEMAGDARLTRLLLGMGLRKFSMHPANLLSVKQRVLTSHLDEIAPIATRMLRSEDPDKIADLLQMLNAEPGT

SEQ ID NO: 51895 - protein, 424 aa, Arabidopsis thaliana
  misc_feature (308)..(308): Xaa can be any naturally occurring amino acid
MNSSSPISIDLIAEILSRVPSKSVARFRCVSKPWASMIRRPYFTELFLTRSSPKPCILFATVADGVWSFFSLPQYPYEKSSSASVAASAKFHVKFPPNNMRIGHNSDRRYFSYGYTSGLIYLYGDSSDDRSVICNPYTGEYAILPYLQRYRKTYSFLVFEPIEKQFKILFMAYLSGDRDHKILTVGTGNMKWRTIRCSLRYEIVSEGVSINGVLYYLGETSAWDNKDYDLKYDYAIVCFDIRSEKFIFFEIERFCRLINYKGKLAVIYFEDDVNYQSCLYRKKNYVEPDAINKLNVWVLEDVEKQEWXKYAYTWTDDIFFRRREVSVAPTTAAWGDIVFSMCEYTPGQPFYVFYFNPEKSTLQRVEIQGFGEGVCSVYTFVDDVEDLNVKDLKILKPSNAPFEKTEDSEYEEEYEEEDGDDGWS

SEQ ID NO: 51896 - protein, 362 aa, Vibrio cholerae
FTDTKGKEQHISIPAHQIDADFFEDGKMFDGSSVAGWKGINESDMVMMPDPSSAVLDPFTEDATLNIRCDILEPATMQGYDRDPRSIAKRAEEYMRSTGIADTVLVGPEPEFFLFDDVKFATNMSGSFFKIDDVEAAWNTGTEYEDGNKGHRPGVKGGYFPVAPVDSSQDIRSAMCLIMEEMGLVVEAHHHEVATAGQNEIATRFNTLTTKADEIQIYKYVVHNVAHAFGKTTTFMPKPLVGDNGSGMHVHQSLAKDGVNLFAGDKYGGLSETALYYIGGIIKHARALNAITNPSTNSYKRLVPHYEAPVMLAYSARNRSASIRIPVVPSPKARRIEVRFPDPAANPYLAFAAMLMAGYDGI

SEQ ID NO: 51897 - protein, 171 aa, Citrus maxima
HNLLFILGFNAFGGFSIFLPKLINAIASDTTGLQAKLRSEVKEKCGTSALTFESVKSLELVQSVVCETLRLNPPVPLQFARARKDFQLSSYDSVYDIKKGELLCGYQPLVMRDSKVFDDAESFKAERFMGDKGSELLSYLYWSNGPQTGTPNDMNKQCAGKDYVTLVACLT

SEQ ID NO: 51898 - protein, 199 aa, Coccidioides immitis RS
MADHEHDDDLNPTKTEGFKVGEKKTVEEYQKLDANDESLNRWKASLGLGSGTAISDPNDPRKCIIKSLALEVEGRPDITVDLSAPGSVEKLKDKPFTIKEGCKFRMKATFVVQHEVLSGLKYVQVVKRKGVRVSKDQEMLGSYAPNTTDKPVYEKKFNEEQAPSGMLARGHYTALSRFVDDDDTTHLQFEWSFDFAKDW

SEQ ID NO: 51899 - protein, 648 aa, Bacillus cereus G9241
MFFQFFLLAVIMSFISGRLIGTKLNFFKQASAATLGVSLTSAMYWFLYLRYQDETIVGVDRYFWLGSSLIVSMLCYLVFELFDPIKRGEMDDVVMESRNPIAKFFAKIGRQKRYMRVSSIAIKHGMGKYLALKRSPEADRKLAISLRNTLEECGGVFIKFGQVLSTRSDLLPPVFIHELSNLQENVTRLSQQQVEEILQKELHIPKDEIFSSFEMEPLAAASIGQVHKAKLKDSDQDVVVKLLRPNISETIKRDLDILIHFSLWISNKSTWAKNIGFVDLAHGFSMAMKEEIDFKIEARNFEQVSDSLKNSETTVKIPKVYQEYSNSKILVLEFLDGVSVKSGSALLNELQIDTKKVQRQLFDCILEQIFFKGIFHADPHPGNVYILRDGTPALLDFGSVGRLGTLQQDAFKRLLIGFERKNSYVLLDGLLQLVEKKPNVDKEGLEQSISQLLIQSTYVSTNSSEEFIQGLFQIIAEFELAFYPMVAGAFRSLITLEGTMLHLNPEFNLMDEAKRFAKDHAASFMPVNNYSSLKEAATNELLSMLPAMRRIPRKLDDLSSKLENGELSVKVGFFSDETNASFITTFISQFLIAFIGTAFGGISVGVLHLANNAKEPNDQFLSVVGYGGLFISAILLVRVAIHAVRKFK

SEQ ID NO: 51900 - protein, 302 aa, Arabidopsis thaliana
MGEVWRWNKEVEMDSIRDCLKHFSSIAIDTEFPGCLKETPMDASEEIRYRDMKFNVDNTHLIQLGFTLFDRRGITKTWEINLSDFNEHKCFKNDKSIAFLKSNGLNLDKIGEEGIGIEEFFRDFSQILKEKDGKITWVNFQGSYDNAYLVKGLTGGKPLPETKEEFHETVEQLLGKFVFDVKKIAESCSGLSSRFGLQRIADVLQMKRVGKAHHAGSDSELTARVFTKLTFDLLNSRKQCVRRVDHQQYQLEQQQLMMTRCYIPIPIPIPRPRSVMFAAHHPNPYFGGGYFGMPVQGRNYVL

SEQ ID NO: 51901 - protein, 154 aa, Methanopyrus kandleri AV19
MAEVQREFVMIKPDGVVRGLVGEVIRRLERKGLKIVALEMRQLDRETAEKLYEEHRDKPFFEDLIEYVTSGPVVVMIVEGRKAVKVVRNIIGATDPAEAAPGTVRGDFALDIGRNVVHASDSPESAEREIEIVFGKDLSTIDYERCDEEWLYES

SEQ ID NO: 51902 - protein, 475 aa, Listeria monocytogenes EGD-e
MAKEYDVVILGGGTGGYVAAIQAAKNGQKVAVVEKGKVGGTCLHRGCIPTKALLRSAEVLQTVKKASEFGISVEGTAGINFLQAQERKQAIVDQLEKGIHQLFKQGKIDLFVGTGTILGPSIFSPTAGTISVEFEDGSENEMLIPKNLIIATGSKPRTLSGLTIDEEHVLSSDGALNLETLPKSIIIVGGGVIGMEWASMMHDFGVEVTVLEYADRILPTEDKEVAKELARLYKKKKLNMHTSAEVQAASYKKTDTGVEIKAIIKGEEQTFTADKILVSVGRSANTENIGLQNTDIATENGFIQVNDFYQTKESHIYAIGDCIPTIQLAHVAMEEGTIAANYIAGKAAEKLDYDLVPRCIYTSTEIASVGITEEQAKERGHEVKKGKFFFRGIGKALVYGESDGFIKIIADKKTDDILGVSMIGPHVTDMISEAALAQVLNATPWEVGNTIHPHPTLSESFREAALAVDGNAIHG

SEQ ID NO: 51903 - protein, 327 aa, Listeria monocytogenes EGD-e
MPVISYIDAITMALKEEMERDDKVFILGEDVGKKGGVFKATAGLYDEFGEDRVLDTPLAESALAGVGIGAAMYGYRPVAEMQFADFIMPAVNQIISEAARIRYRSNNDWSCPMVIRAPFGGGVHGALYHSQSVEKVFFGQPGLKIVVPSSPYDAKGLLKAAIRDNDPVLFFEHKRAYRLLKGEVPETDYIVPIGEANVVREGDDITVITYGLAVQFAQQAAERLAAEGVEAHILDLRTIYPLDQEAIIEATKKTGKVLLVTEDNKQGSIISEVAAIISEHCLFDLDAPIARLAGPDTPAMPFAPTMEKHFMINPDKVADAMKELAEF

SEQ ID NO: 51904 - protein, 416 aa, Listeria monocytogenes EGD-e
MAVEKITMPKLGESVTEGTISSWLVKPGDTVEKYDAIAEVLTDKVTAEIPSSFSGTIKEILAEEDETLEVGEVICTIETEEASSSEPVVEAEQTEPKTPEKQETKQVKLAEAPASGRFSPAVLRIAGENNIDLSTVEGTGKGGRITRKDLLQVIENGPVAPKREEVKSAPQEKEATPNPVRSAAGDREIPINGVRKAIAKHMSVSKQEIPHAWMMVEVDATGLVRYRNTVKDSFKKEEGYSLTYFAFFIKAVAQALKEFPQLNSTWAGDKIIEHANINISIAIAAGDLLYVPVIKNADEKSIKGIAREISELAGKARNGKLSQADMEGGTFTVNSTGSFGSVQSMGIINHPQAAILQVESIVKRPVIIDDMIAVRDMVNLCLSIDHRILDGLLAGKFLQAIKAKVEKISKENTALY

SEQ ID NO: 51905 - protein, 103 aa, Pyrenomonas salina
MSGRGKGGKGLGKGGAKRHRKVLRDNIQGITKPAIRRLARRGGVKRISGLIYEETRSVLKVFLENVIRDAVTYTEHARRKTVTAMDVVYALKRQGRTLYGFGG

SEQ ID NO: 51906 - protein, 394 aa, Lactobacillus johnsonii NCC 533
MPKLSNDLSLTKNTRLNSLGPSKIRAFDEKASQIPGIIKLTIGEPDLNTPDHVKDAAIADIKANDSHYAPQAGKPELLEAISNYLDRSLDVKYDPKTEICVTVGATGALNDVFMSILNPGDKILVPTPVWALYFQLIKLTGAIPVQIDTSKDDFILTPEHLETVLQNEGKGAKAIILTDPSNPTGRVYPAATLKALAEVITKYHLFSVTDEIYGELVYDNNVHHSLSQYIPERNILISGLSKAYAMTGWRLGYIAAPADIMKTIQKVNAFLVTSVTDNVQAAAIEALNNGQADPLEARKIYEDRLEFMKTGLEKLGFEMSTPQGAFYIFAKIPDTFGTDDEAFANELATKAKVGVTPGRYFGKGGQGYVRMSYASSTEQLQEALKRIAKFVENI

SEQ ID NO: 51907 - protein, 721 aa, Zea mays
  misc_feature (286)..(286): Xaa can be any naturally occurring amino acid
MAVPTTTLSHRRISSYSLVASTAALLLVFHHHVPSTTAQPLPWQLCNDTSGNFTDKSAYQANINQLATALTNNASSSPSLFAAGAAGSAPDVAYALALCRGDTNASSCARCVAASFKTAQQLCAFKRGATLYDDPCILRYADWDFLTNTTDNRGLYIAWSYDNVSAAVAPAFDAASARLVNATSDYAATDPVRRFGTGEEPFDDAKYPKIYSLAQCTPDMTVADCRACLGGVYRRFAPTYFGGKHGGRVFGVRCSLRFETYHFFSGNPLLQIPGPPGAPPPAAPAXDMTPPATGQGGGGHKNRTRLVLAIALPLAAATAILALAVACLYYRSRRRTTAQRDSSGKPCSPSPDDIDKSIDSLLFDLPALRAATNNFAESNKLGEGGFGAVYKGILSEGQQVAVKRLSLGSTQGLTELKTELVLVARLQHKNLVRLIGVCLEEDEKLLVYEYMPNRSLDTILFGTFPLLAYLPKALSVRAIDSQKSKELDWWKRLEIVSGVARGLQYLHEESQLKIVHRDLKPSNVLLDSAYTPKISDFGLAKLFHMDQSQGATSHIAGTYGYMAPEYAMHGQYSVKSDVFSFGVLILEMVTGRKNSNSDQSVDLLSLVWEHWSSGTIQELLDPFLMSHRAPPDQMAKLVNIGLLCVQDSPADRPLMSSVNVMLSSDTISLQAPSRPTFCIQETEDHSRPYSDAYKRALKLQSSTDRAAMSPNEVTLTELEPR

SEQ ID NO: 51908 - protein, 418 aa, Geobacter sulfurreducens PCA
MATDITMPKLSDTMTEGRLVAWKKGVGDRVERGDIIAEVETDKATMELEAFASGVLAEQRVKPGELVNVGTVIGVIGGADEVKPTEKAAAAPPELADWQPPPEAPANGAEPEIPERVLELPEASAPPAPLPPGDDTKASPAVRRLAREKGIDLHQVRGSGPEGRILMEDLDQVAANEEPPAAQAGQVSAGESPAPPEAEPMTRMRGAIARITAEAWRTIPHFYETVEIDMKEAGEIVRELKGSGNAVTYNDLVLKAAALALVQFPRMNASFRDGGVVAHREVNIGFAVAMEEGLQVPVVKGCQSLALKEIALQTVRLAERARSGAITQEEISGGTFSVSNLGMYGIDEFAAVIMPPQAAILAVGAVADRPVVRDGQLAVARTMRATLSCDHRVVDGAYAAQFLGELRRVLENPVLMLV

SEQ ID NO: 51909 - protein, 328 aa, Geobacter sulfurreducens PCA
MPEMNYRDALNLALKEEMRRDPSVVVWGEDVALYEGSFKVTRGLLAEFGEERVKDTPISENSIVGVAVGAAMGGLRPVAELMTVNFALLAMDQIVNHMAKIRSMFGGQTYLPMVVRAPGGGGSQLGAQHSQSLETYFMHCPGIHVAVPATPADARGLLKAAIRDDNPVMFLEHELLYNSKGEVPDDPESVIPFGKADVKREGKDLTIVAYSRMTILALQAAEELAKEGISCEVVDLRTLTPLDTATFTASVKKTGRAVVVEECWRSAGLGGHLAAIIAEECFDRLLAPVRRVSGLDVPMPYSRKIEKLCIPQPETIAAAVRETLSGTY

SEQ ID NO: 51910 - protein, 119 aa, Medicago sativa
RKQLATKAARKSAPTTGGVKKPHRYRPGTVALREIRKYQKSTELLIRKLPFQRLVREIAQDFKTDLRFQSHAVLALQEAAEAYLVGLFEDTNLCAIHAKRVTIMPKDIQLARRIRGERA

SEQ ID NO: 51911 - protein, 496 aa, Pseudomonas syringae pv. tomato str. DC3000
MFDTKPHLPDALYSAAQVRDLDARLIAAGTPGLELMQRAAHATWRAIRRRWPEANQLTVLAGRGNNAGDGYLVAALAHKAGWQVNVLAVSDPAGLTGDAASAHAAASGIDTQAWGGQPLAGVVLDALLGTGLNGEVREPFLSAINAINASGLPVAAVDIPSGLSADTGHKSGATVRADLTVTFIGLKLGLLTGDAADLVGELVFDDLQADPALVAQTPASAKRLDAHNLPYLAPRPRTAHKGLFGRVLVIGGDHGFGGAALLCAESALRSGAGMLTLATRAEHVPAALTRMPEIMSAAIRSANQLMALIEPASVLVVGPGMGQGSWGRSLLSAAANADRPQVWDADALNMLAAGQVSLPKNSVITPHPGEAARLLGVGIKDIQADRPAAVRALARKFNTVCVLKGSGSLIADADGRLALCNHGHPAMATAGLGDVLAGLIGALMAQHLTPFDAACLAVWLHASAGQKVGESGRGLAASDIIPAIRQLLEELQPCLI

SEQ ID NO: 51912 - protein, 250 aa, Burkholderia mallei ATCC 23344
MQSIPLSLPLSRTAFFFDFDGTLVDLASTPDAIQVPPDVPVLVDALRQLSHGAVAIVSGRGIDSIDAYLNLPGLPVAGLHGAERRDANGDTQRIGFDDPLLLRIERELAALVDRHPGMLLEIKGAALALHFRNAPEREGVARAAAERLVADYADAYVLQPGKMVFEIKPKGVDKGRAVAAFLNEPPFAGRMPVFAGDDLTDEQGFAVANANGGLSIKVGAGDTTARARVDSVAALRAQLARWIAEGRAPA

SEQ ID NO: 51913 - protein, 325 aa, Geobacter sulfurreducens PCA
MATTLRAILPDSELLKMHEQMVLSREFEESCAEQYTKGHITGFLHLYSGQEAVAVGATAALRKDDYILSAYREHAQAIVRGAEPRRVMAELFGKATGMCKGKGGSMHLFDPSLAFMGGYAIVGGQFPIAVGLAFASKYRKEGRISACFFGDGAVNQGTFHESLNWARLWELPVLFICENNFYGIGTAVSRASALSDIHKRTCGYDIPSVRVDGMDVMAVHEAVKWGAEWVREHSRPYLIEAMTYRFRGHSMADPGKYRSAAEVELWKSRDPIPNFEKRLVEEGIATEAELAAVLEKCRGVVADAVAFAEESPWPEDDEVYSDIYV

SEQ ID NO: 51914 - protein, 836 aa, Corynebacterium glutamicum ATCC 13032
MTSTIEHSYQVWPGHAYPLGSTYDGAGTNFALFSDVAERVELCLLDADNNETRIPLEERDAHIWHCYLPGVQPGQRYGFRVHGPWNPDEGKRCDANKLLVDPYARAFDGDFDGHPSLFSYDITNPNDPNGRNTEDSIDHTMKSVVVNPFFDWGNDRAPRIPYNETVIYEAHVKGMTMTHPDVPEELRGTYAGLAHPTIIQYLSDLGVTAIELMPVHQFLQDDRLRDLGMRNYWGYNSFGFFAPYNDYAANKNPGGAVAEFKGLVRSYHEAGLEVILDVVYNHTAEGNHMGPTIAFRGIDNEAYYRLVEGDRRHYMDYTGTGNSLNVRDPHSLQLIMDSLRYWVTEMHVDGFRFDLASTLAREFDDVDRLATFFDLVQQDPVVSQVKLIAEPWDVGEGGYQVGNFPPLWTEWNGKYRDTVRDFWRGEPATLGEFASRLTGSSDLYANNGRRPTASINFVTAHDGFTLNDLVSYNEKHNMANGEDGRDGESHNRSWNCGVEGPTDDPEIMQLRAQQRRNFLTTLLLSQGTPMLSHGDEMARTQNGNNNVYCQDNELAWVNWDQAEENADLVSFTRRLLRIRANHPVFRRRQFLAGGPLGADVRDRDIAWLVPNGTLMTQDDWDFAFGKSLQVFFNGDAIEEPDYRGQKIHDDSFILMFNAHFEPIDFNLPPEHFGMKWKLLVDTTEAVGHPLEDLTIEAGGTITVPARSTMLLRQVEAPDYTKLEEKIAAEKREQELAAEKEAAEKRELELAAAKEAEDAAEALHLAAERASTQEAELAHQHGADAIADEVAEEPQELPQDEVAAEVETEPDTEPDTESDSEQAEVASEEPEADEEEK

SEQ ID NO: 51915 - protein, 339 aa, Triticum aestivum
SVRAERSKWTLTSFHKVSFSEHDILDCLDEDNVIGSGASGKVYKAVLGNGEVVAVKKLWGGALKKDVENAGEGSAADNSFEAEVRTLGKIRHKNIVKLLCCCTHNDSKMLVYEYMPNGSLGDVLHSRKAGLLDWPTRYKIALDAAEGLSYLHQDCVPAIVHRDVKSNNILLDAEFSACVADFGVAKVVEMAGRAPKSMSVIAGSCGYIAPEYAYTLRVNEKSDIYSFGVVLLELVTGKPPVDPEFGEKDLVKWVCSTIDQKGVEHVLDSRLDMAFKEEISRVLNIGLICASSLPINRPAMRRVVKMLQEVRADARPKLDKDGKLSPYYYDDTSDQGSSV

SEQ ID NO: 51916 - protein, 368 aa, Oryza sativa
MAMWRSCLYMPHLNYLPKDRLRKRKKGGGGTAYWRQRQWRQRTVAATAAVHGGGERGTAKARRGAAASWRRRGGSMRRRGGVEAAAWVLHKMGHLSLRAGTALHEVPRSLRPAISSKTFCLYLLFLSRENQAPRQAIALRPSVIARGAYTISRHSALSAVHKVSMASARPYRFPVPAEGGEPTRRRSAAQSCGTCGASAVASCVALCCCPCAVVGCLTLALVKAPYAAGRRCVARLAAGKRRRMIRPGVATTPRKTNRVWDLDDGQLQEWRPAGADGAVRAERKQDRREPGRTGGAASAAPPGDASVDAISAVGEGSGRARPRVDTAEKTWVEIYQLGHWGFGRLSFSQPQVIRGDTCGNDGVAASRQ

SEQ ID NO: 51917 - protein, 400 aa, Pseudomonas putida KT2440
MRAVSYHGANDVRVDSVPDPILQDADDIILRVTATAICGSDLHLYRGKIPETEQGDIFGHEFMGIVEEVGRDVTTLQVGDRVVIPFVIACGSCFFCQQDLFAACETTNTGRGSIINKKGIPPGAALFGYSHLYGGIPGGQADYVRVPKGNVGPFKVPTTLADDKVLFLSDILPTAWQAVINAEIGEGSSVAIYGAGPVGLLSAACARMLGAHTVFMVDDNDYRLAYAQEAYGVIPINFEKDDDPADSIIRQTPGMRGVDAVIDAVGFEAKGSTTETVMTALKLEGSSGKALRQSIAAVRRGGVVSVPGVYAGFIHGFMFGDAFDKGLTFKMGQTHVQKYLPELLEHIEAGRLQPELIVTHRLALEEAAMGYKMFDQKQDNCRKVILVPGAAPGTLGPDHL

SEQ ID NO: 51918 - protein, 432 aa, Daucus carota
MASKAVITQRHKEAEGKQKNVQAERRNRRVLGDIGNVVKAVDAGKPKNPIKTNRPMTRSLCAQLVAKGLPVVGGKDPKDIQLIDGVVGRKDASVLEAAAVKKKDTDQRTTVTLSCEEEIKPKSSGRKSRPDYSEKTEKAFTSILSARSKAACGLINKPQNEIIANIDASDVDDELAAVEYVDDIYKYYKLTEGDGQVHDYMPSQTDINSKMRSILIDWLVEVHRKFELMPESLYLTINIVDRYLSMKIVPRRELQLVGVGSMLIACKYEEIWAPEVNDFIAISDNAYNREQVLLMEKSILAKLEWYLTVPTPYVFLVRYIKSSVPSDPEMENMTFFLAELGLTHYTTVMTYCPSVIAASAVYAARCTLKKSPFWTETLKHYTGYSEDQLRDCAKLLVSYHAALSESKLKAVYKKFARPEKGVVALVPPLKLI

SEQ ID NO: 51919 - protein, 441 aa, Pseudomonas putida KT2440
MVDQATGMKSGERYRVENVERAHQFPGFFQDGKYYLGPELLTAVGWLEGTRFIYDSLDAEGEPVFPNKEAGTVEGLTLTLVDGTALELSLVEADEIIAPFEHRSSGTEQEAPRRGYPVRGPLRGKVVVITGASSGIGRAAAHAFACKGARLVLAARDEEALFDVLDECTDCGTDAIAVTTDVTHSDQVQALAAQASAFGHGRIDIWVNNAGVGAVGNFEDTPLEAHEQVIQTDLIGYLRGAYVALPFFKAQGSGILINTLSLGSWVAQPYAAAYSASKFGLRGLTEALRGELTKFPNIHVCDIYPAVMDTPGFRDGGNYTGHALTPPSPIYDPERVAKTMVACAISPRAHTTVGTAARLAHLASYLVPGIALLSGWVTRWGINRSPIAETSSGNLFEPPSDRRSIDGGWRKPKAKTPLLIGAAALGIIAGLTIACSRRRKH

SEQ ID NO: 51920 - protein, 382 aa, Mycobacterium sp. JLS
MATSSGLIAVGSGPAGLSAAAAFRERHPDLRVQILTADPAMPYAKPPLSKEFLCGGEHHVDLHTPDWFDKRRLELVRGITVDHIDVDAREVITRGGRSYPYWNLVLAPGAAPVPLDVPGAENALHLRSLADAVAIRMTALQARSAVVIGGGLIGCEAAACLAANGIATTMVAGEPVPLLRRFGLDAGERIAKLLSDSGVRFIGPARVVAVREDGVTLDDGAALDGDLVVAATGVRPDARLAERAGIRTQGGRIVVNEHMHTSAPNVFAAGDVALAYNVTAGRPIPTEHWRDAADQGEIAGASAAGSPTAWAKVPGFHCEIGEARLKYRGWGVPYEHARLVDHRDGFTVWYEAGGEVVGVLSLNADDDYRMAAALVSSHCRLR

SEQ ID NO: 51921 - protein, 595 aa, Acidovorax sp. JS42
MYQYTEFDRQFVHLRAQQFRDQLERWQRGELTDEQLLPLRLQNGWYIQRYAPMARIAVPYGDINSTQLRMLAHIAREYDRPTPELLAHAQATQDQLQAAQPGLTLAAPPLRYGYGHFTTRTNVQFNWIPITRAADVMDLLASVHMHGIQTSGNDIRNITCEAYAGIAEDEIVDTRPFAEITRQWSSLHPEFTYLPRKFKIAFNGAAEDRAATGWYDIGLQALKNAAGEVGFAVKVGGGMGRTPVIGTVVREFLPWDQLLNYIEAIVRVYNSYGRRDNKWKARIKILVKSEGQQFIDAVEAEYRAILEQDGAPHTITQAELDRVTGHFVVPPLRPAGRPHGVNTSGQLYQRWLQQNVRGHRMAGLKAVTLSFKRVGFAPGDADGDTLDALAQLADQFSAGEARLTHEQNLLLPWVHEADLPALYEAARKLGLAQPNIGLLTDMIACPGGDFCSLANARSLPIAAAITERYQDLDELFDIGPIDLHMSGCINSCGHHHSGHIGILGVDKDGKEWYQITLGGSDGTQLSGPAIGGKVVGPSFSAAEVPDVIEALLDTYRALRKGNELFIDTLRRVGQDPFKAAANGARHPKAAEEAVA

SEQ ID NO: 51922 - protein, 214 aa, Triticum aestivum
MDAADAASPCDGHRTVWSEPPKRPAGRTKFKETRHPLYRGVRRRGPAGRWVCEVRVLGMRGSRLWLGTFTTAEMAARAHDAAVLALSGRAACLNFADSAWRMLPVLAGPFSTAKEIKDAVAVAVLAFQRQHRVASMAPLSPARTTDDEKEIDGSPAPSALFMSSELLNEHWFGGMDAGSFYSEGLFMESPDTRPWREDLELCGVETPPWSYLFD

SEQ ID NO: 51923 - protein, 519 aa, Populus tremula x Populus tremuloides
MAGGAFAPTSGGKEYPGKFTFRVFFTCLFAATGGLIFGYDLGISGGVTSMDVFLKDFFPDVYQKESSVKPSDDQYCKFDSQILTLFTSSLYLAALVSSIGASMATRTYGRRPTMMTSGLLFAAGAIVNGLAKNVVMLIVGRLLLGFGIGCANQSVPIYLSEVAPYKYRGALNMMFQLFITIGILIANSLNYAFARLIGGDMAWRLSLGGAIVPGLIILLGSCFLPDTPNSEIERGNYERAKDLLLKLRDVDNVDEEFNDLVEASEKAKLVKHAWLNIFKRKYRPQLVFAFCIPMFQQLTGMNVIVFYAPVLFKTIGFGSNASLLSSLITGFVNMVATFVSIFTVDKLGRRKLFLMGGTQMLICQVVITIAIAMKFGVSGNPGVISGTYAGAVVAFICVYVAGFAWSWGPLGWLVPSEIFPLEVRSAAQSINVSVNMIFTFVIAQIFTAMLCHLKFGLFICFAVCVVIMSIFIYKLLPETKGVPIEEMTIVWRNHPHWSKYFDEDDAQFEASKPKDIASA

SEQ ID NO: 51924 - protein, 559 aa, Zea mays
MGSSGFSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 51925 - protein, 472 aa, Geobacter sulfurreducens PCA
MAEQTFDLIVIGAGPGGYVAAIRAAQLGMTVAVAEQRETLGGVCLNEGCIPSKALLDSSEFFAQARDGFAGHGILIDPPRLDLARMMARKDDVVKKLTDGIAYLFKKNRITWLKGTARLAGRNGDLLRVEVGGNGTAPAHLLEAGKVLLATGSEAVPVPGLAFDGETVVSAREALAFDRVPEHLLVVGAGYIGLELGSVWRRLGSQVTVVEVLAKPLPATDGQVADALVRSLKKQGISFRMETRVTGIEKREGTAVVTVESSAGGRDAIACDRVLVAAGRRPVMAGLGLEPFNLAMEGGRIRVDDNYLTSAPGIYAIGDLIHGPMLAHKAMAEGEVFAERLTGEASVVDYEYIPGIVYTWPEAAGVGLTEEQLKEQGIPYAAGRFNFMANGRARCMGETEGFVKILAKPDTGRVLGIHVVGPRASDLIAEAVTVMTYGGSAADIAMTFHAHPTLAEAMKEAALDVEKRAIHA

SEQ ID NO: 51926 - protein, 502 aa, Populus tremula x Populus tremuloides
MAGGGFVANGPASGFNGKITVPVVITCIVAASSGLIFGYDIGISGGVTTMAPFLIKFFPEVFRKASEAKTNMYCQFDSQVLTAFTSSLYIAGLASSLVAGRLTAAVGRKNTMVIGGCTFLAGAAINGGAANIAMLLLGRILLGFGVGFTNQATPVYLSEVAPPKWRGAFSTGFQFFIGVGVVAANCINFGMAKHSWGWRFSLGLAVVPAAIMTTGALFISDTPSSLVERGKIEQARHSLTKVRGINSNVDAELADLLKFNEMAKDAKKEPFLTILERQYRPHLVMAIAIPFFQQLTGINIIAFYAPVIFQSVGFGSDSALIAAIVLGLVNLGSILVSTGMVDRHGRRFLFIIGGIQMFICQVAVTIVLAVTTGISGTKHISKGHGVLLLVFMCIYAAGFGWSWGPLSWLVPSEIFPMKIRSTGQSITVAVNFATTFVLSQTFLTMLCHFKFGTFLFYAGWIALMTVFIVLFLPETKGIPLDSMHEVWQRHWYWGRFVRGGGR

SEQ ID NO: 51927 - protein, 409 aa, Geobacter sulfurreducens PCA
MEIKIPSVGESVFEALVATWLRQDGDAVRKDEPVCEIETDKITMELNAEADGVLSIAVPAGTTVKIGTVIGTIREGAAAPVAESPAPAQAAAAAPAAEPPLSPSVRKMARERGISPEAVPGTGRGGRVTVDDLFSFAEKREQGASPAGAPPPAAPQPPAQQPRPAAEQPRQAEPPEADRTTRTPMTPIRKRIAERLMAARQQTAMLTTFNEADLGRIVELRARHKEQFAKRHGVSLGFMSFFVKACVEALKAFPLVNARIDGNDIVRHHYYNIGIAIGADKGLVVPVLRDADRLHFWEIEQAIAAFVEKIKTNRLELSDLEGGTFSITNGGVYGSLLSTPILNPPQSGVLGMHAIQDRPVARDGQVVIRPMMYLALSYDHRIIDGREAVGFLRTVKEYVEDPEELFLEG

SEQ ID NO: 51928 - protein, 281 aa, Oryza sativa (indica cultivar-group)
MAASTPAASRERRWSRAGKTALVTGGTKGIGRAIVEELAGFGVRVHTCSRHDADLQDCLRRWNAADGGGLGGGAAAPVTASVCDVSVRGDREALVAAARAALGGRLDILVNNVGQTLFGAAAACAAEDYARIMATNLESCFHLAQLAHPLLLGAGGAAASVVNISSVAGFIAYPALSVYSATKGAMNQLTRSLAAEWARDGIRVNCVAPGGVRTDIAGSSGVALEPGAARAMEEREAARVAMGRIGEPEEVASLVAFLCMPAASYITGQVICVDGGRTITA

SEQ ID NO: 51929 - protein, 143 aa, Gossypium arboreum
DKMGKKGKWLSSLKKVFSPDSKEKKNQKSKQQLLEKQVHLGSNDSGAATLETVNLPPPPPEEVKPIEAESKLTYPVAVATAAASPQAAVEVVQRQLNRDALFAGKSEEEVAAIKIQTAFRVYLARRALHALKGLVRLKSLMEG

SEQ ID NO: 51930 - protein, 420 aa, Arabidopsis thaliana
MALSSLLRSAATSAAAPRVELYPSSSYNHSQVTSSLGFSHSLTSSRFSGAAVSTGKYSAKRVQPIKATATEAPPAVHRSRSSGKTKVGINGFGRIGRLVLRIATFRDDIEVVAVNDPFIDAKYMAYMFKYDSTHGNYKGTINVIDDSTLEINGKQVKVVSKRDPAEIPWADLGAEYVVESSGVFTTVGQASSHLKGGAKKVIISAPSADAPMFVVGVNEKTYLPNMDIVSNASCTTNCLAPLAKVVHEEFGILEGLMTTVHATTATQKTVDGPSMKDWRGGRGASQNIIPSSTGAAKAVGKVLPELNGKLTGMAFRVPTPNVSVVDLTCRLEKDASYEDVKAAIKFASEGPLRGILGYTEEDVVSNDFLGDSRSSIFDANAGIGLSKSFMKLVSWYDNEWGYSNRVLDLIEHMALVAASR

SEQ ID NO: 51931 - protein, 277 aa, Oryza sativa (indica cultivar-group)
MAAASRARRWSLAGKTALVTGGTKGIGRAIVEELAGFGVRVHTCSRHDADLQDCLRRWNAAGEGGGAAALVTGSVCDVSVRGDREALVAAARAALGGRLDMLVNNAGQVVVGPAAETAPEEYARLMATNLESCFHLAQLAHPLLRDAAAGGGAAASVVNISSTAAFYAAPHLAVYSATKGGMNQLTRCLAAEWARDGVRVNAVAPGATRTDICDTSGVALGEETRRRLADAGAMDRVPIRRIGEPEEVAAAVVFLCMPAASYITGQVICVDGGRTLL

SEQ ID NO: 51932 - protein, 517 aa, Populus tremula x Populus tremuloides
MPELTLVDGSGVRRDLPAKLTWQVIVCTVISACGGLMFGYDIGISGGVTGMDMFLEKFFPEVYVKKHQAKANNYCKFNSQLLQLFTSSLYLAAIVACFIGSICCKKRGRKPTMQIASVFFLVGAILNAAALNIGMLIAGRLCLGAGIGFGNQAVPLFISEIAPARYRGGLNLCFQLLITIGILTANVINYATSKLHPYGWRISLGGAACPALLLLLGSLMIVETPTSLIERGKNEEGLYTLKKIRGVDNVDKEYEEISQAVEFSRQIRHPFKNLWKQSGRPQLVCGALIQIFQQFTGISVVMLYAPVLVQTMGLGENASLMSAIMTNTVKPIGTAFAIVVVDRFGRRALLIEAAIQMFISFAIGVILAVHLHSTNVVAKHYAVLVIVLVCVFLAGFAWSWGPLGWLIPSEIFPIETRSAGFSVAVIMNFVFTFLVAQTFLTMLCHMRAGTFFLYCAMLAVMCLFAKYFLPETKGIPIDEMVERVWKQHWFWKRYYKDHDTGKGGLEIQDKPKENTIA

SEQ ID NO: 51933 - protein, 514 aa, Populus tremula x Populus tremuloides
MPAVVIANNGDVPEFEGRITFNVIVCVVIAACGGLMFGYDIGVSGGVTAMDDVLKKFFYQVWERKQQAHENNYCKYDNKKLQLFTSSLYIAALIASFLASKTCSKFGRKPTMQLASLFFIGGVALTTFAVNIEMLIIGRLLLGCGVGFANQAVPLFLSELAPAKIRGALNISFQLFITIGILIANIVNYVVGKIHPYGFRISLGIAGVPALLLCFGSLAIYETPTSLIERKKVEQGRAVLKKIRGVDNVDLEYDSIVHACEVASQITQPYHELMKRESRPPLVIAIVMQVFQQFTGINAIMFYAPVLFQTVGFGSDAALLSSVVTGLVNVLSTIVSVVLVDKVGRRALLLEACVQMLITQCIIGGVLMKDLKTTGTLPNGDALVVVIMVCVFVAGFAWSWGPLGWLIPSETFPLETRTAGFSFAVSSNMLFTFVIAQAFLSTLCHLKAGIFFFFAAWIVVMGLFALFLLPETKGVPVDDMVDRVWKQHWFWKRFFNDEQVVEKKAIEMIHPHVT

SEQ ID NO: 51934 - protein, 713 aa, Bacillus anthracis str. A2012
  misc_feature (647)..(680): Xaa can be any naturally occurring amino acid
  misc_feature (688)..(688): Xaa can be any naturally occurring amino acid
MSHSIEQLSINTIRTLSIDAIEKANSGHPGMPMGAAPMAYTLWTQFMKHNPNNPTWFNRDRFVLSAGHGSMLLYSLLHLSGYDVTMDDLKNFRQWGSKTPGHPEYGHTAGVDATTGPLGQGIATAVGMAMAERHLAAKYNRDAYNIVDHYTYAICGDGDLMEGVSAEASSLAAHLQLGRLVVLYDSNDISLDGDLNRSFSESVEDRYKAYGWQVIRVEDGNDIEAIAKAIEEAKADEKRPTLIEVRTTIGFGSPNKSGKSASHGSPLGVEETKLTKEAYAWTAEQDFHVAEEVYENFRKTVQDVGETAQAEWNTMLGEYAQAYPELANELQAAMNGLLPEGWEQNLPTYELGSKAATRNSSGAVINAIAESVPSFFGGSADLAGSNKTYMNNEKDFTRDDYSGKNIWYGVREFAMGAAMNGIALHGGLKTYGGTFFVFSDYLRPAIRLAALMQLPVTYVFTHDSIAVGEDGPTHEPIEQLAALRAMPNVSVIRPADGNESVAAWRLALESTNKPTALVLTRQDLPTLEGAKDDTYEKVAKGAYVVSASKKETADVILLATGSEVSLAVEAQKALAVDGVDASVVSMPSMDRFEAQTAEYKESVLPKAVTKRFAIEMGATFGWHRYVGLEGDVLGIDTFGASAPGEKXXXXXXXXXXXXXXXXXXXXXXXXXXXXXXXXXXAKAYFGRXICFLIYLLDFQNLGPFRRKKCYINK

SEQ ID NO: 51935 - protein, 522 aa, Populus tremula x Populus tremuloides
MPAVGIAVGDNKKEYPGNLTPFVTVTCIVAAMGGLIFGYDIGISGGVTSMPSFLKKFFPSVYRKQQEDATSNQYCQYDSQTLTMFTSSLYLAALLASLVASIVTRKFGRKLSMLFGGVLFCAGAIINGFAQAVWMLILGRILLGFGIGFANQSVPLYLSEMAPYKFRGALNIGFQLSITIGILVANVLNYFFAKIHGGWGWRLSLGGAMVPALIITVGSLVLPDTPNSMIERGQHDEAREKLRRVRGVDDVDEEFNDLVAASEASMKVEHPWRNLLQRKYRPHITMAVMIPFFQQLTGINVIMFYAPVLFNTIGFGSNASLMSAVITGVVNVVATMVSIYGVDKWGRRFLFLEGGFQMLICQAVVAACIGAKFGVNGNPGELPKWYAIVVVLFICIYVAGFAWSWGPLGWLVPSEFFPLEIRSAAQSISVSVNMLFTFIVAQIFLTMLCHLKFGLFLFFAFFVVLMSIFVYYFLPETKGIPIEEMGQVWKTHWFWSRYVTDEDYPKAGGYEMTKGGQGPKNV

SEQ ID NO: 51936 - protein, 905 aa, Arabidopsis thaliana
MSRVSFEVSGGYHSDAEAGNSGPMSGGQLPPIYKKPGNSRFTAENSQRTRTAPYVDLTVDVQDDTVSVHSLKMEGGSSVEESPELTLLKRNRLEKKTTVVKRLASVSHELKRLTSVSGGIGGRKPPRPAKLDRTKSAASQALKGLKFISKTDGGAGWSAVEKRFNQITATTGGLLLRTKFGECIGMTSKDFALELFDALARRRNITGEVIDGDQLKEFWEQINDQSFDSRLKTFFDMVDKDADGRLTEDEVREIISLSASANNLSTIQKRADEYAALIMEELDPDNIGYIMLESLETLLLQAATQSVITSTGERKNLSHMMSQRLKPTFNRNPLKRWYRGLRFFLLDNWQRCWVIVLWFIVMAILFTYKYIQYRRSPVYPVMGDCVCMAKGAAETVKLNMALILLPVCRNTITWLRNKTRLGRVVPFDDNLNFHKVIAVGIIVGVTMHAGAHLACDFPRLLHATPEAYRPLRQFFGDEQPKSYWHFVNSVEGITGLVMVLLMAIAFTLATPWFRRGKLNYLPGPLKKLASFNAFWYTHHLFVIVYILLVAHGYYLYLTRDWHNKTTWMYLVVPVVLYACERLIRAFRSSIKAVTIRKVAVYPGNVLAIHLSRPQNFKYKSGQYMFVNCAAVSPFEWHPFSITSAPQDDYLSVHIRVLGDWTRALKGVFSEVCKPPPAGVSGLLRADMLHGANNPDFPKVLIDGPYGAPAQDYKKYEVVLLVGLGIGATPMISIVKDIVNNIKAKEQAQLNRMENGTSEPQRSKKESFRTRRAYFYWVTREQGSFDWFKNIMNEVAERDANRVIEMHNYCTSVYEEGDARSALIHMLQSLNHAKNGVDIVSGTRVMSHFAKPNWRNVYKRIAMDHPNTKVRVFYCGAPALTKELRHLALDFTHKTSTRFSFHKENF

SEQ ID NO: 51937 - protein, 389 aa, Oryza sativa (japonica cultivar-group)
MDGFPFPPPFDGSYRGGFPSSSAWLDASGGDESSPGSCDKDVHPRGGFMSYFGNHAQNSHLVGAPIYIADASSPPEVEILQGNDDGNGNGNVRTEKRILWTEEEDIRLMSAWIEHSTDSTCGADKGGGQYWGEVVESYNKTTPPLRKRNLKQCKDRWHKINRWTDLFECAYVKARRIFTSGYSNQMWIDAAHKFYVDDNKEAKLGPFVLMEVWKICREVSKWKTYNENMRNARKRKSFHLEGDSEEADDTFDEMPKRPMGQKAAKKAALDAKIKSNGLGSSDDGHSKESPIQLDKFDRYSKFQEENNDKRMKLLDRQEKISSEKLEATKIAHLTAQEYKEGRKLEKESKMMETYNSLISQDTSSMSAEEKAQRVSMMKCLMKTLFPESD

SEQ ID NO: 51938 - protein, 389 aa, Methanopyrus kandleri AV19
MDARELIDKYHMNTYSRFPVTLVPGEGARVWDDEGNEYIDLVAGIAVNVLGHCHPAVVEAVKEQVERLIHCSNLYYNEPQAEAARLLAEAAPKDLNKVFFCNSGTESVECAIKLARKFTGCTKFIAFEGGFHGRTMGALSATWKPEFREPFEPLVPEFEHVPYGDVNAVEKAIDDDTAAVIVEPVQGEAGVRIPPEGFLRELRELCDEHGLLLIVDEVQSGMGRTGQFFAFEHEDVLPDIVCLAKGLGGGVPVGATIAREEVAEAFEPGDHGSTFGGNPLACAAVCAAVSTVLEENLPEAAERKGKLAMRILSEAEDVVEEVRGRGLMMGVEVGDDERAKDVAREMLDRGALVNVTSGDVIRLVPPLVIGEDELEKALAELADALRASG

SEQ ID NO: 51939 - protein, 160 aa, Clostridium difficile
MKKEMLAMILAGGQGSRLGVFTKRIAKPAVSFGGKYRIIDFVLSNCSNSGIDTVGVLTQYRPLILNSHIGMGSHWDLDRINGGVYVLQPFMNEKEGNWYNGTAHAIYQNMDFVDTYNPEYVLILSGDHIYKMDYSKMLKFHKEKGSKATIAVIEVPWDEA

SEQ ID NO: 51940 - protein, 300 aa, Methanopyrus kandleri AV19
MGFQIEGVIPALITPFTDDLKGINEEGLRENVSRLLEAGVHGVVPAGTTGESSTLSHAEHRRVIEIVVDEVNGKVPVIAGAGSNSTREALELSTYAEDVGADAILSVVPYYNKPPQEGLFIHFSKIAEAVECPIILYNVPSRTGCALEPETAAKLAEEYSHIVGVKEASGDLDVVQRFIEETPDDFILLSGVDELTLPILAVGGVGVISVTANVAPELMVEMYEAWKSGDVERARELHYELLPLHRALFTETNPIPVKAAVELVGMASSPPRPPLKEAREDTKELLRRELKKLGLLPEGG

SEQ ID NO: 51941 - protein, 675 aa, Coccidioides immitis RS
MTQLFNSSSGSSGVGSEKRPFPGLSLPSRKHSGDPSHFPTRLKNFFRINSSSSSNTPTVSNSGGGSGSGGAHHTSSGHAHLSTKPESKSTFRQSRFLPTIGRNRSTTVASEGNPLDEIASPTADANPYFHHQGYPALRHRNDDSAPSSPPDTPELQVEGVPASDQATAAGKEELARKLRRVASAPNAQGLFSGDGSGDRPKTAELGKEPLVASGGASPKLSFVDQPGSQAASISDERASTLSVPRSFVNCRRTYSSNSIKVRNVEVGPGSFDKIKLIGKGDVGKVYLVREKKSNRLYAMKVLSKKEMIKRNKIKRALAEQEILATSNHPFIVTLYHSFQSEEHLYLCMEYCSGGEFFRALQTRPGKCIPEDDARFYAAEVTAALEYLHLMGFIYRDLKPERHIMLSDFDLSKQSGPGGAPTMIVGRNGTSSSSLPTIDTKSCIANFRTNSFVGTEEYIAPEVIKGDGHTSAVDWWTLGILIYEMLYGITPFKGKNRNATFANILRNDVPFPDHAGAQQISNLCKSLIRKLLIKDETKRLGARAGASDVKTHPFFRTTQWALIRHMKPPMIPHQGRAIDTVNFRNMKESASVDIGGTSKLKGVPMDSGLATPGEQIPDPFEDFNSVTLHHDGDYHGQLADDSFNGYYSRLVCIQPPSIKVLAEISKMQTEPLGMKI

SEQ ID NO: 51942 - protein, 457 aa, Aquifex aeolicus VF5
MLRAEWVEKRKRFKNKTQMHLARQGIITEEMEYVAKREGLHPEFVRQEVARGRMIIPANINHLHLEPMCIGINSKVKVNANIGNSGLASDIPTEVEKAKVAIKYGADTIMDLSTGEAIKETREAIINVSTVPVGTVPIYEAWKIAKGNVKELTVDLILDVIEEQARQGVSYMTIHAGILREHLPLVQHRVMGIVSRGGAILAQWMAEHGKQNPLYEHFDKICEIFKKYDVSFSLGDALRPGCIEDATDDAQLAELKVLGELVEKAWKHDVQAMVEGPGHVPLHQVEFNMKIQQEWCHEAPFYVLGPLVLDVAPGYDHIGSAIGGALAGWAGAAMLCYITPKEHLGLPNVEDVKQGVIAYKIAAHAADIAKHWPGARDWDLAMSIARYNFDWNKQFELAMDPETARAYHDETLPQEGYKTAKFCSMCGPEFCSYKISQKVQEKVSPEELIENGNWVAP

SEQ ID NO: 51943 - protein, 335 aa, Nicotiana tabacum
MVHEKQVIEEVSGWLTVFEDGSVDRTLTGPPEDKFMAEAVPPHDDFIDGVADKDVVADENSGSRLRIYLPERNDNSVNKLPVILHFHGGGFCISQADWFMYYTVYTRLARVANAIIVSVFLPLAPEHRLPAACDAGFAALLWLRELSRQQGHEPWLNNYADFNRVFLIGDASGGNIVHQVAVRAGEENLSPLRLAGAIPIHTGFVRSYRSKSELEQEQTPFLTLDMVDKFLGLALPVGSNKDHPITCPMGEAAPAVEELKLPPYLNCVAEKDLMKDTEMEFYEAMEKGEKDIELFINNGVGHSFYLNKTAVEIDPVTASETEKFLEAVAEFINKR

SEQ ID NO: 51944 - protein, 420 aa, Aquifex aeolicus VF5
MELLKEYNPYLEYRDGELFIEGVSLKELAQTFGTPLYVYSSNFIKERFEAYRKAFPDALICYAVKANFNPHLVKLLGELGAGADIVSGGELYLAKKAGIPPERIVYAGVGKTEKELTDAVDSEILMFNVESRQELDVLNEIAGKLGKKARIAIRVNPDVDPKTHPYIATGMQKSKFGVDIREAQKEYEYASKLENLEIVGIHCHIGSQILDISPYREAVEKVVSLYESLTQKGFDIKYLDIGGGLGIKYKPEDKEPAPQDLADLLKDLLENVKAKIILEPGRSIMGNAGILITQVQFLKDKGSKHFIIVDAGMNDLIRPSIYNAYHHIIPVETKERKKVVADIVGPICETGDFLALDREIEEVQRGEYLAVLSAGAYGFAMSSHYNMRPRAAEVLVENGSVKLIRKRENYDYIVEPSLDI

SEQ ID NO: 51945 - protein, 251 aa, Brassica napus
MASFTSKYADELIANAAYIGTPGKGILAADESTGTIGKRLSSINVENVESNRRALRELLFTTPGALPCLSGVILFEETLYQKSSKGTPFVDILKEGGVLPGIKVDKGTISLPGTNGETTTQGLDGLGERCKKYYEAGARFAKWRAVLKIGPNEPSELAIRENAYGLARYAAICQENGLVPIVEPEILVDGSHDIQKCAEVTERVLAACYKALSDHHVMLEGTLLKPNMVTPGSESGKVAPEVVAEYTVRAL

SEQ ID NO: 51946 - protein, 1570 aa, Arabidopsis thaliana
MLKKVRRKVKVLITKPFKKPKNRPPSPPPPLPLPPSPSPPPSQQMSSSRQKNTPFLFPRSDSSVLPDPSRFFSHDLLSSPLPTNSFFQNFTLNNGDQAEYFHPYIIKPSTSSLSISYPSLSHNSAFIYEAFNADITITGSDGPDPHSRKSHLISSFSDLGVTLDFPSSNLRFFLVRGSPFITFSVNSSITISTIHAVLSLSGNTSSTKYTVKLNNNQTWLIYASSPINLTKDGVSSINCGDGFSGIIRIVVLPNPNPYFETILDGFSCSYPVSGDADFTKPFALEYKWEKRGYGDLLMLAHPLHLKLLSTNDCSITVLDNFKYNSIDGDLVGVIGDSWVLKPDPVSVTWHSIKGVQEDSHQEIISALIKDVNALDSSAEVTNSSYFYAKLIARAARLALIAEEVCYLDVIPKIRTYLKNMIEPWLNGSFGPNGFLYDPKWGGVITKLGSRDSGADFGFGIYNDHHYHLGYFVYAIAVLAKIDPLWGKRYRPQAYTLMADYLTLGKKGAKSNSNYPRLRCFDLFKLHSWAGGLTEFADGRNQESTSEAVNAYYSAALLGLAYGDTHLVAAASMVLTLEIHAAKMWWQVKEDDAIYPQDFTSENRVVGVLWSTKRDSGLWFAPKEWKECRLGIQLLPLLPVSEVLFSDVTFVKQLVNWTMPALARDSVGEGWKGFVYALESMYDKDGAMEKIKGLNGFDDGNSLSNLLWWVHSRNNDDDDDYEEDDEGGYGGHGGGGKATRRILEFEIHYFTAEKMHSPLQTQQPEQRCWPMTSTVSEIEEVLPDEDSDRTTLLNGEPLRRRVSGKSPVDEGPRRIFRQQSFGRDIGHAAAETYLITGLSFKLLRYLGLSMDDKITCPYMLCYASYAWLSSRLDLYLPSNNDGLKPVVVFVTGGAWIIGWLLVNKFMFANLVLIFRYKAWGSLLGMQLAERDIIVACLDYRNFPQGTISDMVTDASQGISFVCNNISAFGGDPNRIYLMGQSAGAHIAACALLEQATKELKGESISWTVSQIKAYFGLSGGYNLYKLVDHFHNRGLYRSIFLSIMEGEESFEKFSPEVRLKDPVVGKAASLLPPIILFHGSSDYSIPCDESKTFTDALQAVGAKAELVLYSGKTHTDLFLQDPLRGGKDELFDDIVSVIHAEDNDGLTKDSLAPPRKRLVPELLLKLAPTWQIPIGSLDLHRWPNQLDRLDVEGNKSPAAFTYDLTHHQTTTTSAVSMLKVESNWAQACDTCRSAACTVYCRADSAYLCSSCDAQVHAANRLASRHERVRVCQSCERAPAAFFCKADAASLCTTCDSEIHSANPLARRHQRVPILPISEYSYSSTATNHSCETTVTDPENRLVLGQEEEDEDEAEAASWLLPNSGKNSGNNNGFSIGDEFLNLVDYSSSDKQFTDQSNQYQLDCNVPQRSYGEDGVVPLQIEVSKGMYQEQQNFQLSINCGSWGALRSSNGSLSHMVNVSSMDLGVVPESTTSDATVSNPRSPKAVTDQPPYPPAQMLSPRDREARVLRYREKKKMRKFEKTIRYASRKAYAEKRPRIKGRFAKKKDVDEEANQAFSTMITFDTGYGIVPSF

SEQ ID NO: 51947 - protein, 409 aa, Glycine max
MAACLQLWQCKLARPFDSLPVRRSIPLSLRCSAAPSSSKPTRSYSITLIPGDGIGPEIISVAKDVLVLAGYLEGIKYDFREMLMGGAALDATGLPLPHETLSAAKQSHAVLLGAVGGYKWDRNDKHLKPETGLLQIRKELGVFANLRPATVYSPLVDASTLKREVAEGVDIMLIRELTGGIYFGEPRGFGTNDNGEEIGFNTEIYATHEIDRIAHFAFKVAQKRRRKLCSVDKANVLEASMLWRKRFLAIAQEYPDVELSHMYVDNASMQLIRDPKQFDTMVTNNIFGDILSDEASMVTGSIGMLPSASLGASGPGLFEPIHGSAPDIAGQDKANPFATVLSAAMLLRYGLGEEKAAERIENAVMDTLNRGFRTGDIYSAGTKLVGCKQLGEEILKSVESNVPAGAAAV

SEQ ID NO: 51948 - protein, 163 aa, Triticum aestivum
  misc_feature (95)..(119): Xaa can be any naturally occurring amino acid
VAPFQGLKSTAGLPVSRRSNGASLGSVSNGGRIRCMQVWPIEGIKKFETLSYLPPLSTEALLKQVDYLIRSKWVPCLEFSKVGFIFREHNASPVXXXXXXXXXXXXXXXXXXXXXXXXXEVEEVKKEYPDAYVRIIGFDNMRQVQCVSFIAFKPPGCEESGKA

SEQ ID NO: 51949 - protein, 390 aa, Rhodococcus sp. RHA1
MLRILSDRPRYVNLMVLLRILCEITATVVLVGGLSDLLEPVWALTFTAIIMVLVDYVVIGVGPRTLGRQHAYSIALITSFPLQVIGTLLGPISRLLILIGNAITPGKGFRNGPFASEIELRELVDMAQERGVVADEERRMIQSVFELGDTSAREVMVPRTEMVWIESDKSAGQATSLAVRSGHSRIPVIGENVDDVLGVVYLKDLVQETYHSRDGGRSVRVGDVMRPAVFVPDSKPLDSLLAEMQRDRNHMALLVDEYGGIAGLVTIEDVIEEIVGEIADEYDQDETPPVEDLGDGMYRVSARLPIEDLGELFGIEVENDEVETVGGLIGYELGRVPLPGSEVVSHGLVLRGEGSPDVRGRVRISTVFVQRAPIDEGDDSGDGDREDGDD

SEQ ID NO: 51950 - protein, 128 aa, Gossypium thurberi
KKVFSPDSQEKKNQKSKQQLLEKQVHLGSNDFGAATLETVNLFPPPPEEVKPIEAESKQTYPVVVATAAASPQAAVEVVQRQLNRDALFAGKSEEEVAAIKIQTAFRVYLARRALHALKGLVQAEIID

SEQ ID NO: 51951 - protein, 296 aa, Triticum aestivum
ELVQKHVDDNADITLSCAPVGESRASEYGLVKFDSSGRVVQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMSLCEQPPKFEFYDPKTPFFTSPRYLPPTKSDKCRIKEAIILHGCFLRECKIEHSIIGVPSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 51952 - protein, 265 aa, Oryza sativa (indica cultivar-group)
MPLPTMTHSSSFLRLPATSSPHPPPADDASAAYAVVVLNQRLPRFAPLLWDRAARLRVCADGGANRVFDGMPELLPAEDPDQVRMRYKPDVIKGDMDSIRPEVKEYYSNLGAEIVDESHDQDTTDLHKCVSFITRNPPGSEESNLYILVLGALGGRFDHEMGNINVLYRFSNIRIVLLSDDCSIFLLPKTHSHEIHIERSIEGPHCGLIPMGSPSASTTTTGLRWNLDNTSMSYGGLISTSNIVEEETVSITSDSDLIWTISLRN

SEQ ID NO: 51953 - protein, 382 aa, Rhodococcus sp. RHA1
MARDYYATLGVDQKATDQELKRAYRKLARELHPDVNPDEAAQARFRDISTAYEVLSDPEKRRIVDLGGDPLSSGGGGGAGFGGGFGGGLGDVFEAFFGGGGGAGRGPRGRVQPGADSLLRTRLTLAECATGVSKQVTVETAILCDSCTGAGTNGDSKPVRCETCGGAGEVQSVQRSFLGQVMTSRPCPTCRGAGETIPDPCHKCGGDGRVRARRDITVKVPAGVAGGMRIRLAAQGEVGPGGGPAGDLYVEVVEQAHEVFVRDGEDLHCTIRVPMIDAALGTTVTIDTIIDGPKEITIEPGTQPGSVTVLRGHGMPKLRSGIRGDVHAHLEVVVPSRLDHKETKLLRELKDLRDRDVAEVVSTQSQHSGGLFSRLREAFSGR

SEQ ID NO: 51954 - protein, 387 aa, Pseudoalteromonas tunicata D2
MFCPFLHWAPLILTLCNIHIGQVAVEIKYQLKSLSQRRSEPFTPEDNIGFGRIRTDHMFLMDYDNGQWLNPRIIPYGPLPISPGAMALHYGQAIFEGAKAFLHSDEEIYTFRLDKNTERLNESAKIMCMPEVPKEMQMQAIEALIDVERLWFPRQTGACLYIRPFLFATEDNISVRSSQNYTFCVMLSPSGAYYPEGNNNAISLLISKTYHRAVSGGTGSAKAAGNYAASLRAGIAAKEKGAAQVLYLDSTNQRIEEAGAMNHFHVLKDGSIIIPEFTDTILKSITSQSVLALGELLGCNIRQETVYLDKFIADIESGDIVEAGGFGTAAVVSAVGHYIFEDGTKLKVGNGEVGPTTHKLYALYSAIQTGQHPDELAWLKQVPHRLA

SEQ ID NO: 51955 - protein, 428 aa, Lactobacillus johnsonii NCC 533
MLKSVIENVHALEIFDSRGNPTVEVFVTLSNGVVGKAEVPSGASTGENEAVELRDGGSRLGGKGVMNAVNNVNTEINDALKGLDPHDQPNIDATMIALDGTPNKGRLGANAILGVSMATAAAAAKDNHQPLYRYLGGTDLEMPQTFHNVINGGEHADNGIDIQEFMITPVAKTSFRDGFEKIVNVYHTLKKVLEDMGYETGLGDEGGFAPNMKNSEEALKALHESIIKAGYKPGEDIAIACDCAASYFYNKEDGKYHLEGKVLTDEELADYYDKLLDEFPELISMEDPYDENDVEGMVKFTQSHKDRIQIVLDDFICTNPKLLNKAIHEGAGNASLIKLNQIGTVTETLETIRLSRKNGYNTMISHRSGETGDTFIADFAVAVNGGQLKTGAPARSERVEKYNRLLEIEEELGKGERLAFFPDNVDLD

SEQ ID NO: 51956 - protein, 1325 aa, Ralstonia solanacearum GMI1000
MATTTLGVKLDDASRERLKRAAQSIDRTPHWLIKQAIFTYLDQVERGQLPNDAGGPAADGLPSAAAAVADMADADGTEAVVQPFLEFAQSVQPQSVLRAAITAAYRRPETEAIPMLLEQARLPGALASEAKQLARDLAGKLRTQKVGTGREGLVQGLIQEFSLSSQEGVALMCLAEALLRIPDKATRDALIRDKISSGNWQSHLGQSPSLFVNAATWGLLLTGKLVATHNEAGLSKALTRIIGKRGEPLIRKGVDMAMRLMGEQFVTGETISEALANARKYEAEGFRYSYDMLGEAAMTEEDAQRYLASYEQAIRAIGQASGGRGIYEGPGISIKLSALHPRYSRAQYDRAINELYPRVKGLAMLAREYDIGINIDAEEADRLELSLDLLERLCFAPELAGWNGIGFVVQGYQKRCPFVLDYLIDLARRSKHRLMIRLVKGAYWDSEIKRAQVDGLEGYPVYTRKVYTDVSYLACARKLLAAPDVVFPQFATHNAHTLAAIYHMAGQNYYPGQYEFQCLHGMGEPLYEQVVGNKPGKLNRPCRIYAPVGTHETLLAYLVRRLLENGANTSFVNRIADESIPLDELVADPVAVVENMHAEEGALGLPHPKIPLPRHLYGDVRANSAGIDLANEHRLASLSSALLAGTSSVWAAEPTIGDAPYTGGTPQPVRNPSDLRDVVGHVTEATEADVDAALSAAAAAAPIWQATLPEARAALLDRAADLMEGEMQHLMGLIIREAGKTLSNAIAEVREAVDFLRYYAAQVRGGFSNDTHRPLGPVVCISPWNFPLAIFTGQVSAALAAGNPVLAKPAEQTPLIAAQAVRILREAGVPAGAVQLLPGRGETVGAALVKDARTKGVMFTGSTEVARILQRTLAGRLDANGAPIPLIAETGGQNAMIVDSSALAEQVVADVLSSAFDSAGQRCSALRVLCLQDDVADRVLAMLKGGMAELAMGNPDRLSTDVGPVIDAEARDNIVGHIEGMRAKGRRVHQAPAPAACAHGTFVPPTVIELDSLSDLTREIFGPVLHVVRWKRTADNAGLTRLIEQINGTGYGLTLGIHTRIDETIAHIVERARVGNLYVNRNIVGAVVGVQPFGGEGLSGTGPKAGGSLYLLRLLSTCPQDAMRTALELTAGAGTDVETEERRALLAPFDALRDWARRQSPGLAALCDRLAAATATGAVLTLPGPTGERNTYMLLPRDAVLCVAADPADWLRQLAAVLAVGSEAVVQENPAIAEVLRTLPSAVQSRVRTVASLEDAAFDAVLHHGDSDHLRALCEGLARRAGPIVGVQGLPHGGQGLALERLLIERSLSVNTAAAGGNASLMTIG

SEQ ID NO: 51957 - protein, 278 aa, Rhodopseudomonas palustris CGA009
MAATKRAACLIGCPAAHSRSPLIHHYWLRQLGIEGGYSIEAVPPEGFAEFVLHLKTHGYVGANVTIPHKERALQLTEPDERACAVGAANTLYYDGDLLRSTNTDIEGFIGNLDASAPGWDRSAHALVLGAGGSSRAVVFGLLERGVQRIALANRSIERAQALRDLFGERVVPIAWSDIPAALPGAGLLVNTTSLGMKGQPPLQIDLSALPADAVVSDLVYVPLETDLLAAAKARGLRTADGLGMLLHQAVRGFDLWFGARPHVTPELRALVEADLAPK

SEQ ID NO: 51958 - protein, 222 aa, Zea mays
  misc_feature (187)..(187): Xaa can be any naturally occurring amino acid
MDSSSSSLSQQPEFDYLFKLLLIGDSGVGKSSLLLRFTADSFDDLSPTIGVDFKVKMVSIGGKKLKLAIWDTAGQERFRTLTSSYYRGAQGIIMVYDVSRRETFTNLSDIWAKEIDLYSTNQDCVKMLVGNKVDKESERAVTKKEGIEFAREYGCLFLECSAKTKVNVEQCFEELVLKILNTPSLHXDTPSLLADASSAGVSKKNIFKQKAPEADAATGSCC

SEQ ID NO: 51959 - protein, 568 aa, Ralstonia eutropha JMP134
MYLYDSTDQQLVDERVTQFTDQTARFLSGDLTEDEFRILRLQNGLYIQRHAPMLRVAIPYGMLVSRQLRKLAEISRRWDRGYGHFSTRQNMQFNWPRLEDAPAILAELATVQMHAIQTSGNCIRNTTTDHFAGIAPDEVVNPLVWCEIIRQWSMLHPEFAFLPRKFKIAVSGATTDRAAVGVHDIGLQAVERDGETGFRVWVGGGMGRTPMVGKEISGFVHWSDLLTYLQAILRVYNLHGRRDNKYKARIKILVKDLTPEVFAQQVHEHWQPIRGGPDTVDADFVRDIATRFTTPDYDAAAAQDHDPNPALAAANPRFARWLRSNVHAHRVPGYAAVTVSLKATGTPPGDITADQMEAAADLADHYGFGELRVSHEQNLIIADVRRTRLHELWQQLQTWNLATPNIGLLTNIIACPGGDFCSLANAVSIPLAEAIQQRFDDLDYLYEIGELDLNISGCINSCGHHHVGHIGILGVDKAGEEWYQVTLGGRQGGPSGAAIGRIIGPSFARDEIPEVVEELIKRYIAMRDSEAERFIDVVERVGIEPFKVAVYQNPVIAKRRLEAEAARV

SEQ ID NO: 51960 - protein, 244 aa, Zea mays
MSETGHTVQVTNLSSRVSESDLHEFFSFSGPIQHIELIRSEGYGATAYVTFKERFALETAVLLSGATIVDQPVCITYWGQPEGTFNFWDRPTWEVEEEIEYRNYQTCQYNTTPQEAFTVAQDIMKTMLEKGYVLSKDALAKARAFDESYGLTAAAAARAAELSKRIGLTDRVNAGVGAMRSVDETYGVRETTKTVATATGRTAAKVVNGIVTSSYFSAGAMILSDALTRAAKAAADLAAHGRQN

SEQ ID NO: 51961 - protein, 935 aa, Stellaria longipes
MASPAQSQNSTNSGRSKHSARIIAQTIQDAKLHAEFEESSNEFDYSSSVRGSTSGVNQLPKSDKVTSSYLLQIQKGKFIQPFGCLLALDDKTFRVIAFSENAPEMLTMVSHAVPSVGDLPVIGIGTDIRTIFTGPSASALQKALGFTDVSLLNPILVHCKNPGKPFYAIVHRVTRSLVIDFEPVKPYEVPMTAAGALQSYKLAAKAITRLQSLPSGNMDRLVDTMVQEVFELTGYDRVMAYKFHDDDHGEVVSEVTKPNLDSYLGLHYPATDIPQAARFLFMKNKVRLICDCRAKNVRVVQDEKLSVDLTLCGSTLRAPHGCHAQYMENMNSIGSLVMAVVVNDEDDEDGGSAPAQPHKRKRLWGLVVCHHTSPRFVPFPLRYACEFLAQVFAIHVNKELELENQFLEKKILRTQTLLCDMLMRDAPLGIVTQSPNIMDLVKCDGAALLYNNKVWRLGITPTDYQLQEIGGWLSRDHMDSTGLSTDSLYDAGYPAALELGDSVCGMAAVRITVNDMLFWFRSHTAAEIKWGGAKHEAGEKDDGSKMHPRSSFKAFLEVVKRRSVPWKDYEMDAIHSLQLILRNAFKDGEAADLNTSVIHSKISDLQISGLKELEAVTSEMVRLIETATVPIFAVDSDGLVNGWNTKIYELTGIPVEEAVGKHIAALVEDSSIDNVKQMLQSALQLASHDLQHALHIQRLAEQAATKRANVLAYMKRRIKNPLAGIIFSGKILDGTNVDEKQRLVLQTSARCQGQLNKILDDSDLDSIIDGYCELEMVEFAVQDILVASISQVMAKSSEKGIQMSNNCTEHGFKETLYGDSLRLQQILADFLSISVNFTSPGGHIGVTVRLTKDKIGESVQLANLEFRITHTGGGISEELLSEMFESRGNASEDGISLLISRKLVKLMNGDIQYLRSAGTSTFIISVELAVAGNSS

SEQ ID NO: 51962 - protein, 555 aa, Ehrlichia ruminantium str. Welgevonden
MKIDLNTIFPSSRKEYIPGKIYKNIKIGMRKVSFNNDTESIFIYDTGGPHSDQDIQTNINNGIKKLRLNWITDRQDVEYYDRHTINTNSSTAFPLQNNKALKSKSDKPVTQMFYAKNNIITPEMEYVAIRENSLIQKLLSHTPNTIIPEITPELVRQEVAAGRAIIPANINHPESEPMIIGKNFLVKINANIGNSAVSSDINNEVHKMIYAIIYGADTVMDLSTGSHIHNTREWIIRNSPVPIGTVPIYQALNKVNGIVGELDFNIFKETLIEQAEQGVDYFTIHAGVLKKYIQYTTNRLTGIVSRGGAIIAQWCSIHNKENFLYTNFEEICDIMKSYDIAFSLGDGLRPGSIADANDKAQFLELKTLGELTDIAWKHDCQVMIEGPGHVPMHLIKENVEKQIYFCKEAPFYTLGPLTTDIAPGYDHITSAIGAAMIGWYGTSMLCYVTPKEHLGLPNLNDVKNGVITYKIAAHAADLAKGNPSAYIRDYALSHARFNFRWYDQFNLSLDPETAKSFHDESLPSEHAKSAHFCSMCGPKFCSMKLTHQLQLNSTE

SEQ ID NO: 51963 - protein, 1123 aa, Stellaria longipes
MASPAQSQSSTNSGRSKHSARIIAQTIQDAKLHAEFEESSNEFDYSSSVRGSTSGVNQLPQSDKVTSSYLLQIQKGKFIQPFGCLLALDDKTFRVIAFSENAPEMLTMVSHAVPSVGDLPVIGIGTDIRTIFTDPSASALQKALGFTDVSLLNPILVHCKNSGKPFYAIVHRVTRSLVIDFEPVKPYEVPMTAAGALQSYKLAAKAITRLQSLPSGNMDRLVDTMVQEVFELTGYDRVMAYKFHDDDHGEVVSEVTKPNLDSYLGLHYPATDIPQAARFLFMKNKVRLICDCRAKNVRVVQDEKLSVDLTLCGSTLRAPHGCHAQYMENMNSIGSLVMAVVVNDEDDEDGGSAPAQPHKRKRLWGLVVCHHTSPRFVPFPLRYACEFLAQVFAIHVNKELELESQFLEKKILRTQTLLCDMLMRDAPLGIVTQNPNVMDLVKCDGAALLYNNKIWKLGISPTDYQLRDIAGWLSRDHTDSTGLSTDSLHDAGYPGARSLGDTVCGMAAVRITLNNMLFWFRSHTAAEVKWGGAKHETGEKDDGSKMHPRTSFKAFLEVVKRRSVPWKDYEMDAIHSLQLILRNAFKDVEASDLNTSVIHSKISDLQINGLRELEAVTSEMVRLIETATVPILAVDADGLVNGWNTKIFELTGVPVAEAVGKHIASLAEESSIDNVKRMLQLALQGEEKKNVQFEIKRHQSNPDSSPISLVVNACASKDVNGNVVGVCLITQDITGQKTVMDKFTRIEGDYKAIIQSPNPLIPPIFGTDEFGWCSEWNPAMAKLTGWSREEVIDKMLLGEVFGTQKSCCRLKNQEAFVNFGIILNGAMSGQNTDKLPIEFFTRFGKYIECLLCVNKKLDGDGAVTGVFCFLQLASHDLQHALHIQRLAEQAATKRAKALAYMKRQIKNPLSGIMFSGKILDGTEMGEDQRQVLQTSIRCQGQLNKILDDSDLDSIIDGYCELEMVEFTVQDILVASTCQVMAKSNEKGIQIANDSTTEHGLKETLYGDSLRLQQILADFLWISVNFTPAGGNVGIKVRLTKDKIGESIQHANLEFRISHTGGGISEELLSQMFENQGEVSEEGISLLVSRKIVKLMNGDVQYLRSAGSSTFIISVELAIAGNSL

SEQ ID NO: 51964 - protein, 1122 aa, Stellaria longipes
MASPAQSQSSTNSGRSKHSARIIAQTIQDAKLHAEFEESSNEFDYSSSVRGSTSGVNQLPKSDKVTSSYLLQIQKGKFIQLFGCLLALDDKTFRVIAFSENAPEMLTMVSHAVPSVGDLPVIGIGTNIRTIFTGPSASALQKALGFTDVSLLNPILVHCKNSGKPFYAIVHRVTRSLVIDFEPVKPYEVPMTAAGALQSYKLAAKAITRLQSLPSGNMDRLVDTMVQEVFELTGYDRVMAYKFHDDDHGEVVSEVTKPNLDSYLGLHYPATDIPQAARFLFMKNKVRLICDCRAKNVRVVQDEKLSVDLTLCGSTLRAPHGCHAQYMENMNSIGSLVMAVVVNDEDDEDGGSAPAQPHKRKRLWGLVVCHHTSPRFVPFPLRYACEFLAQVFAIHVNKELELENQFLEKKILRTQTLLCDMLMRDAPLGIVTQNPNVMDLVKCDGAALLYNNKIWKLGITPTDYQLRDIAGWLSRDHTDSTGLSTDSLHDAGYPGARSLGDTVCGMAAVRITPNDMLFWFRSHTAAEVKWGGAKHETGEKDDGSKMHPRTSFKAFLEVVKRRSVPWKDYEMDAIHSLQLILRNAFKDVEASDLNTSVIHSKISDLQINGLRELEAVTSEMVRLIETATVPILAVDADGLVNGWNTKISELTGVPVAEAVGKHIASLAEESSIDNVKRMLQLALQGEEKKNVQFEIKRHQSNPDSGPISLVVNACASKDVNGNVVGVCLIAQDITGQKTVMDKFTRIEGDYKAIIQSPNPLIPPIFGTDEFGWCSEWNPAMAKLTGWSREEVIDKMLLGEVFGTHKSCCRLKNQEAFVNFGIILNGAMSGQNTDKLPIEFFTRFGKYIECLLCVNKKLDGDGAVTGVFCFLQLASHDLQHALHIQRLAEQAATKRAKALAYMKRQIKNPLSGIMFSGKILDGTEMGEDQRQVLQTSIRCQGQLNKILDDSDLDSIIDGYCELEMVEFTVQDILVASISQVMAKSSEKGIQMSNNCTEHGFKETLYGDSLRLQQILADFLSISVNFTSPGGHIGVTVRLTKDKIGESVQLANLEFRIMHTGGGISEELLSEMFESRGNASEDGISLLISRKLVKLMNGDIQYLRSAGTCTFIIYVELAVADNSS

SEQ ID NO: 51965 - protein, 459 aa, Pseudomonas putida KT2440
MSSHEHSPGAGAPANELVLGLEDKPRLLIGLLAALQHLLAIIVPIVTPGLLICQALGVSARDTNLIVSMSLVISGIATFVQCKRFGPFGAGLLIVQGTSFNFVGPLIAGGALMVKQGTPVEGVMAAIFGVVIAGSFVEMGVSRILPFVKRLITPLVTGIVVLMIGLTLIKVGLISMGGGFGAMANGTFANGENLLMSGVVLAIIVVLNRIPVVWMRSCAIVIALAVGYALAGYLGRLDFTGMHEAALFQVPTPLHFGLGFSWALFIPMLVIYLVTSLEAIGDVTATSKVSRQPVEGPMWMQRIKGGVLVNGANSLLAGLFNTFPSSIFAQNNGVIQLTGIASRHIGMWIAVMLVLLGLFPSVAGVIQAVPEPVLGGAAMVMFGAVAASGINILASTRLDRRALLIIAVSLALGLGVAQVPEFLAHMPAAIRNVLESGVATGGICALVLNWFLPEGKEQA

SEQ ID NO: 51966 - protein, 533 aa, Triticum aestivum
MAVAAGRRLLLQSEAPRRQQQQQAASPSPWSAGYLNTWLSQRTPVFGLRLWVLMGIAVGAAIVLVLLLLFLCLSRRRRGRRAANLYHPADAKPLKQQQQHLQHHHAPTPAKDIQEIVRRQQQPAPTPLPQPAAVQMAKAEPPPPPQAQAQTLQQQRAQLPAMPAGSKRSTAASGLSATTSGGSERDLATPRSAGSGAAGPEVSHLGWGHWFTLRELEEATDGLAEENVIGEGGYGIVYRGTLQDSTIIAVKNLLNNRGQAEKEFKVEVETIGRVRHKNLVRLLGYCVEGAYRMLVYEYVDNGNLDQWLHGEIGEESPLTWDMRMNIIIGTAKGLAYLHEGLEPKVVHRDVKSSNILIDKQWNAKVSDFGLAKLLCSEESYVTTRVMGTFGYVAPEYASTGMLTERSDVYSFGVLLMEIITGRSPVDYTRSAGEVNLIEWLKNMVAERKAEDVVDPKLPERPSSKALKRALLVALRCVDPDGHKRPKMGHVIHMLEMEDLNPRDDRKPRRDATTDRSSSMEDGSLSKRENQRYR

SEQ ID NO: 51967 - protein, 292 aa, Exiguobacterium sibiricum 255-15
MKQISVVGSISMDLVVESDRRPSAGETVIGSAFHTVPGGKGANQAVAIARLGGHVEMVGCIGDDANGVAIRQNFETEHVGTTHLQTIADQRTGTAHITLAEGDNSIVVVQSANLAVVYDENQLDSLLGQADMILLQLEIPLATVKQVARYGKTHGIPVVLNPAPAIVLDDELLADVTYLTPNEHECGLIFGQQQPLEHWLTQYPNKLIVTEGSRGARFYDGEAIVTVPAIKTDVVDTTGAGDTFNGALAVSLTDGATLTEAIRFANKAAGMSVRALGAQGGMPTHEQMEVEA

SEQ ID NO: 51968 - protein, 461 aa, Escherichia coli
  misc_feature (193)..(193): Xaa can be any naturally occurring amino acid
MADNKPELQRGLEARHIELIALGGTIGVGLFMGAASTLKWAGPSVLLAYIIAGLFVFFIMRSMGEMLFLEPVTVAFAVYAHRYMSPFFGYLTAWSYWFMWMAVGISEITAIGVYVQFWFPEMAQWIPALIAVALVALANLAAVRLYGEIEFWFAMIKVTTIIVMIVIGLGVIFFGFGNGGQSIGFSNLTEHGXFFAGGWKGFLTALCIVVASYQGVELIGITAGEAKNPQVTLRSAVGKVLWRILIFYVGAIFVIVTIFPWNEIGSNGSPFVLTFAKIGITAAAGIINFVVLTAALSGCNSGMYSCGRMLYALAKNRQLPAAMAKVSRHGVPVAGVAVSIAILLIAHAWNYIIPNPQRVFVYVYSASVLPGMVPWFVILISQLRFRRAHKAAIASHPFRSILFPWANYVTMAFLICVLIGMYFNEDTRMSLFVGIIFMLAVTAIYKVFGLNRHGKAHKLEE

SEQ ID NO: 51969 - protein, 102 aa, Gossypium arboreum
MGISDEKVVAVIMVGGPTKGTRFRPLSLNIPKPLFPLAGQPMVHHPISACKRIPNLAQIYLVGFYEEREFAMYVSSISTELRVPVRYLREDKPHGSAGGLTL

SEQ ID NO: 51970 - protein, 573 aa, Rhodococcus sp. RHA1
MTSTTDASPAAVDAAPARTRTAKPARRRAEGQWALGYREPLNANEQAKKDDNPLNVRARIENIYSKQGFDSIDKGDLRGRMRWWGLYTQREQGYDGTFTGDENIDLLEAKYFMMRVRCDAGALNVEQLRTIAGISTEFARDTADLSDRENVQYHWVEVENVPEIWKRLEGVGLKTTEACGDCPRVVLGSPLAGESLTEVLDPTPAIDEIVRRYIGKPEYSNLPRKFKTAISGQQDVVHEINDVAFVGVNHPEHGPGLDLWVGGGLSTNPMLAQRVGVWVPLDEVPDVWEAVVSIFRDYGYRRLRNKARLKFLVKDWGIERFREVLETEYLKRKLIDGPAPEKPTRPIDHVGVQKTRNGLNAVGVAPIAGRVSGTILAKVADAAERAGSDKIRFTPYQKLIILDVADDKLEQLIADLDEVGLPARPSHWRKNLMACSGIEFCKLSFAETRKRSQVLVPELEQRLADINAQLDVPITININGCPNSCARSQVADIGFKGMLVDDGEGNQVEGFQVHLGGSLGFDSAFGRKLRQHKVTSTELGDYIDRVVRHFVKHRNEGERFAEWVVRADEGDLR

SEQ ID NO: 51971 - protein, 102 aa, Gossypium bickii
MGVSDEKVVAVIMVGGPTKGTRFRPLSLNIPKPLFPLAGQPMVHHPISACKRIPNLAQIYLVGFYEEREFAMYVSSISTELRVPVRYLREDKPHGSAGGLTL

SEQ ID NO: 51972 - protein, 430 aa, Exiguobacterium sibiricum 255-15
MSMITEIYAREILDSRGNPTVEVEVYTEDGGFGRALVPSGASTGEHEAVELRDGDKSRYLGKGVLKAVDNVNEKLAPEIIGYDVFDQAGIDKKMIDLDGTKNKGNFGANAILGISMAAARAAADELGLPLYTYLGGFNAKTLPTPMMNIINGGSHADNNVDFQEFMIMPVGAPTFKEALRMGAEIFHALKSVLSGMGLNTAVGDEGGFAPNLKSNEEAITVILEAIEKAGYKAGEDVYLAMDVASSEFYDKAAGKYNLAGEGKVLSTEELVEFYAQLVDKYPIISIEDGCDENDWDGHKLLTDRIGHKVQLVGDDLFVTNTEKLAEGIEKGIANSILIKVNQIGTLTETFDAIEMAKKAGYTAVVSHRSGETEDSTIADIAVATNAGQIKTGSLSRTDRIAKYNQLLRIEDMLSDVAVYDGIKSFYNLKK

SEQ ID NO: 51973 - protein, 515 aa, Exiguobacterium sibiricum 255-15
MKKRPVALIILDGFGMRDEEFGNAVTAANKPNFDRYWEQYPHTLLNAKGEYVGLPEGQMGNSEVGHLNIGAGRVVYQSLSRINNAIKDRSFFSRQAMNDAAGHVKKYGSALHIFGLVSDGGIHSHINHLYAVLEFAKLHEIEKVYLHAFTDGRDCDPQSGAGFLRDAQAKMDELNVGQFASVSGRYYAMDRDNRWERVKKVYDVITFADGPTTKDPIAMVEASYKTDVTDEFIEPTVVVQEDGTPVAPIHDNDAIMFFNYRPDRAIQLAKTYKEKTGFTGFELPDNVPKNLLLVSMTKYSDAIDTDIVFPPEDIKNTLGETLSKQGLKQLRIAETEKYPHVTFFFNGQREEPYEGEDRILIPSPKVATYDLKPEMSVYEVTEALVDAINSDKHDAIILNFANPDMVGHSGMLEPTKKAIEAVDKCLGQVVDLIISKGGAAIITADHGNADKVLNADGSKMTAHTTEPVPCIVTVEDVELLKPLTGVLADLAPTVLDLLGADQPAEMTGKSIVLKK

SEQ ID NO: 51974 - protein, 1103 aa, Oryza sativa (indica cultivar-group)
MGFAASPAFPPCHRKMPCRLATTYSDHIALPRPSPGFEAATLAELYPVTSGHDAASSLAIDAPPVDGRWLPMLYPTSDILSFFSALHILISTTTYGTYSFDIATSEWTKSGDWRLPFRGRAEHVLEHGLWLGISAIDDTILGAWNLSSVPEVDGEPPVEGVLCGQSRKRIICHYSWGLAHHRLLTRSLARLGQGPLTLRRICPGPQSPKKKLVKLPSGSNASKVTGPKAGPDQIDDTLEHQEEGVAEEDMQDKLTEHSVSQRLPLIIPDKVHRSKPLIECDGDSIDLSGDVGAVGRIVISNSPNGYQDLLLDLEGTIYKSTIVPSRTFYVIEYIMNEFIQLEPQSNLFGRDYDGIDYDGGPSICLNSRVQTINLAGEIAQEFQKRQYLPATDDMLALDIAYTIYMKFEDLTSALRIALLLDNKSIQYMKQVYTATEDLQPKKQFSFIIARHGLAMEIDNEIAADDNDKEGLQEIVNNTKLSEGYLTLARDIEVMEPKSLEDIYKVHLIDGGGASSSLDSARQNLAATFVNAFVNAGFGQVSSTNNMILLVLSEERMNLKTISSVQNKLMTAPSDSSSSGASGNCLFKNKEHGKASAAASLTQIRFQILPPIRNRRNYSLKNESISFFPYIPSRKKEQFHEVKGMILLWDPDSGLAQLDKYLHSNDAHVVAGALLGIGIVTCGVKNDCDLALAILMEYINKDDTNIRIGAILGFGIAYAGSQKGECNEAEPAEPIIRLLPVALGLLYLGKQESVEATTEVSKTFDEKIRKYCDVTLMSLAYARTGNVLKVQKLLGICSQHLEKGETHQGPAVLGIALIAMAEELGAEMAVRPLERLLQYGEQNIRRAVPLALGILCISNPKVNVMDTLSRLCHDADADVSMAAIISLGLIGAGTNNACFAIFQVTITKKLHICFVMALGRLVTVLHACLDMKSTILGKYHYILYIIVLAMQVVVDIRMLLTVDEYLKPISVPVRVGQAVDVVVAVALHREPLQLEARHQLLLLERGGQIPRTENGVIYVGDAQPEAVLGDVLGAAAEGQPPVARLGSRRGRGVEGVGAVCGGGYQDVRVAVAGRCVPADLAAGGDFVVGGVHARWRRRRWQGTP

SEQ ID NO: 51975 - protein, 94 aa, Zea mays
FDYVVDQALDQVASTDLKQVMLVKALLNARDTLLAELQKLSAAINHAVHLTEFTSKMNDMKLFDSFLQEPVAADAEDSAQGKPQNGLEVLALCY

SEQ ID NO: 51976 - protein, 564 aa, Pseudoalteromonas tunicata D2
MTNKDTKNFLYIPHSGPKLIETPLLNKGSAFTKRERESFNLMGLLPPRFESIEEQVKRCYQQYSSFTDNLNKHIYLRAIQDNNETLYYRLVRDHLEEMMPIIYTPTVGDACEQFSDIYRSARGLFISYEDRHQIDDILRNATKGKVKVIVVTDGERILGLGDQGIGGMGIPIGKLSLYTACGGISPAYTLPVMLDVGTNNEKLLNDPMYMGARHKRIGQEEYDEFLDLFINAVKRRWPNVLLQFEDFAQPNAMPLLKRYRNEICSFNDDIQGTAAITVGSLLAACRVKGEKLSDQTVAFVGAGSAGCGIAEQIISQMVFEGISDAQARSQIFMVDRFGLLTDGMADLRDFQQALVQNDTTLADWTFSGEYASLLDVMHCAKPHILIGVSGQPGLFTEQVIRAMYQGCERPIIFPLSNPSKQVEAVPHDVIHWTEGQAIVATGSPFSPVEYDGKTFPIPQCNNSYIFPGIGLGVIAAKAKTITDEMLMVSSETLAASSPLANTGKGSLLPALTQIEALSKEIAFAVAKKAIEQGVALEISDDALRSAIDKNYWLPQYRDYKRVSI

SEQ ID NO: 51977 - protein, 325 aa, Listeria monocytogenes str. 4b H7858
MNLNKHSERKFDLITVGRACIDLNAVEYNRPMEETMTFSKYVGGSPANIAIGTAKLGLKVGFIGKISADQHGRFIEKYMRDLNINTDGMVKDTEGRKVGLAFTEIKSPDECSILMYRENVADLYLTPEEISEDYIKEARVLLISGTALAQSPSREAVLKAVSLARKNDVAVAFELDYRPYTWTNTEETAVYYSLVAEQADVIIGTRDEFDMMENQVGGKNEATKAHLFQHQAEIVVIKHGVEGSFAYTKAGETFQAKAYKTKVLKTFGAGDSYASAFLYGLFSGESIETALKYGSAAASIVVSKHSSSDAMPTADEIKALIAQAE

SEQ ID NO: 51978 - protein, 629 aa, Pseudomonas syringae pv. tomato str. DC3000
MSTKPKNAAHLSESAQVDSGSVQPFTRSQKIYVQGSRPDIRVPMREVTLDVTPTDFGGEINAPVTVYDTSGPYTDPNVIIDVRKGLADVRSPWIDSRNDTERLPGLSSHFGQQRLSDAELTALRFAHVRNPRRAKAGANVSQMHYARQGIITAEMEYVAIRENMKLQEARAAGLLTQQHAGHSFGASIPKEITAEFVREEIARGRAIIPANINHVELEPMIIGRNFLVKINGNIGNSALGSSIEEEVAKLTWGIRWGSDTVMDLSTGKHIHETREWIIRNSPVPIGTVPIYQALEKVGGAAEDLTWELFRDTLIEQAEQGVDYFTIHAGVLLRYVPLTAKRVTGIVSRGGSIMAKWCLAHHQENFLYTHFEDICEIMKAYDVSFSLGDGLRPGSIADANDAAQFGELETLGELTKIAWKHDLQTMIEGPGHVPMQLIKENMDKQLECCDEAPFYTLGPLTTDIAPGYDHITSGIGAAMIGWFGCAMLCYVTPKEHLGLPNKDDVKTGIITYKIAAHAADLAKGHPGAQIRDNALSKARFEFRWEDQFNLGLDPDTARSYHDETLPKDSAKVAHFCSMCGPKFCSMKITQEVREYAANQRIEAVDVDVARGLAEQAERFKQEGSQLYKKV

SEQ ID NO: 51979 - protein, 472 aa, Myxococcus xanthus DK 1622
MARYDFDLFTIGGGSGGVAASRRAGAHGAGVALCEDRDVGGTCVHRGCVPKKLLVYGAHFREEFQDAEGYGWTVQEPLFTWSKLLAAKDKELDRLRGVYARLLRDSGVTLLEGRGRVVDPHTVEVAGKLYTAERILIATGSRPYLPPDITGIEHAITSDEALSFPELPRRLAVVGAGYIGVELAGVFHGLGSKVTMLIRGASVLGGFDDDVRSFLTDEMRKKGIELMTDTFIRDIEKRAEGGVSLLTGGGETVEADAVLFATGRVPNSGGLGLEEVGVTLDARGAVVVDAWSRTSVESIYAVGDITDRINLTPVAISEGRALAETLFNDNPTQMDHTNVPSAVFSQPPVASVGLTEQEARERHGKLDIYVTSFRPMKHTLSGRNERTMMKVVVERESNRVLGCHMVGTDAPEIIQGLAVAVKCGVTKKQLDATVGIHPTAAEEFVTLRDKRPDPDERLAAELGRDAAASTRR

SEQ ID NO: 51980 - protein, 356 aa, Myxococcus xanthus DK 1622
MARIAVIPGDGIGIEVTREVMRILQVLDAEMRLGLSLEAFDFGAERFLRTGVGLPPGQMDVFRTEFDAILLGAMGDPRVPDNAHAREILLGLRFGLDLYVNFRPCSPLAERLSPLKGKGPQEIDMTIFRENTEGIYGAIGGSFKRGTLDEVAIAEEIHTRKGVERIIRAAFKWASAHGKRHVALGDKSNAIAAHGLWLRTFREVAAEYPQIEARHYYVDALALQMVTRPESLQVIVTTNLFGDILTDLGAALSGGLGVAPSANLNPDSTPLFEPVHGSAPELTGKGLANPAAMVLSAALMLEHLGQAGAARRLSTAVQQTVAEGQCTRDVGGTLSTTEAADAILDRMLQGLRRTRT

SEQ ID NO: 51981 - protein, 67 aa, Arabidopsis thaliana
MDPCHSLIHTDDVPATPKANNDITYITSNGGRANCMQEWPPIGKKKYETVYNLTDLTESELANDVDY

SEQ ID NO: 51982 - protein, 338 aa, Triticum aestivum
  misc_feature (95)..(95): Xaa can be any naturally occurring amino acid
  misc_feature (248)..(248): Xaa can be any naturally occurring amino acid
  misc_feature (256)..(256): Xaa can be any naturally occurring amino acid
  misc_feature (271)..(271): Xaa can be any naturally occurring amino acid
  misc_feature (280)..(280): Xaa can be any naturally occurring amino acid
  misc_feature (289)..(289): Xaa can be any naturally occurring amino acid
  misc_feature (300)..(300): Xaa can be any naturally occurring amino acid
LPGASDLGIRVEIGIPAEAGLAQRLGAAANERLAGQEPLLLVAAPLLALLAARAVHAAAADVADRGLRTVLITLAMAAVKLVPGVSGYIAAEKRXVVDKLQSGSASSKKNLRTELPAVGIPDRVIGDLQALKDKDVRWQGKCSGTVYIAGSESEGHFSLINKAYSMFSHTNPLHQDVFKSVAQLEAEVVAMTAALLGSKEKASGGQICGNMTSGGTESILWAVKTSRDYMQSKKGITKPEMIIAESAXHSAYDKAXAQYFIIKVRRVPVNXEFLAHVKGXHTCINGNPXMMGGSDPGFPXGLIDPIDGLGGWLPNMVWLAVEIGLGGSVGHPPETVVP

SEQ ID NO: 51983 - protein, 295 aa, Corynebacterium glutamicum ATCC 13032
MISLLNDPRTLFPKVDPPKQSQPEPGLDIKLSPQADIGLSSYQGSGRLKGRKALITGGDSGIGAAVAIAYAREGADVAIAYLPEEQADADRVLQAIEETGQKAFSFPGDLRDPEYCRSLVQETVNALGGLDILVNNASRQVWAPGLTEITDENFDQTLQVNLYGSFRVTKAAIPHLKPGSSIIFTSSIQAYQPSETLLDYAMTKAALNNLSKGLASSLIGDGIRVNSVAPGPFWTPLQPSHGQPQEKIEGFGQHAPIGRAGHPVELAGAYVFLASDEASYVVGETLGVTGGTPTP

SEQ ID NO: 51984 - protein, 311 aa, Oryza sativa
  misc_feature (231)..(231): Xaa can be any naturally occurring amino acid
MHVLFCSDSRRTLQNQTNTCTTSTEENPTSKAHIHTNKHPPSAASAAALASTATPMVRKLPLSSVLYTINSARDIPPSSPPPPAATPPAWMWPSCKHPRAHSFRSPSAASAAAAAKTIASIFLDSGESSFANSSARMHHDCASDSLSTESDVSATAEDMADAIVRGLRSDRLLFEPRAPSSSILDKKPVRRAAGGGDDDDDGAASFGGGVAVAFDSEDPYEDFRASMAEMXLPAHGVGDWGWLEAMLGWYLRANGKETHAAIVAAFVDLVVSTAARGSSSSRHSSFTLAGTDLESSSAGGGAAGHISFRLR

SEQ ID NO: 51985 - protein, 250 aa, Exiguobacterium sibiricum 255-15
MRKPIIAGNWKMNLTLKDAVAFAEEVKGTVPASSKVDAAVCAPSVFLAHLTEATAGTDLKIGAQNMYDQESGAFTGEISPVMLKELGVTYVVLGHSERREYFGETDAFINSKTKKAFEHGLVPIVCVGETLEEREGGKFESVIREQTTNSLKGLTVDQVKNLVVAYEPVWAIGTGKSATEQDAQDSCKFVRDVIAAEFGTEAAEAVRIQYGGSVKPDNIKEYMAQPDIDGALVGGASLETGSFLKLLEAI

SEQ ID NO: 51986 - protein, 582 aa, Vibrio fischeri ES114
MKSDIEICQTATLTRMKTIASNLGLHDDDITPQGPFKAKVNIDALKRLKSEPNGKLILVSAITPTPLGEGKTVTTIGLAQGLAKLGESVSACIRQPSMGPVFGVKGGAAGGGYSQVAPMEELNLHLTGDIHAITAAHNLASAAIDARIYHEQRLGYDVFSEKNELPALRIDPQHVVWKRVMDHNDRALRMVTIGKNEDGKTINGYEREDGFDITAASELMAILALATDLQDLRQRIGRIVVAYNLDGEPVTTEDLQVAGAMTVTMKFAINPTLMQTLEGVPTFVHSGPFANIAHGNSSIIADNIALKLTDYTVTEGGFGSDMGFEKACNIKAPLSEKSPDCAVLVATLRGIKANSGLFPLSPGQSLPKELFAPNKEALDAGLDNLLWHINNCAKYGLPVVVAINRFPEDTQEELDSLLNWVSNLDMNVDVAISEAFVKGGNGTLELAEKVIKACQQETQFTPLYTSEMSLFDKLNAVAIKGYGAERIELSEKAQQQLATFEKLGYQSLSVCMAKTPASISTDGNIKGAPTDFIVPIRELKLCAGAGFIYALCGNVMTMPGLPEKPAFMNLDIDGDGNIVGLS

SEQ ID NO: 51987 - protein, 394 aa, Exiguobacterium sibiricum 255-15
MNKKSIRDIDVKGKRVFTRVDFNVPLEDGKITDDTRIRAALPTIKHLVDGGAKVILASHMGRPKGEKNPEFSLAPVVARLSELLGKDIKLVEEAYGPVAEEAVSKLEEGDVIVLENVRFYPGETKNDPELAEGFAKLADVFVNDAFGAAHRAHASTEGIAHHVETAVAGLLIEKELQVLGKALSNPDRPFTAIIGGSKVADKIGVIDHLLDIVDTLIIGGGLSYTFLKAQGYEVGTSLLEVDKIEQAKEFMKKAEDKGVKFLMPVDCVITKEFGEETYVGSRDIDSIPADHMSLDIGPKTVELYAEAIKASKLVVWNGPMGVFELDKYANGTKGVAQALADSDAYSIIGGGDSAAAAEKFGLADKMSHISTGGGASLEFMEGKALPGVEALNDK

SEQ ID NO: 51988 - protein, 335 aa, Exiguobacterium sibiricum 255-15
MAVKVGINGFGRIGRLALRQILQFDGIEVVAINDLTDTKMLAHLLKYDTTQGRFDGEVEVHDGYFLVNGKEIKTLANRNPEELPWGELGVDIVLECTGFFTDKEKAELHLKAGAKKVVISAPATGDMKTVVFNTNHEILDGTETVISGASCTTNCLAPMAKVLQDNYGIVQGLMTTIHAYTGDQNTLDAPHPKGDFRRARAAAANIVPNSTGAAKAIGLVLPELQGKLDGAAQRVPVATGSLTELTTVLEKKVTVEEVNAAMKAAANESYGYTEDEIVSSDIVGISYGSLFDATQTKVVTVGDKQLVKTVAWYDNEMSYTSQLIRTLKHFAEIAK

SEQ ID NO: 51989 - protein, 160 aa, Nicotiana benthamiana
MSGGIARGRLAEERKAWRKNHPHGFVAKPETLSDGSVNLMVWHCSIPGKAGTDWEGGFYPVTIHFSEDYPSKPPKCKFPQGFFHPNVYPSGTVCLSILNEDSGWRPAITVKQILVGIQDLLDQPNPADPAQTEGYHLFIQDAIEYKKRVRLQAKQYPPLV

SEQ ID NO: 51990 - protein, 421 aa, Acidovorax sp. JS42
MAIVEVKVPQLSESVAEATLLQWKKKPGEAVAIDEILIEIETDKVVLEVPAPAAGVMAEIVVADGGTVASDQVIAKIDTEGKAGAAAPAAAAAAPAPAAASAPAAAAPAAAGGSKGDVAMPAAAKLLADNNLSVGDVTGSGKDGRVTKGDVLAAVAGGVKSTAAVIPTGVPTKALPQVAAPASKEELGERPEQRVPMSRLRARVAERLLQSQSTNAILTTFNEVNMAPVMDLRKKFQDAFTKEHGVKLGFMSFFVKAAVHALKKYPVLNASVDGNDIVYHGYFDIGIAVGSPRGLVVPILRNADQMSFADIEKKIAEFGKKAADGKLGIEEMTGGTFSISNGGTFGSMMSTPIINPPQSAILGVHATKDRAVVENGQVVVRPMNYLAMSYDHRIIDGREAVLGLVAMKDALEDPSRLLFDL

SEQ ID NO: 51991 - protein, 475 aa, Acidovorax sp. JS42
MSKQFDVIVIGAGPGGYIAAIRAAQLGMNVACIDEWKNAAGGAAPGGTCTNVGCIPSKALLQSSEHFEHANLHFADHGITATDVKMDVAKMIARKDNVVKQNNDGILYLFKKNKVTFFHGRGSFVKAVDGGYEIKVTGKAEETLTAKQVIVATGSNARALPGAAFDEEQILSNDGALAIGSVPKKLGVIGSGVIGLEMGSVWRRLGADVTILEGLPTFLGAVDEQIAKEAKKAFDKQGLKIELGVKIGEVKTGKKGVSIAYTNAKGEAQALEVDKLIVSIGRVPNTTGLNAEGVGLKLDERGAVVVDGDCKTNLPGVWAVGDVVRGPMLAHKAEEEGVAVAERMAGQHGHVNFNTIPWVIYTSPEIAWVGRTEQQLKADGVKYKAGTFPFLANGRARALGDTTGMVKFLADAATDEILGVHIVGPMASELIAEAVVAMEFKASSEDIARICHAHPSLSEATKEAALAVDKRTLNF

SEQ ID NO: 51992 - protein, 562 aa, Arabidopsis thaliana
MDRILKAARTSGSLNLSNRSLKDVPTEVYQCLETTGEGENWWEAVDLQKLILAHNDIEVLREDLKNLACLVVLNVSHNKLSQLPAAIGELTAMKSLDVSFNSISELPEQIGSAISLVKLDCSSNRLKELPDSIGRCLDLSDLKATNNQISSLPEDMVNCSKLSKLDVEGNKLTALSENHIASWTMLAELNACKNMLGVLPQNIGSLSRLIRLDLHQNKISSVPPSIGGCSSLVEFYLGINSLSTLPAEIGDLSRLGTLDLRSNQLKEYPVGACKLKLSYLDLSNNSLTGLHPELGNMTTLRKLVLVGNPLRTLRSSLVNGPTAALLKYLRSRLSNSEETSASTPTKENVIASAARMSISSKELSLEGLNLSDVPSEVWESGEITKVNLSKNSIEELPAQLSTSVSLQTLILSRNKIKDWPGAILKSLPNLMCLKLDNNPLNQIPLDGFQVVSGLQILDLSVNAVSFREHPKFCHLPQLRELYLSRIQLSEVPEDILNLSNLIILDLNQNSLQSIPKGIKNMTSLKHLDISNNNISSLPPELGLLEPTLEVLRLDGNPLRRYK

SEQ ID NO: 51993 - protein, 494 aa, Salmonella enterica subsp. enterica serovar Paratyphi A str.
MSDVTLLAEVTTFLRQRHGQFIAGERQAGNGTNFSVTNPATGKIIADVVSATPTQAEEAMQSARRAFDVWRKMPTLQRGALLLKLADTLAAHREELAQLESVCSGKTILLSRGLELDQSVAFLRYFAGWAGKITGETLNVSLPSMGEERYTAFTQRQPIGVVVGIVPWNFSIMIVIWKLAAALVCGCTIVIKPSEYTPLTLLRVAELAKEAGFPDGVINVVNGAGGEIAQQLIAHPDCAKVSFTGSVATGEKVRRSATSSGKRVTLEPGGKNAALFLNDLTEQAMVNGILEAGYLNQGQICAAAERFYLPQEKLDTVMTLLRQRLSEIVPGSPLDEKTVMGPLANQVQLEKVLRLIQRAREEGDTIVYGGETLPGEGYFLQPTAVKVRSKNSTLIHEETFGPVCSFIGYQNEKEALSHINDSPFGLAASVWSENMSKALHYAEDIDAGMVWVNMHTFLDPAVPFGGMKGSGIGREFGSAFIDDYTELKSVMVRY

SEQ ID NO: 51994 - protein, 194 aa, Chlamydomonas sp. HS-5
MDESNATCGKRLDSIGVENTEENRRAYRDLLLSTPGLGQYISGAILFEETLYQSTKDGKTFVQVMNDQGIVPGIKVDKGLVPLVNSNGESWCMGLDGLDKRCAEYYKAGARFAKWRSVISIPAGPSIIAQRDCPTAWPATPPLPSPLAWCPSSSPRCCWTVTRTLTRLWRLPRTSGLRLSSTWPTTRSCSRVSC

SEQ ID NO: 51995 - protein, 618 aa, Desulfovibrio desulfuricans G20
MCGIFGIISQLVPPSKRELETSCELLAHRGPDGYGYFIKGPVGFAHRRLSIIDIAQGSQPMSTQEGELTITYNGEIYNFRHIKASLVAKGYSFQTNSDTEVILAAYKEWGTECVQHLRGMFAFAIADHIRQTVFLARDPFGIKPLVYRESSLGFAFSSELPALVRLKKWPSVTVSPKAVSLFFRHQYIPAPYTIYNETQKLPPAHAMLVDFNGCIQQKWRYWTPAFHPSVTYSLQDAIKDAHNSVTESIDAHTLSDVPIGVFLSGGIDSTLVAARLAQRHSRSIPAFTIGYKESDFSELPYAQHAADKLGLKLYAQTLDEKALKFAPEILSHYGEPFGDSSVIPTWHVCKLASEHVPVCLSGDGADELFGGYQKYQIWSESTPWRQLQLAGSAIAKRKLRTAWWMLRRASRSFCDDKAFWLDHVQYYPPQGIRQLTHPDMHPYANAFAPAFDEPFLNIDKLGRFEYAQRMDLLSYLPDCLLAKVDLASMAHGLEVRPALLDKYVFQLAATLPTDVKLHPQKGGKVVLKELLLRQGFSEEFVYRPKQGFALPLRHWFISGQPANNMLCELVSSYKRELSEHLTVSDIERMLTAHSPACDYSGPLWLAFAFTCWVANTSK

SEQ ID NO: 51996 - protein, 697 aa, Kineococcus radiotolerans SRS30216
MSQPSLEWSDLDQRTVDTARVLAMDAVQRAGNGHPGTAMSLAPVATLLFQKVLRHDPADPDWVGRDRFVLSCGHSSLTLYNQLYLSGYGLELDDLKALRKWGSKTPGHPEHGHTAGVEMTTGPLGQGLSSAVGMAMAARRERGLFDPEAAPGTSPFDHHVYVLCSDGDIEEGVTSEASAIAGVQELGNLVVIYDQNHISIEDDTAIALGEDTGKRYESYGWHVQTIDWTNGGEGPYTEDLAGLHAAIEAAKAETGKPSIIVLRTIIAYPAPNLQNTGKSHGSALGEAEVKATKEVLGFDPEKTFEVSDEVIGFARQVRERGKTAHEAWQREFDAWREGAGERAELFDRMRTRTLPAGWEQSLPVFEPGKAMASRKASGQVLNAIASSLPELWGGSADLAESNLTSLKGEPSFLPPSRTTKTWDGNVYGRVLHFGIREHAMGSILNGIALHGGTRPYGGTFLVFSDYMRPAVRLASIMRLPVTYVWTHDSIGLGEDGPTHQPIEHLASLRAIPGFDVVRPGDANETAWAWKTILETTDRPAGLALSRQDLPTFDRSQPGWGAADGVAKGAYVLVEASTANPEVILIGTGSEVQIAVAAREKLEAEGIPTRVVSMPCREWFDAQPQSYRDTVLIPGVKARVAVEAGIAQGWHDLTGDAGRVVGIEHFGASADYQDLYREFGMTDTAVVTAAKESLAGLQ

SEQ ID NO: 51997 - protein, 205 aa, Brassica napus
  misc_feature (32)..(32): Xaa can be any naturally occurring amino acid
MKALTDRFVPQQRSPSPPTPLVSSDSEHTVWXCTLWSTSSSVSQPYREPSSTSGRKQLCAATWTSFVKKVSMASGAIKRFQDRVLGPNRTGLPSTTSDFWLLGVCYKLSDDEETDDGSVVAALKQDFSSRILMTYRKGFEPIKDTSYTSDVNWGCMIRSSQMLFAQALLFHRLGRSWRNKNSEVSSVQPEQVVKKFPKKKKKKKK

SEQ ID NO: 51998 - protein, 444 aa, Haemophilus influenzae R2846
MKNVVIVGGGAGGIELATFLGNKLGRQKQAKVTLVDRNATHLWKPLLHEIATGVMDDGVDSLSYRAHGKNHFFSFEQGSIIRINREQKYVELAPVYGQEGDMLVIARRIPYDYLVIAIGSKSNDFNTKGVADNCIFLDSSKQALRFQHKLLELFLKFSENRALDDIGEEEFKQKLVDENKVNIAIVGGGATGVELTAELYHAAEDLSSYGYGKIDSSCLQVTLVEAGTRLLPALPENLSAAVLDELKEMGANVQLNTMITEAQPNTLITKDGREIKADLIVWAAGVRVSTVTQQFDGLEINRINQLVVKDTLQTTVDDSIFAIGDCAAFIQSNGKLVPPRAQAAHQMAKACAKNIFALFENKPLKSFKYNDKGTLVSLSNFTALGSLTNKFGKNPLTVQGKFAQFAYVSLYRMHQHALHGCIKIGLIILVDKLNRYLKPRLKLH

SEQ ID NO: 51999 - protein, 261 aa, Kineococcus radiotolerans SRS30216
MSRTPLIAGNWKMVLDHQQGTLLVQKLDWTLKDAKHDYSAVEVAVLPSHTSLRTVQTLIEGDKLSIALGAQDVSEHDSGAYTGEVSAAMLAKLGVTYVAVGHSERRQYHGETDATVRAKAAKALAAGLTPIVCVGEALEIRKAEQHVEFTVGQVTQALTGLTAEQAAGLVLAYEPVWAIGTGEVATPEDAQEVCAALREAVAELFDRATADAVRVLYGGSVKPASIAAIMRQPDVDGALVGGASTDAGDFAAIVRFRDHPA

SEQ ID NO: 52000 - protein, 412 aa, Kineococcus radiotolerans SRS30216
MKTLDDLETQLGGFAGRRVLVRSDLNVPLDHDRRDGAGQPVITDDGRLRASVPTLRRLLDAGARVVVTAHLGRPKGAPEAKYSLAPVHARLAELLPGVEVGFCPVTVGAQATAAVDALADGELLLLENIRFNAGETSKDDEEREAFADELAALADAFVSDGFGAVHRKHASVYDVALRLPHAAGGLVATEVEVLQRLTAHPERPYAVVLGGSKVSDKLGVIDNLLGSLLGEGDRLLVGGGMVFTFLKAQGYEVGKSLLETDQLDRVAGYVRTAREKGVELVLPTDVVAATAFAADAEHDVVAVDAIPADRLGLDIGPDSGAAFAARLADARTVFWNGPMGVFEMEPYSHGTRAVAQALVDGGAFSVVGGGDSAAAVRTLGFADERFGHISTGGGASLEYLEGKHLPGLDVLS

SEQ ID NO: 52001 - protein, 448 aa, Listeria monocytogenes EGD-e
MKKDKTERTKQSWRKAQNAPSLSEVNNSVAIPKNAKFFRKLFAFMGPGALIAVGYVDPGNWATSIAGGSEFGYTLLSVILISNILAVLLQSLASKLGIVTGRDLAQASSDHFSKPFGFVLWILAELAIIATDIAEVIGSAIALNLLFGIPLIWGVCITALDIFLVLFLQHKGFRYIEVIVITLMVTILVCFGAEMVMSHPDMQAIAKGFIPQSEIVTNPAMLYIALGILGATVMPHNLYLHSSIVQTRQYARTKEGKKEAIRFSFIDSTFSLTIALLINASILILAAAAFYTTGQHNVAGIEDAYKLLNPTLGSSIASTVFAVALLASGQNSTLTGTLAGQIVMEGFLNIRLKPVVRRLLTRVLAIVPAVIITALYGANGINELLIFSQVILSMQLSFAVIPLVMFTSDKQKMGEFVNPTWLKIISWAVAIFIAVLNIYLLFYTLTSL

SEQ ID NO: 52002 - protein, 177 aa, Brassica napus
MAAELVCCEANFFIHIAVIAFLVLFAGLMSGLTLGLMSLSLVDLEVLAKSGTPQHRKYAEKILPVVKNQHLLLVTLLVCNAAAMETLPIFLDALVTAWGAILISVTLILLFGEIIPQSICSRYGLAIGATVAPFVRVLVFVCLPVAWPISKLLDFLLGHRRAALFRRAELKTLVDFM

SEQ ID NO: 52003 - protein, 630 aa, Rhodococcus sp. RHA1
MTVARNRAGAGPGKGSPISSFADKTFTDPARIRNFCIIAHIDHGKSTLADRMLQLTGVVEERQMRAQYLDRMDIERERGITIKAQNVRLPWKVGDEEFVIHLIDTPGHVDFTYEVSRALEACEGAVLLVDAAQGIEAQTLANLYLAMEKDLTIIPVLNKIDLPAADPDRYAEEIAHITGCEPGDVLRVSGKTGIGVKELLDEVVRQVPAPVGDPDGPARAMIFDSVYDAYRGVVTYVRVVDGRISPREKITMMSTGTTHDLIEVGIISPEPKASIGLGVGEVGYLITGVKDVRQSRVGDTVTAARGGATEPLVGYRDPKPMVYSGLYPLDGSDYPVLRDALDKLRLNDAALAYEPETSVALGFGFRCGFLGLLHMEITRDRLEREFGLELISTSPNVVYRVVMEDGSEHVVTNPSYWPEGKIREVYEPMVKCTIIAPSEFIGAIMELCQNRRGELGGMDYLSETRVELRYEMPMGEIMFDFFDALKSRTKGYASLDYEESGEQQADLVKVDILLQGEAVDAFSSIVHRSAAGAYGGRMTSKLRELIPRQQFEVPIQAAIGSKIISRENIRAIRKDVLAKCYGGDISRKRKLLEKQKEGKKRMKTIGRVEVPQEAFVAALSSESVGDKPKK

SEQ ID NO: 52004 - protein, 334 aa, Kineococcus radiotolerans SRS30216
MTTRVGINGFGRIGRNFFRAALAQNADFEIVAVNDLTDAKALAHLLKHDSILGKLAEDVRVEGDSIVVGSRTIKVLADRDPANLGWGDLGVDVVVESTGFFTDGEKAKAHLTAGAKKVVVSAPATNDDVTVVMGVNDSDYDGSKHAIISNASCTTNCLAPLAKVLDDAFGIERGLMTTVHAYTADQNLQDGPHKDLRRARAAALNIVPTSTGAAKAIGLVLPQLKGKLDGYALRVPVPTGSATDLTVTVGREVTVDEVNAAYRAAADGPLKGYLTYSDEPLVSSDIVTDPSSCIYDSGLTKVIGNQVKVVGWYDNEWGYSNRLVDLVTLVGASL

SEQ ID NO: 52005 - protein, 469 aa, Bordetella bronchiseptica RB50
MASTMETDLLVLGGGPGGYTAAFRAADLGLSVVLVEQRPTLGGVCLNVGCIPSKALLHCAKALDEARAMSELGIEFSEPRIRLDKLRAHKEALVAKLCGGLGGLARQRKVQVVTGTGRFDGPHSLAVSDGSRVAFKQAVIAVGSRPVRLPFLPDDPRIMDSTGALELKEIPRRLLVIGGGVIGMELATVYAALGARVTVVELTDGLLPGCDRDLVKPLAQRVAGRYEAVLLGTRVSAAQARDDGIHVGFEGPQAPGPQVYDQVLVAAGRRPNGAAIDAERAGVRVDEGGFIRVDAQQRTNVGHIYAIGDVVGEPMLAHKAAHEGKVAAETAAGMRVANDARVIPAVAYTDPEVAWVGLTETAAQRDGIAYEKAAFPWAASGRALSLGRGEGLTKILVDPATHALLGVGMVGPQAGDLIAEAALAIEMGAEPGDIALTIHPHPTLSETLAFAAEAYEGTLTELYLTRKKS

SEQ ID NO: 52006 - protein, 417 aa, Oryza sativa (japonica cultivar-group)
MDPSKRGFMNLLNQGSPSQQSSQNSPPTQFPSTFSQSQFPQSPHFTQASPPNFQTFNPFGPPANYHLYGSSPPNFQGFQQQASWLQSAPISFQGFRPQESWMHSPNQVVGSASSHGSESASQCPARQEENNLVNIEESSDNSQETGRRGTRVNWTEEENLRLLSSWLNNSLDSINGNDKKGEYYWRDVAAEFNGNASSNNRKRTVVQCKTHWGGVKKDIAKFCGAYSRARRTWSSGFSDDMIMEKAHALYKSENNDKTFTLEYMWRELKDQPKWQRILEEDSKNKRTKISESGAYTSSSNQETEEETSRKEKRPEGQKKAKAKLKGKGKKPAPSPLGDQPSQDFVLFNEAVKLRAEAVLKSAEATTKSAEAKKEQTRMEKYQTYLKLLDKDTANFSDAKLKRHEAVLEKLATELAEE

SEQ ID NO: 52007 - protein, 431 aa, Clostridium acetobutylicum ATCC 824
MDKLSIREDNYNIKHKTISLNRASSVTRNLKGLLKFLGPAFVVSVAYIDPGNFATNISGGSSFNYNLIWVILWSNLMAIFLQTMSAKLGIATGCSLPEMCAKVFSKRANWIFWIVGELGAMATDLAEFIGGTLGLYLLFRIPMIYAGLLTGVLTFIIVYMEKYGQKMVETIIAALIAVICVAYTIELFLARPAWTQVGMHTLIPSLPNGEAVLIAVGMLGATVMPHVIYLHSELVQHRNTNSSDKEKLHHLKMEKIDILIAMNIAFVVNAAMVIVSAAVFFKHGIKVSTIEEAHRSLQPLLGNLSSGAFGIALLASGLSSSAVGTMAGQTIMKGFVNLSIPINLRRIITMLPALIIIALGINPMRVLVLSQVALSFILPFPIIQMLLIAGRKDLMGILVNKKFTKIVGFIIATMIILLNIILLYLTFTGQT

SEQ ID NO: 52008 - protein, 427 aa, Methanopyrus kandleri AV19 [sequence omitted]

SEQ ID NO: 52009 - protein, 497 aa, Aquifex aeolicus VF5
MTLMKKFYVTTPIYYVNDVPHLGHAYTTIAADTIARYYRLRDYDVFFLTGTDEHGLKIQKKAEELGISPKELVDRNAERFKKLWEFLKIEYTKFIRTTDPYHVKFVQKVFEECYKRGDIYLGEYEGWYCVGCEEFKSEAELAEDHTCPIHQKKCEYIKEPSYFFRLSKYQDKLLELYEKNPEFIQPDYRRNEIISFVKQGLKDLSVTRPRSRVKWGIPVPFDPEHTIYVWFDALFNYISALEDKVEIYWPADLHLVGKDILRFHTVYWPAFLMSLGYELPKKVFAHGWWTVEGKKMSKTLGNVVDPYEVVQEYGLDEVRYFLLREVPFGQDGDFSKKAILNRINGELANEIGNLYSRVVNMAHKFLGGEVSGARDEEYAKIAQESIKNYENYMEKVNFYKAIEEILKFTSYLNKYVDEKQPWALNKERKKEELQKVLYALVDGLFVLTHLLYPITPNKMKEALQMLGEKEFLKELKPYSKNTYKLGERKILFPKREG

SEQ ID NO: 52010 - protein, 411 aa, Zea mays
  misc_feature (48)..(48): Xaa can be any naturally occurring amino acid
  misc_feature (72)..(72): Xaa can be any naturally occurring amino acid
  misc_feature (95)..(95): Xaa can be any naturally occurring amino acid
MLSLSCSCPGVSSMSKTALDWGHLVASCRSRWPGGARAPPRRRRTPCXVCLVALPTTTQPGPAAVDVPSRTXSSLVTTSSAPERISVSALLEVVXSNDLLNLNNNLKSLVGAENPVLVSAAEQIFSAGGKRLRPALVFLVSRATAELAALPELTTEHRRLAEIIEMIHTASLIHDDVIDDSGMRRGKETIHQLYGTRVAVLAGDFMFAQSSWFLANLENIEVIKLISQVIKDFASGEIKQASTLFDCDVTLDDYLLKSYYKTASLIAASTRSAAIFSGVGSGVCEQMYEYGRNLGLAFQVVDDILDLTQSAEQLGKPAAGSDLAKGNLTAPVILALREEPRLRGIIESEFCEPGSLAAAVELVHRGGGIRSARELAEEKGGLALRSLQCLPRSEFRSALERVVHYNLQRVR

SEQ ID NO: 52011 - protein, 901 aa, Coccidioides immitis RS
MAKEDQAGASDKGKGKIDDVRELQEDKKDSKDGKFMMNGKKDEEPKEEELSEEDQQLKEKLEMLVERLQEPNTSLYKQALETIKELIKTSTSSMTAVPKPLKFLRPHYDELTTLYEQWLAGDDKDSLADMLSVLGMTYGDEEKFETLKYRLLSRSDDLGSWGHEYIRHLALEIGQEYQNRITDEKDVQDLVDLALSLVPYFLRHNAEADAVDLLSELEMIEEISKFVDENTYPRVCLYMVSMVNLLTYPEDHQFLRTAHDIYMRYNKFTQAIVIAIRLNDIDLIMSDFNATTDKSIRRQMAFLVARQQIWLDLDDDKDSELVDCLNNTQLSTHFRTLAKELNIIDPRMPEDIYKTHLESNRGAGLTNVDSARHNLASAFVNAFTNAGFCNDKMMLVEDDKGPWVWKTKDDGMMSTTASMGMLLQWNVEEGLDKIDKFTYAEEHQIRAGALLAIGILNSGVRLDSDPALALLGDAENLSNKNTMMRVASIMGLGLSYAGSCREDLLDLLLPIVEDASLPMQISAMAAVSLGLVFVGSSNHQVSEAIATTLMDEERQPQLKDKWTRFMALGLALLYFGRQEEVEVILDILKAIDHPMAKPTSVLASVCAWAGTGTVLKLQELLHICNDQIEDKEEKKGEELVQSYAVLGLSLIAMGEDIGQEMVLRQFGHLMHYGAANIRKAVPLAMGLISASNPQMGVYDTLSRYSHDNDNDVAINAIFAMGLLGAGTNNARLAQLLRQLASYYHRDQNSLFMVRIAQGLLHMGKGSLTFNPFHTDRQVLSRVAAAGLLTVLVAMIDAKDFVLADSHYLLYYLVTAMYPRFLVTLDEDLQPLKVNVRVGQAVDVVGQAGRPKTITGWQTQSTPVLLSYGERAELEDEEYISLSSSLEGLVILRKNPEWESSS

SEQ ID NO: 52012 - protein, 293 aa, Listeria monocytogenes EGD-e
MDLGKVITAMVTPIHPEKDKVCKKRIHHLVNHLIKNGSDGLVIAGTTGESPTLSHDEKIKLFRQVIETNDGRAKLIAGTGSNNTAETIAFTKEVATLGGMDAVLIVAPYYNKPNQDGLYAHFAAVAEASDLPVVIYNIPGRSVVNIEPETIIRLAKLPNIVGVKESSGNLDNISKIIAETSDDFQVYSGDDSLTLPILAVGGNGVISVASHIVGNEMQEMIQAFERGEVQKAAQIHRELLPLMNGLFSVPNPAPTKYLLNQQGISVGPVRLPLVDLNAEQGTKLQAILEGLSK

SEQ ID NO: 52013 - protein, 136 aa, Zea mays
MPMYSKSMNAAVRDVWASNFDEELSNLSAVLSRYPCICLDTEFPGAVHDSDMPRYMRGPRESYELVKRNVDDLKLLQVGIALSGPAGRFPIAWQFNIRGFDPALHPHAPASIAMLREQGMDFAMLNEFGIDPEDFA

SEQ ID NO: 52014 - protein, 878 aa, Oryza sativa
  misc_feature (130)..(130): Xaa can be any naturally occurring amino acid
  misc_feature (139)..(139): Xaa can be any naturally occurring amino acid
MPPREDPNGDASSASPSDPVPPPPQQPQPQPAKGKGKKKDEKKDDDLSEEDQALKEQLELYVVRAQDTDPGVQKLALESMRQEIRSATSSMTSVPKPLKFLRPHYGTLKAYFETMPESDLKKYMADIFVXVLALTMSAXERRKRRAFNLPEWIGFLNVTLGSWGHEYVRNLAGEIAQEFQKRQDDGMPTDSLKELVEQIVSFHMKHNAEPEAVDLLMEVEKLDLLVKHVDSTNYKRTCLYLTSSSKYLPAPDDMSALKIAFEIYMKFGDFANALRIALLLYDKSLELKPIFTATDDFQLKKQFAFIIARHGLSIEIDDDIAADENEKEALQDIISNIKLSEGYLTLARDIEVMEPKSPEDIYKVHLIDGRGATSSSLDSARQNLAATFVNAFVNAGFGQDKLMTTPSDSSSSGSSGNWLFKNKEHGKASAAASLGMILLWDSDSGLAQLDKYLHSNDIHVVAGALLGIGIVSCGVKSDCDPAFALISEYFSRDESIIRIGAILGLGIAYAGSQKEEVRENLTAFLTDSQVPLEVLVFSAISLGLVFVGSCNEEVAQTIICVLMERSEPELAEPIMRLLPVALGLLYLGKQESVEATAEVSKTFDEKIRNYCDVTLMSLAYAGTGNVLKVQKLLGICSEHLEKGETHQGPAVLGISLIAMAEELGAEMAVRSLERLLQYGEQNIRRAVPLALGLLCISNPKVNVMDTMSRLSHDADAEVSMAAIISLGLIGAGTNNARIAGMLRNLSSYYYKEAGHLFCVRIAQGLVHLGKGLLTLSPYHSDRFLLSPIALAGLVTVLHACLDMKSIILGKYHYMLYILTLAMQPRMLLTVDEDLKPLSVPLIFAYAYAYALSMCRYLPLTPVLEGFVILRKNPEYHED

SEQ ID NO: 52015 - protein, 581 aa, Hordeum vulgare
MCGILAVLGCGDESQGKRVHVLELSRRLKHRGPDWSGLHQVADNYLCHQRLAIIDPASGDQPLYNEDKSVAVAVNGEIYNHEELRERLSGHRFRTGSDCEVIAHLYEEHGESFIDMLDGVFSFVLLDARDHSFIAARDAIGVTSLYIGWGIDGSVWISSEMKGLNDDCEHFEIFPPGNLYSSKEKCFKRWYNPPWFSEVIPSVPYDPLRLRSAFEKAVIKRLMTDVPFGVLLSGGLDSSLVAAVAARHFAGTKAAKRWGTRLHSFCVGLEGSPDLKAAKEVADHLGTVHHEFNFTVQVRIDAIEDVIYHIETYDVTTIRASTLMFQMSRKIKALGVKMVISGEGADEIFGGYLYFHKAPNKEEFHQETCRKIKALHQYDCLRANKATSAWGLEVRVPFLDKEFIDEAMSIDPEWKMIRPDLGRIEKWILRKAFDDEEKPFLPKHILYRQKEQFSDGVGYSWIDGLKDHAASNVSDKMMSNAKFIYPHNTPTTKEAYYYRMIFERYFPQSSAILTVPGGPSVACSTAKAIEWDAQWSGNLDPSGRAALGVHLSAYEQDTIAVGGSNKPGPMETVVNGVAIES

SEQ ID NO: 52016 - protein, 125 aa, Brassica napus
MNYRTGLITGGSKDVVRRTFAAAASKAKKGGKGGGSDAPKGSSLSKEIKSTTVVGANTLKDGSDPKILPDSDYPDWLWRLLQIRPALSELRRKNVETLPYDDLKRFVKLDTRAKIKENNSIKAKN

SEQ ID NO: 52017 - protein, 558 aa, Pseudoalteromonas tunicata D2
MCSIFGVLDIKSDPIQLRSQAIEMSKLLRHRGPDWSGVYSSEKAILVHERLAIVGVTSGAQPLYNPEQTNILAVNGEIYNHKELAKNLKVDFEFQTESDCEVILALYKEKGPEFLDDLNGIFAFCLYDEEQDAYLIGRDHIGIIPLYTGTDEHGNFYVASELKALSPICNHIKEFPPGHYLWSQDGELRPYYQRDWTSFDAVKDNSATAQDVKVALEAAVKRQLMCDVPYGVLLSGGLDSSVISAITQRFAAKRIEDNDNSNAWWPQLHSFSVGLAGSPDLAAAQKVADMIGTVHHPIIFTVQQGIDALKEVIYHLETYDVTTIRASTPMYLMARQIKAMGIKMVLSGEGADELFGGYLYFHKAPDEKEFHEELNRKVSKLHLFDCLRANKSMAAWGVEARVPFLDKEFVDVAMRVNPIAKMCGKNGKIEKHILRQAFEGYLPHEVLWRQKEQFSDGVGYSWIDSLKEYVAEQVTDQMLASAAFKFPINTPDSKEAYFYRCIFAEHFPGDAAALCVPFGKSVACSTPQALAWDASFANNADPSGRAAGVHNDAYNKTK

SEQ ID NO: 52018 - protein, 168 aa, Debaryomyces hansenii CBS767
MSTPAKRRLMRDFKRMQQDAPSGVSASPLPDNVMSWNAVIIGPADTPFEDGTFRLILQFDEQYPNKPPSVKFISEMFHPNVYASGELCLDILQNRWSPTYDVSSILTSIQSLLNDPNISSPANVEAANLYKDHRSQYIKRVRETVENSWNEDDEDEDEDEDEDIDDAE

SEQ ID NO: 52019 - protein, 300 aa, Oryza sativa
MASQQFPPQNQETQPGKEHAMDPRPEAIIQSYKPANKLKDKVAIVTGGDSGIGRAVCLCFALEGATVAFTYVKGQEEKDAEETLRALRDIRARTGAKDPMAIPADLGYDDNCRKVVDEVAGAYGGAIDILVNNAAEQYERPSITDITEDDLERVFRTNIFSYFFMSKHAVKRMRDRRGGAGAGGCSIINTSSINAYKGNKTLLDYTATKGAIVAFTRALALQLAEEGIRVNGVAPGPIWTPLIPASFAEEKVRQFGSQVPMGRAGQPSEVAPSFVFLASDDASYMSGQMLHVNGGVIVNG

SEQ ID NO: 52020 - protein, 1017 aa, Geobacter sulfurreducens PCA
MPILITALIYLIFFLSGATALVYEVVWVRKLSLVFGGSHLAVTTVLAVVMGGLALGSWLFGRRVRTTRNLLRLYGALEIGIAFFALLFIALLNLYSLMPAYSFESLTEHSHQLPRVALLTLRIVLAAIALIVPTTLLGGTLPVLAAFMVRGRRAVGRGVAYLYALNTFGAVAGCFGAGFYLLGRFGVSNTMAGAITVNVLLGIACFALQGPAARYLEAGEDEAPAPLSAVTLPEEKARIGLVVWGIGVSGFCALGYEVLWTRVLGIVIGTNVYGFTLMLAAFLTGIAAGSGAYGLWARRLRPPEEGGCPVSKLIGGFGVVQIVIGLSALLVTILIRDLPTRVFFLQDLFLSQSTDLFRARQFANFALVFSYLFIPAFFMGVAFPLAGTLDACRRRKVGHAVGEVLTCNTIGAILGTVVSGFVLIQVFGIERSLYLLATVNAGFGLLILARLLRGTPRRLATAGTVLAVVGVMAVAGTMPRIWDAKYFAIYRTNQPEVFRTPDLIAEAKRHTDVLYYAEGIQSIVSSIRIRGGYQAFLRNGRIEASDHNESLQNQYALGHLPMLLHRNPRKVLVIGAGSGITLGAVSLHPSVSEMTLAEVEPKVLGVTRSFAAYNHGVLGDRRLRVAFSDGRNYLATTGERYDVITADPIHPWLSGAGYNYTREYFELAAEHLRAGGIMCQWLPLYDLSADDLRSVVRTFRQAYRHVLVWMTQGDAMLIGSNAPILLSEDELAARIAVPAVAADLARVQMGSATDLLSYFVMGTAGADRFSRTGRINTDDNLYLEFSVPRSTGKSALPEVNVNALARHRESVLAYLDDSVPPADRLARENRWMRLDRAAALALEARAIFLGGRYDSPRFGLLVSELEGNYAAFAPWRFLRSEYLEEMASSPLPLDQLALALLDESGRRVVVNVAAVMSRVSRELTVVDFVDSDERVIIGQADINGRGRDGSAKRLAAEVMEAVRLAYNEELSGAEARGKPLPDQAEFVRRMREIIATMTGRQHGNPYPAQGRPIKESA

SEQ ID NO: 52021 - protein, 418 aa, Saccharomyces cerevisiae
MENKLLCWWLYWPCVYSSIIATIISFYTITRHLLNYRKPYEQRLSIRILLLVPIFSVSCASGIIKPEAAQFYVDPIREFYEAFVIYTFFTFLTLLLGGERNIITVLSLNHAPTRHPIPLIGKICKPIDLSDPFDFLFVKKGILQYVWFKPFYCFGTLICSAWKLPKFEIFLNVFYNISVTWSLYSLALFWKCLYPELTPYKPWLKFLCVKLIIFASYWQSIIIQGLVVTGKLGTGNQDRTSGYVYKNGLLCIEMVPFAILHAVAFPWNKYTAFSIPYGARMKFIYALKDFLGCGDLIWDFKQTLFAGPLYYNYRNFDPEAMDLLSTRQQSGATMERLKHGLRFTDNGRNSYWVAYGSIDNNLVPESIEESWEDDIAGQRTFPEDPNYPVVHDYTMGHRYSRSMNDLRRDVQSRSSMAC

SEQ ID NO: 52022 - protein, 404 aa, Saccharomyces cerevisiae
MTIIQTVTELGVTEDTIKVQMAPSGGKHLLADPGNHPAEHFESQMSWLRFQTRQYLTRFTDNQSDFVHSLQKKHRTPFRDVYFKYTSLMGSHMFYVIVLPMPVWLGYRDLTRDMIYVLGYSIYLSGYLKDYWCLPRPKSPPVDRITLSEYTTKEYGAPSSHSANATAVSLLFFWRICLSDTLVWPTKLLLLSLVIFYYLTLVFGRVYCGMHGMLDLFSGAAVGAICFFIRIWVVHALRNFQIGEHLWFPLLSVAWGLFILFNHVRPIDECPCFEDSVAFIGVVSGLDCSDWLTERYGWNLVCSRYASCGSKVFLRPLVGVASVIVWKDVISKTAVYTLLIKLLRFHDDRSEKVHFHNETSEEEECLLYSGVSKVEIVGRFLIYAGIPTTVFLLCPVFFTWTNLR

SEQ ID NO: 52023 - protein, 369 aa, Oryza sativa
  misc_feature (73)..(73): Xaa can be any naturally occurring amino acid
  misc_feature (81)..(81): Xaa can be any naturally occurring amino acid
METLSMLKVGYTLLRSETPATDLVNAFMDWAARRSLLLLAVFVPPYLAYRLASSALAAASPEDVAGKVVLVTXGASSGIGXQVAYRYARRGARLALVARREASLGEVAARARALGSPDVLAVPGDVARPDDCRRFVQATVEHFGRLDHLVNNAGLANVCWFEEVPDVANFKQVLDVNFWGTVHPTHAALPHLKASRGKIFVNSSASAVLAMPRMSFYNASKAAVHNFAETLRMELHGEVGVTVATPGWVDSEMTKGKHLSSHGAMEVDQDTRDAQVGVFPVERGERCAEAIVDAVARGRRRVTSPAWYGALFLWRTMAPEVADACQRVFYHRRSSAAGGGGRARAALEATGAKAVLQPPSLRSSEIKVE

SEQ ID NO: 52024 - protein, 416 aa, Bordetella bronchiseptica RB50
MSQLNDLLMPKLGLTMTEGMLIEWSVTSGAEVKAGDSLFVVETDKVANEIVAQADGTLAEILVAAGETVPVGTVVARWTGPGQGADDLADAPPAPAPQPPQPAAEAAPAAAREPARGGRVVATPLARRLAREAGLDLAQVSGSGPGGRIKAADVRQAPPALPVAPRDAASPAPAARASLAPAAGEQRIEASALVQSMARRMTQAKQVPHFYLSAEAEVSALLALRQRLNAQADAPRLTLNHFVIAAVARALAAMPHQNRIWNDDHIVQFQGIDVGVAVSTERGLMAPVLHGLDHASLDDIAAQSGALLGRVRAGKATREDMSGGAISISNAGMFNVTYMAPIINPPQSAILGVGSIRELFRPDEQGAPALRREMGLVLAADHRLHDGASALAFLNHVIDLLQDPYRLLRNRPHTKG

SEQ ID NO: 52025 - protein, 291 aa, Saccharomyces cerevisiae
MNTLLFKRKGGNCGNESNIVSQGSPSSSNLPESPGTLDEKNLPRLPTPFARSLSTIPSYEQMKRTNKLPDYHLKIVVVGDGAVGKTCLLISYVQGTFPTDYIPTIFENYVTNIEGPNGQIIELALWDTAGQEEYSRLRPLSYTNADVLMVCYSVGSKTSLKNVEDLWFPEVKHFCPSTPIMLVGLKSDLYEADNLSDLVEPSSAESLAKRLGAFAHIQCSARLKENIDEVFETAIHTLLSDSLYAPREPTHTIKNPFKRNTTRSDIDSSTGDTSVSISGTKRLRKNKCIIM

SEQ ID NO: 52026 - protein, 324 aa, Bordetella bronchiseptica RB50
MAELRFAHAINRALAECMEEDPMVFLFGEDIAEAGGPFGVTRGLHDRFGPDRIRDTPISEATMANAAVGAALSGLKPVLEIMFMDFMTLTMDALVNQAAKARFMFGGQASVPMVVRTPHGGGISAGPQHSQCLEAWFAHIPGLKVVCPSNPADAYGLLKSAIRDPDPVVFVENKALYAAKGEVPDDAGPIPLGQARVARAGRDLTVVSYGAMVHKVERAAEALARDGIEAEVLDLRSIQPWDEAAVLASLQRTHRLLIVHEAVEAFGVGAEIAARMADIGFDELDAPIVRVAAPFVPVPFAPSLEAQYQPQEADIIAAARKLCA

SEQ ID NO: 52027 - protein, 323 aa, Bordetella bronchiseptica RB50
MARANKEQLLDAYQRMLGIRLVELRLGRLFADGEVPGFIHLSVGQEAVAAAMGMVLRPDDTVASTHRGHGHALAKGIDMDDFFLELMAREEGICKGRGGSMHVANMSIGMLGANAIVGASIPIALGSALAHQVRKTDALAVAFFGDGAMAEGVLHESLNLAALWQLPLLFLCENNGWAEFSPTHKQFVAPLDKLSAAFSIPHAKVDGNDVLAVMDAAQAAVADIRAGKGPRVLECITHRWRGHYEGDPQKYRDSDEISGLDEHDPVARFEAVLDSKGVNQAQRQKVRDAVQAQVDQAVERARKGRPPAWEAARADVYTQAEAR

SEQ ID NO: 52028 - protein, 329 aa, Burkholderia mallei ATCC 23344
MQVPLDVVTYGEAMAMFVAAEPGPLDSATHFTKRIAGADLNVAIGLARLGFRVGWMSRVGADSFGRYVLDTLAREQVDASCVTVDARYPTGFQLKSRATDGADPSVEYFRKGSAASRLSLDDYVPDYVLGARHLYLTGVAPALSDSSRELAFHLARTTRAAGKTVSFDPNLRPTLWPSPEAMARTLNALAEHADWVLPGLAEGRQLTGLDTPADIARFYLERGARGVIVKLGAAGAYFRVADGREGEIAAERVEHVVDTVGAGDGFAVGVVSALLEGRAIDEAVARGNRIGALAIQVIGDSEGLPTRAALDRIENLSNARDRLEAPLAR

SEQ ID NO: 52029 - protein, 150 aa, Haloarcula argentinensis
ERTFVMVKPDGVQRGLIGDIVSRFEDRGLKMVGGKFMQIDQELAEEHYGEHEDKPFFDGLVDFITSGPVFAMVWEGQDATRQVRNMMGETDPAESAPGTIRGDYGLDLGRNVIHGSDHEDEGANEREIELFFDEDELVDWDQIDSSWLYE

SEQ ID NO: 52030 - protein, 61 aa, Glycine max
ASLATLTNPQPAALNGLAGSSISGTKLSFKPSRHTVQSKNFRSGALVSKFGHKSVFFALPD

SEQ ID NO: 52031 - protein, 150 aa, Haloarcula californiae
ERTFVMVKPDGVQRGLIGDIVSRFEDRGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEDELVDWDQIDSSWLYE

SEQ ID NO: 52032 - protein, 445 aa, Bradyrhizobium sp. BTAi1
MPDAISIDVPPNDLEAFWMPMTANRRFKKTPMFFSAAEGMYYATPDGRRVLDAIAGLWCVNAGHCHPRIVEAIRAQAGKLDYASSFGVGHPLAFHFANRVVEIAPPGFRHLFLAGSGSEAVDSALKFALAYHRARGEGHRQRLIGRQRAYHGVGFGGLSVSGIGWQRAQFGALLPATSHLPHTHDLARNAFSRGQPAHGVEFADALEGLLFAVDPSTVAAVIVEPVAGAGGVLPPPQGYLQRLREICDRHGILLIFDEVVTGFGRLGAPFAAQALGVGPDLITCAKGMTSGTVPMGGVLISDRVHDGLSQGPEAVPELAHGYTYSGHPLACAAGLAALDVYRDEGLFERAARLAPIWEDALHGLRTLGPVRDIRNLGLLGAIEIDGGDGAPSERARACAEVCLERGVFIRALGDTLILSPPLVIDEGQIGQIVDAIGSGLRRLAA

SEQ ID NO: 52033 - protein, 433 aa, Aspergillus fumigatus
MTVLSLAVFFTLGFGAGAAPHVPHGRLSSPIKNVVVLVQENLSFDNYAGGLTYSPSIDGLVNRTYCNPANISDPHSPMVCAQPTAKNIAPDDPDHSITGGNQQVYSTYHPDSDFDAPNMQGFVAEQIAAYGIDGNLSRAGEVINYYTPEHIPVFNAMAENFVLFDRWFAAVPGPTNPNRAYLTSGTSHGHGTNDPDFDRSALPQRSIFEQLSEHNISWINYSNTTGFLPDALFYRWTAVSGLGETNVRPIDQFYRDAKAGTLPQFTWINPECCSYMSFHPPSPINMGEGWIKSVYEALRSSPQWHETLFILTFDEHGGFADHVPPPENVPAGDDLTYTETARDGKPSTFAFDRLGIRVPTVLMSPWVGKGVVQNRPADGNGEFTHTSILKFVADLWGLEYLSPRVAWSASFAHLITDTFREDTPATLPEPADF

SEQ ID NO: 52034 - protein, 406 aa, Methanopyrus kandleri AV19
MYENISTMDDFEFENKWVLLRIDINSTVIDGKIEDDERIKRHLGTIKELMEHDARVAILAHQGRPGEDDFTTLEPHAEIMSEELDNFEYVPDVFGPTAKKKIRSLEPGEVILLENVRFYSEERINRDPEWHARRHLVRNLAPLFDIFVNDAFAAAHRSNASLVGFTRRLPSCVGRVMEREIEVLETMVRDEMEDGVFVIGGSKIEDAIKVIRRAIEMDNVRRVLLGGLVGNLFLWASGVDLGKPSRKFLDMKGYTGYLDEARELLEEGDDVILVPEDVALNRGGEREEVDVDELPADAPVFDIGTGTIERYRKEVESAGMVVANGPMGVYEEPGFEKGTYEVLNAIADSEAFSVIGGGHIIAAAKACGAYDSIDHVSTGGGAMLRMLAGERLPAIDAILTCPFSGC

SEQ ID NO: 52035 - protein, 523 aa, Mannheimia succiniciproducens MBEL55E
MNNIHNHKILILDFGSQYTQLIARRVREIGVYCELWAWDVTEQQIREFNPTGIILSGGPESTTEDNSPRAPEYVFNAGVPVLGICYGMQTMAMQLGGLTEPSSHREFGYASVSLENSTALFAQLNDDLNSSLPKLDVWMSHGDKVTRLPEGFQLTGTTSTCPIAAMSDESRHFYGVQFHPEVTHTKSGLALLTNFVVNICGCTTNWTPENIIEDAVARIKAQVGDDEVILGLSGGVDSSVTALLLHRAIGKNLHCVFVDNGLLRLNEGDQVMEMFGDKFGLNIIRVNAEDRFLDALKGIDEPESKRKMIGKVFVDVFDEESHKQTSVKWLAQGTIYPDVIESAASKTGKAHVIKSHHNVGGLPDYMKLGLVEPLRELFKDEVRKIGLALGLPAEMLNRHPFPGPGLGVRVLGEIKKEYCDLLRKADAIFIEELYNSGWYYKVSQAFTVFLPVKSVGVMGDGRKYDWVVSLRAVETIDFMTAHWAHLPYDLLGKISNRIINEVDGISRVVYDVSGKPPATIEWE

SEQ ID NO: 52036 - protein, 467 aa, Ehrlichia ruminantium str. Welgevonden
MAMIVLSAAQVLACENRCSIPIASLIQKAGKAVSDVIISSFQRQGVTILAGPGNNGKDGIVVARTLKSFGWPVTLMLYCCDTDIYEDWIVSLTYDGIVNCTNSIIVDALFGIGLSRDVCDDLSKIFNYINSSNKIVVAVDISSGVNCDTGQVMGCALRADLTITFSVLKMAHVLFPGCYYSGRVHVVDIGIDIDDSVVKIHKNTPILWKDEIPKLTYTSNKYNRGYTLVCSIGNKSIGASKLAAMSALKVGSGIVSIACDSVALDLYAVCLTSIMYKLYDDVIDDDRITSVLIGPGCGTSDITKQRVINVLQKKKCVLDADAISVFSGSSDVLFSHIKNDVIMTPHEGEFRRIFPFLTGSKVDMVREAANISGAVIVLKGADTVIGDPDGNIVITNPPFTLATAGSGDVLSGIIAGLLSSGMSSFSAACCGVWIHAECARSYGIGLTADDIILQIPTILKNLLYRNY

SEQ ID NO: 52037 - protein, 175 aa, Triticum aestivum
MAPTVMASSATSVGPFQGLKSTVGLPVSRRSNGASLGSVSDGGRIRCMQVWPMEGIKKFDTLSYLPPIRTEALLKQVDYLIRSKWVPCLKFSKVGCIFREHNASPGYYDGRYWTMWKLPMFGCTDATQVINEVEEVKKEYPDAYVRIIGCDNMRQVQCVSFIAFKPPGCEESGKA

SEQ ID NO: 52038 - protein, 150 aa, Haloarcula japonica
ERTFVMVKPDGVQRGLIGDIVSRFEDRGLKMVGGKFMQIDQELAEEHYGEHADKPFFDGLVDFITSGPVFAMVWEGQDATRQVRNMMGETDPAESAPGTIRGDYGLDLGRNVIHGSDHEDEGANEREIELFFDEDELVDWDQIDSSWLYE

SEQ ID NO: 52039 - protein, 555 aa, Triticum aestivum
MGSEAGMEAAGARDPPERRRGAVTAVLLAALPLLLLLFLFGDRAASIAADSLAWAQVKQQSPRNASSSPSPEPGAARDGRLLGGLLSPDFDEPACRSRYEGSSRWKPSPFPVSPYLVRKLRQYEANHRRCGPGTPRYREAMAQLRSGRNGERGECRYVVWLPVQGLGNRMLSLVSTFLYALLTARVLLVHEPPEMEGLFCEPFPGTSWLLPATFPYKDVRFGSESKESYVSMLHNNVVRYDDVDGGNAGALPPYVYLHLENMNLRLQNHTFCEEDHRALDGFNWMLLRSDSYFAVALFLVPTYRDDLERMFPSKGSVFHHLGRYLLHPGNPAWGIAQRFFDGYLAGADQRLGVQVRIVWHHPVPFDVMFDQILRCTREHGLLPRLTGEPSLVRPSSNSTAKANKVKAVLVVSLKPEYYDKLHAMYYNNATDSGELVTVYQPSHDQDQHTEARAHNERALAEIFLLSYCDEMVTTSWSTFGYVAHALAGLRPRLLAPLDLSKMRSDVACVRPASIEPCLHSPPSLVCRRAQDLDPVAHVPFLRHCEDVDFGLKLVD

SEQ ID NO: 52040 - protein, 315 aa, Fulvimarina pelagi HTCC2506
MYLSCGDALFDLFGEKEGDDVAAIDLAGRVGGSPLNVALGIARLGHPTGFFTKISSDVFGRRLARFMDQEKIDRRYSIPTERHTTLAIVSLDETGTAVYDFYIEGTADRSIETSELPRTLDDVVGIHLASYATVTEPTASALSALAKRESAKKFISYDPNIRLSIEPDVEVWRAKVAQLVAQSTLVKASEEDLELLYPGRSIEDVQADWLALGPELVVITLGGKGAKAASRSGLRAFEESQRITVVDTVGAGDTFQAGLIVWLMENHRLSRTGLAECSETDLHAMLSFAMKAAAVTCSRQGADLPRRADLGLSPL

SEQ ID NO: 52041 - protein, 183 aa, Capsicum annuum
MAVAPTAREENVYMAKLAEQAERYEEMVDFMEKVSNSLGSEELTVEERNLLSVAYKNVIGARRASWRIISSIEQKEESRGNEEHVNSIKEYRSKIENELSKICDGILKLLDSKLIPSATSGDSKVFYLKMKGDYHRYLAEFKTGAERKEAAESTLTAYKAAQDIASAELAPTHPIRLGLALTS

SEQ ID NO: 52042 - protein, 196 aa, Triticum aestivum
  misc_feature (144)..(144): Xaa can be any naturally occurring amino acid
  misc_feature (178)..(178): Xaa can be any naturally occurring amino acid
  misc_feature (186)..(186): Xaa can be any naturally occurring amino acid
GGEMAAAECGSREERWSLAGATALVTGGSKGIGGAIVEELAGFGARVHTCSRNAAELEECCLRWEEKGMRVTVSVCHVSVPADREKLMDTVRQTFDGKLSILVNNAGQHLVKPTVECTMEEYKNVMATNLESSFHLCQLARPLXARAVGGNIINISSIASSIGFAGSTIYTITKDQIXAEAEAEEXVHDGGRRQRR

SEQ ID NO: 52043 - protein, 455 aa, Mycobacterium sp. JLS
MSATRKTQHREVARLDRVPLPVEAARFGATGWQVTRTGARVVTNLRGRGSLSQKIVKQVPQTFADLGPTYVKFGQIIASSPGAFGEGLSKEFRSLLDRVPPANPEQVAKLLREELGDDPKNLYKSFDDTPFASASIAQVHYATLHTGEEVVVKIQRPGIRRRVAADLQILKRGARLVEFAKLGQRLSAQDVVADFADNLAEELDFRLEAQSMDAWVSHMHASPLGRNIRVPQVYWDLTSERVLTMERVSGIRIDDAAAIRKKGFDGTELVKALLFSLFEGGLRHGLFHGDLHAGNLYIDDDGKIVFFDFGIMGRIDPRTRWLLRELVYALLVKKDHAAAGKIVVMMGAVGTVKPEAQAAKDLEKFATPLTMSTLGDMSYAEIGKQLSVLADAYDVKLPRELVLIGKQFLYVERYMKLLAPKWQMMSDPQLTGYFANFMVDISREHKERDDEELEV

SEQ ID NO: 52044 - protein, 286 aa, Ralstonia solanacearum GMI1000
MTQAPATVDALETRQRMKDGTELFVRTWLPAPEAGEPRGTVILVHGMAEHSGRYPHVAQVLCELGLRVRAFDLRGHGRSGGPRMALDAPDNYLTDLAEILDAVVAEWNEMPFVLGHSMGGLIVARFATARVRPVRGVLLSSPALRLKLPPGANAVLGLLSALAPKLPVPNPVDPARLSHDPSVGAAYRADPQVQKTISASVLAFMLNAITQAQQDAPRLEAPMLLLAGGADTIVDPSGSRDFCAGAPEDLRTLAWFETAYHELFNEAEPMRGEAFGTMRAWLAGRI

SEQ ID NO: 52045 - protein, 414 aa, Burkholderia sp. 383
MRPFFLLPRLPRPARPMNTATDSLVRLAARVDAIQPFYVMELMKEAQRLESSGRDVIHMGIGEPDFTAPEPVVEAAAAALRRGVTQYTSALGIAPLREAIAAHYARAYGLTISPERIVVTAGASAALLLACLALVGRDDEVLMPDPSYPCNRHFVAAAEGRAVLVPSGPDARFQLTEDDVRTRWGDRTRGVLLASPSNPTGTSLEPDELKRIVEAVRARGGFTIVDEIYQGLSYDAAPVSALSFGDDVVTVNSFSKYFSMTGWRLGWLVVPPALVGTFEKLAQNLFICPSALAQHAALACFEPAALDIYEARRLEFKRRRDFIAPALERLGFTVPVMPDGAFYVYAHCGGVAHPAAGDSAALTTAMLHDAGVVLVPGMDFGVHAPRDYIRLSYATAYSRLEEAVDRLATLFGQH

SEQ ID NO: 52046 - protein, 212 aa, Glycine max
MIMEESSVHEIKTPLLSSNNEEDEVGSSTSHRQQNEENSPIKQVALTVPTTDDPSLPVLTFRMWVLGTLSCVLLSFLNQFFWYRIQPLTITAISAQIAVVPLGQLMAATITKRVFFRGTRWEFTLNPGPFNVKEHVLITIFANSGAGTVYAIHVVTAVKIFYHKHISFFVSLLVVITTQVLGFGWAGIFRRYLVEPAAMWWPANLVQVSLFR

SEQ ID NO: 52047 - protein, 200 aa, Oryza sativa (japonica cultivar-group)
MGGGSPCASCKLLRRRCTKDCIFAPFFPADDPHKFAIVHKVFGASNVSKMLQELPAQQRGDAVSSLVYEANARMRDPVYGCVGAISFLQNQVSQLQMQLAVAQAEILCIQMQHRDDGAAHQLDAAADHHPLLDQQQQQQMVVDAADAAASFLVQNGGGGGGPAAQLISGYGSPAAGGGGGHGVVHYAAAQEHLKRESLWT

SEQ ID NO: 52048 - protein, 150 aa, Haloarcula sinaiiensis
ERTFVMVKPDGVQRGLIGDIVSRFEDCGLKMVGGKFMQIDQELAEEHYGEHEDKPFFDGLVDFITSGPVFAMVWEGQDATRQVRTMMGETDPAESAPGTIRGDYGLDLGRNVIHGSDHEDEGANEREIELFFDEDELVDWDQIDSSWLYE

SEQ ID NO: 52049 - protein, 191 aa, Glycine max
MKLDCSNGQAPLAADVSPPQEDGSEEEIFVPPLNFAMVDNGIFRAGFPDSANFGFLKSLRLRSVMCLCPEPYPETTSEFLKANGIRLYQFGIDGCKEPFVNIPNDTIREALKVALDVRNHPLLIHCKRGKHRTGCLVGCIRRLQRWCLSSVFDEYQRFAGAKARVSDQRFIELFDISCLKHHPLSFSCSKK

SEQ ID NO: 52050 - protein, 291 aa, Yersinia pestis CO92
MNEKVFTLPVVEQISPYISQRQLDELPVVVVSHPKVRAAISLQGAHLLAYQPSGEQPIIWLSNNTPFKEGIAIRGGVPICWPWFGPTAQPAHGFARILPWTLSAHDENENGVILTFTLEDNDMTRQYWPHAFTLIARFKLGDECEVELESHGDYQAAAALHTYFQIGDISQIKVSGLGEKYLDKVLKVADVTQQGDLVFNGQTDRVYTQPEAYSLIKDAALKRTIEVHHHHQSDVVAWNPGAELSCSMVDMPNDGYKTMVCVETARVNKPLVAAPDAPARLAMTIRSRKNT

SEQ ID NO: 52051 - protein, 334 aa, Yersinia pestis CO92
MEYMTIKVGINGFGRIGRIVFRAAQERSDIEIVAINDLLDADYMAYMLKYDSTHGRFDGTVEVKDGHLVVNGKTIRVTAERDPANLKWNEVNVDVVAEATGLFLTDETARKHIAAGAKKVVLTGPSKDDTPMFVMGVNHKAYAGQEIVSNASCTTNCLAPLAKVINDKFGIVEALMTTVHATTATQKTVDGPSHKDWRGGRGASQNIIPSSTGAAKAVGKVIPELNGKLTGMAFRVPTPNVSVVDLTARLEKPASYKEICAAIKAASEGELKGVLGYTEDDVVSTDFNGEKLTSVFDAKAGIALNDNFVKLVSWYDNETGYSNKVLDLISHISK

SEQ ID NO: 52052 - protein, 399 aa, Ehrlichia ruminantium str. Welgevonden
MSFLSKRMECIKPSPTLEIASQAQKLKMLGRDIISLSAGEPDFDTPEHIKQAAINALNLGKTKYTAVDGIIELKKAIISRLKQDHNLIYDVSQISVGNGAKQCIYNLFMSTLNDGDEVIIPAPYWVSYPDIVKIAGGNPVIIDCSSTSKLSAELLENAITDKTKWLILNSPNNPSGLVYTYDELKDIAQVLLKYSNVHIMTDDIYSKIVYDDLKFFTIAQVEEDLYSRVFLVNGVSKAYAMTGWRIGYIAGASEVIKAISVIQSQSTTNPNSIAQFAAVEALTGDQKFLEERNKVFIERRDIMLDMINNTPLLSAEKPQGAFYVFISCKELIGRTTKSGFCITSAMDFTKYLLEDYNIAVVPGEAFGVQGFFRVSYATSTQCVSEACDRILTACNELIY

SEQ ID NO: 52053 - protein, 515 aa, Oceanobacillus iheyensis HTE831
MVLPFKHEPFTDFTVKENRKDYQDALAKVKEELGKDYPLVINGEKIYTDDKLISINPSNKNEVVGNVSKATKQHIEEAFTSAKEAFKEWKSWSAEDRARVLYRAAAIVRRRKHEFSAWLSYDAGKPWDQADGDTAEGIDFLEYYARHMVELEKGKPLADRPNEDNKYFYQPLGPGVVIPPWNFAFAIVCGTTVAPIVAGNPVLLKPSENTPVIAYKLVEVLEEAGLPKGVLNFVPGDPAEIGDYLVDHKDTHFINFTGSRATGVRIFERATKIQDGQTHLKRIVAEMGGKDTIIVDESADLDLAAESIVHSAFGFSGQKCSACSRAVIHESVYDEVIEKSVELAKTLTVGNPTEDNVYMASVVNQKQFDKIKDYIEVGKQEGELVFGGETDDNKGFFVHPTIFKDLDPKARIMQEEIFGPVVAFSKAKSFDELLDIANNTEYGLTGAVISNNRENLNRAQTEFLVGNLYFNRGCTAAIVGYQPFGGFKMSGTDSKAGGPDYLQHFLNAKVVTERF

SEQ ID NO: 52054 - protein, 474 aa, Bacillus anthracis str. Ames
MSQVNNTNNELKRTMKSRHLFMIALGGVIGTELFNGSGFIISQAGPGGSVLAFMAGGLLMYFVMLCLGELAVAMPVSGSFQEYATKFINPATGFTIGWLYWLSWANTTGLEFTTAGITMQRWFPDIPVWVWCLIFGVTIFMINALSARSYAETEFWFSSIKVSAIIAFIILGGAAMFGLIDLKGDEPAPLLSNFVNHGGLFPNGLAAILLTMVTVNYSFQGTELVGIAAGESEDPAKTLPRSIRNIIWRTMFFFVLAIFVLVALIPWEEAGLTKSPFVAVFDNISIPYAADIMNFVILTAVLSVANSGLYAATRMLWSLSKNEMAPAFLKKLSSRGIPLNALILTISISAFSLLTSVVAAETVYLWLISISGVITIIVWMSICVSQFFFRKHYVADGGRLEDLKFKTPLYPLVPILGFGLYGIILVSLIFIPDQRLGIYCTVPFIIFCYTYYHFKVKKRISTNTSSENKISETI

SEQ ID NO: 52055 - protein, 468 aa, Nitrosomonas europaea ATCC 19718
MAADVLKMIQDHEVKFVDLRFTDTNGKEHHVTVPAHTFDTDKFEDGHAFDGSSIAGWKNIHASDMLLMPDPETAALDPFMEETTLLLTCDVVDPADGQGYNRDPRSLAKRGETYLKSTGIGDIAYFGPELEFFIFDSVRWHTDMSGCFVKIESEEAAWSSKKRYEKSNNGYRPAVKGGYMPVPPVDSLHDIRSAMCMVLDELGIPVEVHHHEVANAGQCEIGTRFSSLVKRADWNQLMKYVIHNIAVSYGKTATFMPKPIVGDNGSGMHVHQSIWKEGKNLFAGNGYAGMSETALYYIGGIIRHAKALNAFANPGTNSYKRLVAGFEAPVNIAYSASNRSAAVRIPYASSPKQRRIEIRFPDPSANPYLTFTALLMAGLDGIQNKIHPGDPMDKNLYDLPPEEASMVPNTCASLEEALASLDSDREFLTRGNVFSNDMIDAFIKLKSEEATLLRTTTHPVEFALYYSL

SEQ ID NO: 52056 - protein, 150 aa, Triticum aestivum
  misc_feature (119)..(119): Xaa can be any naturally occurring amino acid
LLPDTRERIVATEVTAWWRYPFEHVSQLPSKPFCFTQRYQDVKKVLAETFFGPPDVGVYSPSVQNTLYLMAKESLQGSQDISVIQLRMPNLHFLPVNLGEQRTPLVKFADDVYLPTDEXHGTIEQLYKRPQSCKKMYPQAGINSLPTPQA

SEQ ID NO: 52057 - protein, 418 aa, Glycine max
  misc_feature (236)..(236): Xaa can be any naturally occurring amino acid
MEMASSSFILGSDFKCMFSSRNTKTMSGFGALRHPHPNGLFSKCFHFHTLSTRTVSGTTKMVSDVYVGGVTSFRVNSKMYTKLDSCLVIPPTPNRAKPRAIVKFLGGAFIGAVPEVTYGYLTELLAKEGFLVVVVPYNVTFDHSQAAKQVYERFQACLGTILTSGIFSENKLPAQLEDLPLFSIGHRLVVCLMLSIILTGINVMKRNIFLANAIIAYNNRPATEAVPYFEQCCPAXLGPAVSQMMPVVEATPFYSIARNASGDVWKMMLDAVRSTLQETEQEILNSLTKFVDQLPSVMNEVTQGVSEFKPTPSENRDCFKCLYNVEHTLLVKFNSDAIDETDILEETLKLRVESLGGTLEKVTLSGNHITPCIQEPRWQVGKLYTPADAVAQGLKSLSLNDTKILARTISDWFRRFEG

SEQ ID NO: 52058 - protein, 1049 aa, Oryza rufipogon
MQPPHFSYKTQSNRLPIPVLSLALVLLLNFTSPTSSCTEQEKNSLLNFLTGLSKDGGLSMSWKDGVDCCEWEGITCRTDRTVTDVSLPSRSLEGYISPSLGNLTGLLRLNLSYNLLSSVLPQELLSSSKLIVIDISFNRLNGGLDKLPSSTPARPLQVLNISSNLLAGQFPSSTWVVMANLAALNVSNNSFTGKIPTNFCTNSPSLAVLELSYNQFSGSIPPELGSCSRLRVLKAGHNNLSGTLPDEIFNATSLECLSFPNNNLQGTLEGANVVKLGKLATLDLGENNFSGNIPESIGQLNRLEELHLNNNKMFGSIPSTLSNCTSLKTIDLNSNNFSGELMNVNFSNLPSLQTLDLRQNIFSGKIPETIYSCSNLTALRLSLNKFQGQLSKGLGNLKSLSFLSLGYNNLTNITNALQILRSSSKLTTLLISNNFMNESIPDDDRIDGFENLQVLDLSGCSFSGKIPQWLSKLSRLEMLVLDNNQLTGPIPDWISSLNFLFYLDVSNNNLTGEIPMALLQMPMLRSDRAAAQLDTRAFELPIYIDATLLQYRKASAFPKVLNLGNNEFTGLIPQEIGQLKALLLLNLSFNKLYGDIPQSICNLRDLLMLDLSSNNLTGTIPAALNNLTFLIEFNVSYNDLEGPIPTGGQFSTFTNSSFYGNPKLCGPMLTHHCSSFDRHLVSKQQQNKKVILVIVFCVLFGAIVILLLLGYLLLSIRGMSFTTKSRCNNDYIEALSPNTNSDHLLVMLQQGKEAENKLTFTGIVEATNNFNQEHIIGCGGYGLVYKAQLPDGSMIAIKKLNGEMCLMEREFSAEVETLSMARHDNLVPLWGYCIQGNSRLLIYSYMENGSLDDWLHNKDDDTSTILDWPRRLKIAKGASHGLSYIHNICKPRIVHRDIKSSNILLDKEFKAYIADFGLSRLILPNKTHVPTELVGTLGYIPPEYAQAWVATLKGDVYSFGVVLLELLTGRRPVPILSTSKELVPWVQEMVSNGKQIEVLDLTFQGTGCEEQMLKVLEIACKCVKGDPLRRPTMIEVVASLHSIDPDGLT

SEQ ID NO: 52059 - protein, 123 aa, Brassica napus
  misc_feature (11)..(11): Xaa can be any naturally occurring amino acid
  misc_feature (105)..(105): Xaa can be any naturally occurring amino acid
MATELEELVEXLSSPSPPVKKAAVEIVSGLTGSEEGLQSLSKYSEILLPSLSRLLSESKEVSEPSAQALVNLSQNSELARKMIQMGLIRVAMDMLYKPESCITRXLLVMLLVNLTQLDDGRSF

SEQ ID NO: 52060 - protein, 350 aa, Brassica napus
MARPQDPPRGFFPFGNPFKNLSSKNPVLSSNLLSLLNTFETNLASSITKLVPKEKSQILTLSWMSQAMASLCQTHNAIKTLITDLELPVSDWEDKWVDIYLDISVKLLDLCNAFSSELSRLNQGHLFLQFALHNLGTNAPQNLPKAQSSLDAWKQHIVSKNPRLESCHAILTSLVQTLNLPKVKNSAKGKVLMRALYGVKVKTLYISGVFAAAFSGSSQNLLYVTVSNELPWAPSFMDMQNTMNSEMKSIFLSDGLTVMKELEAVDSGVKNLAPAIQQGSVDPISLQQLKDSVTELTSGIDLVSKEVDCFFKIMLSGRDTLLENLRSMGAPTTVLTTSPKKAAGKKQRGF

SEQ ID NO: 52061 - protein, 179 aa, Ralstonia solanacearum GMI1000
MPRSSAAAKDSDAHQPTPPEAAGLRRRDRIAVRESGVHGRGVYAVAAIAKGKKIIEYKGEHISWKEALRRHPHDPDDPNHTFYFSLEDGSVIDAKYGGNRARWINHACKPNCEAREKDGRVFIHALRDIDAGEELFYDYGLVIEGRQTKALKAQFACHCGAKKCRGTMLAPPEKKEKKQ

SEQ ID NO: 52062 - protein, 427 aa, Burkholderia sp. 383
MSNNQILFERAQKTIPGGVNSPVRAFRSVGGTPRFVARAQGPYFWDADGKQYIDYIGSWGPMIVGHVHPEVLSAVQNVLADGFSFGAPTEAEIEIAEEICKLVPSIEQVRMVSSGTEATMSALRLARGFTGRSRIVKFEGCYHGHADSLLVKAGSGLLTFGNPTSAGVPADIAKHTTVLEYNNVAALEEAFGAFGDEIAAVIVEPVAGNMNLVRGTPEFLNALRALCTKHGAVLIFDEVMCGFRVALGGAQQHYGITADLTCLGKVIGGGMPAAAFGGRRDIMAHLAPLGGVYQAGTLSGNPIAVAAGLKTLQLIQAPGFYDALTAQTKRLADGLAAEARAAGVPFVADSIGAMFGLYFTERVPTSFAEVTKSDTERFNRFFHLMLDEGVYFAPSAYEAGFVSSTHDDAVIDATLAAARRAFAALAA

SEQ ID NO: 52063 - protein, 1049 aa, Oryza rufipogon
MHPLHSPCKKHSNKFPIPVLALALVLLINLASLTSSCTEQDRSSLLRFLRELSQDGGLAASWQDGTDCCKWDGITCSQDSTVTDVSLASRSLQGRISPSLGNLPGLLRLNLSHNLLSGALPKELLSSSSLITIDVSFNRLDGDLDELPSSTPARPLQVLNISSNLLAGQFPSSTWVVMKNMVALNVSNNSFSGHIPANFCTNSPYLSVLELSYNQLSGSIPPGFGSCSRLRVLKAGHNNLSGTIPDEIFNATSLECLSFPNNDFQGTLEWANVVKLSKLATLDLGENNFSGNISESIGQLNRLEELHLNNNKMFGSIPSNLSNCTSLKIIDLNNNNFSGELIYVNFSNLPNLKTLDLMRNNFSGEIPESIYTCSNLTALRVSSNKLHGQLSKGLGNLKSLSFLSLAGNCLTNIANALQILSSSSNLTTLLIGHNFMNERMPDGSIDGFENLQVLSLSECSLSGKIPRWLSKLSRLEVLELDNNRLTGPIPDWISSLNFLFYLDISNNSLTGEIPMSLLQMPMLRSDRAAAQLDRRAFQLPIYISASLLQYRKASAFPKVLNLGKNEFTGLIPPEIGLLKVLLSLNLSFNKLYGDIPQSICNLTDLLVLDLSSNNLTGTIPAALNNLNFLSEFNISYNDLEGPIPTGGQLDTFTNSSFYGNPKLCGPMLVRHCSSADGHLISKKQQNKKVILAIVFGVFFGAIVILMLSGYLLWSISGMSFRTKNRCSNDYTEALSSNISSEHLLVMLQQGKEAEDKITFTGIMEATNNFNREHIIGCGGYGLVYRAELPDGSKLAIKKLNGEMCLMEREFSAEVETLSMAQHDNLVPLLGYCIQRNSRLLIYSYMENGSLDDWLHNKDDGTSTILDWPRRLKIAKGASHGLSYIHNICKPRIVHRDIKSSNILLDKEFKAYIADFGLSRLILPNKTHVTTELVGTLGYIPPEYGQAWVATLKGDVYSFGVVLLELLTGRRPVPILSTSKELVPWVQEMISEGKQIEVLDSTLQGTGCEEQMLKVLETACKCVDGNPLMRPTMMEVVASLDSIDPDLKMQ

SEQ ID NO: 52064 - protein, 1063 aa, Oryza rufipogon
MQKQQQLHSSCKKCSNRCFIDFLRFNLAFALLLLLSLASPTSSCTEQERSSLLQFLSGLSNDGGLAVSWRNAADCCKWEGVTCSADGTVTDVSLASKGLEGRISPSLGNLTGLLRLNLSHNSLSGGLPLELMASSSITVLDISFNHLKGEIHELPSSTPVRPLQVLNISSNSFTGQFPSATWEMMKNLVMLNASNNSFTGHIPSNFCSSSASLTALALCYNHLSGSIPPGFGNCLKLRVLKVGHNNLSGNLPGDLFDATSLEYLSFPNNELNGVINGTLIVNLRNLSTLDLEGNNIAGWIPDSIGQLKRLQDLHLGDNNISGELPSALSNCTHLITINLKRNNFSGNLSNVNFSNLSNLKTLDLMGNKFEGTVPESIYSCTNLVALRLSSNNLQGQLSPKISNLKSLTFLSVGCNNLTNITNMLWILKDSRNLTTLLIGTNFYGEAMPEDNSIDGFQNLKVLSIANCSLSGNIPLWLSKLEKLEMLFLLDNRLSGSIPPWIKRLESLFHLDLSNNSLIGGIPASLMEMPMLITKKNTTRLDPRVFELPIYRSAAGFQYRITSAFPKVLNLSNNNFSGVIPQDIGQLKSLDILSLSSNNLSGEIPQQLGNLTNLQVLDLSSNHLTGAIPSALNNLHFLSTFNVSCNDLEGPIPNGAQFSTFTNSSFYKNPKLCGHILHRSCRPEQAASISTKSHNKKAIFATAFGVFFGGIAVLLFLAYLLATVKGTDCITNNRSSENADVDAPSHKSDSEQSLVIVSQNKGGKNKLTFADIVKATNNFDKENIIGCGGYGLVYKADLPDGTKLAIKKLFGEMCLMEREFTAEVEALSMAQHDNLVPLWGYCIQGNSRLLIYSYMENGSLDDWLHNRDDDASTFLDWPKRLKIAQGAGRGLSYIHDACKPHIIHRDIKSSNILLDKEFKAYVADFGLARLILANKTHVTTELVGTLGYIPPEYGQGWVATLKGDIYSFGVVLLELLTGRRPVHILSSSKELVKWVQEMKSEGNQIEVLDPILRGTGYDEQMLKVLETACKCVNCNPCMRPTIKEVVSCLDSIDAKLQMQNSVKT

SEQ ID NO: 52065 - protein, 414 aa, Oryza sativa (japonica cultivar-group)
MAAAAAAASDDAAAAGGRFDFDVIVVGAGIMGSCAAHAAASRGARALLLERFDLLHHLGSSHGASRTIRDAYAKAHYPPMVRLARRLWADAEAESGYRVLTPAPQLTVGPPGDASLLAAVGNSGARRVDEDDLAGRWGGAFRGVPDGWVAAVSELGGGVLNATKAVAMFQALAVKGGAVVRDNAEVVGVVKKDGEAGVFVRTSGGEEFHGAKCVVTVGAWTSKLVKSVAGVDLPIQPLHALVLYWKVKPGRERELAAEAGFPTFSSHGDPHVYGTPSLELPGLIKINYDGGPPCDPDGRDWAGGGGDAASRVARWIEEFMPDHVEAAGGPVVRQPCMYSMTPDKDFVIDFLGGEFGDDVVVGAGFSGHGFKMGPAVGRILAEMAMDGEARTAAEAGVELRHFRISRFEGNAMGN

SEQ ID NO: 52066 - protein, 1051 aa, Oryza rufipogon
MEKTMQPLQFSNKNYSNRFPITSFGLALALLLFLASPTSSCTEKESNSLIQFLDWLSKDGGLGMSWKNGTDCCVWEGITCNPNRTVNEVFLATRGLEGIISPSLGNLIGLMRLNLSHNSLSGGLPLELVSSSSIMILDVSFNYLTGDLSDLPSSTHDRPLQVLNISSNLFTGNFPSTTWEVMKSLVALNASNNSFTGKIPTSFCASAPSFALLDISYNQFSGGIPPGLSNCSTLTLLSSGKNNLTGAIPYEIFDITSLKHLSFPNNQLEGSIDGITKLINLVTLDLGGNKFIGSIPHSIGQLKRLEEFHLDNNNMSGELPSTLSDCTNLVTIDLKKNNFSGELTKVNFSTLPNLKTLDVVWNKFNGTIPESIYSCSNLTALRLSFNNFRGQLSEKIGNLKSLSFLSLVKNSLANITSTLQMLQSSKNLTTLIIAINFMHETIPLDDSIDGFENLQVLSLYGCSLSGKIPHWLSKLTNLEMLFLHDNQLTGQIPIWISSLNFLFYLDITNNSLSGEIPTALMEMPMLKTDNVAPKVFELPIFTAQSLQYRINSAFPKVLNLGINNFAGAIPKEIGQLKALLLLNLSSNKLSGQIPESICNLTNLQMLDLSNDNLTGTIPEALNKLHFLSAFNVSNNDLEGPVPTVGQLSTFPSSIFDGNPKLCGPMLANHCSSAQTSYISKKRHIKKAILAVTFGVFFGGIAILVLLAHLLTLLRSTSFLSKNRRYSNDGTEAPSSNLNSEQPLVMVPQGKGEQTKLTFTDLLKATKNFDKENIIGCGGYGLVYKGELSDGSMLAIKKLNSDMCLMEREFSAEVDALSMAQHDNLVPLWGYCIQGNSRFLIYSYMENGSLDDWLHNRDNDASSFLDWPMRLKIAQGASQGLAYIHDVCKPNIVHRDIKSSNILLDKEFKAYVADFGLSRLILPNKTHVTTELVGTLGYVPPEYGQGWMATLRGDMYSFGVVLLELLTGRRPIPVLSASKELIEWVQEMRSKGKQIEVLDPTLRGTGHEEQMLKVLEVACQCVNHNPGMRPTIREVVSCLDIIGTELQTTELN

SEQ ID NO: 52067 - protein, 396 aa, Brucella melitensis
MMFRTLDDANVQSKRVLVRVDLNVPMANGEVTDLTRIERIVPTIAELSRKGAKVILLAHFGRPKGVASDENSLKHVVKPLSKVLDHSVHFAEDCIGDKAKAAVDALKDGDVLLLENTRFHKGEEKNDPEFVQALAANGDLYVNDAFSAAHRAHASTEGLAHVLPAFAGRAMQAELEALEKGLGNPARPVVAIVGGAKVSTKLDLLSNLIEKVDALVIGGGMANTFLAAKGLDVGKSLCEHELASTAREIMAKAETTKCAIILPVDAIVGWHFAADTPHQTYGVDSVPGDAMILDAGELSTDLIASAIDDAATLVWNGPLGAFELRPFDTATVKVARHVAKRTKEGKLVSVGGGGDTVAALNHAGVADDFTYISTAGGAFLEWMEGKPLPGVDVLKK

SEQ ID NO: 52068 - protein, 177 aa, Arabidopsis thaliana
IVDDLGKIFDSDLLKITDLKLVPFGNAHISNNLTITCQHGEEECKLNALEACGIRTLPDPKLQYKFIRCVEKDTNEWESCVKKSGREKAINDCYNGDLSQKLILGYAKLTSSLKPKHEYVPWVTLNGKPLYDNYHNLVAQVCKAYKGKDLPKLCSSSVLYERKVSKFQVSYVDEAIN

SEQ ID NO: 52069 - protein, 392 aa, Neisseria meningitidis serogroup B
MAFLKLTEQNVQGKTVLIRADMNVPFKDGKISDDTRIRASLASIKYCVDNGASVIVMTHLGRPTEGEFHPEDDVAPVAAHLGSLLGKDVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIADVAEDEMILDIGPKSAAALADLLKAAGTVVWNGPVGVFEFDQFAGGTKALAEAIAQSKAFSIAGGGDTLAAIAKFGVTEQIGYISTGGGAFLEFLEGKELPAVAALEKRGA

SEQ ID NO: 52070 - protein, 520 aa, Nitrosomonas europaea ATCC 19718
MIFWRVKSLDAILATAEKKSLHRSLGVWQLTLLGVGAIIGTGIFVLTAEAAQKAGPGMMIAFVIAGFVCAVAALCYSELSSMVPVSGSAYTYSYAVLGELIAWMVGWALILEYSVAAGAVAVGWSGYFVGLLNNASLGFEIPYVLANGPFAGGIINLPAVVICLLVVGLLIIGTRESAMFNAILVAVKIIALTAFIALALPATDMNHFDPFLPLGTSGVVAAAASIFFAYVGFDAVSTAAEETKDPQRNLPIALISSLLLCTLFYLLVSAGVIGAVGAQPLVDAAGEGLAPGSREMAAQCKSLAAAGQQPVVCSHEALAHVLREIGWEKIGNLLGLAAFLALPSVILMMLFGQTRIFFVMSRDGLLPEVLSRIHPRFKTPYIVTLVTGVGVMAAAAFLPVGKLANISNSGTLFAFLVVALTVMILRVRDKNRPRPFRTPMIWLVGPLAIGGCLILFLFLPMDAKLVFPVWTGIGLIFYFLYGYRRSHVLLGIDTPSGGENLIEPIRSLADGSDETEVKVK

SEQ ID NO: 52071 - protein, 469 aa, Medicago truncatula
MASTRRVQCLMRRFYRGSRTFGVATQPNASSSSQTIIDKEFQHSAHNYHPLPIVFAHAKGSAVWDPEGNKYIDFLSGYSAVNQGHCHPKILKALKNQAGRLTVSSRAFYNDRFPVFAEYSTALFGYDMVLPINTGAEGVETALKLARKWGYDKKKIPNDEALIVSCCGCFNGRTLGVISMSCDNEATRGFGPLIPGHLKVDFGDAEALEKILKEKGDAIAAFILEPIQGEAGVKIPPDGYLKAVRDLCSKYNVLMIADEIQTGLARTGKMLACEWEEVRPDVVVLGKALGGGIIPVSAVLADKEVMLCIKPGQHGSTFGGNPLASAVAIASLEVIKEERLAERSTKLGGELLGLLEKIQKQYPDHVKEVRGRGLFIGVELNSESLSPVSFFELSEKLKDRGVLAKSTHDTIIRFTPPLCISADEIQQGSKALADVLEIDLPMLKKMKPKDAAPPAGPSACDRCGRVVYG

SEQ ID NO: 52072 - protein, 207 aa, Triticum aestivum
LLEQVCTKKQSRTGPEFPGYRRPTRPRACLSSYGTETEPPTTTGDRAPPGPDPRPPAATMATAKAAGDEPALGIPYNPAQAQGSYYYPPDPYAAGRVPPNAIYAGAPKGVPLQHTMFRDTPAPFHCQSCGDAAVTSVRSKPSVASVVACMMPFFLGVCFLCPSMDCLWHKQHYCPSCGEMVAEFKKDDPCIVVDPTSWTEPSFAVPA

SEQ ID NO: 52073 - protein, 107 aa, Oryza sativa (japonica cultivar-group)
MAEEAQSHAREGGRHPRQPAGRENDLTTVELARFAVAEHNSKANAMLELERVVKVRQQVVGGFMHYLTVEVKEPGGANKLYEAKVWERAWENFKQLQDFKPLDDATA

SEQ ID NO: 52074 - protein, 642 aa, Burkholderia sp. 383
MSTGAQSKAAVAGQHADGPRLLADVGGTNARFALETGPGDITQIRVYPGADYPTLTDAIRKYLKDVKITRVNHAAIAIANPVDGDQVTMTNHDWSFSIEATRRALGFDTLLVVNDFTALAMALPGLTDAQRVQIGGGARRQNSVIGLLGPGTGLGVSGLIPADDRWIALGSEGGHASFAPQDEREDLVLQYARKKFPHVSFERVCAGPGMEIIYRALAARDKKRVAATVDTVEIVERAHAGDALALETVECFCGILGAFAGSVALTLGALGGVYIGGGVALKLGELFTRSSFRARFEAKGRFTHYLENIPTYLITAEYPAFLGVSAILAEQLSNRSGGASSAVFERIRQMRDALTPAERRVADLALNHPRSIINDPIVDIARKADVSQPTVIRFCRSLGCQGLSDFKLKLATGLTGTIPMSHSQVHLGDTATDFGAKVLDNTVSAILQLREHLNFEHVENAIEILNGARRIEFYGLGNSNIVAQDAHYKFFRFGIPTIAYGDLYMQAASAALLGKGDVIVAVSKSGRAPELLRVLDVAMQAGAKVIAITSSNTPLAKRATVALETDHIEMRESQLSMISRILHLLMIDILAVGVAIRRASTNGELPEAVAQAKARASDDETADVLDWLSHGASPAAKDVARD

SEQ ID NO: 52075 - protein, 465 aa, Akebia quinata
SGKPFYAIVHRVTGSLIIDFEPVKPYEVPMNAAGALQSYKLAAKAIARLQSLPNASMDRLCDTVVQEVFELTGYDRVMAYKFHDDDHGEVVSEITKPGLEPYLGLHYPATDIPQAARFLFMKNKIRMICDCNATHVKVFQDEKLPLDLTLCGSTLRAPHSCHSQYMENMGSIASLGMAVVINEGDEEDNGSGSAQPQRRKRLWGLVVCHNTTPRFVPFPLRYACEFLIQVFAIHINKELELGNQVLEKSVLRTQTLLCDMLMRNAPLGIVSQSPNIMDLVKCDGATLLYKNKIWRLGLSPSEFHIRDIASWLYEYHMDSTGLSTDSLHDAGFPGALSLGDGICGMAAVRITSKDMIFWFRSHTAAEVRWGGAKHDPCEEDDGRKMHPRSSFKAFLEVAKTRSLAWKDYEMDAIHSLQLILRNAFKDGDTADLNPSVIHSRLDNLKIEGMEELEAVTNEMVRLMET

SEQ ID NO: 52076 - protein, 205 aa, Glycine max
MANNSEEQQNNSTRSSIMEWKQMHPLHQIAETPTHKLLLKQWLKEEELINSRIALKETQIDSTRKEITTLYIFFFLFHSTTLMLLFNSSSPSSCHRSWVPSLCSLLFSLGLIWALRYKSDVEAHVEKMLQREKEDKGLLGKCVEELKKKGLEFDLLKEVDALRRAKSLRVESKEVRKWSSRDFVSLFFFSMACFSLALMRVILCT

SEQ ID NO: 52077 - protein, 392 aa, Akebia quinata
DLEPVNPAEDPVTAAGALKSYKLAAKAISRLQSLPSGDISLLCDVLVHEVSDMTGYDRVMVYKFHEDEHGEAVAECLRSDLEPYLGLHYPATDIPQASRFLFLKNKVRMICDCSARSVEIVQDKRLTQPLSLGGSTLRAPHGCHAQYMENMGSVASLVMSVTINEDDDEMETNQQKGRKLWGLVVCHHSSPRFVPFPLRYACEFLIQVFGIQLNKEVELAAQLREKHILRIQTVLCDMLLRDAPVGIFTQSPNVMDLVKCDGAALYYKNKLWLLGVTPTEAQIREIAAWILEYHDRSTGLSTDSLMEAGYPGASVLGDAVCGMAAINITSKDFIFWFRSHTAKEIKWGGAKHDTVDKDDGRKMHPRSSFKAFLEVVQWRSLPWEDMEMVAIQ

SEQ ID NO: 52078 - protein, 546 aa, Oryza sativa (japonica cultivar-group)
MRAVLEEWIKQRESWKPFWVRGINMVGYSINGLHPVLFSSQADGDDDGIRAAPPPPPAEPAVPPRHRGHLHLFKKPLHRALSGLAATHGPVLLLHFGSRAVLHVTDPAVAEECLTDHDVTFANRPRLPSSCHLSNGYTTLGSSSYGPNWRNLRRIATVEVFSAHRLLRSADVRGGEVPHMARWLYLAAPAAGPSEPARADVKARAFELVLNVVARMVAGKQYYGGEGDAEAETEEAARFREMVREYFAMHGASNLQDFVLLLGLVDIGGAKRRAVKLSRERNTWAQRLIDEHRATATAAAATEARTMVGDLLKMQASEPEAYSDKVITALCLTGTDTSSSTIEWGMALLLNHPAAMAKARAEIDRFVGTGRVVEEADLPNLPYLQCIIRENLRLYPVGPLLAPHESSADCSVSVAGGGRYAVPAGTMLLVNVHAMHRDARFWGPDPESFSPERFEGGRSEGKWMLPFGMGRRRCPGEGLAVKVVGLALATLVQCFEWRRVGDEEVDMTEGSGLTMPKAVPLEALYWPRPEMVPALSGIFFIYNFFY

SEQ ID NO: 52079 - protein, 466 aa, Aristolochia grandiflora
SGKPVYAIIHRVTGSLIIDFEPVKPYEAPMTAAGALQSYKLAAKAISRLQSLPSGSMERLVDTVVQEVYELTGYDRVMAYKFHDDDHGEVISEVTKPDLEPYLGLHYPATDIPQAARFLFMKNKVRMICDCYAKPVKVFQDEKLSFDLTLCGSTLRAPHSCHLQHMKNMSSIASLVMAVVVNEGEEDDNPDPNQQQQVPKRKRLWGLVVCHNTTPRFVPFPLRYACEFFMQVFAIHVNNEIELENQIREKNILRTQTLLCDMLLRDSPLSIVTRSPNIMDLVKCDGAALMYQNKVYTLGLSPTESQISEINRWLLEYHMDSTGLSTDSLHDAGYPNAPSLGDIVCGMAAVRITSTDMLFWFRSHTAGEVRWGGAKHDPSDKDDGRRMHPRSSFKAFLEVVKNRSLPWKDYEMDAIHSLQLILRGSTKETAAIDTKTVISSQLNNLKLDGLHELQAVTNEMVRLMET

SEQ ID NO: 52080 - protein, 269 aa, Zea mays
  misc_feature (90)..(90): Xaa can be any naturally occurring amino acid
  misc_feature (109)..(109): Xaa can be any naturally occurring amino acid
MDPKMTEVTQMFARFKAAYTRNDLDACVTLLSQLKVHLTKFPSLPPSFEQTPKAVEELKLARDIYEHAVVLSVKLEDQDAFERDFCQLKXPYYMDTCGIIPPSPEEYPXILGLNLLRLLVQNRIAEFHTELELLPVKALEHPCIKHAVELEQSFMEGAYNRVLSARQAVPHETYVYFMDLLAKTVRDEIAGCSEKGYDSLSVSDAKQMLMFSSDQDLHEYITEEHPEWELKNGAVFFQKAKESQPYKEIPSLQLINQTLSYARELERIV

SEQ ID NO: 52081 - protein, 165 aa, Zea mays
MALAEADDGAVVFGEEQEALVLKSWAVMKKDAANLGLRFFLKVFEIAPSAEQMFSFLRDSDVPLEKNPKLKTHAMSVFVMTCEAAAQLRKAGKVTVRETTLKRLGATHLRYGVADGHFEVTGFALLETIKEALPADMWSLEMKKAWAEAYSQLVAAIKREMKPDA

SEQ ID NO: 52082 - protein, 392 aa, Aristolochia grandiflora
DLEPVNLADAQVSASGALKSYKLAAKAISRLQSLPSGNIVLLCDVLVREVRDLTGYDRVMAYKFHEDEHGEVIAECKRPDLEPYLGLHYPATDIPQASRFLFMKNKVRMIYDCSATPVSVIQDKGLAQPLCLGGSTLRAPHGCHSQYMANMGSIASLVMSVTINEDDDEKGSGQRGRKLWGLVVCHHCSPRFIPFPFRYACDFLMQVFGIQINKEVELAAQVREKHILRTQTLLCDMLLRDAPMGIVNKSPNVMDLVKCDGAALYYQNKFWLLGTTPTEAQIRDLAQWLLQYHNNTTGLSTDSLVEAGYPGAQDLGDAVCGMAAVKITSRDFLFWFRSHAGKEIKWGGAKHDPKEHDGDGKKLHPRSSFNAFLEVVKWRSTPWEDVEMDAIQ

SEQ ID NO: 52083 - protein, 165 aa, Zea mays subsp. parviglumis
MALAEADDGAVVFGEEQEALVLKSWAVMKKDAANLGLRFFLKVFEIAPSAKQMFSFLRDSDVPLEKNPKLKTHAMSVFVMTCEAAAQLRKAGKVTVRETTLKRLGATHLRYGVADGHFEVTGFALLETIKEALPADMWSLEMKKAWAEAYSQLVAAIKREMKPDA

SEQ ID NO: 52084 - protein, 151 aa, Arabidopsis thaliana
  misc_feature (10)..(10): Xaa can be any naturally occurring amino acid
  misc_feature (82)..(82): Xaa can be any naturally occurring amino acid
  misc_feature (144)..(144): Xaa can be any naturally occurring amino acid
HLIPPLNFSXVDNGIFRSGFPDSANFSFLQTLGLRSIIYLCPEPYPESNLQFLKSNGIRLFQFGIEGNKEPFVNIPDHKIRXALKVLLDEKNHPVLIHCKRGKHRTGCLVGCLRKLQKWCLTSIFDEYQRFAAAKARVSDQRFXEIFDVSS

SEQ ID NO: 52085 - protein, 554 aa, Asparagus falcatus
PYEVPMTAAGALQSYKLAAKAISRLESLPGGSMEKLCNAVVEEVFELTGYDRAMAYRFHEDDHGEVFSEVTKPGLEPYLGLHYPATDIPQAARFLFMKSKVRMICDCRAKPVRVLQDEKLPFDITFCGSTLRAPHSCHLQYMENMNSIASLVMAVVVNEGGEDEGEGEAGQASSPAQQQQGLRRKRLWGLVVCHNESPRFVPFPLRYACQFLMQVFAIHVNKEFELEHQIREKNILRTQTLLCDILLREAGPLGIVTARSPNVTDLVRCDGAALLYEDKIWRLGRTPTDSEIRDIAYWLVEYHADSTGLSTDSLLEAGYPGAFALGDLVCGLAAARINSRDILFWFRSHTAAEVRWGGAKHDPSDEDDGRRMHPRSSFKAFLEVVKTRSLPWSDYEMDAIHSLQLILRGSFNDVKKSEGLDSRMRSLRVEGMEELQAVTNEMVRLIETATVPILAVDVDGVINGWNLKIAELTGLPVDEAIGKHLLALVEDSSVAQVRRMLLLALQGTEEQNVEFQMKTCGDRGDDGPVILVVNACASRDLNEKVVGVCFVAIT

SEQ ID NO: 52086 - protein, 335 aa, Pseudoalteromonas tunicata D2
MTTVNLFRLGVLTSGGDAPGMNAAIRAITLKGLSAGFEIVGINAGYNGIFNLDTQILSAQSVDNIIQRGGTLLKTARCSQLREEDGPRLAAEKLTQLKLDALIIIGGDGSFRGAVKLAEFWPKPIIGIPGTIDNDINGTDQTIGFWTAIDTALDSIDKIRDTADAFERIFVVEVMGRDCGFIAMESGIACGAEQIICHELIEDEETYLAQLYNAILHAVTWRQTQSYVIVIAEHSLSICSAELAKRIADFTGVDTKSAILGYIQRGGAPVAMDRVLATQLGISAVKAVCEGKTGLMIGMKNNEMVEIPFAQTGLKNTHNQDLIKRLKHFNFDLTD

SEQ ID NO: 52087 - protein, 254 aa, Oryza sativa
MPRLHLLLLAVLAVAAAAAEAAAEKKPTAYEVLESYDFPVGILPKGVTSYTLEATTGDFTATLDTGDDDDSSSSTCEFAIEGSYSLRYQRAITGRIATGHLTDLRGVAVKVLFFWLNIVEVTRRGDRLEFSVGIASADFTVDNFLESPQCGCGFDCDDDGISSSSSLPPPLEPSLLRLRGPVWHSSSSSSTPPGAGAQPNSFSSTKTGSGVGWSSLTKCTRVVELGLGSSTTPLQTQLLELYLGVGAVPNRPLV

SEQ ID NO: 52088 - protein, 592 aa, Candida albicans SC5314
MPTIPVDKEDLFKLLGRSYTTEEFDELCFQFGIELDEDTTEDVKGTDERPQLKIEVPANRYDMLCIEGIAQALNEFLGNTSAPNYKLSPSKPEISLTIKESTYPIRQYAASAILRNVKLDERAYDSFISLQDKLHANLCRNRTLVAIGTHDLDTLTPPFTYEALAPKDIVFKPLNQTKEINGEELMEFYEKDKNIGKFLHIIKDSPVYPVMLDANRTVASLPPIINSDHSKITLNTKNVWIDVTGTDRTKTEIVINQLVAMFSRYCKEPFEIEPIQIISEHNNETRVCPNITPRTAKAEISYINSCVGLDYSGEEISKLLKKMSLDATPSTEERDILDVKIPITRSDILHQCDIMEDVAIGYGYDNLKKTKPKAESLVAAPLPVNKVADILRLASSQAGYLEVMPLTLSSHDENFAWLKQKDDGTKAVKLENPKTIEYQVVRTTLLPGILKTVKENRKHSLPIKVFECGDIVLKNPELERGAFNQRNWAALYVGKTSGFEMVQGLLGKIMQTMRTPWLENPSKDQRRGYWIEEDKENTTFFPGRGAKIYFRNADNAEAKAIGSIGVLHPEVMNNFDIPYAASSVEINAEVFL

SEQ ID NO: 52089 - protein, 540 aa, Sulfolobus tokodaii str. 7
MPTINIYKWRLLNELKISETQLEDLLFNLKSEMKPIDQDHIEIEINNDRPDLLFVYGIIRSIKGLLKKELGEPRYSVKDTDYVFEIKEVPSRPYALAAVVEDIKFDDELLKELIQFQEKLHITVGRKRKKIAIGLHDLKKIDSKHIIYTTVNLDYKFIPLNSDKEMSVREILESTPQGKEYGNISLLDGKMPAIMQDDGQILSLPPVINSEKTRINSKTQSLFIDVTGTSLDTVIFTLDVIVTNLAEMGGKIGRIKVISPYVDNSPLLQHKSIKITAEYINKILGTNLNKNEIIEYLKMARFDVNDLGKEIEVIIPPYRNDILSQIDITEEVAITYGYNNLSPTPYKIEKIGSLSDRTKLIRVLRDLSVGGGFTEIFTFTLISESLLLGDFVKILNPITVDYNSVRNSLLPSILIFLSKNQHARMPIRVFEIGDVVIRNENTETGYSNKLNAAYAIMNSRVSFEELQAPLHEILNSLGINPIYKRDTNPLFIEGRTASIYANNKKIGIIGEINPNILEKIDIEYPIVMSEIYLDEIKDIL

SEQ ID NO: 52090 - protein, 99 aa, Glycine max
  misc_feature (82)..(82): Xaa can be any naturally occurring amino acid
IMDVVNAEHARIVEEDGVCAVMVLERVPANICDHGRMRSMSYPAVHKDIKRGRTMPVMGKVKTGHKVEDDTLEGIGINYVNXSQDLTLIDDANHMNKHN

SEQ ID NO: 52091 - protein, 640 aa, Corynebacterium glutamicum ATCC 13032
MCGLLGILTANGNAEAFVPALERALPCMRHRGPDDAGTWHDADAAFGFNRLSIIDIAHSHQPLRWGPADEPDRYAMTFNGEIYNYVELRKELSDLGYAFNTSGDGEPIVVGFHHWGESVVEHLRGMFGIAIWDTKEKSLFLARDQFGIKPLFYATTEHGTVFSSEKKTILEMAEEMNLDLGLDKRTIEHYVDLQYVPEPDTLHAQISRLESGCTATVRPGGKLEQKRYFKPQFPVQKVVKGKEQDLFDRIAQVLEDSVEKHMRADVTVGSFLSGGIDSTAIAALAKRHNPDLLTFTTGFEREGYSEVDVAAESAAAIGAEHIVKIVSPEEYANAIPKIMWYLDDPVADPSLVPLYFVAAEARKHVKVVLSGEGADELFGGYTIYKEPLSLAPFEKIPSPLRKGLGKLSKVLPDGMKGKSLLERGSMTMEERYYGNARSFNFEQMQRVIPWAKREWDHREVTAPIYAQSRNFDPVARMQHLDLFTWMRGDILVKADKINMANSLELRVPFLDKEVFKVAETIPYDLKIANGTTKYALRRALEQIVPPHVLHRKKLGFPVPMRHWLAGDELFGWAQDTIKESGTEDIFNKQAVLDMLNEHRDGVSDHSRRLWTVLSFMVWHGIFVENRIDPQIEDRSYPVEL

SEQ ID NO: 52092 - protein, 402 aa, Oceanobacillus iheyensis HTE831
MSKPKVVVLGAGYAGLVATRRLTQKLSADEAEIVLINKHNYHYESTWLHEVAAGTINPNQARFMLTDAVNPKRVRLIYDTVTEVNRDEQRVILDNSEVSYDYLVFALGFVSNTFGIPGMDEHAFAITDIDSSRHIAEHIEYQFAQYSTDENKNDDQLTILVGGGGFTGIEFVGELAEKVPELCQKYDIDRSKARIINVEAAPSILPVFDDDLVSYAKKALEDRGVEFRIGAPIKECTEEGFIVGDDKELIKAGTVVWTGGVTGNPVLAKSGYELFKGKVNVGPDLRPEGEENVFILGDCSWTLDQETGRPYPPTGQLATQEGAQVAENIAALINNQPIQDFVYSNKGTVASLGLSDGIGNVLNGNKLRGKSAAAMKKVVDDRSLFLVGGPKVLLKKGKFRPF

SEQ ID NO: 52093 - protein, 612 aa, Ehrlichia ruminantium str. Welgevonden
MSSEGDYQSICNLAIIAHVDHGKTTLLDAMLKQSGTFRENQDVAERVMDNNDLERERGITILAKCTSITWQGKKINIIDTPGHADFGGEVERVLSMADGVLLLVDASEGPMPQTKFVLSKALKAGLLPIVIINKVDRPDSRIDEVLDEVYELFMNLDATDEQLDFPILYASGRSGWCVKSLSDNRENLVPLFDAVIQHVKPISYDINAPFSMLLTLLESDKFLGRVLTGKIYTGTAKINDSVKVLNLAGEVVEYGKLTKLLSFSGLKRVPVKDARAGDIIAVAGLEKASVSDSIVDSSITHPIASTPVDPPTMAVTISVNDSPFAGTEGVKLTSTVIKARLIAEAETNVAITVKETEQGDAYEVGGRGELQLGVLIETMRREGFELSVSRPRVLLKKDDNGQVLEPIEEVVIDVDEVYSGIIMEKLNLRKGDMQDLRPSGKNRVRMVFLVPSRGLIGYQGEFLTDSHGTGIINRLFYSYAPHKGNIPTRNNGVLISNDKGEAVAYALFNLQDRGMMFIKPQDKVYCGMIVGLHSRENDIDVNVLKGKQLTNIRAAGSDEAVRLVPPKLMTLEEMIAFINDDELVECTPKSIRLRKKYLDPNERKRAFRANKI

SEQ ID NO: 52094 - protein, 334 aa, Nitrosomonas europaea ATCC 19718
MHTGTTLTQFIIEEQRHIAGASGDFTALLNDIVTAIKTISNAVNKGALIGVMGALDTENVQGETQKKLDVITNEIMIRNNEWAGHLSGMASEEMDDVYSIPSPYPLGKYLLVFDPLDGSSNVDLNISVGTIFSILRSPVPSRAASMEDFLQPGVKQVCAGYALYGSSTMLVLTTGHGVNGFTLDRDIGEFVLTHPNMRIPADTREFAINASNQRFWEAPVQRYVAECLAGSTGPRGRDFNMRWVASMVAEVHRILTRGGIFMYPRDTKDPSKPGRLRLMYEANPMSFIVEQAGGLSTTGYERILDVVPQDLHQRVPVILGSKNEVEVVLEYHNA

SEQ ID NO: 52095 - protein, 147 aa, Vicia faba
MGFTDKQEALVNSSWESFKQNLSGNSIFFYTIILEKAPAAKGLFSFLKDTAGVEDSPKLQAHAEQVFGLVRDSAAQLRAKGEVVLGNATLGAIHVQKGVTDPHFVVVKEALLQTIKKASGSNWSVELSTAWEVAYDGLASAIKKAMN

SEQ ID NO: 52096 - protein, 146 aa, Vicia faba
MGFTEKQEALVNSSWELFKQNPGNSVLFYTIILKKAPTAKGMFSFLKDSAGVVDSPKLQAHAEKVFGMVRDSAVQLRASGEIVLGDATLGAIHIQKGVLDPHFVVVKEALLETIKEISGDKWSEELSAAWEVAYEGLAVAIKKAMS

SEQ ID NO: 52097 - protein, 803 aa, Oryza sativa (indica cultivar-group)
MQLDSNNRSWDGDTSSTFAPSVKGLAARASYQDPSLPSLVPYMTSRIFISNYTYSFPVIPGRMFVRLHFYPVAYGNYASRDAYFGVTTNNLTLLDNFNASQTALAAKYAYILREFSLNVTSGSLDLTFFPSTQNGSYAFVNGIEIVPTPDIFTTLSPIPPTNGNPDPSDIDSMISFQTMYRLNVGGMTISPQGDSMFYRSWENDSPYIWGSAFGVTFSKDSNVTITYPSTMPNYIAPADVYGTARSMGPIAQINLHYNLTWILPVDAGFYYLLRFHFCDIEYPITKVNQRSFFIYINNQTVQEQMDVIVWSGGIGITTYTDYVIVTVGSGQMDLWVALHPDLSSGPEYYDAILNGLEDFKLQDIGKKSLAGLNPPLPPQPKSDVNPKGVSGGGKSKGAVPASIRGAMGSTATMLIACFSVCIICRLKKVAKHSFMTDKKCMTYRTEFYHSPSNLCRNFTFDEIQVATRNFDESLLLGRGGFGDVYRGELDNNGENVAIKRSNPLSVQGVHEFQTEIELLSKLRYCHLVSLIGYCKEKNEMILVYEYMAQGTLREHLYNSNKPSLPWKQRLKICIGAARGLHYLHMGANQTIIHRDVKTANILLDDKWVAKVSDFGLSKANPDIESTHVSTVVKGTFGYLDPEYYRRKQLTQKSDVYSFGVVLFEILCARPAVNIELPEEQASLRDWALSCQKKGMLGKIIDPHLHGEISPPCLRMFADCAKQCVADRSIDRPLMSDVLWSLEAALKLQENAENNKKFSEATTSSKRTPDLITIMGTDKPSTYSTMSITGQKIIFSDMMHPQGR

SEQ ID NO: 52098 - protein, 114 aa, Gloeobacter violaceus PCC 7421
MNTDTVFGKILRREIPAAIVFEDERALAFRDINPQAPVHILVIPKRAIAQLEQVAPEDEALLGHLLYVAVQVARQEGLDSGYRLVVNNGVQGGQTVYHLHVHLLGGRMLAWPPG

SEQ ID NO: 52099 - protein, 159 aa, Gossypium hirsutum
MGFTEKQEGLVKESWEVLKQDIPHSSLRFFSLILEIAPGAKNMFSFLRESEEIPQNNPKLKAHAVKVFKMTCESAIQLREKGEVVVADTTLKYLGTVHVKSGVKDPHFEVVKEALLRTIEEAIGEEKWNEEMKNAWGEAYDQLAEAIKAEMKNHHDETA

SEQ ID NO: 52100 - protein, 176 aa, Fulvimarina pelagi HTCC2506
MIDFKAAIRTIPDYPKPGIQFRDITTLLSDPTAFRASVDALVAPYADGKIRHVVGIEARGFILGGALAHQLTAGFIPIRKRGKLPRETVSVTYELEYGEDEMELHRDAILPGERILLTDDLIATGGTAIGGVKLLRDLGAEIVAACFLVDLPDLGGSKKLREMGVDVRCLCEFEGD

SEQ ID NO: 52101 - protein, 448 aa, Exiguobacterium sibiricum 255-15
MTRRNITREDIMKIAKAEDVRFIRLQFTDILGTIKNVEIPVSQLEKALDNKMMFDGSSIEGFVRIEESDMYLFPDLNTWVVFPWTEDGTGKVARLICDIYNPDGTPFAGDPRGQLKRVLKEMEELGFTSFNVGPEPEFFLFKKDANGRPTLELNDQGGYFDLAPVDLGENCRKEIVIELENMGFEIEASHHEVAPGQHEIDFKYADAITTADNIQTFKLVVKTIAAKHNLHATFMPKPLYGVNGSGMHANMSLFKGNENVFFDEENSNMQLSDDARAFTAGILKHARAFTAVCNPTVNSYKRLVPGYEAPCYVAWSARNRSPLVRVPAARGLSTRIEVRSVDPAANPYLALATLLASGLDGIKNNLQAPAPIDRNIYVMDKPERVANGIDDLPSTLSHALEVLKADDVVMHALGEHIAEHFVELKEIEWDMFRTQVTEWERDQYMVLF

SEQ ID NO: 52102 - protein, 156 aa, Solanum lycopersicum
MGFTDKQEALVRDSWEFMKQDIPQLSLRFFSLILEIAPVAKNMFSFLKDSDELPENNPKLRAHAVKVFKMTCESAIQLREKGEVVVGETTLKYLGSIHLQKRVADPHFEVVKEALLRTVKEATGNKWKDEMKEAWSEAYDQLASAIKAEMHAEAAA

SEQ ID NO: 52103 - protein, 161 aa, Brassica napus
MGEIVFTEKQEALVKESWEILKQDIPKYSLHFFSQILEIAPAAKDMFSFLRDTDEVPHNNPKLKAHAVKVFKMTCETAIQLREKGKVVVADTTLQYLGSVHFKSGVLDPHFEVVKEALVRTLKEGLGEKYNEEVEGAWSKAYDHLALAIKAEMKQEDSQKP

SEQ ID NO: 52104 - protein, 444 aa, Asparagus falcatus
  misc_feature (59)..(59): Xaa can be any naturally occurring amino acid
DLEPVNPADVPVTAAGALKSYKLAAKAISRLQSLPSGNISLLCDVLVREISDLTGYDRXMAYKFHDDEHGEVIAECRRSDLEPYIGLHYPATDIPQASRFLFMKSKVRMICDCSAHPVKIIQDKKLAQPLSLCGSTLRAPHGCHAQYMSNMGSVASLVMSVTINEDDDESGSDQKGRKLWGLVVCHHTNPRFVPLPLRYACEFLLQVFGIQLNKEVELAAQAREKHILRTQTVLCDMLLRDAPIGIFTQTPNVMDIVKCDGAALYYKNQIWVLGTTPAEPQIRDISAWLLECHDGSTGLSTDSLMEAGYPGALALGDAVCGMAAIKITDKDFIFWFRSHTAKEIKWGGAKHEPANRDDEGRKLQPRSSFKAFLEVVKWRSLPWEDIEMDSVHSLQLILRESLHNEIAVGESKTLVNSTLDDMKRIQGMDELRAVTNEMVRLIET

SEQ ID NO: 52105 - protein, 463 aa, Ceratophyllum demersum
GKPFYAVVHRVTGSLVIDFEPVRPYEVPTTAAGALQSYKLAAKAITKLQSLPSGSMQRLCDTIVKEVYELTGYDRVMVYKFHEDDHGEVVAEVTKPNMEPYLGLHYPATDIPQASRFLFMKNKVRMICDCHAKAIKVYQDGNLPMDLTLCGSTLRAPHSCHVQYMHNMGSVASLVMAVVVNEGEDDQGESTESGQQRKKKLWGLVVCHNTSPRFVPFPLRYACEFLMQVFAIHVGKQIELENQLQEKNILRIQTLLCDMLMRDSPLGIVSKSPSIMDLVKCDGAALLYKNKVWLLGLTPSELQIHDIASWLSTHHMDSTGLSADSLYDAGYPGALSLGNAVCGMASVRITSKDMIFWFRMHTASEVRWGGAKHYPDDKDDGQKMHPRSSFKAFLEVVKTRSLPWKDYEMDAIHSLQLILQGTFKEIENGGIKNTIDSQFDGLKIDQMEELQVVANEMVRLMET

SEQ ID NO: 52106 - protein, 361 aa, Glycine max
MLKNQPQPDWPEPIVRVQSLSENCIDSIPERYIKPSTDRPSIRSSNFDDANIPIIDLGGLFGADQRVSDSILRQISEACKEWGFFQVTNHGVSPDLMDKARETWRQFFHMPMEVKQQYANSPKTYEGYGSRLGIEKGAILDWSDYYFLHYLPLPLKDYNKWPASPPSCRKVFDEYGRELVKLCGRLMKALSINLGLDEKILQNGFGGEDIGACLRVNFYPKCPRPELTLGLSSHSDPGGMTMLLPDDQVPGLQVRKCDNWITVKPARHAFIVNIGDQIQVLSNAIYKSVEHRVIVNSDKERVSLAFFYNPKSDIPIEPIKELVTPEKPSLYPAMTFDEYRLFIRMRGPRGKSQVESLKSPR

SEQ ID NO: 52107 - protein, 441 aa, Pseudomonas fluorescens Pf-5
MNKQIGTIKRWRVQIFAITWIAYAAFYFTRKAFSVAKLGIADDPDFTLDKMAMANLDAIYLAAYAVGQFTWGIFADRFGPRVVVLGGLLISAAAALVMGSFATLPVFATCMLVQGLAQSTGWSGLCKNIGSFFPAGQRGRVLGLWSSCYAFGGLVASPFAGWWAYTLIGTWHAAFISSAVVVGLTAVLFFIFQRNTPEDVGLPAVEPLPPQSAEEDAAGRRMSVWEPLREILRNRTVLILGLSYFLLKPARYAILLWGPVIVYEQMPSVGKVGAAIVPTSFELAGLLGPVMIGLASDKLFGARRMPACVISLLALTLSLALFMGALHTGSVVLVMALLFFMGLTLYGPDSMICGAAAIDFGSAKAGATAAGFVNGCGSVGAVLGGLLPGYFDTVTVFIVFAACALVSALVLVPYWNSRPQGLEPVRALVPNGPLLIKPLRT

SEQ ID NO: 52108 - protein, 465 aa, Coptis trifolia
SGKPFYAIAHRVTGSLIIDFEPVKPYEVPMTAAGALQSYKLAAKAITRLQSLPGGSMERLCDAVVQEVYELTGYDRVMAYKFHEDDHGEVVSEVTKEGLEPYLGLHYPATDIPQAARFLFMKNKIRMICDCRAKHVRVLQDEKLSFDLTLCGSTLRAPHSCHLQYMENMDSIASLVMAVVVNDDDEDDEGTRPSQPQKRKRLWGHAVCHNTTPRFVPFPLRYACEFLIQVFAIHVSKEFELENQILEKNILRTQTLLCDMLMRNVPLGIVSQSPNIMDLVKCDGAALLYKNKIWRLGSSPNEIQIRDIASWLSDYHMDSTGLSSDSLYDAGFPGALSIADTVCGMAAVRINSKDMLFWFRSHTAAEVRWGGAKHDPGEKDDGRKMHPRSSFKAFLEVVKTRSAPWKDYEMDAIHSLQLILRSAFKDIETTDGNTKAFHSQLDNLKINGMEELEAVTNEMVRLIET

SEQ ID NO: 52109 - protein, 243 aa, Oryza sativa
MLAKGRKVAGRGGDMSAHYAFGLQEDDAIIKRRLLTRTTTTRGEPPLKKLQKKFMSFATEVEKDADNISDCERLYKAFLQEINAFVLPLLKSKAVVDANLREKESFTELQDEIQRQILQAQTDIEELKKKLEQSRIERLYKEECEAIRKMISLQPPRSETEKLIAGLEKEIANLEAENTACIRTLELRKKQLSLLLHVVEELQISIEDEQRSIADELRAGAEEQQNMSTDEGSGDASDAMALD

SEQ ID NO: 52110 - protein, 391 aa, Coptis trifolia
DLEPVNPADVPVTAAGAMKSYKLAAKAISRLQSLPSGNIAVLCDVLVQEVSDLTGYDRVMVYKFHEDDHGEVIAECRVPELEPYLGLHYPATDIPQASRFLFMRNKVRMICDCSAAPVKVIQDNKLEQPLSLGGSALRAPHGCHAQYMANMGSVASLVMSVTINENDDQMETDQQKGRKLWGLLVCHHTSPRFVPYPLRYACEFLIQVFGMQINKEVELATQVRERHILQTQTVLCDMLLRDAPIGIVTQSPNIMDLVKCNGAALYYRSRFWLLGVTPTEAQIRDIAEWLLQYHNASTGLSTDSLMEAGFPGASVLGTAVCGMAAIKITLKDFLFWFRSHTAKEIKWGGAKHNPTEKDDGWKMHPRSSFKAFLEVVKHRSLPWEDVEMDAI

SEQ ID NO: 52111 - protein, 589 aa, Zea mays
MPREIITIQVGQCGNQIGMEFWKQLCLEHGIGKDGLLEDFATQADDQHFIPRSLLIDLEPRVINGIQNSEYRNLYNHENIFVAEHGGGAGNNWASGYHQGEQFVDDIMDMVDREADGSDSLEGFVLCHSIAGGTGSERLTLNADCVVVLDNTVLNRIVVERFRLSNPTFAQTNSLISTVMSASTTTLSGLEAEMGAGAEVMHQVVPLLEPPLHRCVVKSVDVMEEVVAVAPGQVQPATSPKALLEVAVEVPDLELKRSSNAGSSVSAEQLQFVPIIRSGSFADIGPRRFMEDEHIRIDDLSGHLGSLLMVSAPSAFYGVFDGHGGSDAAAYMKTHAMRLFFEDADFPQASQEDKIFAESVEDSVRRAFLRADLALADDSVINRSSGTTALTALVLGRQLLVANAGDCRAVLCRKGTAVEVSKDHRPTYDAERQRVIECGGYIEDGYLNGVLSVTRALGDWDMKLPQGSPSPLIAEPEIHWTTLTEDDEFLIIGCDGIWDVMSSQHAVSTVRKGLRRHDDPGRSAQELAMEAKRLETFDNLTVIVVCFVPDLAGGSATPSEQVPAGRIRCRKSLSPEALCKLRRWLESDQ

SEQ ID NO: 52112 - protein, 501 aa, Arabidopsis thaliana
MASIGLYEAFIGFLCFLISFYFLVKKPFRYLLIKKTHQSYPWNWPVLGMLPGILLRLQRIYDYSVEFLENSNMTFQFKGPWFVGMDILATADPTNIHYIMSSNFSNYIKGPIFHEIFEAFGDGIINTDAELWRDWRNASQLIFNHQRYQNFSASTTKSKVNDGLRFMFDITFIFLTGTDPRSLSIEMPEIEFAKALDDVGDVIVYRHITPRFVWKLQKWIGIGTEKKMSKANATLDRVCEKLIAAKREELRSQGIIDNANGDSEDLLTSHIMLDATKYELLNPNDDKFLRDFTVSFMAAGRDSTSSALTWFFWNLTENPNVLSKILQEINTNLPRTGSDQDMSSYLNKLVYLHGALNESMRLYPPIPFERKSPIKDDVLPSGHKVKSNLNIMIFIYAMGRMKTIWGEDAMEFKPERWISETGGSGLRHEPSYKFFSFNAGPRTCLGKNLAMNLMKTVIVEILQNYEIKIVSGQKIEAKPGLVLHMKHGLKVTMTMKCSSLE

SEQ ID NO: 52113 - protein, 331 aa, Candida albicans SC5314
MPSLDDILKPVAEAVKNGKKVTFFNGAGISTGAGIPDFRSPDTGLYANLAKLNLPFAEAVFDIDFFKEDPKPFYTLAEELYPGNFAPTKFHHFIKLLQDQGSLKRVYTQNIDTLERLAGVEDKYIVEAHGSFASNHCVDCHKEMTTETLKTYMKDKKIPSCQHCEGYVKPDIVFFGEGLPVKFFDLWEDDCEDVEVAIVAGTSLTVFPFASLPGEVNKKCLRVLVNKEKVGTFKHEPRKSDIIALHDCDIVAERLCTLLGLDDKLNEVYEKEKIKYSKAETKEIKMHEIEDKLKEEAHLKEDKHTTKVDKKEKQNDANDKELEQLIDKLKI

SEQ ID NO: 52114 - protein, 587 aa, Triticum aestivum
  misc_feature (336)..(336): Xaa can be any naturally occurring amino acid
  misc_feature (343)..(343): Xaa can be any naturally occurring amino acid
  misc_feature (357)..(357): Xaa can be any naturally occurring amino acid
  misc_feature (543)..(543): Xaa can be any naturally occurring amino acid
MAEAGDPTLEQGLLANPEESNQLTYTGDGSVDFSGNPVVKEKTGRWKACPFILGNECCERLAYYGISTNLVTYLTKKLHDGNSSAARNVTTWQGTCYLTPLIGAILADAYWGRYWTIATFSTIYFIGMSVLTLSASVPMLMPPSCEGAICPEASPLQYTVFFLGLYLIALGTGGIKPCVSSFGADQFDDTDPAERIQKGSFFNWFYFSINIGALISSSFLVWVQDNLGWGLGFGIPTVFMGLAIISFFAGTSLYRFQKPGGSPITRVCQVVAATLRKWNAHVPADSSLLYELPDGVSAIEGSRQLEHTDELRCLDKAATITDLDVKEDSFNNPWRXCTVTQVXEELKILVRMFPVWXATTIVFSAVYAQMSTMFVEQGMVLDPTIGSFKIPPASLSTFDVVSVIIWVPIYDSILVPIARRFTGKERGFSELQRMGIGLVISILAMSAAAVLEIKRLAIAREAHLVDQNVPVPLSILWQIPQYFLVGASEVFTFIGALEFFYDQSPDAMRSLCSALQLTTTALGNYLSAFILTMVAYFTTRGGXPGWIPDNLNEGRLDNFFWLLAGLSFLNFLVYVLCANRFKSKKAA

SEQ ID NO: 52115 - protein, 780 aa, Oryza sativa (indica cultivar-group)
MANRTELATLLCIPLFSLLLLDVVAGNFTGPHQIRLRCGGTSTAIDSDGRTWEGDANSKLALDGLAANASYLDPLLPSPVPYMTARIFSSNFTYWFGLNPGRVFLRLYFYPTEYADRAAADALFSVTAGILVLLNDFNPSQVAHAMGRTYLILEYSVNVPSGDLDVTFSLSPHHTGSYAFVNGIEVVSTPDIFTKPAPTFLNVGISDPFPISVNIGLQTMYRLNVGGETISPKDDSEFCRTWGKDSPYISGDSGLNFFKDDTVTISYPRTMPSYIAPVGLYETARSMGLKGYINLRYNLTWILPIDAGFHYLLRLHFCEIQHPITKANQRTFFVYINNQTAQKMDVIVLSGGIGVPIYTNYIVGPIGYGQTDLRVALHPDVETNPEFVDAILNGLEVFKLQDVNKSNLAGMNPIPWSHRDGDPRLATIGGAIFVLVVLLIASLSMYIINIRKKRVDHGNTNKELLLATLLSKKSNLCHQFTFLQIQEATSNFDEAFLLGKGGFGNVYKGELDHGMKVAIKRGDPLSQQGINEFQTEIEMLSKLRHRHLVSLIGYCEDENEMILVYDHMENGTLQEHLYGSQKPPLPWKQRLEICIGAALGLHYLHTGAKQTIIHRDVKSTNILFDGKWVAKVSDFGLSKVSTDKDKTYVSTVVKGSFGYLDPEYFRRQKLTKKSDVFSFGVLLFEVLCARPVINPELPEEQVSLRDWALSCRKKGILSEIIDPHLQGEITPQCFRKFTETAEQCVADYSMNRPSMGDVLWNLEVAYSCRRVQRKTAKRQH

SEQ ID NO: 52116 - protein, 548 aa, Glycine max
MNLLPARSVDETVEEIMRLHRSLPARLGIEEVEAARTLVANVEREDQAKLEAVARARERKGPHVPEELFAVLQEMQKSVVLFQSKEQRREALKLLDLENVHVLFDELIQRASNCVSSRSGSKNSVLKRETSSSSSVSVSAFKKEPVKSSEILFTRDDNYMNKIKPNFYPDGYTIGPSVSSKPLILDSSIIPASTSGEDKLSLIKLASLMEVSAKKGTRELILQNKLMDQVDWLPDSIGKLSSLIKLDLSENRITVLPSTIGGLSSLTSLNLHSNKIAELPECVGDLLSLVYLNVGGNQLSSLPASLGRLVHLEELDLSSNQLSVLPDAIGSLVSLKVLNVETNDIEEIPHSIGRCVALRELCADYNRLKALPEAVGKIESLEVLSVRYNNVKQLPTTMSSLSNLKELNVSFNELEYVPESLCFATSLVKMNIGNNFADMRSLPRSIGNLEMLEELDISNNQIRVLPDSFRMLTRLRVLKVEENPLEIPPRHVAEKGAQAVVRYMADLVEKKDAKLQPLIKKKKGWAHHMCFFSKSNKRKRDGVDFVKT

SEQ ID NO: 52117 - protein, 859 aa, Oryza sativa (indica cultivar-group)
MAADNNSTASAPIFLNCGASGVQPDSYNRSWDGDASSKFAPSVKGNVARASYQDPSLPSPVPYMTARFFTSNYTYSFPVSPGRMFVRLHFYPTNYNGNLDSANAYFGVTTNNLILLDNFNASQTALATSSAYFFREFSVNVTSSSLKLTFAPSTRNGSYAFVNGIEIVPTPDIFTTPTPTSANGGDNVQYGIDPVTGLQTMYRLNVGGQPISPQGDSGFYRSWDNDSPYIYGAAYGVTFSKDGNVTIKYPNTEPNYTAPVAVYATARSMGPTAQINLNYNLTWILPVDAGFTYLLRFHFCEIQYPITKVNQRSFFIYINNQTAQNQMDVIVWSGGIGRTTYTNYVVTTVGSGQTDLWVALHPDLSSKPEYFDAILNGLEVFKLQDLGRNNLAGLNPPLPPKPGVNPNGGSSRGKSKSVAPAAIGGAVGGLAVLLIACVGLCIICRRKKKVAKDTGKSDEGRWTPLTDFTKSQSATSGKTTNTGSHSMLPANLCRHFSFAEIQAATNNFDKSFLLGKGGFGNVYLGEIDSGTRVAIKRGNPLSEQGVHEFQNEIEMLSKLRHRHLVSLIGYCEDRNEMILVYDYMAHGTLREHLYNTKNPPLSWKQRLEICIGAARGLYYLHTGAKQTIIHRDVKTTNILLDDKWVAKVSDFGLSKAGPNVDNTHVSTVVKGSFGYLDPEYFRRQQLTEKSDVYSFGVVLFEVLCARNALSPSLPKEQVSLADWALRCQKKGVLGEIIDPLLKGKIAPQCFLKFAETAEKCVADRSVDRPSMGDVLWNLEFALQLQESTEDSSSLTEGTSASTSPLVVARLHSDEPSTDVTTTTTTTTSLSITDRSIASVESDGLTPSNIFSQLMTPDGR

SEQ ID NO: 52118 - protein, 579 aa, Triticum aestivum
  misc_feature (24)..(25): Xaa can be any naturally occurring amino acid
  misc_feature (27)..(27): Xaa can be any naturally occurring amino acid
MGKSPAKWLKSVLFGKKTSRSGSXXAXDLSKAGGNRGYVAAGKEPGFSESSPVISEPVLVTPRNNDAVPEVGKGENSSSQGEAAAQQEVNHDLEKQSTAGSDVLSNDPERLKEEQAAVKAQAAFRGYLARRAFRALKGIIRLQALIRGHLVRRQAASTLRATWLIVKFQAIVRGRNVRLSSDAIQFSWKLAEQKSVGAKPDAWRERLASNAFARKLLASPILVEALHFQYDERDPNSAFNWLERWTISRVWKPVYQTKRNAIADAKPQTKRASYAMETESGKLKRNARKSSALSVEPIPLTNMPLETEKTRRTPRKFTSTPADSVPDSQLTELEKVKRSLRKVTNSMAEASKVSSPACDTPDHPEIECEKPQCTAQEVPVYPEIQEPNHDDQLENAKVDIFVPDLKPEGEVTPYAVTSEEKLDEPAVVATAAEVMPLQDIDNEENALVNDAEQRSREEPLSAESLKGGNRRSSFSTKPEYPENGSKNSPAVPSYMAATKSAKAKLRGQISPRLSADSAEKTVYTRRHSLPSPANGKQNSHSPRTQRPIHPGTKEGAKVDKSMLSSRDAAERPMKAEWRR

SEQ ID NO: 52119 - protein, 358 aa, Campylobacter jejuni subsp. jejuni NCTC 11168
MKTYKVAVLAGDGIGPLVMKEALKILTFIAQKYNFSFEFNEAKIGGASIDAYGVALSDETLKLCEQSDAILFGSVGGPKWDNLPIDQRPERASLLPLRKHFNLFANLRPCKIYESLTHASPLKNEIIQKGVDILCVRELTGGIYFGKQDLGKESAYDTEIYTKKEIERIARIAFESARIRKKKVHLIDKANVLASSILWREVVANVAKDYQDINLEYMYVDNAAMQIVKNPSIFDVMLCSNLFGDILSDELAAINGSLGLLSSASLNDKGFGLYEPAGGSAPDIAHLNIANPIAQILSAALMLKYSFKEEQAAQDIENAISLALAQGKMTKDLNAKSYLNTDEMGDCILEILKENDNG

SEQ ID NO: 52120 - protein, 394 aa, Oryza sativa (japonica cultivar-group)
MASGTDEKAKMEGLTSAAAFVEGGIQDACDDACSICLEAFCESDPSTLTGCKHEFHLQCILEWCQRSSQCPMCWQPISLKDPTSQELLEAVERERNVRTNQTRNTTIFHHPALGDFEVQHLPVVGNDAELEERILQHLAAAAAMGRSHHLGRREGHRGRSGSHGRPQFLVFSSHPNMPSAGSVSSSSVQGEVDNESSPVHTTGELSLHANTHEEAGNQSPGMLTYDADQDAVVSSGNSTPVSSPRFFNRRHSTGQSTPVNNDRAGPSDLQSFSDSLKSRLNAVSMKYKESITKSTRGWKERLFSRHSSVADLGSEVRREVNAGIASVSRMMERLETRGSNGRTSDGPAISTSEVIPSTESSNERVTENNPTTAATSSGNTSASSAPCVTTTGSN

SEQ ID NO: 52121 - protein, 607 aa, Fulvimarina pelagi HTCC2506
MNAITPTVTAGPLQASRKIYLSGKAHPNIAVPLREISVHPTAGEPPVTVYDSSGPYTDPNVEIDIAEGLPRSRAEWAKARGDTEKYEGRALRPEDNGNLPEDKVTPAFPVHHKPLRAKDGKAVTQLAYARAGIVTPEMEFVAIRENLGRASMEEALIRDGEPFEADIPDFITPEWVRDEVASGRAIIPANINHPELEPMAIGRNFLTKINANIGNSAVTSSMAEEVEKMVWAIRWGADTVMDLSTGRNIHNIRDWIIRNAPVPVGTVPIYQALEKVDGIAENLTWEVFRDTLIEQAEQGVDYFTIHAGVRLHHIPLTVDRVTGIVSRGGSIMAKWCLHHHRESFLYEHFDAICDICRVYDVSFSLGDGLRPGSIADANDRAQFAELETLGELTKIARAKDCQVMIEGPGHVPMHKIKVNVEKQQKLCGDAPFYTLGPLVTDIAPGYDHITSGIGAAMIGWFGTAMLCYVTPKEHLGLPDRDDVKTGVITYKIAAHASDLAKGHPAAKVRDDALSRARFEFRWEDQFNLSLDPETARLYHDKTLPKEAHKTAHFCSMCGPKFCSMRISHDIRSEAQKEGMEKMAQKYREGGDLYMPADAAAANTEPAE

SEQ ID NO: 52122 - protein, 670 aa, Vibrio vulnificus YJ016
METELRKITMTTSLARPYPLGATLHDKGCNFAVHSPDCASIRLALFDDNNEFKTFELCEEYAGIRYTFVENVQHGQKYGYIIDTDNGPLLLSDPYAKALDGPLHYQTPYSAEKSFSMPKCVVYQDDFDWQGTESPRIPREEMVLFETHVKGLSKLNPEVPPAAQGRYLGLVSDAMLAFYRQQNINTLQLLPVAACMHEPHLLDMGKVNYWGYNPYLFMVPDPRYADKDAILELKTAIRELHRNGIQVILDVVYNHTAEGGAGPTVFNLKGLDSRCYFKHGSHFANFTGCGNTVDLTYQPALNLVMDTLRYWVSEFKVDGFRFDLAATLGRQGDDYSRDAAFFKAVAQDPVLKETKLIAEPWDIGPNGYQVGNFPFGWNECNDKLRDITRSFWRGDQGYLKEFATRLMGSRDIYSAANWPYKLTVNYITYHDGFTMQDLVSYKHKHNEDNGEQNRDGHGDNRSENYGAEGPTENLMIIATREKQKRNFMASLLFAFGIPHILTADVLSHSQKGNNNAYCQDNETSWLNWEHSERKHDFRHWLAQMVENRQRYMVPFIRAFSGPSRNLNRIYWRRVDGVHMEHDDWNRLSAVSLHIGIGEKGDEMVYLINQTSAPARFTLPDDNQQQWTYICDTNVRNVSPELAQGEVLLSPVSMAILHYHPQESTPPTAAV

SEQ ID NO: 52123 - protein, 352 aa, uncultured bacterium
IGAAHNLLSAMLDNHIHHSNELGIDARRISWRRVVDMNDRALRGITVALGGPGNGFPRQTGFDITVASEIMAIFCLATSLEDLRARLAKIVVGTTRDLEPITCGDIKADGAMTALLKDAMMPNLVQTLEGTPAFVHGGPFANIAHGCNSVMATNAGLKLADYVVTRSRLRCRPGCPKNSLTFKCRKTGLKPECCDYCCHCPCTEDAWRCCQDRTEGENLDALAKGMSNLKRHITNISKYGVPAVVAINRFVDDTAAEVDLIRESCEAMGAKVIECTHWSDGGAGTEKLANTIVDIIEKGESDFRTLYPDDMTLWEKTRTIAKEIYGAEDIIADDKVRKQFESLQSRCPNFPI

SEQ ID NO: 52124 - protein, 352 aa, uncultured bacterium
ITSAHSLLAAMIDNHIYWGNELEIDIRRVVWRRVVDMNDRALRQITASLGGVANGFPRETGFDITVASEVMAILCLAKDLEDLEKRLGDMIVAYRRDKSPVYCRDIKAEGAMTVLLKDAMQPNLVQTLETNPAFVHGGPFANIAHGCNSVIATTTALKLADYVVTEAGFGADLGAEKFMNIRCRKAGLAPSVVVCVATVRAMKMNGGVAKADLGAENVAAVKKGCANLGRHIENLKGFGVPVVVAINHFVTDTEEEIQAIRDYVKTHGSEAILSRHWELGSEGSAELATRVAAIADADTASFSPIYPDEMPLFDKIDTIAKRIYRADEVLADKSIRDQLRTWEEQGYGNLPI

SEQ ID NO: 52125 - protein, 570 aa, Oryza sativa
  misc_feature (29)..(29): Xaa can be any naturally occurring amino acid
  misc_feature (95)..(95): Xaa can be any naturally occurring amino acid
  misc_feature (373)..(373): Xaa can be any naturally occurring amino acid
IRHEARIARARLPRRRRPWRSSCRHSPKXRRAHAILGCERGTVVRHFSSSTCSSLVKEDTVSSSNLHPEYAKKIGGSDFSHDRQSGKELQNFKGXSRKEASRASNFMRASKYGMPITANGVHSLFSCGQVVPSRCFSSGADLPPHQEIGMPSLSPTMTEGNIARWVKKEGDKVSPGEVLCEVETDKATVEMECMEEGYLAKIIHGDGAKEIKVGEIIAVTVEEEEDIGKFKDYKAPSSAESAAPAESKPQSEPTEPKKEKEQPKAPEPKATKTEESFLSEDRTFSSPIARKLAEDNNVPLSSIKGTGPDGRILKADIEDYLASVAKGAKKETAAAPGLGYVDLPNTQIRKVTANRLLHSKQTIPHYYLTVDTXRVDKLIKLRSELNPLQDTSGGKKISINDLVIKAAALALRNVPECNSSWMNDFIRQYHNVNINVAVQTEDGLFVPVIRDADKKGLATIADEVKQLAQRARDNSLKPEDYEGGTFTVSNLGGPFGIKQFCAIVNPPQSAILAIGSAEKRVIPGAEGQFEVGSFMSATLSCDHRVIDGAIGAEWMKAFKGYIENPTTMLL

SEQ ID NO: 52126 - protein, 351 aa, uncultured bacterium
IGAAHNLLSAMLDNHIHHSNELGIDARRISWRRVVDMNDRALRDITVALGGPGNGFPRQTGFDITVASEIMAIFCLATSLEDLRARLAKIVVGTTRDLEPITCGDIKADGAMTALLKDAMMPNLVQTLEGTPAFVHGGPFANIAHGCNSVMATNAGLKLADYVVTEAGFGADLGAQKFFDIKCRKTGLKPDAVTIVATVRALKMHGGVAKTELKGENLDALAKGMSNLKRHITNISKYGVPAVVAINRFVDDTAAEVDLIRESCEAMGAKVIECTHWSDGGAGTEKLANTIVDIIEKGESDFRTLYPDDMTLWEKTRTIAKEIYGAEDIIADDKVRKQFESLQSRYPNFPI

SEQ ID NO: 52127 - protein, 101 aa, Zea mays
GPAKGGKGLGKGGAEPHRKVPRDNSPGILKPGIRRLASRGGFKRISGLIYEESRGVLKIFLEKVIRDAVAYPEHARRKTVTAMDVVYALKRQGRTLYGFGG

SEQ ID NO: 52128 - protein, 351 aa, uncultured bacterium
IGVAHNLLSTMIDNHIHWGNSLGIDARRITWRRVVDMNDRSLRDIAAGLGGPGNGYPRQTGFDITVASEIMAILCLSTDLADLQRRIGAIVIGTTRDLEPITCQQIGADGAMTALLKDALMPNLVQTLEGTPAFIHGGPFANIAHGCNSVMATMAGLKLADYVVTEAGFGADLGAEKFLDIKCRKTGLTPSVVTVVATVRALKMHGGIPKDQLGPEDVEAVRKGFCNLERHLQNIAKFGLPAVVAINRFTMDTAAEVDAIRKGCEAMGVKVIECTHWADGGEGTKALAEEVVKIIDNDEGNFKYLYNDEATLFEKVETVAKEIYRANGISCDAKVVKQFEQFQEKYGKFPV

SEQ ID NO: 52129 - protein, 1202 aa, Vibrio vulnificus YJ016
MNKQPLKLSVVAKAIMPLMATSLLIGCNSSNDGETANPQPDTGKVARVYFKASETATRAAADSSAYDQASLYVWNNDTCGGYAETDEGHDDWGTGIKPTGVDDKFGAYWDLQVRSEATQCINFIPRVGNDKPLGDFDAKLDLTQTGKNNAVYTQQGVAAVYPELISTSDIPANTARVYMNTPDGDEGHFTLHVWNNDTCGAFDGNATTWPGMEPTGFSDVYGPYWDLPVKGAEGCINIIPNNKPDGYQTSDLKFEFDKTTAIGNVAFVFKGTNKVYYTALAQKPVAQVELAGASAIFADDSVILVNAKDATSVTLYYSESGELAFDSASKKVTGATKQITSSKAASTDWNKTKPHLSNDFIGFEMDFSGEGNALKDLLKGQLILVASDATGVIKATEVQPASALDALYAAAATKLSYGAVINPDSTTTFRLWAPTAQSVKLIPYNAEKQAQTAIAMTFDATSGAWVAANTALKHGDFYRYEVTVYHPATDKVETYQVTDPYSLSLSMNSEYSQVVDLANAELKPSGWDALAAPHNQANPAEFVLYEAHIRDFSALDDSTAEANRGKYKAFTQAGTAPVEHLKKLAQSGVTHLHLLPTFDIATINEDPTKVANINQPFAKLCELDASVKNDADFGNYCDSNETLSTVFETLAKKDSKESAVVQRLNSHVRNLDSFNWGYDPFHYTVPEGSYSSDAEGMVRIKEFREMVMSVKKEIGMNVVMDVVYNHTNESGVSSKSVLDRIVPWYYQRLNEFSGAVEQSTCCSNTAPENQMFAKLIDDSISTWVKEYKIDAFRWDLMGHHPLAQMQQTLAAAKAVDPNVYFYGEGWNFGEVGSDRMFKQATQLNLAGTGIGSFSDRLRDAVRGGGPFDSQDSLRSNQGFGNGIYVQVNDKNEQNAALKTTALHLADLTRLGMAGNLKAFPFTDSKGKAITGAELDYNGQPAGYAQDAWEIQNYVSKHDNQTLWDNNQYKIAYATTAAERTRMQAVGLSTAMLGQGVPFIHMGSELLRSKSMQRDSYDSGDWYNRVDFTKQDNNWNVGLPREDKDGSNWAIIDAVITGSSDRAMPSATDIDNMDKFFNELAALRASSGLFTLGKGSEIIKRVAFHNTGAEQTPGLIVMSIDNSGDNHDATIDATRDGVVIVVNASPTMVSDFAKFDATGYTLHSVQTNAGNDSLAKNQDKAAQVVNGKLSVPAWSVAVFEKLR

SEQ ID NO: 52130 - protein, 320 aa, Pseudomonas fluorescens Pf-5
MANTLELDRRTARQSFVVRSHGAPQRSTRISAWPLWFSTDSTEKPLLYLHRCSSSAQLCAVSAETAARGILCNDSETQTSPWPKGADPSLALWLAHNPHCLPFDPATGAEAEAIVLEALQRLYIEGQPGFYYLALHDHELQLELTPEQRQAALQGMYKVTDTTAHPAAGRVRLLGAGRAFAQVRAAADLLQRDWKVASQLWSCPSYTRLAREAAAAQHWNRLHPGQERRGSHLQRCLADDSAPVIAVTGYGQAVAEQLRPHLKAELVALGTDSFDAARDPRRGRCPEARWIAVLALKSLADAGQLPMQCVEQAMATYGLP

SEQ ID NO: 52131 - protein, 277 aa, Rickettsia sibirica
DFLEVAYLLIYGGLPSGEQYNNFTKQVAHHSLVNERLHYLFQTFCSSSHPMAIMLAAVGSLSAFYPDLLNFKEADYELTAIRMIAKIPTIAAMSYKYSIGQPFIYPDNSLDFTENFLHMMFATPCTKYTVNPIIKNALNKIFILHADHEQNASTSTVRIAGSSGANPFACISTGIASLWGPAHGGANEAVINMLKEIGSSEYIPKYIAKAKDKNDPFRLMGFGHRVYKNYDPRAAVLKETCKEVLKELGQLDNNPLLQIAIELEAIALKDEYFIERK

SEQ ID NO: 52132 - protein, 891 aa, Pseudomonas fluorescens Pf-5
MTQNNSATLDNDPQETREWLDSLESVLTVEGRPRAHYLIDQLLDFDVARHGDFHGRVTTPYINTIAPERQLPYPGDLETERKLNAMIRWNAMAMVLRAGKHSGVGGHIATYASAAVLYDVGFDHFFRGRSDSFDGDMVYIQGHSSPGIYGRAYLEGRISAAQLDNFRREADGQGISSYPHPRLMPDFWQFPTVSMGLGPITAAYQARFMRYLELRGLKQHQGRKVWAFLGDGEMDQPESLAAISLAGREKLDNLIFVVNCNLQRLDGPVRGNAKVIQEFESLYRAAGWNVIKVIWGSGWDALLEKDRSGLLRQRMMECVDGDYQNYKSQNGAYVREHFFGKYPQLLELVADLSDEQIWKLSRGGHDPLKVYNAYAAAVRHSGRPTVILAKTVKGFGMGEAGEGQNINHQLKKMGAEAVKAFRDRFELPVSDEQLAEMPYLKPTADSTEGRYFAACRSRLGGYVPARYNDCAPLQIPALEAFATQLKDTGDRAISTTMAFVRILGTLLKDPQIGKRVVPIVPDESRTFGMESLFRQIGIHSAVGQLYTPQDAGQLSYYKESKDGQIMQEGLNESGAISSWIAASTSYSNHQVMTLPFYIFYSMFGFQRIGDLAWAAGDARARGFLLGATSGRTTLMGEGLQHDDGHSHILASVIPCCISYDPTFAYELAVIIHEGMQRMYVQQEDVYYYITLLNENYPQPAMPEGAREGILRGLYRFSSSTAQGAKAPRVQLMGSGSILREVIAAGQLLEKDFGVQSDIWSATSLTELRRQGLAAERWNLLHPQQPRRAAYVEQCLEGHQGPLVVATDYMKLFADQIRPFVEGRRFVALGTDGFGQSDTRENLRQLFEVDRHFIALAALKALADDGEIPYSQVGEALSRYRIDAEKVDPSSV

SEQ ID NO: 52133 - protein, 225 aa, Candida albicans SC5314
MKLGHYMKIDPRTLFWAQFVATIWGSLVQIAVLEWAYGAIDNLCAADQKNHYTCPNGKVFFNASIIWGVIGPQRQFSHGQIYYGLLFFFIIGAVTPVINWLILKKWPNSPVKYLHWPVFFSGTGYIPPATPYNYTSYCAVGLFFGWWIKKKWFHWWSKYNYSLSAGLDIGLAWCSLIIFLCLSLTNTDFPSWWGNDVINTTLDTQVVTNIRHILKEGEAFGPSSW

SEQ ID NO: 52134 - protein, 207 aa, Triticum aestivum
  misc_feature (172)..(173): Xaa can be any naturally occurring amino acid
DDGDMHNDVNQWPSEERLPSWKETMKLYIAAILDTGTRILSLIALGLDLDAEFFHKIGALNCPSTFLRLLHYPGEVNESDSGNYGASAHSDYGVITLLVTDGTPGLQICREKDRNPQLWEDVHHIDGAPIINIGDLLERWTNCVFRSTLHRIVAVGKERYSVAFFLDPNPDXXVQCLESCCSEACPPRFPPIKSSDYIFGRINSTYK

SEQ ID NO: 52135 - protein, 525 aa, Oryza sativa (japonica cultivar-group)
MSRVAVAVLLLLCLQLQLGISGGGGGGHGARRARLIHAKKSSSSSQQQQQQQRSRQAGSKAGWPSTSSTPSNPFGLPMLLPPPPPLKDWPPWLDMPPVQGPSSSPSPSPSPAPSPASSAAVAEHAAPPRRGEEHARPRSIALPPASSSGDAGETSRPEVTDGSATRRGGGGGKTNYVLVAAAGASVLLAASAAAFAACYRSSKVVRSVRPWATGLSGQLQRAFVTGVPALRRAELEAACEDFSNVIGSLPEYTMYKGTLSSGVEIAVVSTTKTSPKDWSKKCEAHFRKKITSLSRVNHKNFVNLLGYCEEEQPFTRMMVFEYAPNGTLFEHLHARDEGHLDWPTRLRVAVGVAYCLEHMHQLAPPEIVRTLDASTVYLTDDFAAKISDVGFCEEEMAAAAAAPAMADRESVVHGYGMLLLEMMAGRLAASEGGLVQGWAAALLRGERRLRDVMDPALRGAFHAETVDRLDAVVRSCADRDPRRRPSMADVAARLREITAMPPDAATPKVSPLWWAELEIISTEAA

SEQ ID NO: 52136 - protein, 227 aa, Brassica napus
  misc_feature (169)..(169): Xaa can be any naturally occurring amino acid
MERLLQPPSSSTISSPKFPSRASPFLPRLRSSTLGFLSSRRVSSVSCSSSFWNQSACSPKRCNLAINSLNGPPSSRESKPNPGSLQRIVGAVSEKRKTLSTGTVILISAVAALLLNPLLAPPAFASFQTAAKTGWLASAWTGFLAGCLHTLSGPDHLAALAPLPIGRHXKWKSAAVGALWGCGHDAGQVIFGLLFLLLKDRLHIEVLRTWGTRIVGLTLVIIGAMGD

SEQ ID NO: 52137 - protein, 1143 aa, Mycobacterium sp. MCS
MFVESVGAHDEVIYSASDLAAAARCEYALLRSFDARLGWGPSVATEDELLARTADLGDEHEKRHLDTLRTDSDHNVTVIGRPPYTVAGLTAAAEATTRAVARRAPVIYQAAMFDGRFAGFADFLILEGDRYLLRDTKLARSVKVEALLQLAAYAEALTAAGVPVADEVELVLGDGATARYPLEELLPVYRPRRAALQRLLDDHLAGGTPVRWEDETVRACFRCPECSIEVRAQDDLLLVAGMRVSQRARFHEAGITTVAELAAHQGPVPELPARTVTALSAQARLQTAPRVDGKPPYEVADPQPLMLLPEPDKGDLFFDFEGDPLWTDDGHEWGLEYLFGVLDTADGFHPLWAHDRPQERKALEDFLELVRKRRKRHPNMHIYHYAAYEKTALLRLAGRYGVGEDAVDDLLRSGVLVDLYPLVRKSFRIGTENYSLKSLEPLYMGGQLRTGDVTTAAASITEYARYCELRAEGRDDDAAVVLKDIEDYNRYDCTSTRKLRDWLVCRAIDCEVPPRGPQPVRDGAEPEPVDALDRTLCRYAGDELEGRTPEQSAVAMVAAARGYHRREDKPFWWSHFDRLNNPVDEWADSTDVFLVDPGGAQVEVDWHTPPRARKPQRRIRLSGVMAAGGLSRDMYALYEPPAPAGLGDDPDRRAAGSVTVVECNAPDVPTEVVVVERTPRDGGVFDQLPFALAPGQPIRTTALRESIEATAADLAERLPRLPETAVTDILLRRPPRTRSGAPLPTGPDVSAAITAALLDLDSSYLAVHGPPGTGKTFTAAAIIATLVNTHGWRIGVVAQSHAVVENLFRGVIDAGVDAARVAKKRGHGDDANWTVLEEAGFPGFVADHDGCVIGGTAWDFANGNRIPRGCLDLLVIEEAGQFCLANTIAVAPAAANLLLLGDPQQLPQVSQGTHPEPVDASALGWLVDGAHTLPAERGYFLDVSWRMHPAVCAAVSRLSYDGRLQSNDAVTTARTLEGWSPGVHEVTVPHDGNATESPEEADAIVTRIGRLLGSVWTDENGSRPLAQDDVMVVTPYNAQVVLLRQRLDAARLTDVRVGTVDKFQGQQAPVVFISMVASSIDDVPRGISFLLNRNRLNVAISRAKYAAVIVRSEALTEYLPSTPKGLVELGAFLSLSQSPSRRE

SEQ ID NO: 52138 - protein, 553 aa, Frankia sp. EAN1pec
MAADRPELGEPDRPGRPQHAGRGPLPGQHPRPRRHRARHAPRPRRIRPVRPPDHRRNHGRRVERLTTSPVPATDTTAATGVPAPEPSPGADELAARIATGLPTGFVWGAATSAYQIEGGAREGGRGPSIWDVFARTPGMTANGENGDVAADHLHRYREDVALMAGLGLGAYRFSVAWPRIVPAGSGAVNPDGLAFYDRLVDEILAAGIDPWLTLYHWDLPQPLQDAGGWPNRDTALRFADYTEHVVSALGDRVRHWSTLNEPWCSAFEGHLTGRHAPGVRDAGAAVRAVHHLLLAHGLGTAVLRAHGAADVGITLNLIPAEPPPDAGGAGDAVRLVDGQQIRLWLDPVLHGTYPSDVIADFARAGAELPAQDGDLAVIAQPVDWIGVNYYAPHIVAPGPDPSPKPTPFAGAGNVTRVPTSEDVTALGWPVRPRSFLALLRRLGADYPGVPFYIHENGAAYDDEVSPDGTVHDPLRVRYLAGHLDAVRQASEDGVDVRGYFVWSLLDNFEWAEGYRMRFGIVHVDFESLVRTPKSSGLWYSRLIREHRAASGTR

SEQ ID NO: 52139 - protein, 297 aa, Triticum aestivum
MSLSHRRPHLPPAAPPAGDPYYHLYAPQPLQHADPRQGVVTLFVAGLPDDVKPREIHNLFSRRPGFDHCLLEYTGRGNQAVAFVSFFTHHAALAAMASLNGSVFDPDNGDCLHIELAKSNSRKRHGGGGEVYRVIDKRVRTEEISDNDNNRDEGDDDVSGNDDGQDGSDGPSDEENDNSSDKNELPTDQSGEPGIKQQKGRSSSNDPPPKIPPCSTLFLSNLGQTCTDKELEELLSKQPGFHVLKMRRRGGLPAAFADFTDIESSAAAMENLKGTILSSSDSDGLQIEYARSKMRKS

SEQ ID NO: 52140 - protein, 276 aa, Mycobacterium sp. MCS
MQGFAGKVAVVTGAGSGIGQALAIELARSGASVAISDVNLEGLAVTEERIKAIGAPVKCDRLDVTEREAFLLYADEVKEHFGKVNQIYNNAGIAFTGDIEISQFKDIERVMDVDFWGVVNGTKAFLPHLIASGDGHVVNVSSVFGLFAVPGQGAYNAAKFAVRGFTEALNQEMTAAGHPVKVTTVHPGGIKTAIARNATAAEGLDPEELAKLFDKKLANTTPERAAQVILDGVRKNKARVLIGTDAKVLDAVIRVVGPHYQRLFTSVTSKLLPRPH

SEQ ID NO: 52141 - protein, 352 aa, uncultured bacterium
ITSAHNLLSAMIDNHIYWGNELGIDERRVVWRRVMDMNDRALRDMVVSLGGVANGFPRQTGFDITVASEVMAILCLANDLEDLQKRLGDIVVAYRRDRTPIYCRDIKADGAMTVLLKDAMQPNLVQTLENNPAFVHGGPFANIAHGCNSVIATNTALGLADYVVTEAGFGADLGAEKFFDIKCRKAGLKPDAAVIVATVRAMRMNGGVAKADLGAENVEAVTKGCPNLGRHIANVKSFGVPVVVAINHFVTDTDAEVQAVQDYVASQGAEAILCKHWAQGSAGIEALAQKVVSLAESGAANFAPIYPDDMGLMQKIETVAKRIYHADEVLADKSVRDQLRAWEDKGYGNLPV

SEQ ID NO: 52142 - protein, 118 aa, Shewanella sp. MR-4
MAEETIFSKIIRREIPADILYQDELVTAFRDISPKAPTHILIVPNHLIPTANDMKASDEPALGRMMTVAAKLAAEAGIAKDGYRLIMNCNKHGGQEVYHIHIHLVGGEPLGPMLSQGQ

SEQ ID NO: 52143 - protein, 125 aa, Salvia columbariae
DLKPENVLVRDDGHIMLSDFDLSLRCAVSPTLVKTSSLDNDAQRKNSGYCAQPACIEPSCIQPSCVVPTSCFSPRIFSSKSKKDKKPKNKNEIDNQVRPLPELMAEPSNARSMSFVGTHEYFAPE

SEQ ID NO: 52144 - protein, 352 aa, uncultured bacterium
IGAANNLLAAMIDNHIYHGNALDIDPRRIVWRRCVDMNDRQLRFVVDGMGGKANGMPREDGFDITVASEVMAAFCLASDIVDLKARLARIIVAYTRDDKPVTAGELNAHGAMAALLKDALKPNLVQTLEGTPAFVHGGPFANIAHGCNSVIATKMAMHFASDYVVTEAGFGADLGAEKFLDIKCRMAGLKPDAVIIVATVRALKYNGGVPKDELNNENLEALEAGLNLLKHVENITQVFKLPAVVAINKFPLDTEAELTLVKSKCQELGANVALSEVWAKGGEGGEELAKEVIRLTEQPSTLEYVYELDAPIKDKITAIAQKIYGADNADFTPAALKEIDRLTKLGFDKLPI

SEQ ID NO: 52145 - protein, 350 aa, uncultured bacterium
ITSANNLLAALIDNHIYWGNELGLDPSKVSWRRVMDMNDRALRQIVVGLGNNGQTREDGFDISVASEVMAAFCLATSLKNLEERLGNIIIGQKFDKTFATAKEVLAAPAMTALLRDAFQPNLVQTLEHTPTIIHGGPFANIAHGCNSVIATDTAMKIADYVVTEAGFGADLGAEKFLNIKCRQADLHPDAIVVVATVRALKMHGGVPKTGLDKESVQAVRDGLANLVCHVENVQKFGVPAIVAINHFTSDTEAETAVIKEACEKLGVPCHFCDHWANGGAGAESLAREVVQMADSGRAKFAPLYPDELPLETKLRTVAKEIYRAKDIDLQPMAQKKLALFEAEGYGNLPV

SEQ ID NO: 52146 - protein, 352 aa, uncultured bacterium
IGAAHNLLAALIDNHMHWENQLNVDPRRVTWRRVVDMNDRALRSITSGLGGFHNGVVREAGFDITVASEIMAIFCLATDLKDLENRLGNIVFGYTRKNEPVTVRELNAQGAMTALLKDALQPNLVQTMENNPAFMHGGPFANIAHGCNSVMATTTALKLADYVVTEAGFGADLGAEKFFDIKCRKAGLKPSAVVVVATVRALKSHGGVTKQDFGKENVAAVEKGFANLGRHLENIAQFGVPAVVAINRFITDTDAELAAISKACKAHGAEAILCTHWADGSKGTQKLAKKVVEIVESGTAKFKPLYPDNMKLVDKIRTIARKLYHADGIAADKKIRSQLEDYETAGYGKYPV

SEQ ID NO: 52147 - protein, 87 aa, Arabidopsis thaliana
  misc_feature (38)..(38): Xaa can be any naturally occurring amino acid
MANRAPIQVLVMLLLAQTHIFFSPSHGRSLGSLMEKPXFVRPNKETLMVVNKTSKKRMVMKFSGHPGTGATNRPLPRLKRSALENSC

SEQ ID NO: 52148 - protein, 336 aa, Sulfolobus tokodaii str. 7
MRLYELSFYEVEQFFYKLAEVRDIIKDQGLLSFLPQKLDAELVQGSTMVKHAFPIFQKGGVVMDVTNVTQAEIAEDAGATAVMVLDKLPYDVRKSGGVARMADPKIIEEVMNSITIPVMAKVRIGHYYEAKILEALGVDMIDESEVLTPADEEHHINKWEFKVPFVNGARNLGEALRRITEGASMIRTKGEAGTGNVSEAVKHMKIINGEIRSLISMSEEDRMKKAREYQVPYQIVELTVKLGRLPVVNFAAGGIATPADAALMMWLGADGIFVGSGIFKSQDPDVRAKAIVLATANWEDPEIVLEAQKMISESKSMMGIDIKALKPEELLQVRGQ

SEQ ID NO: 52149 - protein, 571 aa, Oryza sativa (japonica cultivar-group)
MRIPRRKGGAGPLVGAPSRRAQVAAVFALALLLGVSVLYDSAHIAASLRRHGVGGGGSSGGGGGGGGDGARAYTNTKLSATTEEAEAEAAEVRSPPAQGVESAVEATDRGEAPPEQPVAADSGASSAETPPSLLEQVTETPPPSPSSSSAAAAAAEAQVGGDHGGESCDVYKGRWVYDEANAPLYKESACEFLTEQVTCMRNGRRDDDYQKWRWQPDGCDLPRFDAKLLLEKLRNKRLMFVGDSLNRNQWESMVCLVQSEAPWEKKSLVKNDSLNVFRLEEYNATIEFYWSPFLVESNSDDPNMHSIVDRIIKPTSIAKHAANWEGVDYLIFNTYIWWMNTPEMKILHGGSFSKKPVKYDEMERVAAYRKVLKTWSRWVEKHVDPKRSTVFFMSVSPVHMQSEGWGKPDAIKCFSETQPAINYTKKLEVGTDWDLFSTAHHVTKAMKRVPVHFINITALSEIRKDAHTSVNTLRQGKLLTKDRRRTPASSRTASTGAYLGCQTHGTSSFTVTSSRALKGGRLSRLRINLRDNSEEFVYLESIRSFSEEEVAAEAINYFLGLGIYAVDSPRV

SEQ ID NO: 52150 - protein, 116 aa, Brassica napus
MAATAPNGNPTVSSLAATVPVQAVLFDIDGTLCDSDPLHHVAFQEMLLEIGYNNGVPIDEEFFIKNIAGRSDVEAAQNLFPDWELEKGLKFLEDKEAKYRSLAKERLVPVKGLAKV

SEQ ID NO: 52151 - protein, 190 aa, Glycine max
MVLVLALGDLHIPHRAPDLPAKFKSMLVPGKIQHIICTGNLCIKEIHDYLKTLCPDLHITRGEYDEETKYPETKTLTIGQFKLGLCHGHQVIPWGDLDSLAMLQRQLDVDILVTGHTHQFTAYKHEGGVVINPGSATGAYSSITYDVNPSFVLMDIDGLRVVVYVYELIDGEVKVDKIDFKKSSTSHSAH

SEQ ID NO: 52152 - protein, 235 aa, Debaryomyces hansenii CBS767
MDETKNVYIGNIPFDHTEEQVLEIAKSVGPVIDLKLLFDPMTGKSRGYAFIKYGDHETAASAVRNLNNMAIGNRNIKCSFSNDNSAFPDSSNGNADKLPALPLGIQLFNNQTIPQAISNALSGLDQRSAYQLMKEAKQMSEDNPTLMKKLLDQFPQLAHALVETSLLLNFTTPEIVKLCVNSKQLELESLTLDHVQLLKQVSQLSDPEIDSLTKDQRNIISKMKSEIANGSYGVI

SEQ ID NO: 52153 - protein, 523 aa, Saccharomyces cerevisiae
MRVYQFCRPFQLFTCFLCYLLVFVKANKEKISQKNYQVCAGMYSKEDWKGKIDPFISFNLKKISGLSDESDPGLVVAIYDFQDFEHLGVQLPDEEMYYICDDYAIDIGICEEENRDEFIVQDVVYDPYTSTNRSLANPIMTFSQNEVGLHDTRYPIKETGFYCVTAFRSSTSTKFNAVVNFRNAYGQLAGTEINKLPLYGLLAVAYVVAMALYSFAFWKHKHELLPLQKYLLAFFVFLTAETIFVWAYYDLKNEKGDTAGIKVYMVFLSILTAGKVTFSFFLLLIIALGYGIVYPKLNKTLMRRCQMYGALTYAICIGFLIQSYLTDMEAPSPLILITLIPMALALIIFYYMIIRSMTKTVIYLKEQRQIVKLNMYKKLLYIIYASFLSVLAGSIVSSFIYVGMNTIDMIEKNWRSRFFVTDFWPTLVYFIVFVTIAFLWRPTDTSYMLAASQQLPTDPENVADFDLGDLQSFDDQDDASIITGERGIDEDDLNLNFTDDEEGHDNVNNHSQGHGPVSPSPTK

SEQ ID NO: 52154 - protein, 391 aa, Mycobacterium sp. MCS
MAETVVGSSQVVISDDEIFAAHEGGKLAVQLNEPLDTQRALSIAYTPGVAQVSRAIAKDPALAARYTWANRLVAVVSDGSAVLGLGDIGAAASLPVMEGKSALFKTFGGLDSIPIVLDTKDPDEIVETLVRLRPTFGAVNLEDISAPRCFEIERRVIEALDCPVMHDDQHGTAIVVLAALMGAARVLGRDAATLRVVISGAGAAGVACANILLAAGISDVTVLDSKGIVHSGRDDLNSFKAELAERTNPAGRTGGVAEALDGADMFLGLSAGVVAEELIATMAPGGIVFALSNPDPEIHPDLARKYAAVVATGRSDFPNQINNVLAFPGVFRGALDAGARRITERMKVAAAEAIFSVVGDDLAVDHIVPSALDPRVAPAVAAAVGAASQVG

SEQ ID NO: 52155 - protein, 454 aa, Mannheimia succiniciproducens MBEL55E
MTITTPVKAVLASNQYFLDRQNAMESNVRSYPRKLPFAYAKAQGCWVTDVEGNEYLDFLAGAGTLALGHNHPVLIQSIKDVLDSGLPLHTLDLTTPLKDAFTEELLSFFPKDQYILQFTGPSGADANEAAIKLAKTYTGRGNVIAFSGGFHGMTHGALSLTGNLGAKNAVQNLMPGVQFMPYPHEYRCPFGIGGEAGAKAVERYFENFIEDVESGVVKPAAVILEAIQGEGGVVPAPVSFLQKVREVTQKHGILMIVDEVQAGFCRSGKMFAFEHAGIEPDIVVMSKAVGGSLPLAVLAIKKEFDAWQPAGHTGTFRGNQLAMATGYASLKIMREENLAQNAQQRGEYLTQALRELSKEFPCIGNVRGRGLMMGIDIVDERKPQDAAGAYPQDGELAATIQKFCFKNKLLLERGGRNGNVVRVLCAININQAECEEFIKRFKQSVTDAIKAVRG

SEQ ID NO: 52156 - protein, 402 aa, Arabidopsis thaliana
MNGEKPLRERKKKMPYPSPVTEEPISIMSLPYDLLLNCFSLVSRLYYPTLSLVSKTFRSIITSRELYEIRSRLNRTDKCLYLCFPYDMNTHWFTLCREPNRNVAENSSGYLLVQVPSPNGLLPVHSSSVIAVGSNIYKIGGTKSYRHKLWKRTRYSSSVSVLDCRSHRWRQAPGMRVARGCSSTVCEVDGKIYIAGGCKEDIGSLYWIEVFDPKTQTWGTLKNPCIEYQHDIGYRCEVKSLGLDGKIYMFGSEFVVYNFEEDRWKCIGRDKYNLYHAVDPMSRINSSSCVVDNVLFILDKGTRVFKWYDFKVSLWKELNGVEGLPDLSDRGYVKMVDLGGKIAVLWQECLTNKKIKRIWCAEISLERRDRDEIWGKVEWFDIVLSVHSSFSLLCADTISVVV

SEQ ID NO: 52157 - protein, 397 aa, Gluconobacter oxydans 621H
MSSENWRTATRLLHEAPNRTEFGETSEALFLTSGFVYDSAEQAAATFTGDVQHFQYSRFGNPTVDTLQERLALLEGAEACVATATGMGAVSSAILSTVKAGDRVVASRAIFGSCYWIVTNLLPRYGIETELVDGTDYDAWERALSKPTAAVLIESPSNPMLDVLDIARVAELTHKAGGLLIVDNVFATPLGQSPLKLGADVIVYSCTKHIDGQGRVLGGAVLGSSKWISETLQPFTRNTGNALSPFNAWVLLKGLETLQLRTDAMARNAAAVADALAELPGIVQVRYPGRADHPQHELAKTQMNNGGSMVAFVVDRGREGAFAFMNAFKIIAISNNLGDARSLATHPATTTHMRVSEEERARLGITDGAIRLSVGLEDPADLIDDLKRGAAAVAALA

SEQ ID NO: 52158 - protein, 123 aa, Salvia columbariae
PEKPENVLVRDDGHIMLSDFDLSLRCAVSPTLVKTSSITSDPQNKNSTYCAQPACIEPACIQPSCVLPTMCFSPRLFSSKSKKDRKPKNDIGNQVSPLPDLIAEPTNARSMSFVGTHEYFAPE

SEQ ID NO: 52159 - protein, 302 aa, Triticum aestivum
MASRTAGRGGRPLLGGGAGGGRRGKPSKAIMAALLLASVALLLLLALGALSLPAGSGRGAVLSLPLPRPRFRRSAFESRLEKRGEKGEPWTEVLSWEPRAFIYHNFLSKEECQYLISLAKPHMKKSTVVDSATGGSKDSRVRTSSGTFLKRGQDKIVRTIEKRISDFTFIPVENGEGLQVLHYEVGQKYEPHFDYFHDDFNTKNGGQRIATVLMYLSDVEEGGETVFPSAKVNSSSIPFHNELSECAKRGISVKPKMGDALLFWSMRPDGTLDPTSLHGGCPVIKGDKWSSTKWIRVHEYKV

SEQ ID NO: 52160 - protein, 119 aa, Salvia columbariae
DLKPENVLVRDDGHIMLSDFDLSLRCSVSPTLVKFPSLEPDTLRANTTECIAPSCVQPSCMAPTTCFGPRFFSGKSKKKDHKPKNDIGNQVRPLPELMAEPTDARSMSFVGTHEYLAPE

SEQ ID NO: 52161 - protein, 409 aa, Gluconobacter oxydans 621H
MSAGARVLVLGGGVGGLEAAAALGRRQNISLTLVDRSPLHYWKPALHEFAAGTMQHQGNCIPFKDTAVKFGFTFVQGSPVAVNRENKTVSLDTGATLPYDYLVVALGSRANDFGIPGIVDHCMFIDSLNDADALFATFREAVQKARAAGEKLSVGIVGGGATGVQLIAELCKSIDDARGLGPAVRKSLLNAVLIETGPRILPAFPEAVSTAATQQLEKLGISVRTEAMVVGADETGFSLKSGEHIPASLRVWAAGVRASDATNLLEGLERGRSGQLGVTTTLQTTQDPAVFAIGDCARIDAAPIAPTAQAARQQGQYLGRALPEIIAGRTPAPFAYNDRGAVVALGDYNGWGMLDAKRSFGGGLLSGLAARLIHEGLYRQHLAGILGVAPTACSTVREHLSPVKPDLGA

SEQ ID NO: 52162 - protein, 860 aa, Arachis hypogaea
MVSVRRSAGIRGRAGILNRGHKIKWTVVLMRKNVLDVDTFTDVAATANIGGLIGTGINVIGSTVDALTAFLGRSVSLQLISSTQSDVNGNGKVVKDTFLEGIIASLPTLELENLAFSIHFEWDDSMGIPGAFYIKNYMQVEFFLKTLTLEDVPNQGTIHFVCNSWVYNSKLYKSPRIFFSNKPYLPSETPAPLVKYREEDLKILRGDGKGERQEHERIYDYDVYNDLGNPDRNENHARPILGGSTTFLTSQGRTGRYPARNDPNSEKPGDVYVPRDENFGHLKSSDFLANSIKFLTRYVLPAFESVFDLNLTPNEFDSFQDVRDLYEGGIRLPTEVISTKRRLLVIKELFRTDGEQVLKFPPPRFLQVNEENSAWMTDEEFVIINELLVSHPCMDPTIYGDQNSKIPAEVLDLEGCSLEEAINGRRLFILDYHDVFMPYVRRINETHAKAYATRTILFLKEDGTLNPVAIELSLPHPDGDKSGAISDVILPAKGRCRKHNLATSQSLCHINDSCYHHLMSHWLNTHAVIEPFVIATNRQLSVIHPIYKLLSPHYRDTMNINALARQNLINSDGIIERTFLPSKFSVEMSSAVYKNWVFTDQALPADLIKRGMAVEDSSSPYGIRLVIEDYPYAVDGLEIWFAIKEWVQDYVSLYYPTDNDLKKDPELQNWWKEAVEVGHGDLKDKPWWPKMQTVEELVESCTTIIWTASALHAAVNFGQYPYGGLILNRPTLSRRLLPEQGTAEYEEMVKSHQKAYLRTITPKLETLIDLTTIEILSKHASDEVYLGERDNPHWTFDSRALEAFQRFGNKLSEIEEKLTEKNKDGRLSNRIGPVELPYTLLHPTSNEGLTFRGVPNSISI

SEQ ID NO: 52163 - protein, 118 aa, Salvia columbariae
DLKPENVLVRDDGHIMLSDFDLSLRCAVSPTLIRNSALNSDRGSGFCVQPACIEPTSACIQPTCFLPRLFPQKSKKKSGKSRTEAGMLSGGTLPELVAEPTAARSMSFVGTHEYLAPE

SEQ ID NO: 52164 - protein, 109 aa, Salvia columbariae
DLKPENVLVREDGHIMLSDFDLALRCVVSPTLITTSALHSHPSKQRARFCAQPSSACIQPSCFLPRIFHQRSKKRSGKTPSGTLPELVAEPTAARSMSFVGTHEYLAPE

SEQ ID NO: 52165 - protein, 351 aa, uncultured bacterium
IGAAHNLLAALIDNHMHWENQLNVDPRRVTWRRVVDMNDRALRSITSGLGGFHNGVVREAGFDITVASEIMAIFCLATDLKDLENRLGNIVFGYTRKNEPVTVRELNAQGAMTALLKDALQPNLVQTMENNPAFMHGGPFANIAHGCNSVMATTTALKLADYVVTEAGFGADLGAEKFFDIKCRKAGLTPAAAVIVATVRALKMHGGIAKADLGKENVEAVKQGCANLARHLENVKKFGVPPVVAINQFITDTDAELEAVRSTAEGLGAKAIICSHWADGGAGAEELANHVVDLVDSGQAEFKPLYPDEMPLVDKVRTIVQEIYGGDDISYDSAVEKRFEELQKDYGHFPV

SEQ ID NO: 52166 - protein, 118 aa, Salvia columbariae
DLKPENVLVREEGHIMLSDFDLSLRCSVSPTLVKSSSTHDASTADAAANGSILNDENAVRGCAQPSSFFPRLLPKKNRKSKSDFGLGNNMNGLPELMAEPTNVRSMSFVGTHEYLAPE

SEQ ID NO: 52167 - protein, 351 aa, uncultured bacterium
IGIAHNLLSAMIDNHIYWGLDPQIDSRRVAWKRVVDMNDRALRNIVNSLGGVANGFPREDGFDIVVASEIMAIFCLSKDLNDLTNRLGKIVIAQDRARNSITAKDVKGPGPMSVLLKEAVAPNLVQTLENNPAFVHGGPFANIAHGCNSVIATKTALKLCDYVVTEAGFGADLGAEKFFDIKCRKAGLTPAAAVIVATVRALKMHGGIAKADLGKENVEAVKQGCANLARHLENVKKFGVTPVVAINQFITDTDAELEAVRSTAEGLGAKAIICSHWADGGAGAEELANHVVDLVDSGQAEFKPLYPDEMPLVDKVRTIVQEIYGGDDISYDSAVEKRFEELQKDYGHFPV

SEQ ID NO: 52168 - protein, 379 aa, Glycine max
MSSTAGQVIKCKAVSWEAGKPLVIEEVEVAPPQAGEVRLKILYTSLCHTDVYFWEAKGQTPLFPRIFGHEAGGIVESVGEGVTHLKPGDHALPVFTGECGDCPHCKSEESNMCDLLRINTDRGVMIHDSQTRFSIKGQPIYHFVGTSTFSEYTVVHAGCVAKVNPAAPLDKICVLSCGICTGLGATINVAKPKPGSSVAIFGLGAVGLAAAEGARISGASRIIGVDLVSSRFEEAKKFGVNEFVNPKDHDKPVQEVIAAMTNGGVDRAVECTGSIQAMISAFECVHDGWGVAVLVGVPNKDDAFKTHPVNFLNERTLKGTFYGNYKPRTDLPSVVEKYMNGELELEKFITHTVPFSEINKAFDYMLKGESIRCIIRMGE

SEQ ID NO: 52169 - protein, 351 aa, uncultured bacterium
IGIAHNLLSAMIDNHIYWGLDPQIDSRRVAWKRVVDMNDRALRNIVNSLGGVANGFPREDGFDIVVASEIMAIFCLSKDLNDLTNRLGKIVIAQDRARNSITAKDVKGPGPMSVLLKEAVAPNLVQTLENNPAFVHGGPFANIAHGCNSVIATKTALKLCDYVVTEAGFGADLGAEKFFDIKCRKAGPTPAAAVIVATVRALKMHGGIAKADLGKENVEAVKQGCANLARHLENVKKFGVPPVVAINQFITDTDAELEAVRSTAEGLGAKAIICSHWADGGAGAEELANHVVDLVDSGQAEFKPLYPDEMPLVDKVRTIVQEIYGGDDISYDSAVEKRFEELQKDYGHFPV

SEQ ID NO: 52170 - protein, 156 aa, Glycine max
MGCPANGKSGLGMLNDNGRNLVPLVGPPTSACKRIPNLAQIYLLGFYEEREFALYVSSISNELKVPVRYLKEDRPHGSAGGLYHFRDLIMEEDPSHIFLLNCDVCCSFPLPEMLDAHKRYGGMGTILVVKVSAESASEFGELVADPTTNELLHYTE

SEQ ID NO: 52171 - protein, 748 aa, Yersinia pseudotuberculosis IP 32953
MLMRLREVVEKVAMATGLTEALELLVNETCLAMDTEVCSIYLADNDRRCYYLMATRGLKKPRGRTITLAFDEGIVGLVGRLAEPINLADAQSHPSFKYVPLVKEERYRAFLGVPIIYRRQLLGVLVVQQREHRQFDESEESFMVTLATQLAGILSQSQLNAIFGQYRQTRIRALAAAPGVAVAEGWQDISQPSLDLVYEASTLDSTLERERLTQALEEAAAEFRRFSKRFAASSQKESAAIFDLYSHLLNDARLKRELFAQIDAGAVAEWAVKQVVEAFAAQFASLQDTYMRERASDLRALGQRLLFHLDDSTSGASQWPERFILVADELTATLLAEVPQDRLAGVVVRDGAANSHAAILVRAMGIPTVMGADIQPALLSQRLLIVDGYRGEVLVDPEPVLVKEYQRLVTEEIELSKLAEDDVEQPAALKSGERIQVMLNAGLSPEHEQLLGGRVDGVGLYRTEIPFMLQSGFPSEEEQVAQYQGMLQLYPQKPVTLRTLDIGADKQLPYMPISEENPCLGWRGIRITLDQPEIFLIQVRAMLRANAGTGNLGILLPMITSIEEVDEAKRLIDRAGREVEEMLGYVLPQPRLGVMIEVPSMIFMLPYLTSRVDFISVGTNDLTQYLLAVDRNNTRVASLYDSLHPAMLQVLRQILMQATESGLQVSLCGEMAGDPMGALLLVGLGYRNLSMNGRSVARIKYLLRNIELADAQALAARVLTAQMTTDVRHLTAAFMERRGLGGLIRGGK

SEQ ID NO: 52172 - protein, 243 aa, Gibberella zeae PH-1
MARNSEKAQSMLFRFREAQAADLGIIDAGRTRRPKLITEVTTIPACEKWRGQVLKEISRKMSRIQEPILSDYQIRDLNDEINKLMREKHMWEIQIRNLGGPNYMRGGGKIYDDQGREIPGSGKGYKYFGRARELPGVKELFEAAKNQGDEKPLEERHDMRRNVDAAYYGYAPDEEDEELLAYEAEKERQAVDHMLKTGPRDVPDGWEALPGDTGDGNTWVLPTLEEVQEELIERRRRKLLEQL

SEQ ID NO: 52173 - protein, 1361 aa, Aspergillus oryzae
MDTPSSGTVDLERGGGAIRKRLTLTFRNLNVRVTAPDAALGDTLLSYADPRQLLDVFRKSRGNKRTILKDINGQVKPGEMLLVLGRPGAGCTSFLRVLSNDRDSFDEVSGETRYGSMDHKEARKFRQQIMFNNEDDIHFPTLTVNRTMKFALKNKVPRERPEHLQEKKEYIQGTRDGILESLGIAHTKKTLVGNEFIRGVSGGERKRVSLAEVMAGQSPVQFWDNPTRGLDSKTAVEFARLLRREADQNDKTMVATMYQAGNAIYDEFDKILVLAEGRVIYYGPRTMARAYFEDMGFIVPKGANIADFLTSVTVITERIVQPGLEGKVPSTPEEFESRFLASDINTQMLDAIEPPEKLTHEKDDLVMAVANEKKKKHLPRPQSVYTTSLWDQIYACTVRQFQIMAGDKLSLAIKVVSAILQALVCGSIFYNLKLDSSSIFLRPGTLFFPCLYFLLEGLSETTGAFMGRPILSRQKRFGFYRPTAFCIANAITDIPVVIVQISCFSLILYFMSALQMDAGKFFTYWIMLIALTLCYMQLFRAVGALCRKFGLASMISGFLSTIFFVYGGYLIPFEKMHVWFRWIFYLNPGSYAFEALMANEFTGLKLDCIEPDYIPYGAGYPDSSSAYRGCSVLGSDENGLIDGAAYIREQYHYSHGHIWRSFGVIIGMWAFFIFLTSVGFEKLNSQGGSSVLLYKRGSQKKRTPDMEKGQQNMSQPAANTGALANTAKQSTFTWNNLDYHVPFHGEKKQLLNQVFGYVKPGNLVALMGCSGAGKTTLLDVLAQRKDSGEIYGSILIDGRPQGISFQRTTGYCEQMDVHEASATVREALEFSALLRQPASVPREEKLAYVDHIIDLLELSDISDALIGIPGAGLSIEQRKRVTLGVELVAKPTLLFLDEPTSGLDGQSAYNIIRFLRKLVDGGQAVLCTIHQPSAVLFDAFDSLLLLAKGGKMTYFGETGQDSAKVLDYFAKNGAPCEPDVNPAEHIVEVIQGNTEKKIDWVEVWNQSEERQRAMTELEALNNDRKANTQEEEDQSDFATSHWFQFKMVLRRLMIQLWRSPDYIWSKIILHVFAALFSGFTFWKMGNGTFDLQLRLFAIFNFVFVAPACINQMQPFFLHNRDIFETREKKSKTYHWLAFIGAQAVSEIPYLIICATLYFACWYFTAGFPVEASISGHVYLQMIFYEFLYTSIGQAIAAYAPNEYFAAIMNPIILGAGLVSFCGVVVPYSALQPFWRYWMYYLDPFTYLVGGLLGEVLWDVKVECKASELVHFSAPSGQTCGQYMADFLSEQAGYLLDPNSTSSCSFCQYSTGADYAKTFNLKEKYYSWRDTGISALFCISSYALVFLMMKLRSKKTKSARSE

SEQ ID NO: 52174 - protein, 379 aa, Gluconobacter oxydans 621H
MTPKITRFLAEQQPATPCLVVDLDVVGAHYRALHDALPEAKIYYAIKANPAPAILDRLVALGSSFDVASPAEIRMCLDAGATPDRISYGNTLKKAEWIREAHDLGISLFVFDSIEELEKLAKHAPGARVFCRLAVENEGADWPLSRKFGTTLSNARALMLRARDLGLKPYGLSFHVGSQQTGVAAYDHAIAKAAGLYHDLRAQGVDLQMLNLGGGFPTHYRENVPSVQDFADTIHASLRTHFPDGAPEILLEPGRYMVGQSGVVSSEVILVSRRGGAVTDPRWVYLDIGRFGGLAETEGEAIRYTFRTSRDSDDATCSPCVLAGPSCDGVDIMYEKNRIPLPDSLECGDRVEILATGAYVSTYASVGFNGFPPLTEYYI

SEQ ID NO: 52175 - protein, 839 aa, Pseudomonas fluorescens Pf-5
MPEFAPATHPAPDSATPLEAIIIGSGFGGLGMAIALRKAGVHRFVILEKGQDVGGVWRDNSYPGAACDVPSHLYSFSFEPNPHWSRVFAPQAEIHGYLQHCAGVYELKPHIRFGAEVRHAEFDTANACWHVTCADGQRHAARLLISATGQLSRPALPDLPGMASFRGRVFHSAHWDHDYPLAGKRVAVIGTGASAIQFVPEVARQVAELKVFQRSPAYIMPKADRPYSAEEKQRFLRQPWKMKLVRAAHYLHFESRALGFTRLQGLTKWVVGGPFKKLLHTSVASPELRRQMTPDYPIGCKRILLSNDYLKTFDQPHVHLLTRGIRQITEHGIETLDGEEHAVDAIIYGTGFAATEFLSPMRITGRDGLDLNQAWQGGAAAYLGISVPGFPNFFMLYGPNTNLGHNSIIHMLESQISHVMQARQALLDSGASHVEVDEQRHQRFQLGIQRRLATSVWSGCKSWYVDERGHNSTNWPGFTWSYRWLARYAGLAAYRLSSPLDTQSPACDGQRIAAPRDWLERANAAFLRVFLRVSFRALIGPPRPLASQRKIVDRLSWLMPGCLGVNRRSMQLDGLSLQIVEPGTRAPKGVILYLHGGAFCLGSPRSHYSVTSRLARDSGCAVWVPDYRLAPEHPYPAALEDCLACYDAIRAQLCPADKLLIAGDSAGGALVLALALSLKERGDEIAAGLMLLSPVTDPDLGGASMQSRQEADPMIRRDWLEQALKAYAAPVQALSHRPLEADLRGLPPMLIQVGDQELLLSDSTRLAERARQSGVACQLEIHQGRWHVFQLQAFYLRSARNALLGLARFARQCLETAGQTPQAADSPRTTQPATDPQPS

SEQ ID NO: 52176 - protein, 420 aa, Yersinia pseudotuberculosis IP 32953
MPRALNDRSSALTAQNLIALPERFGCPVWAYDGDIIAERINQLRHFDVIRFAQKACSNIHILRLMREQGVKVDSVSLGEIERALHAGYQPGQEPAEIVFTADLLDQATLLRVTELNIPVNAGSIDMLDQLGQQAPGHPVWLRVNPGFGHGHSQKTNTGGENSKHGIWHEELPRALKKIEHYGLTLVGIHMHIGSGVDYQHLEQVCDAMVQQVITLGHDISAISAGGGLSIPYQFGDDVIDTEHYYGLWNSARERIAAHLGHPVSLEIEPGRFLVAESGVLIAQVRAVKDMGRRHYVLVDAGFNDLMRPAMYGSYHHISLLPADGRDLASAPLIDTVVAGPLCESGDVFTQQEGGGVETLALPAAVIGDYLVFHDTGAYGASMSSNYNSRPLLPEVLFEKGQPRLIRRRQTIEELIDLERV

SEQ ID NO: 52177 - protein, 341 aa, Synechococcus sp. RS9916
MTLRVAINGFGRIGRNVMRGWISRGADTGIEIVGVNATSDPKTSAHLLTYDSILGKLDPSVKIETTDDSMIVNGKQVKFFSDRNPLNCPWKDWGVDLVLESTGVFNTDEKASMHIQAGAKKVILTAPGKGPKVGTFVVGVNEDQYRHEDWDILSNASCTTNCLAPLVKVIDQSIGINRGLMTTIHSYTGDQRILDNNHRDLRRARAAAVNMVPTSTGAAQAVALVYPAVKGKFTGIAMRVPTPNVSAVDLVFESSRASSVDEIKSIIKGAADGAMSKIIKYGDLPLVSSDYAGTNQSTIFDADLTLSMGDNFFKIVAWYDNEWGYSQRVVDLAEVVARNWK

SEQ ID NO: 52178 - protein, 418 aa, Neisseria meningitidis Z2491
MANKLRNYTINFGPQHPAAHGVLRMILELDGEQIVRADPHIGLLHRGTEKLAETKTYLQALPYMDRLDYVSMMVNEQAYCLAVEKLAGIDVPIRAQYIRVMFAEVTRILNHLMGIGSHAFDIGAMTAILYAFRDREELMDLYEAVSGARMHAAYFRPGGVYRDLPDFMPKYESSKFRNAKVLKQLNESREGTMLDFIDAFCERFPKNIDTLETLLTDNRIWKQRTVGIGVVSPERAMQKGFTGVMLRGSGVEWDVRKTQPYEVYDKMDFDIPVGVNGDCYDRYLCRMEEMRQSVRIIKQCSEWLRVNPGPVITTNHKFAPPKRTEMKTGMEDLIHHFKLFTEGMHVPEGETYTAVEHPKGEFGVYIISDGANKPYRLKIRAPGFAHLQGMDEMAKGHMLADVVAIIGTQDIVFGEVDR

SEQ ID NO: 52179 - protein, 224 aa, Solanum chmielewskii
FLMQKELDYLVGAVSNPQKPFAAIVGGSKVSSKIGVIESLLEKVDVLLLGGGMIFTFYKAQGYAVGSSLVEEDKLELATSLMEKAKTKGVSLLLPTNVVIADKFAADANSKIVPASEIPDGWMGLDIGPDAIKSFGSALDTTKTIIWNGPMGVFEFDKFAAGTEAIAKKLAELSGKGVTTIIGGGDSVAAVEKVGLAEKMSHISTGGGASLELLEGKQLPGVLA

SEQ ID NO: 52180 - protein, 325 aa, Oceanobacillus iheyensis HTE831
MAQMTMIQAITDAMRVELKNDENVLVFGEDVGQNGGVFRATEGLQDEFGEDRVFDTPLAESGIGGLAIGLALEGFRPVPEIQFFGFVYEVMDSISGQMARMRYRSGGHYNAPITVRAPFGGGVHTPELHADSLEGLMAQQPGLKVVIPSTPYEAKGLLISAIRDNDPVVFLEHMKLYRSFRGEVPEEDYTVEIGKADVKREGSDVTLVSYGAMVHSSLKAAEELEKDGIQAEVIDLRTVSPIDYETILASVKKTNRVVVVQEAQRQAGVAGQVISEIQERAILDLEAPILRVSAPDTVYSFSDAEETWLPNHNDIVEKVNEVINF

SEQ ID NO: 52181 - protein, 139 aa, Brassica napus
PRVRPRVRLRVRKEASEIPEPCVVALENGEETDEKSSKKKKKIGFATFATGIVHGLQPDALMMVLPALALPSRVAGAAFLIMFLLGTVIAMGSYTVFIGSCSEALKEKVPRITEKLTWASSLVAIGLGLANIVSQFFGF

SEQ ID NO: 52182 - protein, 352 aa, uncultured bacterium
ITSANNLLAAMIDNHIAWGNDLDLDPRRVGWRRVIDMNDRALRSITSGLGGFHNGVVREAGFDITVASEIMAIFCLATDLKDLENRLGNIVFGYTRKNEPVTVRELNAQGAMTALLKDALQPNLVQTMENNPAFMHGGPFANIAHGCNSVMATTTALKLADYVVTEAGFGADLGAEKFFDIKCRKASLKPDAVVLVATIKALKMHGGVAKDQLGKENVKALEAGLKNLGKHLRNLSTFGVPAVVAINHFTADTAAEIAAVTKYCENFGVSAVECTHWADGGAGAEALARKVAELADSGAAQFRTLYADDLPLWDKAKRIATTIYGADDIIADKKVRQQLAQFEKEGYGHYPV

SEQ ID NO: 52183 - protein, 577 aa, Arabidopsis thaliana
MCGILAVLGCVDNSQAKRSRIIELSRRLRHRGPDWSGLHCYEDCYLAHERLAIVDPTSGDQPLYNEDKTIAVTVNGEIYNHKALRENLKSHQFRTGSDCEVIAHLVKHGEEFVDMLDGMFAFVLLDTRDKSFIAARDAIGITPLYIGWGLDGSVWFASEMKALSDDCEQFMCFPPGHIYSSKQGGLRRWYNPPWFSEVVPSTPYDPLVVRNTFEKAVIKRLMTDVPFGVLLSGGLDSSLVASVALRHLEKSEAACQWGSKLHTFCIGLKGSPDLKAGREVADYLGTRHHELHFTVQDGIDAIEEVIYHVETYDVTTIRASTPMFLMSRKIKSLGVKMVLSGEGSDEIFGGYLYFHKAPNKKEFHEETCRKIKALHQYDCLRANKSTSAWGVEARVPFLDKEFINVAMSIDPEWKMIRPDLGRIEKWVLRNAFDDEKNPYLPKHILYRQKEQFSDGVGYSWIDGLKDHANKHVSETMLMNASFVFPDNTPLTKEAYYYRTIFEKFFPKSAARATVPGGPSVACSTAKAVEWDAAWSQNLDPSGRAALGVHVSAYGEDKTEDSRPEKLQKLAEKTPAIV

SEQ ID NO: 52184 - protein, 60 aa, Glycine max
  misc_feature (20)..(20): Xaa can be any naturally occurring amino acid
AFRKLPNMFHLWQHVAGMGXGPVCAHQLLKWEAQGEQDLAKMLPKAKAANERRDIHGDDE

SEQ ID NO: 52185 - protein, 355 aa, Zea mays
MPRPPLSRPATPGPGRPCRGRPCVSRRRALAAPPLRAVATGARIARFPLRRQHPPPLINPTRKKKPAAEKRSRRDRELQSTPPPQPPTMDPKMTEVTQMFARFKAAYARNDLNTCVTLLSQLKVHLTQFPSLPPLFQQTPNIVEELKLARDIYEHAVVLSVKLEDQDAFERDFCQLKPYYMDTCGIIPASPEEYPILGLNLLRLLVQNRIAEFHTELGALPAKALEHPCIKHAVELEQSFMEGAYNRVLSARQAVPHETYVYFIDLLAKTVRDEIAGCSEKGYDSLSVSDAKQMLMFSSDQDLHEYITEEHPEWEIKNGAVFFQKAKESQPCKEIPSLQLINQTLSYARELERIV

SEQ ID NO: 52186 - protein, 240 aa, Urochloa panicoides
MSALAIRSAPSSIIASVRTPAHRRPGLVRNAAATTAELTMDPVERLQSGFKQFKSEVYDKKPELFEPLKEGQAPTYMVFACSDSRCCPSVTLGLKPGEAFTVRNIAAMVPPYDKNRYTGIGSAIEYAVCALKVKVLTVIGHSRCGGIKALLSMQDGAADNFHFVEDWVRIGFLAKKKVLTDHPMAPFDDQCSILEKEAVNVSLYNLLTYPWVKEGVSNGSLKLVGGHYDFVKGAFVTWEK

SEQ ID NO: 52187 - protein, 436 aa, Zea mays
  misc_feature (21)..(21): Xaa can be any naturally occurring amino acid
  misc_feature (133)..(133): Xaa can be any naturally occurring amino acid
MATAVSGRWTSVRTLGRGASXGAVVSLAADAASGALFAVKSAPAGAAEQLRREGSILSSLRSPHVVPCLGHRPAADGGWQLLLEFAPGGSLADVAARSGGGRIGDERAVAAYAADVARGLAYLHGRSVVHGDXKARNVVVGADGRAKLADFGCARAVGSGRPVGGTPAFMAPEVARGEEQGPAADVWALGCTVVEMATGRAPWSDVDSLPAAVHRIGYTDAVPDAPGWMSAEAKDFLARCFARNPRDRWTAAQLLEHPFLASAGRGVKAEEDAAASPTSTLDAAVWEPDSDDEGDASESPAQRIKALACPCSVLPDWDSEEGDWIEVLDEQCEATNLVPVPTKEAAGDDECQLPSVALETGVDFIDADAEGEDPGCCVAVGYDPGCCVAVGLTTALSVGLLEEQCMGDYSNPTVFFAYSIEISKTSLLRKKKKKST

SEQ ID NO: 52188 - protein, 353 aa, uncultured bacterium
IGAAHNLLSALIDNHIHWGNDKALDARRIVWRRVVDMNDRALRDVVLSLGGVANGFPRQSGFDITVASEVMAIFCLATDLEDLQARLGKVVVGYTRDREPVYARDLDADGAMSVLLKDALNPNLVQTLENNPAIIHGGPFANIAHGCNSVIATKTALKLADYVITEAGFGADLGAEKFFDIKCRKAGLKPDAAVIVATIRALKMHGGVARDALGAEDVDAVKAGLENLGRHIRNVGQFGVPALVAVNRFTSDSDAEVAAVRDFCAGLGVDAHECTHWADGGAGTEGLAEAVAAVADAGRSQFRPLYDDDMTLWEKTRTVARSIYGADDIIADKRVRDIVRPVLRNVGFGSYPV

SEQ ID NO: 52189 - protein, 337 aa, Burkholderia sp. 383
MSIARRTTLSKFLIEQQRETNNLPADLRLLIEVVARACKAISYNVSKGALGEALGTAGSENVQGEVQKKLDILSNEILLDANEWGGNLAAMASEEMETFFPIPANYPRGEYLLVFDPLDGSSNIDVNVSIGTIFSVLRCPDGKQATEESFLQPGTQQVAAGYAVYGPQTVFVLTTGNGVNCFTLDREVGSWVLTQSNMQIPADTREYAINASNARHWYDPVKRYVDELNAGKDGPRGDNFNMRWIASMVSDVHRILNRGGVFMYPADKRTPDRPGKLRLMYEANPMSFIVEQAGGAATTGTQRIMEVQPTGLHQRVPVFLGSKNEVDRVTGYHQEKQ

SEQ ID NO: 52190 - protein, 215 aa, Urochloa panicoides
MSGCLCLPGYKKKTMDPVERLQSGFKQFKSEVYDKKPELFEPLKEGQAPTYMVFACSDSRCCPSVTLGLKPGEAFTVRNIAAMVPPYDKNRYTGIGSAIEYAVCALKVKVLTVIGHSRCGGIKALLSMQDGAADNFHFVEDWVRIGFLAKKKVLTDHPMAPFDDQCSILEKEAVNVSLYNLLTYPWVKEGVSNGSLKLVGGHYDFVKGAFVTWEK

SEQ ID NO: 52191 - protein, 124 aa, Glycine max
SADAQRTDLMTITRFVLNQQSNHPESRGDFSILLSHIVLGCKFLCSAVNKAGLARLFGLAGVTGVQGEEQKKLDVLSNDVFIKALVSSGRTCILVSEEDEEATFVEASKRGKLLPIYSLVVFLP

SEQ ID NO: 52192 - protein, 352 aa, uncultured bacterium
IGAAHNLLAALIDNHMHWENQLNVDPRRVTWRRVVDMNDRALRSITSGLGGFHNGVVREAGFGITVASEIMAIFCLATDLKDLENRLGNIVFGYTRKNEPVTVRELNAQGAMTALLKDALQPNLVQTMENNPAFMHGGPFANIAHGCNSVMATTTALKLADYVVTEAGFGADLGAEKFFGIKCRKASLKPDAVVLVATIKALKMHGGVAKDQLGKENVKALEAGLKNLGKHLRNLSTFGVPAVVAINHFTADTAAEIAAVTKYCENFGVSAVECTHWADGGAGAEALARKVAELADSGAAQFRTLYADDLPLWDKAKRIATTIYGADDIIADKKVRQQLAQFEKEGYGHYPV

SEQ ID NO: 52193 - protein, 360 aa, Oryza sativa (japonica cultivar-group)
MEVENEGNSTHSRTQVDIFRDAAGLMVNYVDEIRAQGFELEYLNIGGGLGIDYHHTDAVLPTPMDLINTVRELVLSRDLTLIIEPGRSLIANTCCFVNRVTGVKSNGTKNFIVVDGSMAELIRPSLYGAYQHIELVSPSPDAEVATFDIVGPVCESADFLGKDRELPTPDKGAGLVVHDAGAYCMSMASTYNLKLRPPEYWRRWGGADTHTTSFDHVLVIDTVEFDPFTAITGKVVISKSYLKTFWLHSNKKFPALLTTSGGYNLQEHVQLPDNNPLMIFPEGTCVNNRYTVMFKKAAFELGCIVCPIAIKYNKEFTDTFWDIELFRLMTSWGVVCDVWFLDPQQIMPGETAIELALHLK

SEQ ID NO: 52194 - protein, 349 aa, Nostoc sp. PCC 7120; identical to SEQ ID NO: 1384

SEQ ID NO: 52195 - protein, 200 aa, Oryza sativa (japonica cultivar-group)
MGHLYCEGVRVEDAMGAAERTPFYLYSKPQVVRNFTAYRDALEGLRSIVGYAVKANNNLRVLQLLRELGCGAVLVSGNELRLALRAGFDPTRCIFNGNGKTLEDLVLAAESGVFVNIDSEFDLENIVTAARVAGKKVPVLLRINPDVDPQVHPYVATGNKTSKFGIRNEKLQWFLDSIKSYSNDITLVGVHCHLGSTITK

SEQ ID NO: 52196 - protein, 194 aa, Sulfolobus tokodaii str. 7
MSTRSVRKIRETKETKIELYLDIDKKGEVKVSTPVNFLNHMLSTLFYYMNSTATLIAEDKQNFDDHHVVEDTAIVIGEAFKEALGDKKGIRRFSHQIIPMDDALVLVAVDISGRGVSNIELNLERDEIGGLATENIIHFFQTFSYNSGVNMHIIQLRGWNTHHVIEASFKGLGFSLYEASRIVYEETYSLKGSL

SEQ ID NO: 52197 - protein, 379 aa, Gluconobacter oxydans 621H
MYGRVRSLFLRPESSEDVFPMTPFIIEKTETPTDPVKRTELLANPAFGRVFTDHMALISYSADKGWHDAKITPRRPLSIDPASTVLHYGQEIFEGMKAYREKDGHVATFRPEANASRFAASARRMGMAELPEDLFVQAVDELVRVDQDWVPSGEGQSLYLRPFMISNEVFLGVKPATEYLFIVIACPVGAYFSSGCVSVWVSEHYTRAAIGGTGEAKCGGNYAGSLIAQAEAKDKGCDQVLFLDARERRFVEEMGGMNVMFVRKDGKIVTPPLGGTILRGITRNSLIQLAADQGIEVVEEPVDIDELFSGAASGKYTEAFACGTAAVLSPIGKFMRPTGEAVFGDGKTPGPVSQQLKKALTDVQGGRTNDVHGWIHRIS

SEQ ID NO: 52198 - protein, 124 aa, Calonectria ilicicola
QTARRSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLAR

SEQ ID NO: 52199 - protein, 783 aa, Candida albicans SC5314
MDKIRAVISGGEKPPVDTDNDHNTDFEADRKMPDLDIVVSKSQEFDPVTSHLVNDIMEDEYAAVHVEDDSPYPEVRAAVPSTDDPTLPQNTIRAWVIGLILTTVGCGMNMLFSFHSPSFAITTFVTSILAWPIGNFWAWIVPDWKIFGASLNPGPFNVKEHTIITIMANVSFGTGAAYATDILLAQNMFYKSNFGWGYNLLLIWSTQCIGFAFGGVLRRFVVDSPGAIWPSNLVTATFLTNMHINENHTANGWKISRLAFFVIVFVASFVWYWFPGYIFQALSYFSWITWIKPNNVIINQVFGSSSGLGMIPNNIALDWNQIAGYIGSPLIPPASVIATIFGSIVVIFWIVVPAIHYSNTWYSQYLPISSTGSFDRFQQTYNVSKIIDHKTLSFNEAEYKKYSPLFLSTTFAISYGLSFASILATITHTICFHGRDLIASLKAKEKPDVHNRLMKAYKPVPEWWYLIVFLVFFGMSIATVRAWPTEMPVWGLVFALIIAIIFLLPVAIIYAKTNIAVGLNVVTEFIVGYVLPGRPIAMMLFKTFGYITNNQAVTFVQDMKLGHYMKIDPRTLFWAQFAATIWGSLVQIAVLEWAYGAIDNLCAADQKNHYTCPNGKVFFNASIIWGVIGPQRQFSHGQIYYGLLFFFIIGAVTPVINWLILKKWPNSPVKYLHWPVFFSGTGYIPPATPYNYTSYCAVGLFFGWWIEKKWFHWWSKYNYSLSAGLDIGLAWCSLIIFLCLSLTNTDFPSWWGNDVINTTLDTQVVTNIRHILKEGEAFGPSSW

SEQ ID NO: 52200 - protein, 119 aa, Sulfolobus tokodaii str. 7
MMKLSENEASKLIEKLWFRHTDSTIIAVLQDYKTKEVLMVGHMNREAVFKTLTTGYVHFWSLSRKKLWLKGETSGHFQLVEDFKIDCDGDAMVFLVKSVGPVCHTGNRSCFYRNFSDLI

SEQ ID NO: 52201 - protein, 468 aa, Oceanobacillus iheyensis HTE831
MVVGDFPVEVDTLVVGAGPGGYVAAIRAAQLGQKVTIVDKGALGGVCLNVGCIPSKALIEAGHKYENAHGSEDLGIKTDKVEVDFSKVQDWKGSVVNKLTSGVESLLKGNKVDIVKGEAYFVDANTAKIAGESSSQTYKFKDCIIATGSSPIEIPSFKFSDRVLDSTGALSLKEIPKKMVVIGSGYVGTELGTAYANFGTEITFLEGAKDILGGFEKQMTQLVKKGLKKKGATIITEAMAKGVEETKDGVKVSYEVNGKEETIEADYVLVTVGRRPNTDELGLEQMGVKMTDRGHIEIDKQCKTSVDNIYAIGDIVEGPALAHKASYEGKIAAEAISGEKSEIDYVGIPAVAFTEPELATVGLSEQDAKDAGYDVKVGKFPFGANGRALSLNNTEGFLKLITRKDDGLVIGGQIAGPNASDMISEIGLAIEAGMTAEDISLTIHAHPTLGEITMEAAEVALGTPIHTM

SEQ ID NO: 52202 - protein, 404 aa, Mycobacterium sp. MCS
MRELPHVLGIVLAGGEGKRLYPLTADRAKPAVPFGGAYRLIDFVLSNLVNARYLRICVLTQYKSHSLDRHISQNWRLSGLAGEYITPVPAQQRLGPRWYTGSADAIYQSMNLIYDEDPDYIVVFGADHVYRMDPEQMVQFHIESGAGATVAGIRVPRAEATAFGVIDADESGRIRSFVEKPADPPGTPDNPDEAFVSMGNYIFTTKVLIDAIRADADDDDSDHDMGGDIIPRLVSDGMAAVYDFSNNEVPGATERDHGYWRDVGTLDAFYDAHMDLVSVHPIFNLYNKRWPIRGESENLAPAKFVNGGSAQESVVGAGSIISAASVRNSVLSSNVYIDDGAIVEGSVIMPGTRIGRGAVVRHAILDKNVVVGPGEMVGVDLEKDRERFSVSAGGVVAVGKGIWI

SEQ ID NO: 52203 - protein, 345 aa, Zea mays
METAEPARVQALAEAGVFRLPAQYIQPPEHRPTPSPSPIAAALSVPVVDLSTSTATDAVRAACADWGAFHVVGHGVPGELLDAVRAAGLAFFRAPMEDKLRFACDPARGAASEGYGSRMLANDDSVLDWRDYFDHHTLPESRCDPARWPDFVPGYRDTIAKYSHSMKDLAKKLLCIISENLSLPPSYIQEAVGEVFQNITISYYSPCPQPDLALGLQSHSDMGAITLLIQDDVGGLEVLKDGMWIPVPALRDGILVILADQTEIITNGRYKSSVHRAVVNAERARLSVATFYDPSKSRKICTAPQLVSENEPQKYRDVIYGDYVSSWYSKGPEGKRNIDALLIQH

SEQ ID NO: 52204 - protein, 294 aa, Shewanella sp. MR-4
MINGSIVALITPMNSDGSVDFASLERLVEFHIDQGTDAIVAVGTTGESATLPMNEHVTVVAQTVKFAAGRIPVIGGNGANATSEAIELTKSLSKVGVAAMLGVTPYYNKPTPKGLVAHYKAVAASTDIPQILYNVPGRTAVDMKPETVAELVGVSNIIGVKEATGDVSRVKRLRELCGNDFMLYSGDDATAREFLLLGGNGVISVANNIVPKAFKAMCDAALAGNAELAASIDEPLRGLYTTLFCEANPIPVKWAAHRMGLIECGHIRLPLTELSEQCHGLLLDAMTRAQIEVK

SEQ ID NO: 52205 - protein, 462 aa, Streptococcus suis 89/1591
MSLFRKKQAVGRHSQMRRHLGLVDLIFLGIGSMVGTGIFTVTGLAAAQYAGPALIISIVIAAISVGLTALFYAEFASRIPTNGGAYGYLYSVFGEFPAWIAGWLTIMEFLTAVSSVASGWGAYLKGLLANFGIAMPTALNGTFNPAAGTYVDLLPVLVLIFVVGVVLLNSKAALRFNSALVVLKFSALALFILVGLFFIKPENWSNFSPFGFGAIYGGQAGIMAGASLMFFAFLGFESISLAIDEVKKPEKNVPKGIVLSLSIVTILYIVVTLVLTGMVHYTKLNVADAVAFALREVGLDWAASYISIVAILTLITVCISMTYALSRMVYSISRDGLLPKSLSRLTQTSKVPKNATILVGIFAAICAGIFPLASIASFLNICTLAYLIMLALGIIRLRQVEGLPKDGQFKTPLVPLLPILSIIICLSFMFQYSLDTWLAFGVSVVIGILIYFCYGYRHSEAK

SEQ ID NO: 52206 - protein, 553 aa, Burkholderia mallei ATCC 23344
MTQKFEEGLGRREANYVPLTPIDFIARAAEVYGERLAVVHGEIRRTWSETYARARRLASALERAGVGRGDTVAALLPNIPAMIEAHFGVPMAGAVLNALNTRLDVASMLFMLRHGEAKVLIVDTEYAEFAHRAALEVPGLAIVSVADAMPADPARFPAALDYEAFLAGGDPAYAWTPPSDEWEAIALNYTSGTTGDPKGVVYHHRGAYLAAISNLLEWDMPKHAVYLWTLPMFHCNGWCFPWAVAARAGVNVCLRKFDAKRVLELIRRERVTHYSGAPIVQSAIANAPAEWRAGIAHEVHAFVAGAAPAPAVIAKMKEIGFDLTHVYGLTEVYGPATVCAKQAHWASLPDDELAQLNARQGVRYHLQAGATVLDPDTMAPVPADGETLGEIMFRGNLCMKGYLKNPHATDEAFAGGWFHTGDLGVLTPDGYIRIKDRRKDIIISGGENISSIEVEDALYRHPAVEVAAVVALPDPKWGEVPCAFVELRDGMSATEEEIIAHCRLLLAAYKIPKTVRFGELPKTSTGKIQKFQLRAQVGSSSAIDLVAAARKPG

SEQ ID NO: 52207 - protein, 354 aa, uncultured bacterium
IGAANNLLAAMLDNHIHQGNELNIDPKRITWRRCVDMNDRQLRNIVDGLGKKGDGAVRQDGFDITVASEIMAAFCLASDIVDLKNRMGRIIVAYSVDGTPVKASDINAQGAMAALLKDALKPNLVQTLEGTPAFIHGGPFANIAHGCNSVIATRMAMHFADYVVTEAGFGADLGAEKFLDIKCRMAGLKPDAVVIVATVRALKYNGGVAKADLNNENLEALEKGLPNLLKHVENITKVFKLPAVVAINKFPLDTEAELTLVKSKCQELGANVALSEVWAKGGEGGEELAKEVIRLTEQPSTLEYVYELDAPIKDKITAIAQKIYGADNADFTPAALKEEIENLENLGYGKLPIC

SEQ ID NO: 52208 - protein, 475 aa, Vibrio vulnificus YJ016
MNSLFRQQCYLLGEWRSAPQTMTITNPFNDEVIGTVPNMGEKETQEVIAGADKAFQQFKALTAQERANLLHRWHQLILEHSDELAHIMTLEQGKPLAEAKGEVLYAASFIEWFAEEARRAYGTLVPSHKANAKILVTKEPIGVVAAITPWNFPAAMITRKCGPAFAAGCPVILKPAPDTPFTALALAVLAEKAGFPAGVFNVITGDAVAIGGELTSNKRVRKLSFTGSTPVGKLLMRQSADNIKKLSLELGGNAPFIVFEDADLDAAVEGAMIAKFRNAGQTCVCANRLYVQRSVYTEFCEKLVEKVSALNVGNGFDQGVHLGPLINDAAVAKVVQHVEDAQSKGAHIECGQLPTAGSRLVQPLVLSGVTDEMLVAQEETFGPMAPLFVFDSEEEVLARANNTDFGLAAYFYTQSLSRAWRVSEALEAGIVGVNEGLISTTVAPFGGVKESGLGREGSFLGMDDYMESKYILMGL

SEQ ID NO: 52209 - protein, 352 aa, uncultured bacterium
IGAAHNLLAALIDNHMHWENQLNVDPRRVTWRRVVDMNDRALRSITSGLGGFHNGVVREAGFDITVASEIMAIFCLATDLKDLENRLGNIVFGYTRKNEPVTVRELNAQGAMTALLKDALQPNLVQTMENNPAFMHGGPFANIAHGCNSVMATTTALKLADYVVTEAGFGADLGAEKFFGIKCRKASLKPDAVVLVATIKALKMHGGVAKDQLGKENVKALEAGLKNLGKHLRNLSTFGVPAVVAINHFTADTAAEIAAVTKYCENFGVSAVECTHWADGGAGAEALARKVAELADSGAAQFRTLYADDLPLWDKAKRIATTIYGADDIIADKKVRQQLAQFEKEGYGHYPV

SEQ ID NO: 52210 - protein, 455 aa, Bacillus megaterium
TIKEMPQPKTFGELKNLPLLNTDKPVQALMKIADELGEIFKFEAPGRVTRYLSSQRLIKEACDESRFDKNLSQALKFVRDFAGDGLFTSWTHEKNWKKAHNILLPSFSQQAMKGYHAMMVDIAVQLVQKWERLNADEHIEVPEDMTRLTLDTIGLCGFNYRFNSFYRDQPHPFITSMVRALDEAMNKLQRANPDDPAYDENKRQFQEDIKVMNDLVDKIIADRKASGEQSDDLLTHMLNGKDPETGEPLDDENIRYQIITFLIAGHETTSGLLSFALYFLVKNPHVLQKAAEEAARVLVDPVPSYKQVKQLKYVGMVLNEALRLWPTAPAFSLYAKEDTVLGGEYPLEKGDELMVLIPQLHRDKTIWGDDVEEFRPERFENPSAIPQHAFKPHGNGQRACIGQQFALHEATLVLGMMLKHFDFEDHTNYELDIKETLTLKPEGFVVKAKSKKIPL

SEQ ID NO: 52211 - protein, 239 aa, Oryza sativa
RCSSWFLRSGSHRPSRRRDREVVIRGRLLLLLLPQPQTRDPYHHLLSFSGQDQYHGDDVFGLQYYGGDQVIPAVVPQKSSPTTECSSSVSSMSSSPTATAISSSKSPASVLHEELGYIRFLHDQVQVLSSPYLQRLPPSARVPEQERGTPAAEEQPPALRPSDLRSRGLCLVPISCTEHVAGAGAGTGHGNGADLWSVAAGMAKATATVTAAVERSKEAAAAAATAALLRADRPGQQLA

SEQ ID NO: 52212 - protein, 352 aa, uncultured bacterium
IGAAHNLLAALIDNHMHWENQLNADPRRVTWRRVVDMNDRALRSITSGLGGFHNGVVREAGFDITVASEIMAIFCLATDLKDLENRLGNIVFGYTRKNEPVTVRELNAQGAMTALLKDALQPNLVQTMENNPAFMHGGPFANIAHGCNSVMATTTALKLADYVVTEAGFGADLGAEKFFGIKCRKAGLKPDAVVLVATIKALKMHGGVAKDQLGKENVKALEAGLKNLGKHLRNLSTFGVPAVVAINHFTADTAAEIAAVTKYCENFGVSAVECTHWADGGAGAEALARKVAELADSGAAQFRTLYADDLPLWDKAKRIATTIYGADDIIADKKVRQQLAQFEKEGYGHYPV

SEQ ID NO: 52213 - protein, 125 aa, Calonectria ilicicola
KQTARRSTGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLAR

SEQ ID NO: 52214 - protein, 498 aa, Candida albicans SC5314
MIIKDRTEKKNTYKKKYPIIFFGLISSHFLYITYTPMKLYFEAEKFLKPNKGTNGSLQSRIFNDKRLTNSPKHIFALVYSTLKYKEYIDVIVKKSKIQHDLQIKKVKMSNELLCLLVHDLLFSSKGRIQSGKHPMKDAFLSNKTRLQAEFTKLKLKYKVKSVDQLPTKEADDDETPIRWFRINTIKIDIDRFYTKHPFFKQLQPVSSIDEITETGIIYSDDYIPNLFGVHPREKITSTEAYRLGEIIIQDRASCFPSHILNADPEDVHTQVIDACAAPGNKTTHAAAHLPNSDSVVYAFERDSKRVKILKTMCEKATGKTKKKLIQVTHADFTTTKPEDFPDVTGLVIDPSCSGSGIFGRALEDSHNEEEIENVNTERLNKLAGFQFAIMKHALSFPSARKVVYSTCSIHAQENERVVVDLLSDPEVNRRGWKLADREIVLPKWDRRGFEEEFIKISRDPKECARLAGGCVRANPKEDGGIGFFTACFVRSTEVNHEN

SEQ ID NO: 52215 - protein, 313 aa, Gluconobacter oxydans 621H
MNRSELNSRQRFCVGVEQIFLHPEHTMANYPAPPFNTPHQDHIPGQTSLMTPKPDHGEQSYVGHDRLRGKIAIITGGDSGIGRAVAIAFAREGVDVVLSFLPEEMDDARETESWIRKAGRRALLVPGDLRDRDVCAELVDRTVAEFGQIDILVNNAAFQIERSSLADVSEEEWDKTFDINAGSAFRLSRLALPHMPRGGALIHTVSVNADQPKPKLLAYSATKSAIQNFSGGLAQLLGEKGIRSNVVAPGPIWTPLIPATMDVEHVERFGADTPMKRPGQPAELAGAYVFLASDDARYVSGATIAVTGGTPVI

SEQ ID NO: 52216 - protein, 496 aa, Oryza sativa (indica cultivar-group)
MATAAAASLQYALHGAASASAKPRSAAPGRSVRVAAARRSASADATAESKSGGHEVLLFEALREALIEEMKEDPTVCVFGEDVGHYGGSYKVTKGLAEMFGDLRVLDTPIAENSFAGMGVGAAMKGLRPIVEGMNMGFLLLAYNQISNNCGMLHYTSGGQFKIPIVIRGPGGVGRQLGAEHSQRLESYFQSIPGLQMVACSTPYNAKGLMKAAIRSENPVVLFEHVLLYNLKEKIPDEEYICCLEEAEMVRPGEHVTILTYSRMRYHVMQAAKTLVNKGYDPEVIDIRSLKPFDLHTIGNSIKKTHRVLIVEECMRTGGIGASLRSAIIDNFWDYLDAPIICLLLNHHDMPDLFSLHGGRGICSRHRIADPTVVIEAIALFIMDICPESRCVAAAAAAYPIHGHEAMITIHRPTGRCREQLPSVGDDGHQWGSSSSWRQEAVEDRAKISCRCRDMPAQLMLLMAMASNGHEGFTHEEEGQRKKTINLVSDLHGIIL

SEQ ID NO: 52217 - protein, 124 aa, Calonectria ilicicola
QTARRSSGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQLAR

SEQ ID NO: 52218 - protein, 134 aa, Polaromonas sp. JS666
MGNKLYVGNLPYTVRDEDLQQSFGAFGSITSAKVMMERDTGRSKGFGFVEMGSDAEAQAAIAGMNGQSLGGRSITVNEARPMEARPPRTGGFGGGGGYGGGGDRSGGGGYGGGGGGRSGGGGYGGGSGGGRGGY

SEQ ID NO: 52219 - protein, 116 aa, Cylindrocladium pseudonaviculatum
TGGKAPRKQLASKAARKSAPSTGGVKKPHRYKPGTVALREIRRYQKSTELLIRKLPFQRLVREIAQDFKSDLRFQSSAIGALQESVESYLVSLFEDTNLCAIHAKRVTIQSKDIQL

SEQ ID NO: 52220 - protein, 248 aa, Salvia miltiorrhiza
TRHSSLKMSEELKYTSHETAKPANEPCETATPVAVESTDRGLFGFGAKKEEEKCQETAISAEFEEKVKVCEEEKKEEAPEEKKHEGFIEKLRRSDSSSSSSDEEEVGEDGLKKKKKKGLKEKVVEKVSGDKEKVSGDKEEEEVKCVDTSVPVEKYDDVVPTQEHEEKKGFLDKIKDKLPGGKKTEEVVSAPPPPAPVAHEYGATPEAEGKEKKGFLDKIKEKLPGYHPKTDEEKEKEKEKEKEKEAAC

SEQ ID NO: 52221 - protein, 528 aa, Synechococcus sp. RS9916
MSQTQPDGQRKPAIVILDFGSQYSELIARRVRETEVFSLVLGYSTSAAELREMAPAGIILSGGPSSVYSEGAPLCDPEIWNLGIPVLGVCYGMQLMVQQLGGVVEAATGKAEYGKAPLEVDDPTDLLTNVDSGSTMWMSHGDSVKALPEGFVRLAHTANTPEAAVADHNRRLYGVQFHPEVVHSTCGMALIRNFVYHVCGCEPDWTTDAFIEEAVALVRDQVGDKRVLLALSGGVDSSTLAFLLKKAIGDQLTCMFIDQGFMRKGEPEFLMDFFDRKFNIHVEYINARQRFLAKLNGITDPEEKRKIIGTEFIRVFEEESKRLGPFDYLAQGTLYPDVIESAGTNVDPKTGERVAVKIKSHHNVGGLPKDLQFKLVEPLRKLFKDEVRKVGRNLGLPEEIVRRHPFPGPGLAIRILGEVTDEKLDCLRDADLIVREEIKEAGLYHDIWQAFAVLLPVRSVGVMGDKRTYAWPIVLRCVSSEDGMTADWSRLPADLLETISNRIVNEVKGVNRVVLDITSKPPGTIEWE

SEQ ID NO: 52222 - protein, 75 aa, Triticum aestivum
  misc_feature (56)..(56): Xaa can be any naturally occurring amino acid
MAFAAGQIKRWKASQHFEDILSRFATSLASAKELLELPCHLRRACIAYAGKLAPLXWYIPRMRDYDKLTRDKIGG

SEQ ID NO: 52223 - protein, 113 aa, Prochlorococcus marinus str. MIT 9515
MTQTTIFSKIINGEIPCEKLYEDELCIAFDDIAAQAPVHFLVIPKKPLVSLYECLEEDKDLLGHLLLVGKNIARSKKLKNWRTVINTGEESGQTVFHLHIHFLAGRKMSWPPG

SEQ ID NO: 52224 - protein, 291 aa, Mycobacterium sp. MCS
MDESAATPEVVVVTGASSGIGEETALRYAGRGARLVLAARTEDALQRVADACRAAGAEAVLVQATDIADAAEVEELFGVAEGHFGRIDIVVQSAAITAFGRFEDVPAGVFDSIVRTNLIGSANVARSALAHFHKRGRGHLVLIGSLLGTAAAPYQSAYVASKFALNGLVRTLRQENRHLSGIKIHGVYPGPVDTPVYGTASNYFGRAPRVPPTAVKPSSVVSAIVRATDRGRSSERQVGVFNRPVIAMYRLAPPVYDVLMGVFLRTFGFTSESTEPTHGNAFARDRHPKAD

SEQ ID NO: 52225 - protein, 685 aa, Gluconobacter oxydans 621H
MSTLPQLAINTIRTLSMEGVERANSGHPGTAMALAPAMYAVWQHDLKYDPADPCWPARDRFVLSVGHASMLLYSTLFLTGVKDIRDGKVVDAPSLTVEDLSQFRQLNSKTPGHPEYRFTAGVETTTGPLGQGCGNSVGMAIAQKWMSARYDRPGFKLFDYHVTVFCGDGDMMEGVASEAASTAGHLALGNLTWIYDSNQISIEGSTDLAFTENVGKRFEAYGWHVQTLTDGNDVDAILAALKAARAVTDRPSLIVLKTVIGYGAPKKAGTASAHGEPLGADEIKGAKQAYGWPEDAPDFYVPDGVKEHFAEGLGKRGAEAHAEWRELFSAYREAHPELAAEIDCIIEHRLPEGWDKDIPTFDADAKGIASRASSGQVLNAVAKNLPWMIGGSADLTPSTKTDIKGGGSFQPEKWNGSYGGRNIHFGVREHAMGSICNGIALSGIRAYGSGFLIFSDYMKAPIRLSAIMELPVLYIFTHDSIGVGEDGPTHQPIEQLAQLRATPGIMTIRPSDANEVAEAWRTLIPMTHKPAVLALSRQNLPTIDRTKYASAAGLAKGGYVLASCEGKPDVILIASGSEVSLVVAAYEKLTEEGIKARVISMPSFDLFEEQSQEYRDSVLPPDVIGRVAVEQAAAFGWDRYVGLGGAIIAMNTFGASAPASALLTKFGFTPEAVYDAAKRQALRGK

SEQ ID NO: 52226 - protein, 177 aa, Glycine max
  misc_feature (10)..(10): Xaa can be any naturally occurring amino acid
  misc_feature (35)..(35): Xaa can be any naturally occurring amino acid
  misc_feature (69)..(70): Xaa can be any naturally occurring amino acid
MPRGSRDPLXVVGRVIGDVLDPFECSIPMRVTYQXKDVSNGCEFKPSQVVNQPRINIGGDDFRNFYTLXXVDPDAPSPSDPNFREYLHWLVTDIPATTGPTFGHEVVTYENPRPMMGIHRIVFVLFRQQGRETVYAPGWRQNFITREFAELYNLGLPVAAVYFNIQRESGCGGRRLC

SEQ ID NO: 52227 - protein, 220 aa, Triticum aestivum
MYAFFWFIFISIVAANIGLQYYLRQGSASQNKASSTDAEFKAFQKNYFVIYWAVMFSDWLQGPYTYALYESYGYSRSEIATLFIIGFGASLVFGTVTGAFADKYGRKRMCMAFGVIYATSCLLKAVNSFTILMFARILAGISTSLLYSVFEAWMVTEHKRRHFPDEWLGDTFSTATFGNGLAAILAGLIASALAAQFGYVAPFMLAMLCLLGVPILIITG

SEQ ID NO: 52228 - protein, 352 aa, uncultured bacterium
IGTAHNLLSALIDNHIYWGSKSALDMRRITWKRVMDMNDRSLRDITIGLGGPGNGFPRQNGFDITVASEIMAIFCLATDLQDLERRIGNIVIGYTRDLKPVHARDVNAPGAMTVLLKDAFMPNLVQTLENNPAFIHGGPFANIAHGCNSVIATKTALKLADYVVTEAGFGADLGAEKFFDIKCRKAGLHPDAVVLVATVRALKMHGGVAKDQLGSENTDAVSRGCENLARHIRNLSQFGVPVTVAINRFVADTEGELDVIRKFCAKFDVKAFDCTHWAEGGKGTEELAKHVADVADSGQAQFHTLYDDDMTLWNKARHIARSLYGADDIIADKKVRDQFAKFEADGYGRYPV

SEQ ID NO: 52229 - protein, 342 aa, Glycine max
MPNDSVLSLFFFVTLFTCLLSATSHDDHIFLPSQLHDDDSVSCTATDPSLNYKPVIGILTHPGDGASGRLSNATGVSYIAASYVKFVESGGARVIPLIYNESPENLNKKLDLVNGVLFTGGWAVSGPYLDTLGNIFKKALERNDAGDHFPVIAFNLGGNLVIRIVSEQTDILEPFTASSLPSSLVLWNEANAKGSLFQRFPSDLLTQLKTDCLVLHNHRYAISPRKLQYNTKLSDFFEILATSGDRDGKTFVSTARGRKYPVTVNLWQPEKNAFEWATSLKAPHTEDAIRVTQSTANFFISEARKSTNTPDAQKVRDSLIYNYKPTFGGTAGKGYDQVYLFE

SEQ ID NO: 52230 - protein, 353 aa, uncultured bacterium
IGAANNLLAALIDNHVYWRQNDETGLDNRRITWRRALDMNDRSLRQITTSLGGVANGAPREAGFDITVASEVMAILCLAKDLKDLERRLGNVIIGFTRDRKPVLAREINAQGAMTALLKDAMKPNLVQTLEGNPAFIHGGPFANIAHGCNTLIATKTALKLADYVVTEAGFGADLGAEKFFDIKCRKGGLKPDAAVLVATIRALKMHGGVAKGDLSQENLDALEKGCVNMERHIRNMKRFGVKVVVGINRFSADTPAEIDLVKKKCASLGVKAVMSDHWAAGGAGAEDLAREVIAAAESGESNFQTLYDDSLTLWNKVQRIATDLYGASEIIADKKVRAQVRDLEADYGHFPV

SEQ ID NO: 52231 - protein, 233 aa, Glycine max
VGLICRNNGNEQIGLDMASLALETEDVISDIYLSLGLKESDKGVGVPRVLSLLSSLLERSVQRNETLLEAKHVKDVVTVFHGLRAPTLSVRKYIDRIFKYSGCSPSCFVVAHIYVDRFIQHTEIKLTSLNVHRLLITSIMLAAKFIDDAFYNNAYYAKVGGVSTSELNRLEMSFLFGIDFRLQFSVDTFGRYCRQLEKEAAEVVQIERPMQACRIKESWSNKDDPTCASTIAR

SEQ ID NO: 52232 - protein, 352 aa, uncultured bacterium
ITSAHNLLSAMIDNHIYWGNELEIDERRIVWRRVMDMNDRALRDIVVSLGGIANGFPRQGGFDITVASEVMAILCLATNLEDLQRRLGDIIVAYRRDHTPIYCRDIEADGAMTVLLQQAMQPNLVQTLENNPAFVHGGPFANIAHGCNSVVATQTALKISDYVVTEAGFGADLGAEKFMNIKCRKAGLAPDVVVLVATVRASKMNGGVARADLGEENVSAVIEGCANMGRHIENLKQFGVPVVVAINHFVTDTEDEVEAIKAYARGHGSEAILCKHWAEGSKGTKELATRVAEIAEAGVSQFAPLYPDDLPLFEKIETIAKRIYRADEVMADKKIRQQLRDWEAADFGNLPV

SEQ ID NO: 52233 - protein, 476 aa, Zea mays
MGKKGKWFGAVKKVFSPESKEKKEERLRRKSAASNPAPVDLTPSTSLEVNVSVPPPPAPPPVPRQTDEVRVPEAEQEQSKHVTLEEAPAAAAAPAQASVLPPGAPTEELAAIKIQTAFRGYLARRALRALRGLVRLKSLVEGNSVKRQSASTLRCMQTLSRVQSQIRSRRAKMSEENQALQRQLLLKQELENFRMGENWDDSTQSKEQIEASLISRQEAAIRRERALAYAFSHQWKSTSRSANPMFVDPNNLQWGWSWLERWMAAKPWEGRNGTDKESNIDRGSVKNMSLNLGVGEGEITKAFNRRDSKPEKPSPPTPKPARPASRQSPSTPSARVAPIPARRKSSTPKNGLSQVDDDVRSVLSVQSERPRRHSIATTSTMRDDESLASSPSLPSYMVPTESARAKSRTATANGAETPEKGGSAGPVKKRLSFQGGAAAASPMRRHSGPPKVESAVKDIAAPPQPEALVANGGGSK

SEQ ID NO: 52234 - protein, 472 aa, Xylella fastidiosa Temecula1
MSCCIANAIRWDVSLLIHRSMSSSMSSVQPTSPVSDSPSLGEMHASVAVSRRGHWGFRLLAFLGPGYMVSVGYMDPGNWATGLAGGSRFGYMLLSVILLSNVMAIVLQALAARLGIASDMDLAQACRARYSRGTNLALWAVCELAIIACDLAEVIGTAIALNLLLGVPIILGAVITAVDVVLVLLLMHRGFRALEAFVIALLLVIFGCFVVQIVLAAPPLQEVLGGFVPRWQVVADPQALYLAIGIVGATVMPHNLYLHSSIVQTRAYPRTPVGRRSALRWAVADSTLALMLALFINASILILAAAVFHAQHHFDVEEIEQAYQLLAPVLGVGVAATLFATALLASGINSTVTATLAGQIVMEGFLRLRLRPWLRRVLTRGLAIVPVIVVVALYGEQGTGRLLLLSQVILSMQLPFAVIPLLRCVADRKVMGALVAPRWLMVVAWLIAGVIVVLNVKLLGDYAVHLMVGVSD

SEQ ID NO: 52235 - protein, 352 aa, uncultured bacterium
IGAAHNLLAALIDNHMHWENELNIDPRRVTWRRVVDMNDRALRSITSGLGGFANGVVREAGFDITVASEIMAIFCLATDLKDLENRLGKIVLGYTRDNEPVTVRELNAHGAMTALLRDAMQPNLVQTMENNPCLMHGGPFANIAHGCNSVMATATGLKLADYVITEAGFGADLGAEKFFNIKCRKAGLSPDAVVLVATIKALKMQGGVAKDALGEENLEALKKGCINLERHMRNLAKFDVPVVVAINRYTADTDAEVETVRAFCEQFGVRAINCTHWADGGKGATDLAEHVARLCDSGTAQFRTLYSDDTSLWEKTATVAREIYGADDIIADKKVREQFALSSGKATASTRS

SEQ ID NO: 52236 - protein, 688 aa, Rhodobacter sphaeroides 2.4.1
MSFALREGRPFPLGATWDGSGTNFAIFSAHARKVELCLFDARGRREIARVALPEYTHEVWHGYLPEVRPGQLYGYRVHGPYEPQAGLRFNPNKLLIDPYALMLQGEVVWHDAVFGYRMGNARADLSFDRRDSAFVMPKCVVVDPAVTWGPDYPPNIPWPETIIYEAHVKGMTAQNAAIPDRVRGSFAALADPRAIEHLVTLGVTAIELMPTQAFFDDRYLIEKGLTNYWGYNTIGFFAPATRYISPGGGVHEFKLMVRRLHEAGIEVILDVVYNHTAEGNHLGPTLSFKGIDNASYYMLGDDPRYYYDTTGCGNTVNLGHQRVLQMVMDSLRYWVEACHVDGFRFDLATSLGRDRQGFNANAVFLDAVRQDPVLSRVKLIAEPWDTGHEGYQLGNFPPGWAEWNDQYRDTVRSYWKGDAGELPGLASQLLGSAGHFDRRGRRPWASVNFITAHDGFTLADTVSYNDKHNAANEEGNRDGHSDNRSWNCGEEGPTEDAEVLDLRDRMRRAMMGTLLISQGTPMLLMGDEVGRSQGGNNNAYCQDNAMNWLKLEGLEPRDAAFLDFTRRLIALRRSRPLLRHPSFLHKAAVGEEPVEVRWLRPDGEEMEPDDWHNPAARTLGLLIRNKPALLALFNSHFEEVPFSLPVRGRGWGLLLDTAAGRVPERPVPQRAAGFVVPPRTLLVLEETE

SEQ ID NO: 52237 - protein, 391 aa, Arabidopsis thaliana
MEILSRLPLKSLARFHCVSKLWASMFGSPYFKNLFLTRSSAKPRLLFALVEKGDVKEESCGVWSFFSSLQLDNLYEESSSTLVAAAEFHGKFSPNNHYLPVLWTCCNSQQESHNNETNQYEVGSSEIPVFGTQRCQESHEKRYASRVAIARKKWAAKEDIVLISAWLNTSKDPVVGNEQKAPAFWKRIASYVAASPDLDGVPKRASAQCKQRWAKMNELVMKFVGCYATTTNQKASGQTENDVMLFANELFKNDMKKKFSLDHAWRLLRHDQKWLISNAPKGKGIAKRRKVRVGTQAASSQPIDLEDDDVMRRPPGVKAAKAKAKMTPTVKGEEVNSVEHLTSLWDLKEKDWDRKDKQSKNQMLESLLSRTEPLSECDLVLKKKLIEELFS

SEQ ID NO: 52238 - protein, 156 aa, Anabaena variabilis ATCC 29413
MQDIGEILDNRVLLVALVACFVAQALKLFVELIKNRKLNVRVLVTTGGMPSAHSALVTSLAAGVGQTLGWASPDFALATVFAIIVMYDAAGVRQAAGKQARILNQMIDELFHEKPDFSQDRLKELLGHTPVQVIAGSALGVTISWLARALFIVHSP

SEQ ID NO: 52239 - protein, 231 aa, Gluconobacter oxydans 621H
MSGTDMNVHKRTAAREAADMVKSGMVVGLGTGSTAAYMIERLGERVAEGLEIFGIPTSDDSEDKALKAGIPLTDFSAHRRIDIAIDGADEVQRGSLNLIKGLGGALLREKIVAQAAKRFVVIVDGTKPVDLLGERAPVPVEVISFGWECTAERLAACGARGVKPRTDRAGSLFVTDTGNMILDCHFGPIEKPEELAEKIDRIVGVVEHGMFLNMASEVLVATPDGVEHWEP

SEQ ID NO: 52240 - protein, 178 aa, Gluconobacter oxydans 621H
MTEHETQMGLKPRFLVVMGVSGTGKTTVATGLATRLGWHFQEGDALHPPANVEKMSTGQPLTDADRAPWLALCHDWLREQVKAGHGAVLTCSALKRSYREQLRGDDLPIEFVHIDTSTGELADRLQRREGHFMPASLLPSQLATLEVPGDDEPVIRVSGEKHPDVVLEELIRHFQAED

SEQ ID NO: 52241 - protein, 556 aa, Streptococcus suis 89/1591
MKTDIEIAQSVTLKPITEIVEKVGISFDDIELYGKYKAKLSFDKINAVKDNAPGKLILVTAINPTPAGEGKSTVTIGLADALSKIGKKTMIALREPSLGPVMGIKGGAAGGGFAQVLPMEDINLHFTGDMHAITTANNALSALIDNHIHQGNAVGIDQRRIIWKRVVDLNDRALRKVTVGLGGPLNGIPREDGFDITVASEIMAILCLATDINDLKERLANIVIGYRFDRSPVYVRDLAVEGALTLILKDAIKPNLVQTIYGTPAFVHGGPFANIAHGCNSVLATTTALRLADYTVTEAGFGADLGAEKFLDIKVPNLPKAPDAVVIVATHRALKMHGGVAKTELSAENVEAVKAGFSNLKRHVENIQKYGIPAVVAINEFVSDTADEIAALKELCAEIGVPVELASVWANGADGGVELAETVVATIENQAANYQRLYKAEDSLEEKVTKIVTQIYGGSGVVFEKKARNQLTEFAKNGWDKLPVCMAKTQYSFSDDQFALGAPTDFDITVREFVPKLGAGFIVALTGDVMTMPGLPKAPAALNMDVAADGTAIGLF

SEQ ID NO: 52242 - protein, 545 aa, Prochlorococcus marinus str. MIT 9515
MTEVKVIHINNPFQDQKPGTSGLRKSTIRFQEEHYLEIFIEAIFKSLKSLQGSTLVVGGDGRYGNIAAIKKIIQICVAHKVRKVIIPKNGLLSTPATSHLIRKEGAIGGIILSASHNPGGLQGDFGVKLNISNGGPAPESLTNQIYQCSQSLKSYKISKIQIPDLDKFGVFSFGETSLAIIDGLKDYSDLMESIFDFDQISDFLKRDFSLIFDAMNAVTGPYAKNIFVEKMGLGDDCLMNGVPLEDFGGLHPDPNLTYASKLADLLLVQKSYSFGAACDGDGDRNMILGQGCFVNPSDSLAVITANSNCIPGYKDGISGVARSMPTSSAVDFVASALNIPCFETPTGWKFFGNLLDSNLITICGEESFGTGSNHVREKDGLWAVLYWLQILAVKNCSVSELMQNHWKQYGRNYYSRHDYEAIPSNVANQIFNNLSSMLPNLKENRFAGNLVKRADNFSYLDPVDNSISKNQGLRIILEDNSRVILRLSGTGTKGSTLRLYFEKFASSEQNLDLNPQIALKTLINDLDHLLNISKLTKMEKPTVIT

SEQ ID NO: 52243 - protein, 950 aa, Shewanella sp. ANA-3
MRLTRKTDQVVEPKVPALGLNRRQFLKSAGLATGGIAAASMLGTGMMRKAQAQEHIPHNAPTEVKRTICSHCAVGCGIYAEVQNGVWTGQEPAFDHPFNQGGHCAKGAALREHGHGEKRLKYPMKLEGGKWKKISWEQAINEVGDKMTAIRQESGPDSIYFMGSAKFSNEQAYLYRKLAALWGTNNVDHSARICHSTTVAGVANTWGYGAQTNSLNDIRNSKCIMFVGSNPSEAHPVAMQHILVAKERGAKIIVVDPRFTRTAAKSDEYVHIRPGTDIPFIYGLLWHIFENGWEDKEFINQRVYGMERIRDEVKKYTPEEVENVAGVPKAQMYRIAKMLAETKPGTIVWCMGGTQHHVGNANTRSYCILQLALGNMGVSGGGTNIFRGHDNVQGATDFGLLFDNLPGYYGLTSGAWAHWSGVWDLDPKWVAGRFDQGEYLGQTPQTSTGIPCSRWHDGVLEDKTKIAQKDNIRLAFFWGQSVNTETRGREVREALNKLDTVVVVDPIPTMAGVMHQRKDGVYLLPAATQFETYGSVSATNRSIQWRSKVIEPLFESLPDHVIMYKLAKKLGIEKEFCKHIQVNGEEPLIEDVTREFNKGMWTVGYTGQSPERLKMHQENWGTFDVNSLTAPGGPAKGEVYGLPWPCWGTPEMKHPGTQILYDQSKEVKDGGGTFRARYGVEHNGVSILADGSFSKGSEIQDGYPEFTADMLKQLGWWDDLTEDEKKLAEGKNWKTDLSGGIQRVAIKHGCIPFGNAKARCIVWTFPDDIPLHREPLYTPRRDLVAKYPTYEDRMVARLPTLYKSIQDKDFTQGFPLTLTSGRLVEYEGGGEESRSNPWLAELQQEMFIEMNPADAADRGIRDGDNVFVHSPEGAKITVKAMVTPRVVPGECFMPYHFAGIFEGENLAKNYPEGTVPYVQGESANTILTYGYDVVTQMQETKSSLCQVSKA

SEQ ID NO: 52244 - protein, 480 aa, Gluconobacter oxydans 621H
MTEKNNLFINGSWVAPKGGEWIKVENPATKAVVAEVAKGGQADVDAAVSAAKSAFIGWSRRTATERADYIHALKDLVKRDKEKLAAIITSEMGKPLKEARIEVDFAIGLLRFSAENVLRLQGEIIPGSSPEEKILIDRVPLGVIGAITAWNFPLALCARKIGPAVAAGNTIVVKPHELTPLACLHLAKLVEEAKIPHGVINVVTGDGKDVGVPLVAHKDIKLITMTGSTPAGKKIMAAASETLKEVRLELGGKAPFMVMEDADIDRAADAAVTARFNNAGQVCTCNERTYIHEAVYDRFVQKVREKIEALKVGLPTDPSTDMGPKVSEDELNKVHEMVEHAVRQGARLAIGGKRLTGGVYDKGYFYAPTLLTDVTQDMDIVHNEVFGPVMSLIRVKDFDQAIAWANDCRYGLSAYLFTNDLSRILRMTRDLEFGEVYVNRPGGEAPQGFHHGYKESGLGGEDGQHGMEAYVQTKTIYLNA

SEQ ID NO: 52245 - protein, 175 aa, Gluconobacter oxydans 621H
MVKVAALATDGLEEIELTGPQEALEKAGATVTVISLKAGEFQAVNKDIYPSNKIRADLAIADAKVEDYDALLLPGGLASPDALRMNKDVVAFARAFVKANKPIAAICHGAQTLIEVNELKGRTVTSWPAIRTDLENAGASWVDNEVVVDGPYVFSRCPDDIPAFNKAIIKHFKLA

SEQ ID NO: 52246 - protein, 454 aa, Shewanella sp. MR-4
MRNLLDLDFDFDSAHIWHPYTSMTRALPVFGVHSAQGCELELVDGRKLIDGTSSWWACVHGYGHPAILTAMERQLQQLSHVMFGGITHEPAITLCKKLLAMTCEPLTKVFLCDSGSIAVEVAIKMALQYWQGQDLPLVQKAQKQRILTVKKGYHGDTFAAMSVCDPEGGMHTMFGEAVTKQCFVDAPQTPFGEPLSQDDLAPMQRILREQHQEIAAVIIEPIMQGAGGMRFYSSDYLRGLRALCDEYNVLLILDEIATGFGRTGKLFAYEHADITPDILCLGKALTGGYISLAATLCTDNVAQGISQSPAGVFMHGPTFMGNPLACAAACASLDLINQQEWPAQVAAIEQQMQRELADANDIPSVKEVRVLGAVGVLEMHQAVNTAALQQQFVDLGVWVRPFANLIYIMPPYVITPAQLTQLTRAMKQVAATITPPQAAQTEALANESITISHG

SEQ ID NO: 52247 - protein, 214 aa, Medicago truncatula
MDAAGEIFRSNLTELMEESPSGAGELHVLAVDDSLVDRKVIERLLKISSCKVTVVESARRALQFLGLDGENSDVAFDAVKVNLIMTDYSMPGMTGYELLKKIKESSVFREIPVVIMSSENVLTRIDRCLEEGAEDFLLKPVKLSDVRRLKDFIMRGEVKDGEKCSLKRMRSSDDCSPCPSLSTTFSPMRHSCDPPSSVFSPLSPSTLSSKKSRL

SEQ ID NO: 52248 - protein, 154 aa, Sesbania rostrata
QKKTKNMGFTDKQEALVNTSYEAFKKNLPGHSVLFYSFILEKEPAAKGLFSFLKDSDGVPQNNPSLQAHAEKVFGLVHDAAAQLRATGVVVLADASLGSVHVQKGVTDPHFVVVKEALLKTLKEAAGATWSDEVSIAWEVAYDGLAAAIKKAMS

SEQ ID NO: 52249 - protein, 148 aa, Sesbania rostrata
GAFTESQEALVTSSYETFKQNASDLSVLFYTFILEKAPGAKNLFSFLKDSDGVPKDNPNLKAHAAKVFELVVDSAVQLRTKGAVVIADANLGPVHVQKGVTDAHFVVVKEALLKTVKEATGAKWSDELSNAWEVAYDELAAAIKKAMG

SEQ ID NO: 52250 - protein, 350 aa, uncultured bacterium
ITSANNLLSALIDNHIYWGNKEGLDPSKVQWRRVMDMNDRALRQIVVALGNNGQTREDGFDISVASEVMAVFCLATSLKNLEERLGNIIIGQRFDKTFAMAKDVLAAPAMTALLRDAFQPNLVQTLEQTPTLIHGGPFANIAHGCNSVIATKTALGMADIVVTEAGFGADLGAEKFLNIKCRQAGLRPDALVLVATVRALKMHGGVAKDQLNAENVEAVRAGLDNMMRHISNLQKFGVPVLVAINKFTADTQAEMDVIHKACEGVGVRAHFCNHWAEGGAGAVTLAEDVVETVASGKADYRPLYPDEMALTDKIRTVAKEIYGAKDIDLAPAAARKLALYEQEGYGKLPV

SEQ ID NO: 52251 - protein, 354 aa, uncultured bacterium
ITTAHNLLAAILDNHLHHGNALGIDSRRITWRRVLDLNERALRAIVCGLGGKANGVPRENGFDITVASEMMAILCLANDLDDMKARIGRIIVAYTYEGKPVTPQDLKVTGALTLLFKDAIKPNLVQTLENTPAFVHGGPFANIAHGCNSVSATKYALKLADYCVTEAGFGADLGAEKFLDIKCRFAGFKPSAVVIVATVRALKYNGGVPKANLNEENLDALKKGISNLLKHVENITQKFKLPAVVALNRFPTDTEAELKLVSEECKALGVNVVLSEVWAKGGEGGIELAKEVLRLIEEGKNEYAPFSYEDDMSIKDKRAIAQKVYGADDVLFADQANKEIDELEKNGFGKTPIC

SEQ ID NO: 52252 - protein, 352 aa, uncultured bacterium
IGAAHNLLAALIDNHMHWENELNIDPRRVTWRRVVDMNDRALRSITSGLGGFANGVVREAGFDITVASEIMAIFCLATDLKDLENRLGKIVLGYTRDNEPVTVRELNAHGAMTALLRDAMQPNLVQTMENNPCLMHGGPFANIAHGCNSVMATATGLKLADYVITEAGFGADLGAEKFFNIKCRKAGLSPDAVVLVATIKALKMQGGVAKDALGEENLEALKKGCINLERHMRNLAKFGVPVVVAINRFTADTDAEVETVRAFCEQFGVRAINCTHWADGGKGATDLAEHVARLCDSGTAQFRTLYSDDTSLWEKTATVAREIYGADDIIADKKVREQFAQFEREGYGKYPI

SEQ ID NO: 52253 - protein, 351 aa, uncultured bacterium
IGAANNLLAAMLDNHINHGNQLGIDSRKITWRRAVDMNDRQLRNMVNGLGGKGNGIPREDGFDITVASEVMAAFCLASDIVDLKERLSKIIVAYTKDDKPVTAGELNAHGAMAALLKDALKPNLVQTPEGTPSFVHGGPFANIAHGCNSVIATKMAMHFASDYVVTEAGFGADLGAEKFLDIKCRMAGLKPDAVIIVATVRALKYNGGVPKDELNNENLEALEAGLPNLLKHVENITQVLPAVVAINAFPTDTAAELSFVEEKCNAMGVEVALSEVWAKGSLGGQVLAEKVLAACEKPSNFSFIYDEQAPIKDKIAAIATKIYGADGVNYTAAAEKTSKELTALGFDKTPI

SEQ ID NO: 52254 - protein, 352 aa, uncultured bacterium
ITSAHNLLSAMIDNHIYWGNKLDIDSRRVTWKRVMDMNDRALREIACSLGGVANGFPREAGFDITVASEVMAILCLALDLEDLQHRLGEIIIGYRRDRSPVYCKDIKADGAMTVLLKDAMQPNLVQTLENNPAFVHGGPFANIAHGCNSVVATTTALKIADFVVTEAGFGADLGAEKFMNIKCRKAGLAPDAVVIVATVRAMKMNGGVKKQDLDQENTKAVFAGCDNLGRHIENIKSFGVPAVVAINHFVTDTDAEVKVIKDYVESLGSEAILCKHWADGSKGTIDLATRVAEIAESGSSQFATLYPDNMPLFQKIETIAKRIYRADEVLADNKIREQLRQWEDAGYGHFPV

SEQ ID NO: 52255 - protein, 538 aa, Cicer arietinum
AAFLSENNDDDDEVLLATAEELGVFVPYVGGVEYASVLLPPLETLCTVEETCVRDKSVESLCRIGAQMREQDLVEHFIPLVKRLASGEWFTARVSSCGLFHIAYPSASEGLKTELRAIYGQLCQDDMPMVRRSAATNLGKFASTVEAAHLKTDIMSVFDDLTQDDQDSVRLLAVEGCAALGKLLEPQDCVAHILPVIVNFSQDKSWRVRYMVANQLYELCEAVGPDSTRAELVPAYVRLLRDNEAEVRIAAAGKVTKFSRILNPELAIQHILPCVKELSTDSSQHVRSALASVIMGMAPVLGKDATIEQLLPIFLSLLKDEFPDVRLNIISKLDQVNQVIGIDLLSQSLLPAIVELAEDRHWRVRLAIIEYIPLLASQLGVGFFDDKLGALCMQWLKDKVYSIRDAAANNVKRLAEEFGPEWAMQHIIPQVLDMINDPHYLYRMTILHAISLLAPVLGSEITSSNLLPLVVNAAKDRVPNIKFNVAKVLQSLIPIVDESVVESTIRPCLVELSEDPDVDVRFFASQALQSSDQVKMSS

SEQ ID NO: 52256 - protein, 378 aa, Anabaena variabilis ATCC 29413
MMVCEYKPGLEGIPAAQSSISYVDGQKGILEYRGIRIEDLAQKSTFLETAYLLIWGELPTKEELQVFEEEVRLHRRIKYRIRDMMKCFPESGHPMDALQASAAALGLFYSRRDLHNPVYIRDAVVRLIATIPTMVAAFQLMRKGNDPVKPRDDLDYSANFLYMLNEKEPDALAAKIFDICLILHVEHTMNASTFSARVTASTLTDPYAVVASAVGTLGGPLHGGANEEVIQMLEEIGSVENVRSYVEERLQRKDKLMGFGHRVYKVKDPRATILQGLAEQLFAKFGADKYYDIAQEMERVVEEKLGHKGIYPNVDFYSGLVYRKMGIPTDLFTPIFAIARVAGWLAHWKEQLEENRIFRPTQVYNGKHSVTYTPIDQR

SEQ ID NO: 52257 - protein, 198 aa, Gluconobacter oxydans 621H
MNESRHARLHRATSETDITLALTLDGQGRSDVDSGIGFFDHMLTALAKHGGFDLELKAKGDLHIDGHHTVEDVGIVFGQAFRQAIGDKRGIERFGHALVPLDEALCEAVVDISGRPYLAWNVVFPREKIGTMDTELFEEFFRAFAMSAHIALHLTCKSGTNAHHIAESGFKAVARALKVAVSHDPRSAGAIPSTKGVL

SEQ ID NO: 52258 - protein, 578 aa, Vibrio sp. Ex25
MTFSTDNNKQVVLGEELGPLSDNERLKRESNLLRGTIEQDLQDRITGGFTADNFQLIRFHGMYQQDDRDIRNERTKQKLEPLHNVMLRARMPGGIITPTQWLAIDKFATEHSLYGSIRLTTRQTFQFHGVLKPNIKLMHQTLNSIGIDSIATAGDVNRNVLCTTNPVESELHQEAYEWAKKISEHLLPKTRAYAEIWLDGEKVESTEEDEPILGKNYLPRKFKTTVVIPPQNDVDVHANDLNFVAIADNGKLVGFNVLVGGGLAMTHGDTSTYPRRADDLGFIPLEKTLDVAAAVVTTQRDWGNRSNRKNAKTKYTLDRVGTDVFKAEVEKRAGIQFEASRPYEFTERGDRIGWVEGIDGKYHLALFIENGRLLDFPGKPLKTGVAEIAKIHKGDFRMTANQNLIVAGVPKSEKAKIEKIAREHGLMDDNISEQRKNSMACVAFPTCPLAMAEAERFLPQFVTDVEGILEKHNLPENDNIILRVTGCPNGCGRAMLAEIGLVGKAPGRYNLHLGGNRAGTRVPKMYKENITDKQILEEIDLLVARWSKEREEGEAFGDFTIRAGIIQEVLVSKRDFHA

SEQ ID NO: 52259 - protein, 506 aa, Triticum aestivum
  misc_feature (371)..(371): Xaa can be any naturally occurring amino acid
HASGRARDVVYRVLSAACEDGDLSIEEAIDAVEDIFRRNASDLYKLNVANGSIHQKTIADNRIASSCVEQDVLFVRIVWNDASGQHRCRVVPAGRFYEIARNKGVGLTFASMGMTSFCDGPADGTNLTGVGEIRLMPDMSTLLRLPWSTREEMVIADMQIRPGEAWEYCPRYALRKVTKVLLDEFNVTMKAGFENEFYLRRKLVSEGHERWVPYDNSSYCSTSSFDGASSILQEVYSSLKAANIVVEQLHAEAGKGQFEVALKYVLCTLAADNLIYAREIIKSVARKHGLIATFLPKPDLNDIGSGSHVHLSLWKNDQNVFMGSNEYSHYGMSNVGEQFLAGVYHHLPSILAFTAPHPNSYDRIQPNTWSXGAYLCWGKENREAPLRTACPPGVPLDMVSNFEIKSFDGCANPHLGLAAIVAAGIDGLRKGLKLPEPIESNPADYATKLKRLPQDLLESVESLAADKTLHELIGDKLITAIIAVRKAEIDHYSKNPGAFGDLIHRY

SEQ ID NO: 52260 - protein, 635 aa, Streptomyces coelicolor A3(2)
MATRHDIRNVAIVAHVDHGKTTIVDGMLKQAGAFAAHQLEGVDDRMMDSNDLEREKGITILAKNTAVKYHPKDGGDVITINIIDTPGHADFGGEVERGLSMVDGVVLLVDASEGPLPQTRFVLRKALSQRLPIILCINKTDRPDARIDEVVNETYDLFLDLDADEEQIEFPIVYACGRDGVASLTKPEDGTVPSDSTSLEPFFSTILDHIPAPTYDEDAPLQAHVTNLDADNFLGRIALLRVHQGELKKGQTVAWMKRDGSVQNVRISELMMTEALTRKPAEKAGPGDICAVAGIPDIMIGETLADVENPVPLPLITVDEPAISMTIGTNTSPLVGRGATGKGADNKAVVKDRKVTARQVKDRLDRELIGNVSLRVLDTERPDAWEVQGRGELALAILVEQMRREGFELTIGKPQVVTKEVEGKTYEPVERMTIDVPEEHMGAVTQLMGVRKGRMDNMSNHGSGWVRMEFVVPSRGLIGFRTEFLTQTRGTGIAHSIHEGHEPWFGTLTTRNNGSLVADRSGAVTAFAMTNLQERGVLFTDPGTEVYEGMIVGENSRADDMDVNITKEKKLTNMRSSSADSFEAIVPPRKLSLEQSLEFCRDDECVEVTPEAVRIRKVNLDARERARAASRAKHG

SEQ ID NO: 52261 - protein, 459 aa, Polaromonas sp. JS666
MQTFDFDLFVIGGGSGGVRAARMSAQRGARVALAEVAAMGGTCVNVGCIPKKLYSYAAHYGDSFEESHGFGWVGEAPTFDWDLLKANRAREISRLNGVYVQLLTSAEVTIIEGWARLLDAHTVEVDGRRFTAKNVLVSTGGTPTVPAITGREHVVTSDQMFDLSPFPKRLLVVGGGYIACEFASIFNGLGSQVTQVHRRDKLLTGFDDDVRRFIAGEMSKTGINLQLGTHISAITKTDDGLQVEVKDSQDKPASFLVDSVLYATGRVPNASGIGLETVGVAVNRVGAIQVNAQYQTSVPSIYALGDVTARLQLTPVALGEAMVVVDHLFGPTDGKKPRGMSYDFVPTAVFTHPNIGTVGYSEADAREQFGAIRVYRTDFKALKHTLSGSTERTLMKLLVEDATDRVVGLHMVGPDAGEIVQGFAVAMKAGATKAVFDSTIGIHPTAAEEFVTMREPVKA

SEQ ID NO: 52262 - protein, 313 aa, Cicer arietinum
ETVAIKKVLQDKRYKNRELQTMRLLDHPNVVTLKHCFFSTTEKDELYLNLVLEYVPETVYRVIRHYSKMNQRMPLIYVKLYFYQICRALAYIHNCVGVSHRDIKPQNLLVNPHTHQLKLCDFGSAKVLVKGEPNISYICSRYYKAPELIFGATEYTTAIDIWSAGCVLGELLLGQPLFPGASGVDQLVEIIKVLGTPTREEIKCMNPNYTEFKFPQIKAHPWHKIFRKRMPPEAVDLVSRLLQYSPNLRSTALEALVHPFLDELRDPNTRLPNGRHLPPLFNFKANELKGVSAEMLVKLIPLHARKQCALFVS

SEQ ID NO: 52263 - protein, 122 aa, Gluconobacter oxydans 621H
MTYDPGNIFARILRKEIPARTVYEDDFALAFHDIAPQAPIHVLVIPKGPYVSIADFGATASPDEITGFWRAVSKIAEEQGLTREGFRLISNSGPNSGQEVPHFHVHLFGGAALGPLLTQKTS

SEQ ID NO: 52264 - protein, 501 aa, Oryza sativa (japonica cultivar-group)
MELLLLCTPCVILLLSSLYLLRLFVDARRNLPPGPRPQPLIGNILDLGSQPHRSLARLAGRYGPLMTLRLGTVTTVVASSPGAARDILQRHDAAFSARSVPDAARACGHDGFSMGMLPPSSALWRALRRVCAAELFAPRSLDAHQRLRRDKVRQLVSHVARLARDGAAVDVGRAAFTASLNLLSSTIFSADLADFGDARAESSVGDLRDLISEFTIVVGVPNVSDFFPAVAPLDPQRLRRRVARVFERLQAVFDGHIERRLRDRAAGEPPKNDFLDALLDYRSPEDGRGFDRPTLQFLFTDLFSAGSDTSAVTVEWAMAQLLQNPPAMAKAREELARVIGSKQEIEESDISQLKYLEAVVKETLRLHPPAPFLLPHQAETTTQVGGYTVPKGTRVLVNVWAIGRDSKVWSDPDKFMPERFLQSEVDLRGRDFELIPFGSGRRICPGLPLAVRMVYLMLASLLHRFEWRLLPEVEKNGVDMAEKFGMILELATPLRAVAIPV

SEQ ID NO: 52265 - protein, 950 aa, Shewanella sp. ANA-3
MKLTRKSDVAQVADKPTLGISRRQFMKQAGITTGGIAAASLMGTGMMRRAEAKDVPHDAPIEVKRTICSACAVGCGLYAEVQNGVWTGQEPAFDHPFNAGGHCAKGAALREHGHGEKRLKYPMKLVDGKWKKISWEDAINEVGDQMLNIRKESGPDSVYFMGSAKFSNEGCYMYRKLAAMWGTNNVDHSARICHSTTVAGVANTWGYGAQTNSFNDIQNANAIFLIGANPAEAHPVSMQHILIAKEKNNAKIIVVDPRFSRTAAHSDLHCAIRPGTDIPFIYGMLWHIFENGWEDKTFIQQRVFEMETIREEVKKFPPKEVADITGVSEEVVYQAAKLMAENRPGTVIWCMGGTQHHVGNANTRAYCILQLALGNMGVSGGGTNIFRGHDNVQGATDLGLLFDNLPGYYGLTSAAWTHWTHVWDLDMEWVKSRFDQNAYLGKDPMTTPGIPCSRWHDGVLEDKSKLAQKDNIRMAFFWGQSVNTETRQREVRDALDKMDTVVVVDPFPTMAGVMHRRKNGVYLLPAATQFETQGSVSNSGRSIQWREQVIQPLFESKTDIEIMYRLAQKLGIAEQYTKRIAKENGLPVIEEITREINRGMWTIGMTGQSPERIKLHTQNWGTFSNKTLEAAGGPAKGETYGLPWPCWGTPEAKHPGTQILYNQSKHVKDGGGNFRARYGVEYNGKNLLAEGSFSKGAEIQDGYPEFTDKLLKQLGWWDDLTAEEKAEAEGRNWKTDLSGGIVRVAIKHGCIPFGNAKARCIVWTFPDQVPVHREPLYTARRDLVAKYPTYDDMQVHRLPTLYKSIQEKDFSGKYPLVLTSGRLVEYEGGGEESRSNPWLAELQQEMFVEINPGDAADRGIRNGEFVWLEGAEGGRIKVQALVTPRVKPGVTFMPYHFAGVMHGESLAPNYPEGTVPYVIGESANTALTYGYDPVTQMQETKASLCQIVKA

SEQ ID NO: 52266 - protein, 448 aa, Xanthomonas oryzae pv. oryzae KACC10331
MCRMPHATCAVLRRRRSGEVARAPNTHEFEPTHAWLCATAPSHVVTATSHCAAGNQPRAMLSSADSRFPIPAMRAAPDILSRVSRVIGCRHSVKECRRVSSLYFRSPRSCHRNYMSIEQLAETAQAMVAPGKGIIAIDESTSTIAKRFASVGIENIEENRRAYRELLLTTPKLSDYISGAILFDETIRQKTKDGVPFAEYMTAHGIIPGIKVDKGAQPLAGMPGELVTEGLDGLRARLEEYYTLGARFAKWRAVITIGEDIPSGTCIEANSHALARYAALCQEQGLVPMVEPEVIMDGSHDIETCYEVTEATLRSLFGALYEQNVVLEGTILKASMVISGKSCEEQASIEEVAESTVMCLKSTVPAILPGIVFLSGGQTDEQSTAHLNEMHQLGTLPWPLSFSYGRAMQQAALKLWAKDMTVNFAKAQQVIYERAKENGLAALGKWKG

SEQ ID NO: 52267 - protein, 343 aa, Neisseria meningitidis Z2491
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKVHLESGAKKVLISAPGGDDVDATVVYGVNDSILTADMTVVSNASCTTNCLSPVAKVLSESVGIVKGAMTTIHALTNDQTVTDVRHKDLRRARSGVENMIPTKTGAAKAVGLVLPELKDKLDGLAIRVPTVNVSLVDLNFQAARDTTIEEINALMKAASEAGALKGVLGYNTLPLVSMDFNHTTEASHFDATLTKVVDGNMIKVFAWYDNEWGFSCQMLNTARRMFGLEVRPLK

SEQ ID NO: 52268 - protein, 494 aa, Glycine max
  misc_feature (308)..(308): Xaa can be any naturally occurring amino acid
MKKTKKSGEENGGKFKLKGADRSAYFARREAAKVLKVVLEGDAKRRALASIKSLIYQPSVRNKKATFALICQTLKHLPIINYVLEAASILNSKWKRQRELIYIIVYDILFGQAVSLVGDAEKYLMRHQDALRSTLKQLLLQRNVKTVKQLIALHQVPDISVPRYVRVNTLKLDVDSALLELQKNYSVQKDHLLPDLLILPPGTDLHDHPLVKNGSIFLQGKASSMAAPALSPEPGWEVLDACAAPGNKTVHLAALMKRKGKIIACELQKERIKRLKDTIKLSGASNIQVLNDDFLNLNPKDPSYSKVXAILLDPSCSGSGTAASRLDHLLPSKAAGQDTDTERLNKLATFQRKALQHALLFPAVERIVYSTCSINQIENEDVIKSVLPIAESNGFQLAKPFPEWQCRGLPVFEGSECLVRTDPAKHGEGFFIALFTRKDANFSGGSNKNETRISHSTPEIKNARRKKKRVPFVSTNLFKMWLYDSTIVKSWRSN

SEQ ID NO: 52269 - protein, 413 aa, Arabidopsis thaliana
MDGVSSLPNELLCHILSFLTTKEAALTSILSKRWRNLIAFVPNLYIDDTVFLHPEEGKRDRPEIIQSFMDFVDRILALQGNYPIKKCSLKCLTEVDSVRVDAWISNVLARGVTDLDLLIILDCESDDNYRLSPKCLQSSTLVSLKIDGGIDIARVDNFDILLLALPALEELALVDVIWKDEDDYPLVNMKNLFDARIIFMLQLPGAREPDDDHWFDQNVALRYSNVWKLFLGLQNVPNLYLSPDTLKVLSLYCESMPVFKNLKSLAIKSGKERGWQAIPVLLRNCPHLETLVIEGVLHNVTDKCGDACDCISREDKGRSLTSCPVKMLEIRGFRGTMKEMTMMKHFLDYFLCLKAMNIYVEENDPTELRFPEVSKCIMQMMEEYNKLSSCNVELLVTDYFYFSEKWTAKGRIL

SEQ ID NO: 52270 - protein, 503 aa, Medicago truncatula
MDIPIPSRQLFINGDWKSPILNKRIPVINPSTQQTIGDIPAATKEDVDAAVAAAKTALSRNKGADWASASGAVRARYLRAIAAKVTEKKSELAKLEAIDSGKPLDEAAWDMDDVAGCFEFYADLAEKLDAKQKAPVSLPMDTFRSHVLKEPIGVVGLITPWNYPMLMATWKVAPALAAGCAAILKPSELASLTCLELGEICKEVGLPPGVLNILTGLGPEAGAPLASHPDVDKIAFTGSSATGSKIMTAAAQLVKPVSLELGGKSPLIVFEDVDLDKAAEWAIFGCFWTNGQICSATSRLIVHESIATEFLNRMVKWIKNIKISDPLEEGCRLGPVVSEGQYEKILKFVSNAKSEGATILTGGSRPEHLKKGFFVEPTIITDVTTSMQIWKEEVFGPVLCVKTFSTEEEAIDLANDTIYGLGAAVISNDLERCERVTKAFKAGIVWVNCSQPCFTQAPWGGIKRSGFGRELGEWGLDNYLSVKQVTQYISDEPWGWYQPPAKL

SEQ ID NO: 52271 - protein, 105 aa, Frankia sp. EAN1pec
MKGAGRVVGSVGSQTKAAHVTGNLGFDAAFDHHDGRHADRLREVAPDGIDVYFDNTGGAQLEAAIEVMKPHGRIVLCGALAAQNGGIGATGPPTPTSPDGSVTAA

SEQ ID NO: 52272 - protein, 531 aa, Zea mays
MAEPGKRAVAQWRRWALANLGPFAALFTTNFGSAWLILAPVVSLVATYAPRRLFRTYFNLFLRRRSRRLLNVVDPYVTIDISEPGGEVRYSRYGPVSDNDSTYEEVKAYLSGAAREQDARELRAEGAREGNGLVVSMRDGQDVADEFRGVPLWWSSVVARDVQGQRKGDRRFQRLTFHLSHRALVVDEYLPHVRRQGREILFSNRRRRLYTNSKSRDSYSYEYKSWSYIDFDHPTTFDTLAMDRARKRDIIHDLDTFRNSREFYRRAGKPWKRGYLLYGPPGTGKSTMVAAMANYLDYDIYDVELTVVHTNSDLRKLLIDTTSKSIIVIEDIDCTLDVTGDRAGRPRRRANGGGDADDRPRDSVTLSGLLNFIDGLWSACTGERIVVFTTNHVERLDPALIRRGRMDMHIEMSYCRFEAFQTLAKNYLDIDDHDDLFAAVGEVLREENLTPADVAECLMAARRAGSGEPSPCLQILIDELKKRAVEKAKAEAEAKARAEAQAKAWAEAEARAAVEANAAARDRAMATHSNV

SEQ ID NO: 52273 - protein, 155 aa, Triticum aestivum
MSAAVGGAEFHGFGGAAQLPRSRMLGRPVRVAPPGATPAGGGGPSAASIRAVSTPLKKDAKEVKRSKVEIIKEKSNFLRYPLNEELVSEAPNVNETAVQLIKFHGSYQQSDREVRGQKNYSFMLRTKNPSGKVPNQTYLAMDTLADEFGIGTLRL

SEQ ID NO: 52274 - protein, 362 aa, Treponema primitia
IGAANNLLAAMIDNRIYQGNKLNVDPRKITWHRCVDMNDRQLRFIVDGLGGKANGASREDSYDITVASEIMAILCLSSDINDLKARLGRIVIGYTYGKQSDGSEKPVTASQLNAQGAMAALLKDALKPNLVQTLEGTPSFVHGGPFANIAHGCNSVMATRLALKLGDYVVTEAGFGADLGAEKFLDIKCRFANLKPSAVVIVATVRALKSHGGVAKADLGKENVEAVRKGLPNLLQHVENITKVYKLPAVVAINAFRKPGEADTEAELKLIADECKKLGVNVALSDVWEKGGEAERLWRKRYSNSAMCPTTLRSAMTKKHRLKKRLKPLLRRSTMRTELTLSRTRRSRYAQLEKLGLDKVPI

SEQ ID NO: 52275 - protein, 102 aa, Brassica napus
EKNTNILDEPLWTMYCKGDKTGYGVRREANDEDLSVMELLRPVSMGAGVLPGNSELEGPDGEMAYMRAYFERVVGSKDSETFYMLSPEGNNGPELSFFFVRV

SEQ ID NO: 52276 - protein, 358 aa, Treponema primitia
IGAANNLLAAMIDNHIYQGNKCNIDPRKIIWHRCVDMNDRQLRFIVDGLGGKANGASREDWFDITVASEVMAILCLSKDIDDLKARLGRIIVGYTYGKQSDNTEKPVTAGQINAQGAMAALLKDALKPNLVQTLEGTPAFIHGGPFANIAHGCNSIMATRLASKMGDYVVTEGGFGADLGAEKFLDIKCRFAGLKPSAVVIVATVRALKSHGGVAKADLEKENLDALEKGLPNLLQHVENITKVYNLPAVVAINAFPKDTKAELDLVEKKCKELGVNVALSEVWAKGGEGGQKLAEEVVKLCELPNKFTFSYDEKSSIKDKIEAIAKKIYHADGINILPVAQKQIAQLEKLGMDKVPI

SEQ ID NO: 52277 - protein, 229 aa, Agrobacterium tumefaciens str. C58
MSGFDLIIFDCDGVLVDSEIIAAQVESRLLTEAGYPISVEEMGERFAGMTWKNILLQVESEASIPLSASLLDKSEKLLDMRLERDVKIIDGVKFALSRLTTPRCICSNSSSHRLDMMLTKVGLKPYFAPHIYSAKDLGADRVKPKPDIFLHGAAQFGVSPDRVVVVEDSVHGIHGARAAGMRVIGFTGASHTYPSHADRLTDAGAETVISRMQDLPAVIAAMAEWEGAF

SEQ ID NO: 52278 - protein, 437 aa, Eubacterium limosum
IGAANNLLAAMLDNHIHQGNELNIDPKRITWRRCVDMNDRQLRNIVDGLGKKGDGAVRQDGFDITVASEIMAAFCLFTGDIHAIGAANNLLAAMLDNHIHQGNELNIDPKRITWRRCVDMNDRQLRNIIDGLGKKGDGAVRQDGFDITVASEIMAAFCLASDIVDLKDRMGRIIVGYTYDDEPVTAGQLKANGAMAALLKDALKPNLVQTLEGTPSFVHGGPFANIAHGCNSVIATKMAMHFASDYVVTEAGFGADLGAEKFLDIKCRMAGLKPDAVIIVATVRALKYNGGVPKDELNNENLEALEAGLPNLLKHVENITQVYKLPAVVAINRFPLDTEAELKLVEDKCRELGVNVALSEVWAKGGEGGIAVANEVIRLCEEGENSFQFSYEDDMSIKDKINAIATKIYGADGVDYTPEADAEIAKLTKLGFDKVPV

SEQ ID NO: 52279 - protein, 449 aa, Vibrio vulnificus YJ016
MNKYQLPQDSQLRQADFLFGVATSSYQIEGGAQLGGRTPSIWDTFCNQPGAVDNMDNGDVACDHFHLWQQDIELIQGLGVDAYRLSMAWPRILPKDGQVNQQGLEFYERIIDECHARGLKVFVTLYHWDLPQYLEDKGGWLNRETAYKFAEYAEVVSGYFGNKIDSYATLNEPFCSAYLGYRWGIHAPGKKGEREGFLSAHHLMLAHGLAMPIMRKNAPQSMHGCVFNATPAYPYSEQDVAAAEYSDAEGFHWFIDPVLKGEYPQSVLEHQAHNMPMILDGDLDIIRGDLDFIGINFYTRCVVRFDANGELESMPQPDAEHTYIGWEIYPQALTDLLLRLKQRYPNLPPVYITENGAAGEDACINGEVNDEQRVRYFQSHLLALDEAIRAGVNVQGYFAWSLMDNFEWAYGYKQRFGIVHVDYATQKRTLKQSAIAYRNTLLARAEEKQ

SEQ ID NO: 52280 - protein, 308 aa, Gibberella zeae PH-1
MSDYKTYSFNPAQDIPSLDGKVILITGANTGLGKATALELAKHNPAHIYITARNSTKGNTALEEVKGVASEGTQVSLLELDLSSFDSIKAAAKDFLDREVRLDVLLLNAGVMGAPPVLTKDGYEMHIGTNHLGHALLLKLLTPVLDKTPNARVVHLFSAGFRHVGPNGIEFDTLKSATSPTPLPLRYAQSKLACLLYAREAAKRYNFTNIAINPGEVQTELFSRKAGDEMMKHLQENVAPKMAGPISEGVKNHLWAATSTEIKNGEFYEPVGKTGGLEGAGLDEEMANKLWDWTEEQLEGLRVSEIDR

SEQ ID NO: 52281 - protein, 393 aa, Saccharum hybrid cultivar SP-80-3280
MSLSLKRKDLMIVNMGPQHPSMHGVLRLIVTLDGEDVIDCEPILGYLHRGMEKIAENRSIIQYLPYVTRWDYLATMFTEAITVNAPEFLENIQIPQRASYIRVIMLELSRIASHLLWLGPFMADLGAQTPFFYIFRERELIYDLFEAATGMRMMHNYFRIGGVAADLPYGWMDKCLDFCDYFLQGVVEYQQLITQNPIFLERVEGVGFISGEEAVNWGLSGPMLRASGIQWDLRKIDPYESYNQFDWKVQWQKEGDSLARYLVRVGEMRESIKIIQQAVEKIPGGPYENLEARRFKKAKNPEWNDFEYRFLGKKPSPNFELSKQELYVRVEAPKGELGIYLVGDDSLFPWRWKIRPPGFINLQILPQLVKKMKLADIMTILGSIDIIMGEVDR

SEQ ID NO: 52282 - protein, 181 aa, Cicer arietinum
MASSMISSSAVTTVKRASSVPSGAVAPFVGLKSMAGFPVRKVNNDITSIASNGGRVHCMQVWPPIGKKKFETLSYLPPLTEEQLLKEVEYLLRKGWVPCLEFELEKGFVYREHNNSPGYYDGRYWTMWKLPLFGCTEAVQVLKELQEVVKAYPNAFVRIIGFDNVRQVQCISFIAHTPKEF

SEQ ID NO: 52283 - protein, 550 aa, Vibrio sp. Ex25
MLKNINPTQTQAWKALTAHFESAQDMDLKELFAQDAARFDKYSARFGSDILVDYSKNLINEETLKHLFALANETELKSAIEAMFSGEAINQTEGRAVLHTALRNRANTPVMVDGEDVMPAVNAVLEKMKSFTERVIGGEWKGYTGKAITDIVNIGIGGSDLGPYMVTEALAPYKNHLNLHFVSNVDGTHIVETLKKVNPETTLFLIASKTFTTQETMTNAHTARDWFLESAGDQAHVAKHFAALSTNATAVSEFGIDTANMFEFWDWVGGRYSLWSAIGLSIALAVGYDNFVELLEGAHEMDKHFVSTDLESNIPVILALIGIWYNNFHGAESEAILPYDQYMHRFAAYFQQGNMESNGKYVDRQGNAVTYQTGPIIWGEPGTNGQHAFYQLIHQGTKLIPCDFIAPAISHNPASDHHQKLMSNFFAQTEALAFGKSEETVKEELVKAGKNTEEVAAIAPFKVFEGNRPTNSILVKQITPRTLGNLIAMYEHKIFVQGVIWNIFSFDQWGVELGKQLANQILPELADESQISSHDSSTNGLINAFKAFKA

SEQ ID NO: 52284 - protein, 457 aa, Mesorhizobium sp. BNC1
MTDRSNELNAWDRDHFFHPSTHMGTHARGESPNRVVAGGEGVYITDVNGRTSLDAFAGLYCVNVGYGRQKIADAIAEQARNLAYYHAYVGHGTDASIRLAKMIIDRAPQGMSRVYFGLSGSDANETNIKLIWYYNNVLGRPEKKKIISRWRGYHGSGIMTGSLTGLDLFHNAFDLPRAPILHTEAPYYFRRPDRSMSEEQFSQYCADKLEEMILAEGPDTVAAFIGEPILGTGGIVPPPAGYWEKIQAVLKKYDVLLIADEVVTGFGRLGTMFGSDHYGIKPDLITIAKGLTSAYAPLSGVIVSDKVWQVLVQGSDKLGALGHGWTYSAHPLCAAAGVANLELIDEMNLVENAGTVGAYFRAELANAVGSHPNVGEVRGDGMLAAVEFVADRDDRVFFDASKKIGPQIAAALAERGVIGRAMPQGDILGFAPPLCLTKEEADKVIAATASAVDSVLG

SEQ ID NO: 52285 - protein, 530 aa, Anabaena variabilis ATCC 29413
MNLVNKSEKTFALTTPLYYVNDVPHIGSAYTTMAADAVARFQKLLGRDVLLITGTDEHGQKIQRSAESLGKAPQEFCDEIVPSFMSLWQLLNIQYDRFSRTTAVRHKAIVDEFFARVWQAGDIYQGQQKGWYCVSCEEFKEERELLEGNRCPIHVNKEVEWRDEQNYFFRLSKYQTQLEEFYKSHPDFIQPESRRNEVLNFVSQGLQDFSISRVNLDWGFPVPTDSKHTLYVWFDALLAYVTALLDPQDEPTLENALAKWWPINLHLIGKDILRFHAVYWPAMLLSAGLPLPDRVFGHGFLTKDGQKMGKSLGNTIDPVGLVQQYGSDAVRYYFLKEIEFGKDGDFNEVRFINVLNADLANDLGNLLNRTLNMVKKYCANYALSITNEDIPAENTLKALGVDLGAKVKQAYEVLAFNQACGVVLSLVQASNKFIDDQAPWSLYKQGRQQEVETVLYTVLESVRLAAYLLSPVIPNISSSIYQQLGFGINFNEQTDITPFAIHAQWGLLSNKQQLGQPQPIFKRIEQTKNV

SEQ ID NO: 52286 - protein, 525 aa, Mesorhizobium sp. BNC1
MTIRAEPVPARNLSDQISVLRCPSKRLSMNAATAKIDLSAKLDLLHDKSLLRELAYVDGRWVTGHEPVNFEVRDPATGAVLAYVASLNAAQVDSAIDAAARAFLSWKRLLPQERAATLRAWYELIVAAKEDLALLMTLEQGKPLAESRGEIDYAASFVEWYAEEAKRLNVESVTSHLPGAEMMVRREPLGVVGVVTPWNFPSAMLTRKAAAALAAGCTIVAHPSSETPLSALALAELGERAGLPAGVLNVVTGDAATIVGRMCGDSRIRAMSFTGSTEIGRLIAAQCAPTMKRLVMELGGHAPLIVFEDAPLDKAVDIAIGAKFATSGQDCLAANRIYVQRGIYGAFCEAFAARIATLKVSDGLDETGDIGPLMHERAIAKVEEQVTDALGRGARCLIGGERHPAGRLFYQPTLLADVPDAALIMREETFGPVAAAVPFDTEDEVVRRANNTEYGLVAYVVTENGARQLRMGRALDYGMVAINRVKITGAPIPFGGVKQSGIGREGARHGLEAFTDLKYLCLDAA

SEQ ID NO: 52287 - protein, 165 aa, Nostoc sp. PCC 7120
MMPCYKLPLSKMRRLGLALLLPVTLFGTVALPNQLSSVTAQTPGGNRPLTIRSDIQEYDAKNQVITARGNVQMLYPARQIQATSAQAQYFSKERRIDFSGNVYILQQGGNSIRAEKVTYLIDEGRFVALPQSNRQVESIYMIEESQQGGQSNAPAPTTPVLRRSN

SEQ ID NO: 52288 - protein, 184 aa, Zea mays
MDPTDQSPEEVYSVWALPPEPVRDRFRRIMEGLRAAYGGPAFEPHVTVVGDFRGRRSEAVKVLRAAAASVQPYTARVTGVARGSFFYQCVYILLDPTAEVVGASDHCCANFGYNRKTPYMPHVSLLYGDLTDEEKEEARKKAEELDKDIYVLEFEISELALYRTDTTDKTLESWELVEVCHLGS

SEQ ID NO: 52289 - protein, 1049 aa, Sulfolobus tokodaii str. 7
MRESVRKVLVIGSGPIKIAEAAEFDYSGSQALKALKEEGIETILVNSNVATVQTSRKFADKLYMIPVTWWAVEKVIERERPDGIMVGFGGQTALNVGVDLYNKGILQKYGVKVLGTPIEGIERALSREKFRETMINVGLPVPPSLSARSEEEALEKARQIGYPVMVRVSFNLGGRGSIVAWNEEELKRDIGRALSQSYIHEVLIEKYLHHWIELEYEVMRDKYGNSAVIACIENLDPMGVHTGESTVISPCQTLDNKEFQDMRFMSMDVAKSIDLVGECNVQFALDPKGYNYYVIETNPRMSRSSALASKATGYPLAYVSAKLALGYSLYEVLNKVSGSTCACFEPSLDYVVIKIPRWDLDKFENVEISLASEMKSVGEVMSIGRSFEESLQKAVRMLDIGEPGVVGGKIYFSKMTKEDALKNLKMRRPYWFLYAAKAFKEGATIDEVYEVTGINKFFLNKIKALVEFYEILRKQRNIDKDTLLQAKKLGFSDLQLAKALGVKESDIRKLREKWNIEPKVKQIDTLAGEWPAVTNYLYLTYNGTEDDIEFSEAGNKLLIIGAGGFRIGVSVEFDWSVVSLLDSSLKYFNDIAILNYNPETVSTDWDIARKLYFDEISVERVLDLIRKEKFTYVATFTGGQIGNNISKKLEEEGIRLLGTSGRSIDTAEDREKFSKLLDKLGIKQPEWISARSLEEVKEFISKVGYPVLIRPSYVLSGAAMKIVNNDLELMEYLKRATEVSPEHPVVISKYLNDAIEAEIDAAGDGKGVYGVVIEHVEEAGVHSGDATMSIPYRKLSSNVVNKMKENVHMIVRELEIKGPFNVQFVIKNNEPYIIELNLRASRSMPFSSKVVSKNIISLALDGILNGFGVDEFIELKPKSWGVKSPQFSWAQLKGAYPFLGPEMKSTGEAASLGTDFYDALLKSWLSSSPNKIPNKEGIALVYGTTNVEYLKIAAKNLIDYGITVYTLSEASIGIEEKSINDIIELIKNRKVEIVVTDGYLKHIDYEVRRIAVDYNIPIILNGRLGAEVTRAFSHPNVTYYEISEYGAGI

SEQ ID NO: 52290 - protein, 212 aa, Thiomicrospira crunogena XCL-2
MQHPLYQQATYLKSAPDLSHCPEDFGYEVAFAGRSNAGKSSALNVITSQRGLAKTSKTPGRTQLINFFECDEQRKLVDLPGYGYAKVNVNTKRAWERSLSQYIEVRSSLKGLIMMVDSRMPPTEIDLMMLDWTLTLNLPVHILLTKSDKLKKGPAQNSLLKMRQLLNEKYPHATVQLFSSLKRQGLDEVWAKLDEWMEYERPVKSQPETKES

SEQ ID NO: 52291 - protein, 448 aa, Helicobacter pylori 26695
MYVEKILQSLQKKYPYQKEFHQAVYEAITSLKPLLDSDKSYEKHAILERLIEPEREIFFRVCWLDDNNQIQVNRGCRVEFNSAIGPYKGGLRFHPSVNESVIKFLGFEQVLKNSLTTLAMGGAKGGSDFDPKGKSEHEIMRFCQAFMNELYRHIGATTDVPAGDIGVGEREIGYLFGQYKKLVNRFEGVLTGKGLTYGGSLCRKEATGYGCVYFAEEMLQERNSSLEGKVCSVSGSGNVAIYTIEKLLQIGAKPVTASDSNGMIYDKDGIDLELLKEIKEVRRGRIKEYALEKKSAEYTPTENYPKGGNAVWHVPCFAAFPSATENELSVLDAKTLLSNGCKCVAEGANMPSSNEAIGLFLQAKISYGIGKAANAGGVSVSGLEMAQNASMHPWSFEVVDAKLHHIMKEIYKNVSQTAKEFKDPTNFVLGANIAGFRKVASAMIAQGV

SEQ ID NO: 52292 - protein, 136 aa, Brassica napus
MRPPMGGGGFRGRGGRDGGGGRFGGRGGRFGGGGGRFGGGRFGGFRDEGPPDEVVEVATFVHACEGDAVTKLSQEKIPYFNAPIYLQNKTQIGKVDEIFGAINESLFSIKMMEGIVATSYAPGDKFFIDPAKLLPL

SEQ ID NO: 52293 - protein, 302 aa, Synechococcus sp. RS9916
MSVAAELSPTPFGRLLTAMVTPFDGEGNVDFSLAGRLACHLVDQGSDGLVVCGTTGESPTLSWDEQAQLLAAVREAVGSGVKVLAGTGSNSTAEAVEATAHAAAAGADGALVVVPYYNKPPQEGMEAHFREVAAAAPELPLMLYNIPGRTGCSLAPATVARLMDCPNVVSFKAASGTTEEVSQLRLACGPRLAIYSGDDALTLPMLSVGAVGVVSVASHVAGQRMRSMIEAFLSGRHAEALAQHELLLPLCKALFATTNPIPVKAALELSGWPVGAPRLPLVPLDAAMRESLAQALNALRQT

SEQ ID NO: 52294 - protein, 385 aa, Glycine max
ELSASTLVLYPASQPPQEPKNENNGGIVFDSKNLQQMQGEMPKEFLWPSRDLVDTTQEELKEPLVDLAIFKNGDEKAISNAAELVRKACLKHGFFQVINHGVDPDLIDAAYHEIDSIFKLPLSKKMGAKRKPGGVSGYSGAHADRYSSKLPWKETFSFLYDHQSFSNSQIVDYFKSVLGEDLQHTGRVYQKYCEAMKDLSLVIMELLGISLGVDREHYRRFFQDGDSIMRCNYYPPCNRANLTLGTGPHTDPTSLTILHQDQVGGLEVFVDNKWLAVRPRSEALVINIGDTFMALSNGRYKSCLHRALVNTYRERRSLVYFVCPREDKIVRPPDNLLCRNEERKYPDFTWSNLFEFTQKHYRADVATLQSFIEWQQCSNSNPSNF

SEQ ID NO: 52295 - protein, 400 aa, Mycobacterium sp. MCS
MPVDRQLEKILVVGTGVAGMRAAETLRLDGYRGELTVVGAERHAPYQRPPLSKKLLSGAVHRAGADLAPRMDLEARVLRGASVRELDMSTRTAHLRDGSDDVSVPFDGLVVATGAAARQWPDGPVPDGVMALRTVDDCLAIRERLESRPRVVVVGGGFIGAEVAATCRSMGLSVTLIEKSSAPMASALGEEMAACWERLHRGNGVELRSGVGVESFAGDDRVEAVHLTDGTRLPADLVIIGLGVTPSVDWLSGSDLRLDNGVVCDATGAVEGVTDVVAAGDVASWWHPRYERYLRIEHWEHAERQGVAAAHTLLAGPERAQEFDALPYFWTDQYDVKMQMLGVPDGYDSVAVVEGGPDRWDFVAAYGRDGRVIAVLSTIPGRVHAYRDAVFGAFPPAPPG

SEQ ID NO: 52296 - protein, 143 aa, Lentinula edodes
MARTKQTARKSTGGKAPRKQLASKSATKSSAARKTAQGAAGGVKKPHRFRPGTVALREIRRYQKSTELLIRKLPFQRLVREIAQDFKTDLRFQSSAVMALQEAAEAYLVSLFEDTNLAAIHAKRVTIQPKDLALARRLRGERS

SEQ ID NO: 52297 - protein, 260 aa, Oryza sativa (japonica cultivar-group)
MSPAEASREENVYMAKLAEQAERYEEMVEFMEKVAKTTDVGELTVEERNLLSVAYKNVIGARRASWRIISSIEQKEESRGNEAYVASIKEYRSRIETELSKICDGILKLLDSHLVPSATAAESKVFYLKMKGDYHRYLAEFKSGAERKEAAENTLVAYKSAQDIALADLPTTHPIRLGLALNFSVFYYEILNSPDRACNLAKQAFDDAIAELDTLGEESYKDSTLIMQLLRDNLTLWTSDNAEDGGDEIKEAAKPEGEGH

SEQ ID NO: 52298 - protein, 411 aa, Triticum aestivum
  misc_feature (152)..(152): Xaa can be any naturally occurring amino acid
  misc_feature (202)..(202): Xaa can be any naturally occurring amino acid
  misc_feature (255)..(255): Xaa can be any naturally occurring amino acid
RDIVLSPKYVLPFLQSGRLVRVQYSTDESTFSIDENVSWGIIINFEKVKTNTEERRPEDCDYTVDVLTRCSVIKDISGKKTMKVIPIKSRGEPVVISLPLSQIDGLSSVRMYIPKDLLPVEARENTLRKVEEVLSRFAKDGVPLLDPEEDMXVKSSSYRKATIRIEALESLFEKHDIRNAPHIQQKLKVLHAKQEIKAKIKXSIKKTMRASTALAFKDELKARKRVLRRLGYITSEDVVEIKGKVACEISSADEXTLTELMFSGTLKDATVEQMVALLSCFVWQEKLQDAPKPREELDLLFYQLQETARRVANLQLECKIQIDVESFVNSFRPDVMEAVYSWARGSKFHQIMEMTQVFEGSLIRAIRRLEEVLQQLILASQSIGETQLEAKLEEAVSKIKRDIVFAASLYL

SEQ ID NO: 52299 - protein, 130 aa, Polaromonas sp. JS666
MSALEYFGNPPMASDHQPRPFSPAVRAGDFVYVSGQVPADEKGEIVQGGIEVQTRQVMKNLSAALALAGCTLDDVCKTTVWLQDARDFGSFNRVYMSYFGDKKPARSTTEARLMVDARVEIDVVAYKPRG

SEQ ID NO: 52300 - protein, 933 aa, Agrobacterium tumefaciens str. C58
MRRSQHAGNAVDDRKMTTLLGGERGMKKWVYTFGNGAAEGGAGDVAILGGKGANLAEMASLGLPVPPGLTIIADACALYHKNGRDLPEELKLQVMAGLHGMEIVTGKTFGGSHSPLLISVRSGARASMPGMMDTVLNLGLNDRTVEALGHDAGDARFAWDSYRRFIQMYGDVVMGLDHEMFEEILEDEKGRLGHEYDTDMSAVEWQHVVSLYKKLIEDELGEAFPQDCHVQLWGAIGAVFASWTNHRAVTYRHLHNIPGDWGTAVNVQAMVFGNLGSSSATGVAFTRNPSTGEAELYGEFLVNAQGEDVVAGIRTPQSITEAARLVSGSDKPSMEKLMPEAFSEFLAICKRLETHYRDMQDLEFTIERGKLWMLQTRSGKRTTRAAMKIAVDMVEAGLISQEEAVCRIEPSSLDQLLHPTIDPGISRPIIGSGLPASPGAATGEIVFTSEEAVAAEAEGRRVILVRIETSPEDIHGMHAAEGILTTRGGMTSHAAVVARGMGIPCVTGAGSMRVDMRNKVLIGVGCMLKRGDVITIDGSSGRVLKGEVPMTQPELSGDFGKLMQWADNLRRMTVRTNADTPADARAARAFGAEGIGLCRTEHMFFEGDRIHVMREMILAESEKGRRAALDQLLPMQRSDFTELFQIMHGLPVTIRLLDPPLHEFLPKSDGEIVEVAAAMGMPQTVFRQRLDALHEFNPMLGHRGCRLAISYPEIAEMQARAIFEAAVAAARITGAPVVPEIMVPLVGLRSELDYVKAVIDTVAAEVAEETGMSIEYLTGTMIELPRAALRAHVIAEAAEFFSFGTNDLTQTTFGISRDDAARFINTYQRKGIIERDPFISLDFDGVGELIRIAAERGRQTRPELKLGICGEHGGDPASIHFCEDADLDYVSCSPFRVPIARLAAAQATLAAKAKQGETPSNVAFIPVRGSVGR

SEQ ID NO: 52301 - protein, 434 aa, marine gamma proteobacterium HTCC2143
MSNTLLDSRAAAARCLAKIVNGSSLSQQLPLLEQQVAEKDRSLYRQLCYGVLRFYPKLNGIAKLLIQKPLKGKDHDVLMLVLIGIYQLSEMRIPDHAAVSTTVNATKSLKKHWAKGFVNGVLRQWQRNEQDLLTKLTVAEAQSHPQWLHDELVKAWPAEASSIESVNNQHPPMCLRVNHQHSSTADYLQQLAAHGIDAGRCDFADQGIRLTNAVSVEQLPNFSAGWVSVQDEAPQLSAALMALAPGQRVLDACCAPGGKTCHMLELQPQLKQLIALDVDHQRLQKVEQNLERLQLKASLTHGDASEPLTWWDNQPFDRILLDAPCSATGVIRRNPDIKLHRQHSDIAQLAKLQRKILNALWLTLKPNGRLVYATCSVLPDENEIIVGDFCEQQKDAKHIVIDAPWGIARPYGRQLLPQNEGHDGFYYAVIEKKP

SEQ ID NO: 52302 - protein, 500 aa, Zea mays
MRRPTLSLALGLGLGLSLVALFAARGAHASIHEYGGGDFAPRANSFFFHGGSEGLYASDHSSNSSASFIRFDTVVFRRTLESASRHEEMQQKTGLVEAIIVEIQDRGKIGGSYLHSDAICCTPELDKEKSCRVGEVIIRPNPENPDWPKRIQTFFDGKNEETTMVTQIVSINKTGMYYLYFMFCDPQLKGLKITGRTVWRNPQGYLPGKMAPMMTFYGFMSLAYLVLGLLWFIQFVRCWKDILQLHYHITAVIALGMCEMAFWYFEYANFNSTGTRPMGITLWAVTFTAVKKTVSRLLLLVVSMGYGVVLPTLGGITSRVAALGFIYFVASEALELVENLGNINDFSGKTRLFLVLPVAVLDATFIIWIFSSLSRTLEKLQLRRSMAKLELYRKFTNSLAVSVLISIAWIGYELYFNATDPLSELWQRAWIIPSFWNVLSYALLGIICILWSPSRNPTGFAYSEDAGEGADEEGLSLVGSAVKGTGDMVNMHIFPEDKRA

SEQ ID NO: 52303 - protein, 220 aa, Debaryomyces hansenii CBS767
MSDNTDDYSYDYEYLYKIVLIGDSGVGKSNLLSRFTRDEFNLESRSTIGVEFATRTLEIDGKRVKAQIWDTAGQERYRAITSAYYRGAVGALIVYDISKAESYESVSRWLKELKEHADANIVIELVGNKSDLDHLRAVPTDEAKNFANENNLLFTEASALSSDNVDLSFHQLLKNIYEMISKHQLDTNEGSNGNKPSGGPTISLTPAPQEKKSKNNSNCC

SEQ ID NO: 52304 - protein, 612 aa, Anaplasma phagocytophilum HZ
MSSGYDSIRNLAIVAHVDHGKTTLLDSMLRQSGAFRDNQDVVDRVMDSNDLERERGITILAKCTAITWKNHKINVIDTPGHADFGGEVERVLSMADGVLLLVDASEGPMPQTKFVLSKALKAKLLPIVVVNKVDRPDSRVSEVLDEVYELFINLDATSEQLDFPVLYASGREGWCSKSLTDEKKGLEPLFEGILEHIKPKQYDLNAPFSMLLTLLESDKFLGRVLTGKVYGGRAKINSQVKVLNLAGEVVESGRLTKLLSFSGLKRVPVEEADAGDIIAVAGLERASVSDSIVDVSVTVPIESTPVDPPTMAVTIGVNDSPIAGTEGTKLTSTAIKQRLLSEAETNVAITVKEGARSEAYEVGGRGELQLGVLIETMRREGFELSVSRPRVIFKKEGSTILEPIEEVIIDVDEEYSGVIMEKLSFRKGDMQDMTPSGKGRVRMVFLMPSRGLIGYHGEFLTDSRGTGIMNRLFHGYAPHKGEISGRMNGVLISTGQGEAVAYAIFNLQDRGMMFIKPQDKVYMGMIVGLHNRNNDIEVNVLKGKQLTNVRAAGSDEAVRLVPPKMMSLEEMIGFINDDELVECTPKSIRLRKRFLDPNERKRFARSKGIIEG

SEQ ID NO: 52305 - protein, 929 aa, Mesorhizobium sp. BNC1
MANGITFTLDGKTVTAGEEETIWDVAKREGTKIPHLCHVDLPGYRPDGNCRACMVDIEGERVLAASCIRRPTAGMVVNTSTERARKSREMVFELLASNMRPVSEGPDQQSLFWQWANSMGISGNRYGSKFAQDSVPAEFDVTNPAIAVNLDACIACGACVRACREVQVNDVIGMAERGNHSVPVFDMHDPMGLSTCVTCGECVQACPTGALFEKSLMDGEGKTRVVQSFDKVVDSVCPFCGVGCQTKVAVKDNRIVQIDGRNGPANENRLCVKGRFGFDYAMSPERLTKPLIRRDDAPKTGDLDLSNVDPLTVFREASWEEALERAAGGLKRIRDEHGGAALAGFGSAKGSNEEAYLFQKFVRQGFGTNNVDHCTRLCHASSVAALMEGVGSGAVSAPFMDALKADCVIIIGARPATNHPVAATYFKQAAKRGTKLIVMDPRGQELMRHASYALRFKPGSDVAMLNALLHVIIEEKLYDEQYIQANVSGFEALKEKVRDFSPEAMAPVCGIEANVLREVARTYAKAERSMIFWGMGISQHTHGTDNSRCLIALALITGHVGRPGTGLHPLRGQNNVQGASDAGLIPMYFPDYRSVENIDTRGQYENFWGQTLDPKRGLTVVEIVDAIHDGEIRGMYIMGENPAMSDPDQSHARAALAKLEHLVVQDIFLTETAWHADVVLPASAHAEKLGTYTNTNRQVQIGRPALELPGDARQDLDLIIELASRMGLGWNYGHVSEVYNEMASVMPSLKHISWERIEREESVIYPADGPDIPGNEIVFSSGFPTTDGRGRIVPADLLPPDEVPDEEYPLVLTTGRLLEHWHTGAMTRRAGVLNAIEPYGIAAMSPYEIRRRGLSQGDVIAVETRRGTVEAILRADREVAEGMVFMPFCFNESPANKLTNPMLDPYGKIPEFKYCAARVVPSSRGEAAE

SEQ ID NO: 52306 - protein, 476 aa, Photobacterium sp. SKA34
MHPNIHIPDAFIDLIKQTMPEHLDIDEFIACCKTPLRRSIRVNTLKISVEDFLVRVANRGWTLTPVPWCDTGFWIEREDEDTVSLGNTAEHMAGLFYIQEASSMMPVTALLKDNNALDCVLDMASAPGSKTTQIASAMQNRGALVANELAASRIKVLHSNLQRCGVHNAALTHFDGCVFGTWAPESFDSILLDAPCSGEGAIRKDEDAMANWSLASIDEIAEVQRNLIISAFQALKTSGVMVYSTCTLNQSENQDVCHFLKEKFGDAVEFEPLNTLFDGADKSLTEDGFLHVYPQVFDSEGFFVARIRKLAPVETDSVKKRMGKFPFTQLKEKEQQEIAQQLKQNLDITLPEQHDVWLRDKEVWLFPSLLRTLIGEIRFQRIGIKLAEQHKKGYRWQHEAVMTLATGKESTAIELNVEQAKEWFMGRDIRPEIPAGKGEVIVTYRDYPIGIGKWVSNRIKNGLPRELVRDTNLFDI

SEQ ID NO: 52307 - protein, 404 aa, Gluconobacter oxydans 621H
MAFRTLDGVDARGKRVLVRADLNVPMHDGVITDDTRLQRVAPTIRELVDKGARVVVFSHFDRPKGQVVPAMSLRPIALKLGQILGQPVGFVAECVGPTVEAAVGAMADGDIIVLENTRFHAGEEANDPEFAKALAQNGDIFVNDAFSAAHRAHASTEGVARDLPSFAGRLMQAELSALSAALENPERPVGAIIGGSKISTKLDLIGNVIEKVDTLFITGAMANTFLAAEGMNVGKSLQEAEMHETARKIAHLAQEKGCEIVLPVDAVVAREFKANVPTETCLIGEVPDDAMILDAGPRTVELIRDRLDTLKTLVWNGPLGAFEIAPFDKATVEVAQYAAQLTEEGKLKTIAGGGDTVSALRHAGVANEMTYVSTAGGAFLEWLEGKILPGIEVLRSAGHDLGLE

SEQ ID NO: 52308 - protein, 352 aa, Gluconobacter oxydans 621H
MPEFSRNGVGQVMAVKIAINGFGRIGRLVLRGIIESGRTDVEVVAINDLGSVEANAHLLAYDSTHGRLPGTVRAEGNSLIIEANGRTYGPIKVSAERNPAQVPFQGVDVAMECTGLFTSREKASALLEAGAKRVVISAPATDVDATIVYGVNNDVLTPDMKIISNASCTTNCLAPVASVLDKAFGIECGYMVTIHSYTGDQRTVDTLHKDPRRARAAALNMIPTSTGAAKAVGLVLPHLKGKLDGTSIRVPTPNVSVVSLDFVPTRTPASAEAVNEAIRAASLEGPLKGILEYNTAPLVSSDFNHDKASSIFDATQTVLVDGGKMVRVCSWYDNEWGFSNRMADTAALFGSL

SEQ ID NO: 52309 - protein, 183 aa, Photorhabdus luminescens subsp. laumondii TTO1
MTANAQQLQFIKDSIETIPDYPKPGVLFRDITTLLDNPLAYQATIDLLVERYQGKGITKIVGTEARGFLFGAPVALRLGVGFIPVRKAGKLPRETLSETYNLEYGTDTLEMHKDSVRENDKVLVIDDLLATGGTVEATVRLIRRLGGEVSEAAFIIGLLGLGGVERLQRQGVSSFTLLEFPDH

SEQ ID NO: 52310 - protein, 272 aa, Solanum tuberosum
MASPDDHDHHHHNHDHTHEDTKATSWVGADGKVYHSHDGLAPHSHEPIYSPGYFSRRAPPLIDRNFSERAFTIGIGGPVGTGKTALMLALCKVLREKYSLAAVTNDIFTKEDGEFLIKHGALPEERIRAVETGGCPHAAIREDISINLGPLEELSNLYKADILLCESGGDNLAANFSRELADYIIYIIDVSAGDKIPRKGGPGITQADLLVINKTDLASAVGADLSVMERDALRMRDGGPLVFAQVKHGVGVEDIVNHILQAWEVSTGNKKR

SEQ ID NO: 52311 - protein, 278 aa, Solanum tuberosum
MASPDHHMHDHDHGHHHHNHDHTHEDTKATSWVGADGKVYHSHDGLAPHSHEPIYSPGYFSRRAPPLIDRNFSERAFTIGIGGPVGTGKTALMLALCKVLRDKYSLAAVTNDIFTKEDGEFLIKHGALPEERIRAVETGGCPHAAIREDISINLGPLEELSNLYKADILLCESGGDNLAANFSRELADYIIYIIDVSAGDKIPRKGGPGITQADLLVINKTDLAPAVGADLSVMERDALRMRDGGPFVFAQVKHGVGVEDIVNHILQAWEVSTGNKKR

SEQ ID NO: 52312 - protein, 280 aa, Solanum tuberosum
MASSGHHMHDHDHHDHDNHHHHHHTHEDTKATSWVGADGKVYHSHDGLAPHSHEPIYSPGYFSRRAPPLNDRNFNERAFTIGIGGPVGTGKTALMLALCKLLREKYSLAAVTNDIFTKEDGEFLIKHGALPEERIRAVETGGCPHAAIREDISINLGPLEELSNLYKADILLCESGGDNLAANFSRELADYIIYIIDVSAGDKIPRKGGPGITQADLLVINKTDLAAAVGADLSVMERDALRMRDGGPFVFAQVKHGVGVEDIVNHILQAWEVATGNKKR

SEQ ID NO: 52313 - protein, 392 aa, Mycobacterium sp. MCS
MAQREWVEKDFYKELGVSSDASADEIKKAYRKLARDLHPDTNPDPSAAERFKAVSEAHSVLSDAAKRKEYDETRRLFAGGGFGRGRFNGGGGGFGGFGGADGGVEFNLNDLFDAAGQTGGANIGDLFGGLFGRGASPRPSRPRRGNDLETETELSFLEATKGVAMPLRLTSPAPCTNCHGSGARPGTSPKVCPNCNGAGVVNRNQGAFGFSEPCTECKGSGSIIEHPCGECKGTGVTTRTRTINVRIPPGVEDGQRIRLAGQGEAGLRGAPSGDLYVTVHVRPDKVFGRDGDDLTVSVPVSFHELALGTTLSVPTLEGKVGVRVPKGTSDGRILRVRGRGVPKRGGGHGDLLVTVKVAVPPNLEGEAAEALEAYAKAERASGFDPRAGWAGA

SEQ ID NO: 52314 - protein, 390 aa, Medicago truncatula
MVAEAEVVVCQQSVDVKYFPNKGSNNHEIGDVDSNFDRVRVSESVSAELLTTKEDVRTTDKISEAALDSAVLQFVPSIRSGSFADIGPRRYMEDEHIRIDDLSSHLGSLYNFPKPSAFYGVFDGHGGPEAAAYIRKNVLKFFFEDVNFPQISEVDNVFLQEVENSLRKAFLLADSALADDSNVNTSSGTTALTALIFGRLLMVANAGDCRAVLSRKGEAIDMSQDHRPIYPSERRRVEELGGYVEDGYLNGVLSVTRALGDWDMKLPRGTPSPLIADPEFRQVVLTEDDEFLIIGCDGIWDVMTSQHAVSLVRKGLRRHDDPEKCARDLVMEALRLNTFDNLTVIIICLSSLDHGESEPSPPPQRKLRCCSLSAEALCSLRSLLEGNASN

SEQ ID NO: 52315 - protein, 440 aa, Gluconobacter oxydans 621H
MSQSAPTADFRDLCAFDALEDGKITPFSLDGTPVVLIRDGENVHGFAGKCPHKEAPLEQGAFCKTEKGSVLVCPWHKAVFDATDGSLVEPLALDPLPQYPVQIVDGRVLVGLKPKQRQAPEKRQENESVLLLGAGAAAVSAAVTLRAEGFAGTITMVSEEKDLPYDRTALSKTVLVSESEKAHAPPVREEEFYTQRGITRVRGHVAQFDPQTRTAKLQDGTELTADHVLIATGAVTRKPDIPGVDMKGVYTLHREADAERIAAILDPDLAVTIVGAGFIGLEAASSLRQRGVGVTIISDSEIPMEKQFGREIGIRLRQLHEENGVAFVSDARVTKIYAEDGKDGTASGVELDDGTRLPAAFVLLGVGVTPATDYVSGLERDESGAIVVNGQMRVTRGGEAGVYSGVYAAGDASAVFHDGAPRRIEHWRHAEVQGRIAAWR

SEQ ID NO: 52316 - protein, 124 aa, Streptomyces avermitilis MA-4680
MSIEKPEIDFPGGEPPADLEIKDIWEGDGPVAKAGNTVSVHYVGVAFSTGEEFDASWNRGTPLQFQLGAGQVIKGWDQGVQGMKVGGRRQLTIPAHLAYGDRGAGGGRIAPGETLIFVCDLVAV

SEQ ID NO: 52317 - protein, 306 aa, Burkholderia mallei ATCC 23344
MSRHAIQWSGVFPAVSTQFKPDFSLDVDATHRVVKNLVNDGVSGLVVCGTVGENTSLGTAEKLAVIEAARDAAGGKVPVIAGVAEFTTEFARNTVREAQRVGVDGVMVMPALVYSAKPHETAAHFRAVASSTDLPVMVYNNPPIYRNDVTPDVLIALQDCENIVCFKDSSGDTRRFVDLRNAVGDRFVLFAGLDDVVVESIAVGAQGWVSGMSNAFPKEGETLFRLAKQKRFDEALALYRWFMPLLHLDARPDLVQCIKLCEELVGRGSALTRPPRLALQGDTLAHVKAIVAKALETRPTLPDVGL

SEQ ID NO: 52318 - protein, 337 aa, Xylella fastidiosa Temecula1
MNAPQAPVLVADIGGTNARFALANPTLTSAPLLNDSMREFAVIEFPSLGEAAQHYLHHIGIHTTKGVFAIAGHVDGDEARITNHPWVITRTRTATMLGFDTLHLINDFVAQAMAISVLGPQDVIQIGSAKWEQFPLSAATRNYGIIGPGTGLGVGGLMIRNGRCYPLETEGGHVSFPPSTPEEIRILEILSQQFGRVSNERLISGPGIVNIHRALSEIDGIDPGPLRPQDITMRAADGDIRATRTINLFCNIFGTITGDLVLIQGAWDGVFLTGGLVPKLLNSIQHSGFRQRFEHKGRFSAIMARIPSLAVIHPHPGLLGAAAYARDTEQVPQEIKA

SEQ ID NO: 52319 - protein, 174 aa, Arabidopsis thaliana
MDEVMTAADVGSLGGGNRALYGSPPSHNLFPHNLPIFSAFLAFALAQFLKVFTNWYKEKRWDSKRMISSGGMPSSHSATVTALAVAIGFEEGAGAPAFAIAVVLACVVMYDASGVRLHAGRQAELLNQIVCEFPPEHPLSTVRPLRELLGHTPIQVAAGGILGCVVAYLMRSSS

SEQ ID NO: 52320 - protein, 442 aa, Rhodobacter sphaeroides 2.4.1
MATEILMPALSPTMEEGTLAKWLKKEGDEVRSGDIIAEIETDKATMEFEAVDEGILGKILIAEGTAGVKVNTPIAVLVEEGESVDAVSSAKVPEPQEPADEAAPAQGAPKEAPAPAAKAPAAQAARSEGERVFASPLARRIAKEKGIDLAAVQGSGPRGRIVKADVEGAQPSAAPAAKADAAAPKAEAPAAAAAPVAAPAASAASVAKLFADRDYEEVTLDGMRKTIAARLSEAKQTIPHFYLRREVALDALMAFRADLNAKLESRGVKLSVNDFIIKACAVALQQVPNANAVWAGDRILRLKPSDVAVAVAIEGGLFTPVLRDAHQKSLSALSAEMKDLAARARTKKLAPHEYQGGSFAISNLGMFGVENFDAVINPPHGSILAVGAGIRKPVVGKDGAITTATMMSMTLSVDHRVIDGALGAEFLKAIVENLENPIAMLA

SEQ ID NO: 52321 - protein, 265 aa, Arabidopsis thaliana
MEFERYLGEGSFGSVSLFSYKRRCDVETLYAAVKTSDDAKSLYEEFQILSKFKGCSRIVQCYGSGVEQRLNDKGYVEYTIPMEYAAGGSLSDFMDRFNDKKLPDPMIRKFTRMLLEGLATIHRHGYVHCDLKPENILVFPGSVCDLKLKISDFGLSKRDGDTTWWHPLKSYAGTPIYMSPESISHGEIGKGLDLWSLGCVVLEMYTGKRPWWHTNYELEDLMKCYEPLFPPNLPCDAKLFLMTCFAPEPDERKDALTLLRQSFFR

SEQ ID NO: 52322 - protein, 463 aa, Rhodobacter sphaeroides 2.4.1
MATQVLMPALSPTMEEGTLAKWLVKEGDAVKSGQIIAEIETDKATMEFEAVDEGTVGKLLVAEGTSGVKVNTPIAVLVEEGESADEVQAPVPTQKEKQPEPAEASEGKAVDEPLVSSPGAPVPGKRDRSPDWPDGTQMKTMTVREALREAMAEEMRGDEHVFLMGEEVGEYQGAYKISQGLLDEFGDRRVVDTPITEHGFAGIAVGAAFGGLRPIVEFMTFNFAMQAIDQIINSAAKTLYMSGGQMGCPIVFRGPNGAAARVGAQHSQDYAAWYAQIPGLRVVMPYSAADAKGLLKTAIRDPNPVIFLENEILYGRSFEVPVMDDFTIPFGKARIWREGTDVTIVSFGIGMTYALEAADKLAAEGISAEVIDLRTLRPIDYETVIESVKKTNRCITVEEGWPVGSIGNHLAATIMQQAFDWLDAPVLNLTGKDVPMPYAANLEKHALVTTAEVVEAAKSVCYR

SEQ ID NO: 52323 - protein, 279 aa, marine gamma proteobacterium HTCC2143
MTTTDKYAVFGNPIKHSKSPQIHSAFARQTQQNISYRAHQVDEGKFSDAAGSFFANGGKGLNITVPFKLDAYDFADELSARARCAGAVNTLAMQEDGRIYGDNTDGAGLVRDICENLAWDIGGKRVLLLGAGGAIRGVLEPLIKLKPAHLLIANRTVKKAQQLARDFSQFGDVSACSFEALRANQFDLIINGTSASLAGELPPLPSEALTDEGCCYDMMYGAGPTPFMRWGAANAAWAVSDGLGMLVEQAAESFCIWRGVRPQTRLVIDAIREELEAEI

SEQ ID NO: 52324 - protein, 211 aa, Oryza sativa (japonica cultivar-group)
MRRQSTRGRNTGSGDGEESAAPAAGMRRQSTRGRSTGSGDGEESEALAAAVHAGKISREDAAARRMARTKQTARKSTGGKAPRKPLRAIAAVMPAPSSRGVARKSVPFIGVKKPRRHRPGTVALREIRKYQKNTELLIRKLPFQRLVREIAQHFKHDMRFQSHAVLALQEAAEAYLVGLFEDTNLCAIHSKRVTIMSKDVQLARRIRGERL

SEQ ID NO: 52325 - protein, 156 aa, Oryza sativa (japonica cultivar-group)
MAFWQARDFLFCGVCGTLLKFDSVRSASCPLCGFKRKAKGRRLPHLSPCKALGCVLLAADAFVLFFYGADIEGKETRYTVTAEDIRRELKLDPYVILETTLKEEDVIVERATVNKECEKCKNPELQYYTKQLRSADEGQTVFYKCANCRHEFNENQ

SEQ ID NO: 52326 - protein, 656 aa, Burkholderia mallei ATCC 23344
MCGITGFVGPVACAPQTARATLARMTDSLAHRGPDDTGLWIDHDAGVALGHRRLSIVDLSEHGHQPMLSACGRYAMTFNGEIYNFRQLRSELEREHRAPEWRGHSDSEVLLAAFCAWGVDRALQKAVGMFALALWNRESRVLTLARDRIGEKPLYYGRIGGSFVFGSELKALRRFPGFDAHPIDRDALCLYLRHASVPAPYTIYEGIRKLPPGTYAQLEDLAEAPAPRRYWSLERAIAAGRANPFDGDANAAVAQLDYVLRDAIAEQSVADVPLGAFLSGGVDSSVIVALMQTQTAQPVQTFTIGFHEAGYDEAGYAKAVARHLGTSHTELYVKPADVLATVPRMPCVYDEPFADSSQIPTLLVSELTRRHVKVSLSGDGGDELFGGYTRYFLTPRLWGRLRRVPAAVRMRIAAALHALRPDHADQIASLVQGAWSASAQRDASPRVGDRLHKLANVMTADSRASLYRLLMSSVHHPERFTLAGHEPQTLIDTPGAWPAGLSFAEQAMAVDTLTYLPTDILTKVDRAAMAVSLETRMPFLDHRVVEFAWRLPEALRIPDGQDKWLLRKLLYRYVPRPLIDRPKQGFCAPVGAWLRGELSDWAAELLRPARLRDEGYLDAARVERLWRQHQSGRMNWQHPLWTVLMFQAWLERQRAE

SEQ ID NO: 52327 - protein, 397 aa, Rhodobacter sphaeroides 2.4.1
MGWKTLDDMDLAGKVVLVRVDVNVPMENGEVTDATRIEKIVPTVEDILKKGGKPVLLAHFGRPKGKVVDEMSLRLVLPALQNALPGTKVSFAADCVGPEPEQAVAAMLEGEVLLLENTRFHAGEEKNDPELAAAMAKLGQVYVNDAFSAAHRAHASTEGLARLLPSAAGRLMEAELKALEAALGHPERPVVAVVGGAKVSTKLDLLGNLVGRVDHLVIGGGMANTFLVAQGIEVGKSLAERDMADTAREILSKAKAAGCTIHLPLDVVVAREFKAGAANETVETAACPADAMILDAGPKTVAALSEVFASAKTLIWNGPLGAFEIEPFDAATNAAALQVAQLTKAGQLISVAGGGDTVAALNKAGAAEGFSYISTAGGAFLEWMEGKELPGVAALTV

SEQ ID NO: 52328 - protein, 140 aa, Anaplasma phagocytophilum HZ
MQERTLSILKPDVVERGIIGNVISYIEAAGLKVVAQRMCRLTVSQAEEFYDVHRDRPFFPELVKFMTSGPVVVQVLEGESAIAVYRDVMGATNPKEAAKGTIRADFAESIDANCVHGSDNADNAKREIMFFFGECEIFKR

SEQ ID NO: 52329 - protein, 121 aa, Anabaena variabilis ATCC 29413
MRIILLLLLLAIATFKITFISPALAAELPTGAKIFNNNCASCHIGGGNILISEKTLKKEALLKYLEDYETNSIQAIIHQVQYGKNAMPAFKDKLSTEEILEVAAYIFQKAEKDWSNLEKEG

SEQ ID NO: 52330 - protein, 570 aa, Buchnera aphidicola str. Sg (Schizaphis graminum)
MISGILASPGIAFGNVLLLKKEEIVINRQNISTENIKTEINKFFNGRKKSVKQLTEIKIATGEKFGKKKEGIFEGHIMLLEDEELEKEIINLITEKKISAAEATKFIIEGQAKALEKIKDEYLKNRAIDVRDIGSRLLKNILNISIVDLNNIKNQVILISKDLTPSETAQINLKYILGFITDLGGPTSHTSIMARSLEIPAIVGTVNITKKVKNNDFIILDSLNNEIIINPSDQIINEKKQVERKYFFKKENLKKLRNLYATTTDGHNIKIGSNIGNIQDIYSAKKNGAECIGLYRTEFLFMGRNALPTENEQFQAYKEIAESMENKPVIIRTMDIGGDKDLPYMNLPKEENPFLGWRAIRISMDRKEILHAQLRAILRASAFGKIYILFPMIISVEEIRTLKIEVHKLQIQLKKEHLVFDENIKIGIMIETPASAIIADHLIKEVDFFSIGTNDLTQYTLAVDRGNDLISHLYNPISPSVIQLIKQVIDISHLHGKWTGMCGELAGDERVTTLLLGMGLDEFSMSSTSIPKIKEIIRKTSFSKSQELAKKVLKAATTKEILDLLNKFII

SEQ ID NO: 52331 - protein, 122 aa, Nostoc sp. PCC 7120
MSSDNRMSETTETIFSKIIRREIPANIVYEDDLALAFKDVHPQAPVHILVIPKQPLAKLSDADSHDHALLGHLLLTAKRVAQEAGLENGYRVVINNGNDGGQTVYHLHLHILGGRPMAWPPG

SEQ ID NO: 52332 - protein, 486 aa, Burkholderia vietnamiensis G4
MSFESLGLAEPLVKAVNELGYTSPTPIQQQAIPAVLGGGDLLAGAQTGTGKTAGFTLPILQRLHTFYTEHRGAKRAVRALILTPTRELAAQVEESVRAYSKYVKLRSTVMFGGVSINPQIDALKRGVDIVVATPGRLLDHMQQKTIDLSDLDILVLDEADRMLDMGFIHDIKRVLAKLPPRRQNLLFSATFSDEIKALADSLLDSPALIEVARRNTTAETVAQKIHPVDRDRKRELLTHLIREHNWFQVLVFTRTKHGANRLAEQLTKDGISAMAIHGNKSQSARTRALAEFKNNTLQVLVATDIAARGIDIDQLPHVVNFDLPNVPEDYVHRIGRTGRAGATGEAVSLVCVDEKQLLRDIERLIKREIPQEVIAGFEPDPNVKPEPIQQRRGQQPRGGGNGGGGGGGGGNRQPRAGGSGQAGAKRDANAQPKAAKAAKPRAAGGASGNANGGGRPAGGGNGARPANGNAAHPNRNRSSRSGQRGH

SEQ ID NO: 52333 - protein, 78 aa, Oryza sativa
FHPSSILQTRVNLTRLETPTLWRYWKHFNLVSMNPDPSKEQLFHGVQQHFQSQQQLDELQVILGFIQAAKRLKTLYHS

SEQ ID NO: 52334 - protein, 278 aa, Solanum tuberosum
MASPDHHMHDHDHGHHHHNHDHTHEDTKATSWIGADGKVYHSHDGLAPHSHEPIYSPGYFSRRAPPLIERNFSERAFTIGIGGPVGTGKTALMLALCKVLREKYSLAAVTNDIFTKEDGEFLIKHGALPEERIRAVETGGCPHAAIREDISINLGPLEELSNLYKADILLCESGGDNLAANFSRELADYIIYIIDVSAGDKIPRKGGPGITQADLLVINKTDLAAAVGADLSVMERDALRMRDGGPFVFAQVKHGVGVEDIVNHILQAWEVSTGNKKR

SEQ ID NO: 52335 - protein, 284 aa, Solanum tuberosum
MASPDHHMHDHDHDHDHDHDHHHHNHDHTHEDTKATSWVGADGKVYHSHDGLAPHSHEPIYSPGYFSRRAPPLIDRNFSERAFTIGIGGPVGTGKTALMLALCKVLREKYSLAAVTNDIFTKEDGEFLIKHGALPEERIRAVETGGCPHAAIREDISINLGPLEELSNLYKADILLCESGGDNLAANFSRELADYIIYIIDVSAGDKIPRKGGPGITQADLLVINKTDLAAAVGADLSVMERDALRMRDGGPFVFAQVKHGVGVEDIVNHILQAWEVATGNKKR

SEQ ID NO: 52336 - protein, 272 aa, Escherichia coli O157:H7 EDL933
METYAVFGNPIAHSKSPFIHQQFAQQLNIEHPYGRVLAPINDFVNTLNAFFSAGGKGANVTVPFKEEAFARADELTERAALAGAVNTLKRLEDGRLLGDNTDGVGLLSDLERLSFIRPGLRILLIGAGGASRGVLLPLLSLDCAVTITNRTVSRAEELAKLFAHTGSIQALGMDELEGHEFDLIINATSSGISGDIPAIPSSLIHPGIYCYDMFYQKGKTPFLAWCEQRGSKPTADGLGMLVAQAAHAFLLWHGVLPDVEPVIKQLQEELSA

SEQ ID NO: 52337 - protein, 433 aa, Zea mays
MARHFKYVILGGGVAAGYAAREFAKQGVNPGELAIISKEPVAPYERPALSKGYLFPQNAARLPGFHTCVGSGGERLLPEWYSEKGIELILSTEIVKADLASKTLTSAAAETFTYETLLIATGSSVIKLTDFGVQGAESNNILYLRDIADADKLVAAMQAKKGGKAVIVGGGYIGLELSAALKINNFDVTMVYPEPWCMPRLFTAGIAHFYEGYYANKGIKVVKGTVAVGFDADANGDVTTVKLKNGSVLEADIVIVGVGGRPLTRLFIGQAADEKGGLKTDAFFETSVAGVYAIGDVATFPLKLYNEQRRVEHVDHARKSAEQAVRAIKAKESGESVAEYDYLPYFYSRSFDLAWQFYGDNVGDDVLFGDNDPASAKPKFGSYWVKDGKVVGVFLEGGSAEENQAIARVARAQPPVADVQALKQEGIDFASKI

SEQ ID NO: 52338 - protein, 427 aa, Streptococcus pyogenes M1 GAS
MTHSTKQEHSHSQSAVLGLQHVLSMYAGSILVPIMIAGALGYSARELTYLISTDIFMCGVATFLQLKLTKHTGVGLPVVLGCAFQSVAPLSIIGAQQGSGAMFGALIASGIYVILVAGIFSKIARFFPPIVTGSVITVIGLSLVGVAMGNMGDNVKEPTAQSMMLSLLTIVIILLVQKFTKGFVKSISILIGLVAGTLVSAMMGLVDTTPVVEASWIHVPTPFYFGMPTFEITSIVMMCIIATVSMVESTGVYLALSDLTNDQLDEKRLRNGYRSEGIAVFLGGLFNTFPYTGFSQNVGLVQISGIKTRRPIYYAAGILVVIGLLPKFRAMAQMIPSPVLGGAMLVLFGMVALQGMQMLNRVDFQKNEYNFIIAAVSISAGLGFNGTNLFASLPETAQMFLTNGIVIATLTSVVLNLVLNGKDKQDE

SEQ ID NO: 52339 - protein, 142 aa, Prochlorococcus marinus str. MIT 9515
MLDEINPIESDFNAALSRYKDGKELIPILEDFQKIIQQIPNHFAAWTCLSWLHLLLKNNEEALAAARQAVRLNQQDPQARMNLSLALLATNNKGVRENVELIKKMSIMMPDVKTELKDSVADGFNRYPNWPELTKINKWLEF

SEQ ID NO: 52340 - protein, 202 aa, marine gamma proteobacterium HTCC2143
MTEKHIDFRQAEFRTSAAKLADCPSDDGCEVAFAGRSNAGKSSAINTLTDNKRMARTSKTPGRTQLLNFFDVGERQRLVDLPGYGFAKVPLAVKEKWQRHLGEYLRERESLAGLVLLMDCRHPLQEFDRMMLAWAEGCEMPVHILLTKADKLKKGPANSVLLKVREELKQQELVSIQLFSALKRTGLDQLREKLQIWLRFEE

SEQ ID NO: 52341 - protein, 457 aa, Sulfitobacter sp. EE-36
MTDIIKCKAAVAWAVNEPLSIEEIDVMPPKAGEVRIKIIASGVCHTDAFTLSGEDPEGLFPVILGHEGGGIVESIGEGVTSVAVGDHVIPLYTPECGECKFCKSGKTNLCQKIRETQGRGLMPDGTSRFYKDGQPILHYMGCSTFSEYTVLPEISLAKVNPDAPLEEVCLLGCGVTTGMGAVMNTAKVEEGSTVAIFGMGGIGLSAVIGATMAKASRIIVIDINESKFDLARKLGATDFINPKDHDKPIQDVIVEMTDGGVDYSFECIGNVNVMRSALECCHKGWGESVVIGVAGAGQEISTRPFQLVTGRVWRGSAFGGVKGRSELPDYVERYMNGEFKLNDFITHTMGLEEINEAFDLMHEGKSIRSVIHFGEGSSAGRAVCRRGRGDLEALLESLKSAHLAPLCIPDQRCHSVEPMRHLGERREQEKRQHRAEMYNQKTRHPAGAPCRIEQQTR

SEQ ID NO: 52342 - protein, 425 aa, Rhodobacter sphaeroides 2.4.1
MSTIIDIHAREILDSRGNPTVEVDVTLESGAFGRAAVPSGASTGAHEAVEKRDGDKSRYMGKGVLEAVAAVNGEIAEMLVGFDATEQVGIDRTMIEMDGTPNKGRLGANAILGVSLAVAKAAAEFTNQPLFRYVGGSSARVLPVPMMNIINGGEHADNPIDIQEFMIMPVAAQNVREAIRMGSEVFHTLKKELAAGGFNTGIGDEGGFAPNISSTREALDYILRSIEKAGYKPGEDIYLALDCASTEYFKGGKYEMKGEGKSLTSAENVDYLAALCADYPIISIEDGCAEDDWEGWKLLTDKLGAKVQLVGDDLFVTNPKRLEQGIKAGVANSMLVKVNQIGSLTETLMAVDMAHRARYTNVMSHRSGETEDATIADLAVATNCGQIKTGSLSRSDRLAKYNQLIRIEEMLGEVAEYAGRSILKV

SEQ ID NO: 52343 - protein, 99 aa, Oryza sativa
  misc_feature (8)..(8): Xaa can be any naturally occurring amino acid
  misc_feature (20)..(20): Xaa can be any naturally occurring amino acid
MENSAEMXQRFIEQEQPEGXMVSRDGRPSSHSVCWDKCITSTPGSKFSSGETTCLTNCAQRFLDMSVIIAKRFEMPVAWQHLKWTTYIKCLFLFSLSFL

SEQ ID NO: 52344 - protein, 493 aa, Agrobacterium tumefaciens str. C58
MTIATPLKAQPKASHFIDGDYVEDNTGTPFESIFPATGEMIAKLHAATPAIVERAIASAKRAQKEWAAMSPMARGRILKRAADIMRERNDALSTLETLDTGKPIQETIVADPTSGADAFEFFGGIAPSALNGDYIPLGGDFAYTKRVPLGVCVGIGAWNYPQQIACWKAAPALVAGNAMVFKPSENTPLGALKIAEILIEAGLPKGLFNVIQGDRDTGPLLVNHPDVAKVSLTGSVPTGRKVAAAAAGHLKHVTMELGGKSPMIVFDDADIESAVGGAMLGNFYSSGQVCSNGTRVFVQKKAKARFLENLKRRTEAMILGDPLDYATHLGPLVSKAQQEKVLSYIEKGKAEGATLITGGGIPNNVAGEGAYVQPTVFADVTDDMTIAREEIFGPVMCVLDFDDEDEVLARANATEFGLAGGVFTADLARAHRVVDGLEAGTLWINTYNLCPVEIPFGGSKQSGFGRENSAAALEHYSELKTVYVSTGKVDAPY

SEQ ID NO: 52345 - protein, 516 aa, Triticum monococcum
MAMAMELLVSYPEVLLAIVSYLCLSLLRLILRCQKSGIPVKWPVVGMLPFLVRNRHHIHDKFAHALHEAGCNLMFTGPWFLDMDFFLSCDPATVNHCLSANFNNYPKGGEFAEMLDFLGNGIIVSDSESWEYQRHMAMHILGSRAYRTFSMSTITTKAGATLLPYLDGMARRGSEVELEGVFMRFLLDVTYTSAFATDLDGLSMSLPIPAFGQATKTAEEAVMFRHTVPRSLWKLLRALKVGSEKKMAGARVVIDRHIYQEIAKRKAHLLQGEEGDVLSMCIKWPMDPSMSEQHKTQFLRDTLLGFIFAAKDLTAVTLTWFFYMMCNHPHVEARIIEEITALLQLQSTTMPAGSLSVLDGDMLRQAVYLQAAFLETLRLFPASPFEEVEAVNDDALPNGTRLSKGTRIVFSLYAMGRLEGIWGKDCAEFRPERWLSKSGRLRHQPGYKFPAFNAGPRSCVGKDLALGSMKMIAASIIYNFKVQLVEGHAVMPGSSIVLHTRNGIMVSLKRREAAAA

SEQ ID NO: 52346 - protein, 319 aa, Staphylococcus aureus subsp. aureus MW2
MRRLFSIGEALIDFIPNITNANLKDVQTFTKQIGGAPCNVACTVQKLGQQAYMITQLGNDAFGDSIIETISSIGVDVSKVYRTNEANTALAFVSLTEAGERDFSFYRKPSADMLFEPSFVNDIDVNENDVVHFCSVDLVDSPMRDAHYQLITKTLNANGTVVFDPNVRLPLWDNAEDLRQTIHTFLPLAHIVKVSDEELEFITGIHDENEAIQSLFTGNVTVVIYTKGADGAAVYLKNGINHYHSGYKVKPVDTTGAGDAFIGAVISRILATDVLNLTQLFENEGEEILAFSNRVAAIVTTKYGAINSLPTLQEVEQAF

SEQ ID NO: 52347 - protein, 778 aa, Aspergillus oryzae
MAVECKEAIANPEPEPELGDKSDATEKDDSKALHYTNLCTLVLITNAAGSSVGEILRAAGIDTEDDDPTEAVLTLRMWVLGIGFCIVVSGLNTLYTLRNPSITISSAVVLLLAYPLGKLWEKAIPSWNVPLGAWSFNLNPGPFNKKEHILVYVMSNLSIYVRLGADVLTEQQMFFGYKAGWGFQIPMTLAGFFVGLSLAGIFRSLVVLPHELVWPGLLGTSALTSTLHESKKKDAQAIESFGYTTWKISRYAFFSLVFCISFCWYWFPDFIFPALSYFAFPCWIAPKNTVVNQLFGMKSGMGLLPLTFDWSQISYVGSPLVVPSWAIVNVFGALVFWIWIVAVACYYTNTWYSAYLPFQSSSVFDNTGSTYSASKIVNKASRYQLDVAKYEAYSPVFMPVTYALNMFGLSFATLTSLVVWMFLEKRQEIADAMRRVQHKFVTGNLKEIFAPDNSPNAEVPMWWYLCTTLLALFLAIFSVEYWDVELRWYGALLACAVALSFFSPLALVYATANQKINIDIFCRIVAGFVFEGRVLANIWFFNLGYVTTIKGLYFCQDMKLGIYFNIPPRKLFIAQCGGIIAGTLSSVSVLNWGLGNIEGVCTTDAVNGFSCPFSRTHFNTSLIWGAIGPRRFFNNKIGYHSLLYFFIIGAVLPVIVFIARRRYPKNVILQKFHVPLFLGGLNYLPPATGTTYGSWALVGLAFGWIIRKRLYAWWYKYNFVLSAALDSSVSVAGVVIFFAIFFSGASSHFSWWGTKVYKDTCDWRGCSYLPIPESGKFA

SEQ ID NO: 52348 - protein, 508 aa, Helicobacter pylori 26695
MILVLDFGSQYTQLIARRLRERGIYTEIVPFFESIENIQKKAPKGLILSGGPASVYAKDAYKPSGKIFDLNVPILGICYGMQYLVDFFGGVVVGANEQEFGKAVLEITQNSVIFEGVKIKSLVWMSHMDKVIELPKGFTTLAKSPNSPHCAIENGKIFGLQFHPEVVQSEEGGKILENFALLVCGCEKTWGMQHFAQREIARLKEKIANAKVLCAVSGGVDSTVVATLLHRAIKDNLIAVFVDHGLLRKNEKERVQAMFKDLKIPLNTIDAKEVFLSKLKGVSEPELKRKIIGETFIEVFEKEAKKHHLKGKIEFLAQGTLYPDVIESVSVKGPSKVIKTHHNVGGLPEWMDFKLIEPLRELFKDEVRLLGKELGVSQDFLMRHPFPGPGLAVRILGEISESKIKRLQEADFIFIEELKKANLYDKVWQAFCVLLNVNSVGVMGDNRTYENAICLRAVNASDGMTASFSFLEHSFLEKVSNRITNEVSGINRVVYDITSKPPGTIEWE

SEQ ID NO: 52349 - protein, 174 aa, Vitis labrusca x Vitis vinifera
MPRERDPLVVGRVVGDVLDPFLRSITLRVTYNNREVANGCEFRPSQLVSQPRVDIGGDDLRTFYTLVMVDPDAPSPSNPNLREYLHWLVTDIPATTGANFGQEIVCYESPRPTAGIHCFVFVLFRQLGRQTVYAPGWRQNFNTRDFAELYNLGLPVAAVYFNCQREGGSGGRRS

SEQ ID NO: 52350 - protein, 102 aa, Arabidopsis thaliana
  misc_feature (12)..(12): Xaa can be any naturally occurring amino acid
  misc_feature (32)..(32): Xaa can be any naturally occurring amino acid
  misc_feature (38)..(38): Xaa can be any naturally occurring amino acid
  misc_feature (44)..(44): Xaa can be any naturally occurring amino acid
  misc_feature (47)..(47): Xaa can be any naturally occurring amino acid
  misc_feature (49)..(49): Xaa can be any naturally occurring amino acid
  misc_feature (61)..(63): Xaa can be any naturally occurring amino acid
  misc_feature (65)..(66): Xaa can be any naturally occurring amino acid
WLSSMLSSAAGXTSPAQATMVAPFTGLKSSAXFPVTRXTTKALXTPXAXNGGRVSCMKGVXXXIXXKKFETLSYLPGPAGQASRPFLQQGGFLGSGYLFTLF

SEQ ID NO: 52351 - protein, 109 aa, Glycine max
  misc_feature (56)..(56): Xaa can be any naturally occurring amino acid
SPTLASTTSGSTVSEQTRILKAQFLKDVQTYHTHTALKFGSTLHFLHQRLPQYKVXQLKLRAEHRDPQDLTPHIDKYINDVSILKTKKGTAEELIADFEASECNNATSR

SEQ ID NO: 52352 - protein, 174 aa, Vitis labrusca x Vitis vinifera
MPRERDPLVVGRVVGDVLDPFLRSITLRVTYNNREVANGCEFRPSQLVSQPRVDIGGDDLRTFYTLVMVDPDAPSPSNPNLREYLHWLVTDIPATTGANFGQEIVCHESPRPTAGIHRFVFVLFRQLGRQTVYAPGWRQNFNTRDFAELYNLGLPVAAVYFNCQREGGSGGRRS

SEQ ID NO: 52353 - protein, 483 aa, Gluconobacter oxydans 621H
MSLKRPLPSAEVSKARKAGMMQDFDLFVIGAGSGGVRCARIAAQNGARVAIAERRHWGGTCVNLGCVPKKLMVYAAEYGREIADAPSYGWDVKPVAHDWSTLISAKDREIERLNRIYVSMLEKAGVTLFTGDASFVDAHTVEIGPSELAPDASVQRVRAKNIVIATGSTPTRLNIPGAEHAIVSDDAFHLADRPERVAVIGSGYIGIEFAGIFAGLGSKVDLVFRQQLPLRGFDHEMRAHLSELLPLNGIKAHPGRSPERIEKVADGYRLHLEGGDVIETDCVFMATGRHPNLAPLKLGNAGVATWDGRIPAKPDDATTNVAGIYAIGDVTDTYNLTPTAIAEGHILAERLFGEPGREWSFATTPKAVFFSQPLATVGLSEEEAVQSHDVDIYTSSFTPMRQTLSGRKGKTLMKLVVDAKSKIVLGAHMIGPDAPEIIQGLAIAITAKLTKRDFDRTIGLHPTSAEEFVTMRSLTRHVPRKAG

SEQ ID NO: 52354 - protein, 973 aa, Mesorhizobium sp. BNC1
MLTKRKGGQTNRTGLQAMMGSAASAPMDRRTFLRRSGLVAGGVAALGTFQLGTVRKAAAIAPPQPGVPIELKKSICTHCAVGCTVTAEVQNGVWTGQEPSWDSPINRGSHCAKGASVRELVHSDRRLKYPMRLSGGQWERVSWEEAINGIGDKLLEIREASGPESVYWMGSAKFSNEGTYLFRKLAALWGTNNQDHQARICHSTTVAGVANTWGYGAMTNSFNDIRNSKTMMIMGGNPAEAHPIAMQHLLEGKELNNANLIVVDPRFTRTAAHATEYVRFRSGTDIALIWGMLWHIFENGWEDKEFIAQRVYGMDEIRKEVAKYTPDEVELITGVPEEQVKRVAEMFATQRPSTMIWCMGQTHHTVGTANTRASCILCLATGNVGKPGTGANIFRGHDNVQGATDIGLDVVTLPFYYGLTEGAWKHWARVWEIPYEDLVGQFSSKELMETPGIPLTRWFDSVSLPKEDVQQPDVMRAMFVQGHASNSIARIPESMKGLAGLELLVIADPHPTTWASLAVQAGRQDNTYLLPVCTQFETSGSRVASNRAIQWGEQIVKPSFEQKDDYQVLYLLSQKLGLSDWMFKNIAVEGDRPVPEDVLREMNRGSWSTGYCGQSPERLKAHMRNQHKFDLVTMRAPKEDPEVGGDYYGLPWPCWGKPELRHPGTANLYSTGLHVMDGGSPFRARFGVERNGETLLAEGSYTEGSELTDGYPEFTMAVLQKLGWDQDLTPEERSIIEQIGADMGDVGKVSWSTDLSGGIQRVALSHGCHPYGNGKARAVAWNLPDPVPIHREPIYTPKVDLVAKYPTYPDAKQFRLPNIGFSVQKAAVDNGIANSFPIILTSGRLVEYEGGGEETRSNRWLAELQQEMFVEINPADAAERGISDGAWVWVNGAENNAKARVRALVTERVGKGVAFMPFHFGGWFQGQDLRANYPQGTDPYVLGESANTITTYGYDPVTGMQEPKVTLCQIAAA

SEQ ID NO: 52355 - protein, 366 aa, Arabidopsis thaliana
MKNSIPIDLIYEILSRLPAKSVARCRCVSKRWRSILRHQVFTELFLTRSNARPRLLIGVQQDGEWSFLSTPQPQNRHESSSLVVAAADFHTKFSSGKSRHQCTYASACFDVRSEKFNFIATKHRYDQLINYKGKLCGINLEYARHVGGFPVKLSMWVLEDVEKPEWSKHVYSLWTESEVVKVNRNLSVSGMTATGDIVLSMEDATNPFYVFNFNPDRNTLQVQSVEIQGLGANRDHIACHAFVDYVEDFSVSDAVLQLKSSPLQQQGQDTSHDLSKSVKNKQLDNYEFLANKLNHSVSLAILFCLFFLLFNYLIRLCWGRSIVINKSKPQQRRHTSRDLCKSAPSVKNKQHNKYESLANILYHSVG

SEQ ID NO: 52356 - protein, 729 aa, Aspergillus oryzae
MYVWYVHANATFVHSNGCGLDIGVKDGRVVGVRGRATDRVNKGRLGPKGLHGWESIHHPDRLKHPLIRRNGKLEQASWDEAMSLIVDKAKEIRARLTNHGIGFYTSGQLFLEEYYVLAMIGKAGLNTLHMDGNTRLCTATAAASMRESFGSDGQPGSYGDIDYTECLFMVGHNVANTQTVLWSRILDRLEGAYPPKLIVVDPRRSETAKKATIHLAPKIGTNVALLNGLQHLLFKNGWVNEAFVSKHVVGLQQLEAVVEEYTPEYVMQVTGVPTTLLEEAARIIGTSSSLLSTALQGVYQSNQATAAACQINNINLLLGHIGKPGSGILQMNGQPTAQNNREAGCDGEYPGFRNFQNQKHMQEIADHWNIDLIRMPHWNQPTHIQNMLNYIENGSIEMFWVSGTNPLVSLPNLHRVRDLFTKPDLFLVVQDIFPTETTAVADVVLPAAQWAEKTGCFTNADRTMHLSQKAVEPPGEAKSDLDIFLDFGRRMGFKSKDGGPLIPYTTPEEVFDAWKKMSYGRPCDCSELTYEKLTGGSGIQWPCTKEYPNGKERLFTDGKFFTDPDYCEDFGHDLETGAPYTRAQYQAMNPAGRAILKAAHHKAPLEAPDDQFPLLLSTGRNVFHFHTRTKTGRARRLQQADPQPFVRISEADARALYLTEGEMVVVRSRRGSVELPVRIGEINKGHVFIPFHFGYFDSKDPRARAANELTVAYQGQKPSDSACSSGSIG

SEQ ID NO: 52357 - protein, 311 aa, Acinetobacter sp. ADP1
MCAMNLADRDGFIWQDGQLVDWRDAKIHVLTHTLHYSMGVFEGVRAYETPKGTAIFRLQDHTKRLLNSAKIYQMKVPFDQATLEQAQIDVVRENKLASCYLRPLIWIGSEKLGIAATENSIHAAVAAWGWGAYLGEEAMARGIRVKTSSFTHHHPNVTMCKAKACGNYTVSILAHQEVARSGYDEAMLLDPQGFVCQGAGENVFLIKDGVLHTPDLAGGALEGITRQTVITIAKDLGYEVVERRITRDEFYIADEAFFTGTAAEVTPIREYDDREIGEGCRGPITTEIQKTFFDAVQGKNAKYEHWLTYVK

SEQ ID NO: 52358 - protein, 482 aa, Ralstonia metallidurans CH34
MTETYRNYIDGEWCDSASGRTVDNVNPADTRDIVSRHAASDARDAAAAVAAAAAAFDGWKKTPIGKRAKILNDAAAHLEANADTIATELTREEGKALNLARDEVMRSAQTLRFYAVEGQTFSGESYPNDDPDMLVYSLREPLGVVTVISPWNFPVSIPARKIAPALITGNTVVFKPSSDAPLSGYRLAEAFVRAGIPKGVLNFLTGSAAEVGPTIVESREVRAVSFTGSTSAGEQIHKSVPMTTRTQMELGGKNPLIVMEDADLDRAVDLAVKGGLSLSGQACTGTSRILVMRDVKQAFTEKLVAKVKALKIGSGMTAGMDLGPLATRKQLETVLSYIAIGKQEATLLCGGEQLSDGDFAHGYYVAPTVFTDVTQSMRIAREEIFGPVLAIIEVDSYADAIAQANDTEYGLSAAIATRNPRYMHDFTRDIESGTVKINRTTTGNLVNAPFGGLKRSSTSTFRESGRAGLEFYTQIKTVYQGI

SEQ ID NO: 52359 - protein, 650 aa, Helicobacter pylori 26695
MQKSLITTPIYYVNDIPHIGHAYTTLIADTLKKYYTLQGEEVFFLTGTDEHGQKIEQSARLRNQSPKAYADSISTIFKDQWDFFNLDYDGFIRTTDSEHQKCVQNAFEIMFEKGDIYKGAYSGYYCVSCESYCAISKADNTNDKVLCPDCLRETTLLEEESYFFRLSAYEKPLLDFYAKNPEAILPVYRKNEVTSFIEQGLLDLSITRTSFEWGIPLPKKMNDPKHVVYVWLDALLNYASALGYLNDLDNKMAHFECARHIVGKDILRFHAIYWPAFLMSLNLPLFKQLCVHGWWTIEGVKMSKSLGNVLDAQKIAMEYGIEELRYFLLREVPFGQDGDFSKKALIERINANLNNDLGNLLNRLLGMAKKYFNHSLKSTKITAYYSKELEKVHQILDNANSFVPKMQLHKALEELFNVYDFLNKLIAKEEPWVLHKNNESEKLEALLSLIANALLQSSFLLYAFMPKSAVKLANAFNTEITPDNYERFFKAKKLQDMILQDTEPLFSKMEKIEKTEKAGEASPEKNEKEKKDAKEKAPLKQENYIGIEDFKKVEIKVGLIKEAQRIEKSNKLLRLKVDLGEGRLRQIISGIALDYEPESLVGQMVCVVANLKPAKLMGEMSEGMILAVRDSDNLALISPTREKIAGSLIS

SEQ ID NO: 52360 - protein, 316 aa, Buchnera aphidicola str. Sg (Schizaphis graminum)
MNQLNALKQFTTIVADTSDIESICKYKPQDATTNPSLILKAVSSSVNKRFIDQAIEYARKKGGSYNYKIVNASDKILVDLGVEILKHIPGYISSEVDARLSFNKEKCILKAKKIIDMYEEKGISRNRVLIKLAATWECIKAAEELKKNNIACNLTLLFSFAQARACAESNVFLISPFVGRIYDWYLSQNLILKNPADQDPGVLSVCKIYDFYKKYNYKTIIMGASFRNVQQILSLSGCDRLTISPVLLKELESSNKELNRKLCPPTSFLNPPVPLTEAEFRWEHNQDEMAVQKLSEGIRNFGKDQLSLEKIFSKLI

SEQ ID NO: 52361 - protein, 665 aa, Buchnera aphidicola str. Sg (Schizaphis graminum)
MCVRRELANAIRMLSIDAVQNAKSGHPGMPMGMADIAEVLWRKFFKHSPTNPNWNNRDRFILSNGHGSMLLYSLLHLTGYDLSIDELKKFRQLHSKTPGHPETGETPGVETTTGPLGQGLANAVGMAIAERTLSAYFNRPDYDIVDHYTWVFVGDGCLMEGISHEVCSLAGTLKLGKLIVFYDKNGISIDGKISNWFTDDTVMRFKSYNWHVVDKVDGHDANSIKNSIEEAKSVKDQPSIIICNTIIGFGSPNKSGTADSHGAPLGEEEIFLTRKNLNWKYSPFEIPNKIYDKWNFVKQGLKLEENWNKQFHLYKSEYPALAEEYSRRIKKKLPTQWYKKTKDYIFNLQKNPQNIATRKASQNAIEEFAALLPELIGGSADLSPSNLTMWSKSSSITENLCGNYIHYGVREFGMTAIANGISHHGGFIPYTSTFLMFVEYARNAVRMAALMNTKHIFVYTHDSIGLGEDGPTHQPIEQLANLRMTPNIDVWRPSDQVETAVAWKYAIEEKNGPTALILSRQNLFQFSRNNEQIKNISYGAYILYDSKKPIDIIFISTGSELQITLTSAKKIAALGYSVRVVSMPSNNVFDRQNIDYKESILPSYITKRIVIEASIKDFWYKYAGSEGLIIGMETFGESASEEVLFKKFGFTVENIVNKSKILLKH

SEQ ID NO: 52362 - protein, 433 aa, Arabidopsis thaliana
MALSKNSNSNSFNKKKVSYISVPSQIINSLSSSSLQSLLVSPKKSSRSTNRFSFSYRNPRIWFFTLFLVSLFGMLKLGFNVDPISLPFSRYPCSTTQQPLSFDGEQNAASHLGLAQEPILSTGSSNSNAIIQLNGGKNETLLTEGDFWKQPDGLGFKPCLGFTSQYRKDSNSILKNRWKYLLVVVSGGMNQQRNQIVDAVVIARILGASLVVPVLQVNVIWGDESEFADIFDLEHFKDVLADDVHIVSSLPSTHVMTRPVEEKRTPLHASPQWIRAHYLKRINRERVLLLRGLDSRLSKDLPSDLQKLRCKVAFQALRFSPRILELGNKLASRMRNQGQYLSLHLRMEKDVWVRTGCLPGLTPEYDEIVNSERERHPELLTGRSNMTYHERKLAGLCPLTALEVTRLLKALEAPKDARIYWAGGEPLGGKEVL

SEQ ID NO: 52363 - protein, 159 aa, Zea mays
MAAPLRRSLPSLGRALLTPAVVPARMLSAEASDALVEIKPGEIGMVSGIPEEHLRRKVLIYSPARTASQQGSGKVGRWKINFLSTQKWENPLMGWTSTGDPYANVGEAGLTFDSAESAKAFAEKHGWNYVVRKRHAPLLRPKAYAENFKWRGPPKAEQA

SEQ ID NO: 52364 - protein, 343 aa, Photobacterium sp. SKA34
MKIKALSKLKPEEGIWMTEVDKPEVGHNDLLIRIKKTAICGTDVHIYNWDEWSQKTIPVPMVVGHEYVGEVVGMGQEVRGFAIGDRVSGEGHITCGHCRNCRGGRTHLCRNTIGVGVNREGAFAEYLVIPAFNAFKIPDDISDDVASIFDPFGNAVHTALSFDLVGEDVLITGAGPIGIMAAAVAKHVGARHVVITDVNEYRLDLAREMGVTRAINVAKESLTDVMAELGMKEGFDVGMEMSGNPAAFNSMLSSMNHGGKIALLGIPPSDMAIDWNQVIFKGLIIKGIYGREMFETWYKMATLIQSGLDLSPIITHHYKIDDFQEGFDVMRSGQSGKVILDWE

SEQ ID NO: 52365 - protein, 70 aa, Arabidopsis thaliana
  misc_feature (12)..(12): Xaa can be any naturally occurring amino acid
  misc_feature (33)..(33): Xaa can be any naturally occurring amino acid
  misc_feature (36)..(36): Xaa can be any naturally occurring amino acid
  misc_feature (52)..(52): Xaa can be any naturally occurring amino acid
TITSSILSSATXISSPPQPTMVSPFNRLKSSPXFPXTLNANNNITSITSNRXRVHCLHVSPPIVKTTSNT

SEQ ID NO: 52366 - protein, 353 aa, Synechococcus sp. RS9916
MAKRAVCAPRVLCLGEALVDRLGPLGGDPATATPAECDDRLGGAPANVACALARLGTPVAFLGRLGDDAIGSSFQELLRNRGVDLRGLQTDMQRPSRVVLVRRDANGERVFQGFAGERGQDFADQGLDHRQLALAWPALAPSARWLLVGTIPLATPASTDALLWAIEQVDHSGLRLALDVNWRPTFWDPQADPAAGPAPEQLATMAPLLDRASLIKLAKEEAIWLFNSANPEAISACLPTHPDVVVTDGGNPVQWCIAGHAGTMDVLPPPRVVDTTGAGDAFTAGLLHQLLALTPAGGSPLELSAAVVQQVIRYAAACGALVCAGAGGIDPQPSACDVEHFLQHSAPMATGLR

SEQ ID NO: 52367 - protein, 288 aa, Escherichia coli K12
MDVTAKYELIGLMAYPIRHSLSPEMQNKALEKAGLPFTYMAFEVDNDSFPGAIEGLKALKMRGTGVSMPNKQLACEYVDELTPAAKLVGAINTIVNDDGYLRGYNTDGTGHIRAIKESGFDIKGKTMVLLGAGGASTAIGAQGAIEGLKEIKLFNRRDEFFDKALAFAQRVNENTDCVVTVTDLADQQAFAEALASADILTNGTKVGMKPLENESLVNDISLLHPGLLVTECVYNPHMTKLLQQAQQAGCKTIDGYGMLLWQGAEQFTLWTGKDFPLEYVKQVMGFGA

SEQ ID NO: 52368 - protein, 269 aa, Anabaena variabilis ATCC 29413
MSFRNKTIVLTGASAGIGRTLAISLSQQDANLVLAARNSEALEQTMTACTNYPGKVIAVPTDVTQAEACQQLIEIAIATFGQIDILINNAGIGMLTRFDEVTDISIFEQVMQVNYLGAVYCTHYALPYLKASQGQLVAISSICGKTGVPTRTGYVASKHAMQGFFDTLRIELHSTGVDVLVVSPGFVATDIRQRALGADGKPLGKSPRDETQGNMSVDECVRQIIWAMERRKREHIMTLKGKAIPWAKLIAPGFVDRIVAATIRKTTST

SEQ ID NO: 52369 - protein, 254 aa, Ipomoea batatas
MRVRFFFYFAYFLITLVFFPSVTLQSYSGGHRQEATGFCGEEGEREDNLIRMATTTLGGISDSASAENSVEIESLARFAVEEHNKKENAMIELVRVVKAEEQVVAGKLHHLTLEVIDAGKRKLYEAKVWLKPWMNFKELQGFNHIEDIPTLTSSDLGARRDCPNTGLKSVPVNDPVVQEAAQHAVKTIQQRSNSLLPYELQEIVHANAEVIDDSAKVHMLIKTKRGEKEEKFSVEVHKNNEGAFLLHHMAPANS

SEQ ID NO: 52370 - protein, 115 aa, Arabidopsis thaliana
MGFSFLKMGLSSKGSQIRCKSLTREEIDTFWKTKKKNEEEEHVQAFSKLVTQEGAQSQAKEKKSVDDLFENQSKSSGWWRKTYWAFLNEPREEEGRPNNYVSQFKVAHIAKIAGS

SEQ ID NO: 52371 - protein, 566 aa, Buchnera aphidicola (Schizaphis graminum)
MKKDYKKVFLKNTKEERIKENSNYLRGTIIDDLKDEITNGFTGDNFSLIRFHGMYQDDRDLRLERNEQKLEPRYAMMLRCRLPRGIIKAKKWLKIDHFASKNTLYGTIRLNNLQTFQFHGILKKTLKDAHKMLNKIGLDSLGTANDVNRNVLCTSNPMESLIHQQCYEWVSKISNFLLPQTKAYAEIWLNQKKIATTDQEPILGKTYLPRKFKTTVVVPPYNDVDLYANDMNFIAITKNNKIVGFNVLIGGGLSINHGNKNTWPFLAVELGYITLEKTLSVAESIVTTQRDWGNRTDRKNAKTRYTIAKVGLSVFKKEVEKRANMTFETIKPYYFISRGDRFGWTKNINNDWSLTVFIQNGRIYDNDKQLVKSGLLKIANLHTGNFRLTANQNIVISEILDKNKKKIEEIAISHGLIKKVSSLRENSMACVSFPTCPLAIAESERILSFFITKVENIMLKYGIEKEIIILRISGCPNGCGRSLLAEIGLIGKSLGRYNLYIGGNRIGSRIPKIYKENITEQEILIHLDFLIKIWSIERQKKEHFGDFVIRRNVVKKVVNPIYDFWN

SEQ ID NO: 52372 - protein, 120 aa, Glycine max
  misc_feature (55)..(55): Xaa can be any naturally occurring amino acid
  misc_feature (59)..(59): Xaa can be any naturally occurring amino acid
  misc_feature (72)..(72): Xaa can be any naturally occurring amino acid
YLGYLWINTLVNRCIFNGNGKVLDDLVLAAKEGVFVNIDSEFDLENIIAAAKIAXKRVXNVLLRINPDVDPXVHPYVATGNKNSKFGIRNEKLQWFLDAVKEHSNELKLVRAHCHLGSTS

SEQ ID NO: 52373 - protein, 407 aa, Zea mays
MAAALQATPLKTLSISRRRVGGAGARPRPMAASFRCSAAARSYNITLLPGDGIGPEVVAVAKDVLSLAGALEGVELRFQEKLVGGSALDATGVPLPDETLDAAKGSDAVLLGAIGGYKWDNNEKHLKPETGLLQLRAGLGVFANLRPAAVLPQLVDASTLKKEVAEGVDIMVVRELTGGIYFGKPRGFGTNDNGDDIGFNTEVYSASEIDRIARVAFEVARKRRGRLCSVDKANVLEASMLWRKRVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAANRIEAAVTETLNHGFRTGDIYSPGTTLVGCKRMGEEVLKTVNSLKEVAAVN

SEQ ID NO: 52374 - protein, 132 aa, Triticum aestivum
  misc_feature (74)..(74): Xaa can be any naturally occurring amino acid
  misc_feature (102)..(102): Xaa can be any naturally occurring amino acid
  misc_feature (118)..(118): Xaa can be any naturally occurring amino acid
  misc_feature (127)..(127): Xaa can be any naturally occurring amino acid
MVRVSVLNDALKSMYNAEKIGKRQVMIRPSSKVIIKFLTVMQRHGYIGEFEYVDDHRAGKIVVELNGRLNKCGXLLSPRFDVGVKEIEGWTARLLPSRQFGXYIVLTTSAGIMDHEEXRRKNVGGKXLGSFY

SEQ ID NO: 52375 - protein, 404 aa, Rhodobacter sphaeroides 2.4.1
MAMDTKFDDVLTGEQKLRNFNINFGPQHPAAHGVLRLVLELDGEVVERCDPHIGLLHRGTEKLMESRTYLQNLPYFDRLDYVAPMNQEHAWCLAIERLTGVAVPRRASLIRVLYSEIGRVLNHLLNVTTQAMDVGALTPPLWGFEEREKLMVFYERASGARLHAAYFRPGGVHQDLTPRLIEDIEEWAEHFPKVLDDLDELLTENRIFKQRNVDIGIISEKDILDWGFSGVMVRGSGFAWDLRRSQPYECYDEFDFQIPVGKNGDCYDRYLCRMEEMRQSTRIIQQCLAKLRVEKGDVLARGKLTPPPRGEMKTSMEALIHHFKLYTEGFHVPAGEVYAAVEAPKGEFGVYLVADGTNRPYRAKIRAPGFLHLQAIDYIAKGHLLADVSAIIGTLDVVFGEIDR

SEQ ID NO: 52376 - protein, 294 aa, Buchnera aphidicola str. Sg (Schizaphis graminum)
MFKGSIVALITPMNEEGEICHSSLKKLIDYHVLNKTKAIVSIGTTGESATLSQEEHIEVVMLTLKLANKRIPIIAGTGANATTEAISLTKRFEKSGIEACLTVTPYYNKPTQEGLYQHFKAISENTKLPQILYNVPSRTGCDLLPSTVARLSEFKNIIGIKEATGDLSRIHKIKKLVKDDFLLISGDDPTALDFIQLGGQGVISVTANIAAKEMTQMCSYALEGNFKSARSINERLMLLHESLFIEPNPIPIKWLAKKIGLIKSDTLRLPMTPILNSTRTQIEKALQYANLQKI

SEQ ID NO: 52377 - protein, 210 aa, Zea mays
QHCFVCDSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 52378 - protein, 456 aa, Escherichia coli B
MEGQQHGEQLKRGLKNRHIQLIALGGAIGTGLFLGSASVIQSAGPGIILGYAIAGFIAFLIMRQLGEMVVEEPVAGSFSHFAYKYWGSFAGFASGWNYWVLYVLVAMAELTAVGKYIQFWYPEIPTWVSAAVFFVVINAINLTNVKVFGEMEFWFAIIKVIAVVAMIIFGGWLLFSGNGGPQATVSNLWDQGGFLPHGFTGLVMMMAIIMFSFGGLELVGITAAEADNPEQSIPKATNQVIYRILIFYIGSLAVLLSLMPWTRVTADTSPFVLIFHELGDTFVANALNIVVLTAALSVYNSCVYCNSRMLFGLAQQGNAPKALASVDKRGVPVNTILVSALVTALCVLINYLAPESAFGLLMALVVSALVINWAMISLAHMKFRRAKQEQGVVTRFPALLYPLGNWICLLFMAAVLVIMLMTPGMAISVYLIPVWLIVLGIGYLFKEKTAKAVKAH

SEQ ID NO: 52379 - protein, 277 aa, Triticum aestivum
  misc_feature (41)..(41): Xaa can be any naturally occurring amino acid
  misc_feature (225)..(225): Xaa can be any naturally occurring amino acid
MALSQGPKNNYRCDRSLQQFYTGGPFAVGRAPRGEGEGDAXEAFLACACGSELRVVSAADASAIGEPIDGDSEAVTGTALSPDSRLLFAAGHSKLIRVWDLASRTCIRSWKGHDGPVMAMSCHASGGLLATAGADKKVCVWDVDGGFCTHFFRGHTGVVTTIMFHRDPKRLLLFSGSDDGTVRVWNLESKKCIAVLNAHFSTVTSLALSEDGLTLLSAGRDKGAXILACLGVEAAKLKEKTDGYFLTVGERGIVRIWCLESAVCVFEQQSSDVTINS

SEQ ID NO: 52380 - protein, 144 aa, Arabidopsis thaliana
MIKPDGVSGNYTEEIKTIVVEAGFNIVKEMLTQLDKETASAFYEEHSSRSFFPHLVTYMTSGPVLVMVLEKRNAVSDWRDLIGPTDAEKAKISHPHSIRALCGKNSQKNCVHGSDSTSSAEREIKFFFKDVVSGDIATQQHDEL

SEQ ID NO: 52381 - protein, 278 aa, Yarrowia lipolytica CLIB122
MPLLLITGYPSAGKTTRAMQIKDYFEKKIQETGSNLTVEVINDESLGLSKDSYKESRTEKMTRGEQISAVKRLVSKNTIVILDNMTYIKGFRYQLWCEAKAVATNYGVAHVGAPVDVCKEYNSIHPNKWEDDLFDALVFRYEEPNGANKWDSPLFTIPHIDKDISGEEMWNALVHRKVLKPNQATVLKPATSTDYLYELDKKTQTIVSEILDIQRDNVGGLVKLDGGNHSLQLPIDAVSLPELQRMRRQFVTLNKMRALGDDRIIPLFIEFLEKNFDE

SEQ ID NO: 52382 - protein, 150 aa, Brassica napus
  misc_feature (148)..(148): Xaa can be any naturally occurring amino acid
MNALAATNRNFKLASRLLGLDSKLEQSLLIPFREIKVECTIPKDDGTLASFVGFRVQHDNARGPMKGGIRYHPEVEPDEVNALAQLMTWKTAVAKIPYGGAKGGIGCDTSELSISELERLTRVFTQKIHDLIGIHTDVPAPDMGTGSXTM

SEQ ID NO: 52383 - protein, 355 aa, Buchnera aphidicola str. Sg (Schizaphis graminum)
MKQKILFIDRDGTLIHEPSNDCQVDAINKLEFKKYIISSLCQLMNFGYKFVMVTNQDGLGSKSFPRENFNIPHFFMLNIFRSEGIIFEDVLICPHFLDDNCDCRKPQTKLLKPWLKKNKIDKQRSYVIGDRETDMELAKNINLTGIQYKEKEFNWIDITKEIIKRNRYREVIRETKETYIHIKLWLDLEHHSCIQTGINFFDHMLEQLSIHSGISMYILAKGDLQIDDHHTIEDTGIVLGEALSQALNNKNGLSRYGFVLPMDESQAKCIIDLSNRPYLSFNAHFKHKMVGDMNTDMVEHFFYSLCCSMKITLHIDVKGKNDHHCIESLFKAFGRALRKAVKIEGNTLPTSKGIL

SEQ ID NO: 52384 - protein, 483 aa, Oryza sativa (japonica cultivar-group)
MAVQICNGKLQQKIDASSGLVVLTIQARTPSLMPPGCAKVAGAACEPVSGPKKAMLFAGLYVTALGIGGIKGSLPSHGAEQFDEHAPRGRKGRSTFFNYFVFCLSVGALIAVTFAVWVEDNKGWQWGFGISTIAILLSIPVFVAGSRLYRNKVPTGSPLTTIAKVVLAAALARRGGAQSASNGAVIDRAPSPTGSTDMKEYCKPGDICGVADGAAEVATEPSQELVFLNRAVQRQPRCGALSCTVQEVEDVKIVLMLPGAAVTFSVEQAATMDTRVGGLKVPPASLPVFPVTFIILLAPVYDHIIIPFARRATGTEMGITHLQRIGTGLVLSIVAMAVAAVVEVKRKNVASNAGMLDAAAPLPITFFWIAFQYLFLGSADLFTLAGLLEFFFSEAPARMRSLATSLSWASLALGYYLSSVLVTVVNSATGRGGRRAWLQGENLNHYHLERFYWVMCVLSTLNYLFFLFWAIRYKYRNAGVIKG

SEQ ID NO: 52385 - protein, 587 aa, Rhodopirellula baltica SH 1
MPATGITLPSPSGPPLPCSAAIFVLDHRSRLPWPFPVSPLLFYTAALAFPAISGKNTMTSSANTTSPAIAETTWLTDQRILVLDFGSQYAQLIARRVREQNVYCQIVRHDISAERIAELAPKGIILSGGPNSVYEEGAPKCDEGLFDLGIPVLGICYGMQLACQALGGKVDNTPSREYGRAMCEFTDRDSIFRGMQESEQVWMSHGDQVSQIADQFTAMAKTSTCPYAAIRHNERPVFGMQFHPEVTHTPHGGQILRNFVIDVCGCDGSWKLGDFADAAIESIRKQVGNKRVICGLSGGVDSSVVAALLYKAIGPQLSCILVDNGLLRKNEQQIVLEEFSNHFKTDLHIVEAEDRFLADLAGIDEPQEKRRRIGHAFIECFKDEAAKIEDAHFLAQGTLYPDVIESGADKDGPAATIKLHHNVGGLPEELGFELIEPLRDLFKDEVRRLGLELGLPEQLVWRHPFPGPGLAVRCLGEITRDKLVVLREADAIVVEEIENAGLYRETSQAFAVLLPVQSVGVMGDARTYDNAVAVRCVNTDDFMTADWSHLPYELLARISTRIINEVKGVNRVCYDISSKPPATIEWE

SEQ ID NO: 52386 - protein, 252 aa, Arabidopsis thaliana
  misc_feature (112)..(112): Xaa can be any naturally occurring amino acid
  misc_feature (175)..(175): Xaa can be any naturally occurring amino acid
  misc_feature (189)..(189): Xaa can be any naturally occurring amino acid
MKNSIPIDLIYEILSRLPAKSVARCRCVSKRWRSILRHQVFTELFLTRSNARPRLLIGVQQDGEWSFLSTPQPQNRHENSSLVVAAADFHTKFSSGKSRHQYTYASGLIYFXEMFIPKEDEDAKRVLCNPLTGQYVILPELRVGGSYSYLGFDPIDKEFKVLFMDTCDFIASKDXYHYILTLGTGELKXRKIQCPFTHEPFWERICINVVLYYSSYYSYSYLISHLISFFYLISYKFNFISTKYLYYHFINY

SEQ ID NO: 52387 - protein, 411 aa, Brucella melitensis 16M
MNTHSVPVTTMDAQLRERAERVIPNGMWGHQRASSLPQGYPQYFASGKDACVTDVDGNSYIDFMCAWGPIILGHRNPLVDAAALSQIELGDSLNGPTAHAVELAELLVATIPHADWALFQKNGTDATTSCVTIARGTTKRRKVLVAKGAYHGAAPWCTPSLVGVTAEDRVHLIHYVYNDVESLTAAAREAGDDLAAILVSAFKHDLAIPQESPTKEFAQAARALCDAAGAALILDDVRGGFRIDLGGSWRGTGIEPDMAAYSKAIANGYALAAVTGSDRFREAARQAYMTGSFWYGGASMAAAVATIKELRRIDGPALMKHAGERLRSGLDAQAARYGFDLLQTGPAVMPLVQFTGDSDAALGARFCQEALKQGVYLHHKHNMFISCAHTDDVIDDALSRTEDAFKAISTK

SEQ ID NO: 52388 - protein, 463 aa, Streptomyces avermitilis MA-4680
MRPHVSHPHELVVLDPATEEVVATVPAATPQDVDAAVVRASKAQVRWAALAPGERARLLRRFAVVVDEHLEELARLEVREAGHVIGNARWEAGNVRDLLDYAAGGVERLTGRQIPVPGGLDITILEPLGVVGVIAPWNFPMPIAAWGTAPALAAGNAVILKPAETTPLTALRLAELALEAGLPEHLFQVLPGAGPVAGNALVEHPGVAKIVFTGSTAVGKQVWAKGSALLKRVTLELGGKSPNIVFADADVEAAAAAAPMAFLDNSGQDCCARTRILVQRSVYDRFLALLAPAVESVAVGDPLDERTAMGPLISKVQLERVRSYVPAGAPALRGKAPEGPGFWFPPTVLTDVDPHAPVAVEEVFGPVAVVLPFEDEADAVRLANATEYGLAGSIWTRDVGRALRVSGAVRAGNLSVNSHSSVRYWTPFGGFKQSGIGRELGPDALTAFTETKNVFISTEGPAQ

SEQ ID NO: 52389 - protein, 327 aa, Triticum aestivum
MPAPAMDYLRSCWGPTSSPDGRPRKGVDAAGRQDGLLWYKDAGQLVAGEFSMAVVQANNLLEDHSQVESGSLSTTDPDLQGTFVGVYDGHGGPETARYINDHMFNHLKGYASEQKCMSVEVIRKAFRATEEGFLSLVSNQWSVRPQLAAVGSCCLVGVICAGTLYVANVGDSRAILGRLVKGTGEVVAMQLSAEHNASFEEVRREMQAMHPDDPHIVILKHNVWRVKGIIQITRSIGDVYLKRPEFNREPLHSKFRLPETFQRPLLSSEPAITVHQIQLTDQFIIFASDGLWEHLSNQKAVELVHSSPRNVCVLILCLVCVTGFFES

SEQ ID NO: 52390 - protein, 175 aa, Triticum aestivum
MAPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVRFIAFNPPGCDESGKA

SEQ ID NO: 52391 - protein, 339 aa, Sulfitobacter sp. EE-36
MTKSNERKLTIARAMAEATAQEMCIDPSVFVMGEDIGPLGGVYGNTRGLIEEFGAERIRDTPISETAFIGAAVGAAQDGMRPVVELMFVDFFGVCFDAIYNLMAKNIYFSGGNVKVPMVLMTSTGGGYSDGGQHSQCLYGTFAHLPGMKVVAPSNAYDAKGLMTAAMRDDSPVVYMYHKGLQGMGWLGTEAGATVHVPEEPYTLEIGKAKVVREGKDVSIVSCGMGVHNALKAAKKLEEQGVSAEVVDLVSLVPLDRDTIRASAAKTGRLIVVDEDYMSYGLSGEIIASVTEHDISVLKAAPKRVAFPDVPIPFARAMEQFCLPNTDKIVAAWDEMQAA

SEQ ID NO: 52392 - protein, 470 aa, Oryza sativa
MTPPLESLRLLTPPRSAAPPKSPLPPPVRPCPSLIATICSAGAATLTRPFSCEYSHAPPRPSPIAAVPNPPMLPLPSSVSNSPDAADQLMLHRRCPTNSHLPRGPVEANSVAVRADGNYGDDNEKLSLIKLASMIEVSAKKGARDLNLQGKLMAQIEWLPDSIGKLTGLVTLDISENRLLALPDAIGKLFSLAKLDIHANRISQLPESIGDLRSLIYLNMRGNQLSSLPSSIGRLLNLEELDVGSNGLSSLPDSIGSLTRLKKLIVETNDLDELPYTIGHCVSLVELQAGYNHLKALPEAVGKLEPLEILSVRYNNLRSLPTTMASLTKLKEVDVSFNELESIPENFCFATSLIKLNVGNNFADLQYLPRSIGNLEMLEELDMSNNQIRVLPDSFGNLKHLRVLRAEENPLQVPPRDIALKGAQAVVQYMSDASKRTTKSEPMKPKKTWVHFCFFSRPNKRKHDRIDNAT

SEQ ID NO: 52393 - protein, 1147 aa, Arabidopsis thaliana
  misc_feature (230)..(230): Xaa can be any naturally occurring amino acid
MDRNRPPHPFQQHAMEPGYVNDSVPQGFTPDQTGLSNANVRPNPADVKPGLHYSIQTGEEFSLEFLRDRVISQRSANPIAAGDINYPTGYNGHAGSEFGSDVSRMSMVGNGIRQYERTNPPVHEFGNKLGHIHSAPEASLCQDRSLGNFHGYASSSASGSLTAKVKVLCSFGGKILPRPGDSKLRYVGGETHIISIRKDISWQELRQKVLEIYYRTHVVKYQLPGEDLDXLVSVSCDEDLLNMMEEYNEMENRGGSQKLRMFLFSVSDLDGALLGVNKSDVDSEFQYVVAVNDMDLGSRSNSTLNGLDSSSANNLAELDVRNTEGINGVGPSQLTGIDFQQSSMQYSESAPPTSFAQYPQSIPHNGAFQFQQAVPPNATLQYAPSNPPSSSVHYPQSILPNSTLQYPQSISSSSYGLYPQYYGETEQFPMQYHDHNSSNYSIPIPFPGQPYPHPGITQQNAPVQVEEPNIKPETKVRDYVEPENRHILATNHQNPPQADDTEVKNREPSVATTVPSQDAAHMLPPRRDTRQNTPVKPSTYRDAVITEQVPVSGEDDQLSTSSGTCGLVHTDSESNLIDLDYPEPLQPTRRVYRSERIPREQLEMLNRLSKSDDSLGSQFLMSHPQASTGQQEPAKEAAGISHEDSHIVNDVENISGNVVASNETLDKRTVSGGGIETEARNLSHVDTERSHDIPEKQTSSGVLIDINDRFPQDFLSEIFAKALSDDMPSGANPYQHDGAGVSLNVENHDPKNWSYFRNLADEQFSDRDVAYIDRTPGFPSDMEDGGEIARLHQVAPLTENRVDPQMKVTESEEFDAMVENLRTSDCEQEDEKSETRNAGLPPVGPSLADYDTSGLQIIMNDDLEELKELGSGTFGTVYHGKWRGSDVAIKRIKKSCFAGRSSEQERLTGEFWGEAEILSKLHHPNVVAFYGVVKDGPGATLATVTEYMVDGSLRHVLVRKDRHLDRRKRLIIAMDAAFGMEYLHAKNIVHFDLKCDNLLVNLKDPSRPICKVGDFGLSKIKRNTLVSGGVRGTLPWMAPELLNGSSSKVSEKVDVFSFGIVLWEILTGEEPYANMHYGAIIGGIVNNTLRPTIPSYCDSDWRILMEECWAPNPTARPSFTEIAGRLRVMSTAATSNQSKPPAHKASK

SEQ ID NO: 52394 - protein, 167 aa, Rhodobacter sphaeroides 2.4.1
MARTSAIDYGRAAKYFLLLDFIKGFGLGMKYFFAPKHTVNYPHEKGPLSPRFRGEHALRRYPNGEERCIACKLCEAVCPAQAITIDAEPREDGSRRTTRYDIDMTKCIYCGFCQEACPVDAIVEGPNFEFSTETREELFYNKDRLLENGARWEAEIARNLELDAPYR

SEQ ID NO: 52395 - protein, 137 aa, Brassica napus
  misc_feature (45)..(45): Xaa can be any naturally occurring amino acid
  misc_feature (60)..(60): Xaa can be any naturally occurring amino acid
  misc_feature (93)..(93): Xaa can be any naturally occurring amino acid
TLVERKERRSWMPTDDVVLISSWLNTSKDVVVRNEQTSVAFWKRXADYFSASPKLAGCEXREPIHCKQRWHKINDLVCKFCGAYEAAAREKLXGQNENDILKQAHVIFFNNYKKKITLEPAWKELRHVQKWCDLSTK

SEQ ID NO: 52396 - protein, 207 aa, Buchnera aphidicola str. Sg (Schizaphis graminum)
MLSKKENLLKLDWIKTNGLIPAIIQDFASNLVLMHGYMNKEAFLKTQKEGFVTFYSRTKKRLWTKGEESGNLLKVIDIVTDCDYDTILIIVEPLGKTCHLNRKSCFFLKENTLNFLSKLEDLIEDRKNFNTDNSYTARLYKSGTKRIAQKVGEEAIETILAAMKNDGDELINESSDLIYHLIVLLHDQNLNFNLIIENLKKRKTEKL

SEQ ID NO: 52397 - protein, 292 aa, Escherichia coli
MFTGSIVAIVTPMDEKGNVCRASLKKLIDYHVASGTSAIVSVGTTGESATLNHDEHADVVMMTLDLADGRIPVIAGTGANATAEAISLTQRFNDSGIVGCLTVTPYYNRPSQEGLYQHFKAIAEHTDLPQILYNVPSHTGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 52398 - protein, 573 aa, Yarrowia lipolytica CLIB122
MISPVKTSVASPATTKGVAVHLSYNPKTNEVAYANTKAVLLVNLDKPNEARQFNGHIAPTTVAKFSPSGFYVCSGDQAGNVKVWDPVSFNIKYEAKIGNGRINDLNWDADSQRIIAVGDGTERYGHCFTFDTGNTVGEISGHGAQVNAVAIKPVRPYRAATVGDDATLVFYKGPPFKFDHTVKQQHSNYIHDVAFSPDGKWLVSVGADRKAVLYNQDGEPVKTIDAHGGSIYSVSWAQDSTHFATASADNTVKVFDVEGKEIDTFKFDQFQVGVVWAGDSLVSVGLDGTLSFSSVSIDALSKLSLTESKVIAHQQPISAVETLKGKIYSGSVDGSILEWTGDKASPSDASHSTYIVSLSDCDGSLASVAWDDTYKLNNTVYSIGTQPKAADSRGSLSAIVTENTLHILDSGKLVKKVSIDRGSAVAIADQVVVGSKSGELSVYSTTGEKQFDLPPLRAAATKLALSENGNLLAAGESTGKIILYDLSTKSVVTSRWTFHTAQINDIDWLGNEYIASVSLDTNIYIYSVKTPMKNLKSLNAHKEGATAVRWLANNEIVTGGADAVLKWWSVELS

SEQ ID NO: 52399 - protein, 292 aa, Escherichia coli
MFTGSIVAIVTPMDEKGNVCRASLKKLIDYHVASGTSAIVSVGTTGESATLNHDEHADVVMMTLDLADGRIPVIAGTGANATAEAISLTQRFNDSGIVGCLTVTPYYNRPSQEGLYQHFKAIAEHTDLPQILYNVPSATGCDLLPETVGRLAKVKNIIGIKEATGNLTRVNQIKELVSDDFVLLSGDDASALDFMQLGGHGVISVTANVAARDMAQMCKLAAEGHFAEARVINQRLMPLHNKLFVEPNPIPVKWACKELGLVATDTLRLPMTPITDSGRETVRAALKHAGLL

SEQ ID NO: 52400 - protein, 662 aa, Anabaena variabilis ATCC 29413
MNISQNVERGCCLFPNKPALIFEGLYFTYKQLNEMANRVANALLGLGIERGDRIALLLPNIPEFVISYLGILKIGAIAVSINPNLQSDELKFILNDCGAAVLVTTETLREKLPKVDLPHLKHIIIAEGQAGEAIALSEFMANASPNARAVEIERDEPAAILYTSGTTGFPKGATLSHGNVISNMHSMKHCCEMRPNDQILLFLPMFHCFGQNAVLNSGLNTCATIILQRSFDPETVLTTISEYNITIFFGVPTTFILLCDKASIRDLDSVRYYFSAAAGLPVEIAKRWQDKFGKVINQGYGLTETSPLASYNHELRYKLGSIGSPIENVEMKIVSLDDGCEVAPGELGEIVIRGVNVMLGYWNRPAETAKAMKNGWFHTGDIGQIDELGYFYIVDRLKDMINNGGLKVYPAEVENVIYQHPGIAEVAVYGVPDSVLGEQVKASIVLKPDQAVTEAEIIAFCYQKLAQYKVPSAVEFVSSIPKNPTGKILKRLLRQENSAAPSHTVVSKTQTSASVKVSYQTAELIENWIIDWVVRKLAVAAQSIDQSKSFADYGLDSVRAVKLAQELSEWLGYPLEATIVWNFSTIESLARHLASQKITQPTELAKTKPESNLHTENLLVSVELPTNNAEPTESADLKALSDAEIAELLTKEIATVKQRRLV

SEQ ID NO: 52401 - protein, 795 aa, Escherichia coli K12
MKFSELWLREWVNPAIDSDALANQITMAGLEVDGVEPVAGSFHGVVVGEVVECAQHPNADKLRVTKVNVGGDRLLDIVCGAPNCRQGLRVAVATIGAVLPGDFKIKAAKLRGEPSEGMLCSFSELGISDDHSGIIELPADAPIGTDIREYLKLDDNTIEISVTPNRADCLGIIGVARDVAVLNQLPLVQPEIVPVGATIDDTLPITVEAPEACPRYLGRVVKGINVKAPTPLWMKEKLRRCGIRSIDAVVDVTNYVLLELGQPMHAFDKDRIEGGIVVRMAKEGETLVLLDGTEAKLNADTLVIADHNKALAMGGIFGGEHSGVNDETQNVLLECAFFSPLSITGRARRHGLHTDASHRYERGVDPALQHKAMERATRLLIDICGGEAGPVIDITNEATLPKRATITLRRSKLDRLIGHHIADEQVTDILRRLGCEVTEGKDEWQAVAPSWRFDMEIEEDLVEEVARVYGYNNIPDEPVQASLIMGTHREADLSLKRVKTLLNDKGYQEVITYSFVDPKVQQMIHPGVEALLLPSPISVEMSAMRLSLWTGLLATVVYNQNRQQNRVRIFESGLRFVPDTQAPLGIRQDLMLAGVICGNRYEEHWNLAKETVDFYDLKGDLESVLDLTGKLNEVEFRAEANPALHPGQSAAIYLKGERIGFVGVVHPELERKLDLNGRTLVFELEWNKLADRVVPQAREISRFPANRRDIAVVVAENVPAADILSECKKVGVNQVVGVNLFDVYRGKGVAEGYKSLAISLILQDTSRTLEEEEIAATVAKCVEALKERFQASLRD

SEQ ID NO: 52402 - protein, 375 aa, Pneumocystis carinii
MEDEIAALVIDNGSGMCKAGFAGDDAPRAVFPSIVGRPRHQGIMVGMGQKDSYVGDEAQSKRGILTLKYPIEHGIVSNWDDMEKIWHHTFYNELRVAPEEHPALLTEAPLNPKSNREKMTQIMFETFNTPAFYVAIQAVLSLYASGRTTGIVLDSGDGVTHTVPIYEGYALPHAILRLNLAGRDLTDYLMKILTERGYNYTTTAEREIVRDIKERLCYVALDFEQEIHTASSSSSLEKSYELPDGQVITIGNERFRAPEALFQPSIVGMETCGIHETTFNSIMKCDVDIRKDLYSNIVMSGGTTMYPGIADRMQKEITALAPSSMKIKIVAPPERKYSVWIGGSILASLSTFQQMWISKQEYDENGPSIVYRKCF

SEQ ID NO: 52403 - protein, 473 aa, Leptospira interrogans serovar Lai str. 56601
MSRTPSEVIAYAKANNVLFYDFRFTDIKGAWHHVSYHAGSINEDSFKGLPFDGSSIPAWQPIDRSDMQLIPDTSAIFLDPFTADSTLVVFCDVFDIYKGTLYEKCPRSIAKKALKYLESSGLADTAYFGPENEFFIFDNIKVRDAINVQYYEIDSSEGIWNSHTDFPGSTNTGHRPGTKGGYFPVAPVDSQVDLRADIVKTLHQIGMETFVVHHEVAQGQGEIGVKFGTLIEAADNVQKLKYVVKMVAHKYGKTATFMPKPLYGDNGNGMHCHQSIWKNGVNLFAGKGYQNLSDTAMHYIGGVLSHAKSCAAFTNASTNSYKRLLPGFEAPSILAYSAQNRSASCRIPFVNGDKARRVEFRFPDSSANPYLAFAAMLMAGIDGVQKKIDPGPPREEDLFELSLDEIREKGIQQMPHTLRESVEHMLLDKEFLKKGDVFTEEFIQTYKAYKFETEIWPWEGRPHPFEFLTTYSC

SEQ ID NO: 52404 - protein, 80 aa, Sclerotinia sclerotiorum
MWPGQAMSLKVEKVLHVEKSKYQDVLVFKSTDYGNVLVLDDCIQCTERDEFSYQEMIAHLALNSHPNPKKALVIGGGDGG

SEQ ID NO: 52405 - protein, 242 aa, Arabidopsis thaliana
MLEAVDSSGVVNGGFPQIQSFYGDCSSEEELSVLPRHTKVVVTGNNRTKSVLVGLQGVVKKAVGLGGWHWLVLTNGIEVKLQRNALSVLEPPTGNEEDDDLDFENTQRNGSDMTSEDTLKPHKSKLRGQRSSRSSHKTMSRSLSSDSQSKSSGFTPPENMKVDLSKLEMPALLNYWRHFNLVDAIPNPSKEQLIDIVQRHFMSQQMDELQVIVGFVQAAKRMKKACKFQSKESRNTDLNCIS

SEQ ID NO: 52406 - protein, 466 aa, Mycobacterium sp. MCS
MIDARTAPTASEVLARLHAEDIATVILGGTDTHGVMRGKRVPISQLPRMLEHGMPMCDVFWVMHVDESDLVARPDGYRGYFPTERQGYPDILAVPDLTTLRIVPWHNDTALLLCDWELPADHRPVPIAPRSVLRRVVERADAMGYQPLSALELEFYLLREKAGTTHRKRADELVPLQEAPSTYGVVMGSLQEDIGALIRRHMLDYGLPVEACNPETGPGQFEITLRYGNSLKSADDAFLFKSAVKEVAAQNDLLATFMAKPVTDWAGNSCHVHLSLRDIAGGGVFFDQDAPDQLSTALRHFAGGILHTMREFTALMAPTPNSYRRFVPYSWAGTTATWGVDNRSVGLRVIREGDHGTRVEHRQPGGDANPYLATAAALAGGLHGLLNEIEPRELSTTDIYSQPSEDLPVLPATLAEAVDLLADSAAAREWFGDDFVDHYVLMKRAEIAAQSVAVTDWEVARYLEAM

SEQ ID NO: 52407 - protein, 309 aa, Chromobacterium violaceum ATCC 12472
MQTVDGVIRARLHSDVVLIRQVAEYIISAGGKRLRPILTLLSGRALGYRGEHLFELAAMIEFIHTATLLHDDVVDESDLRRGRKTANALFGNAASVLVGDFLYTRAFQMMVTTRNMTILEVMAEATNIIAEGEVLQLLNIGNTDVSEDEYLKVIQYKTAKLFEAAARVGALIADASAEQVRAMADYGMYLGTAFQIIDDVLDYSGDADTIGKSLGDDLAEGKPTLPLIYTMRNGSSEASALVRDALENANRDRFHDVLNAVQSCGALEYAKNEAVKMAEQAIASLQSIPDSEVRQALIELARLSVDRSA

SEQ ID NO: 52408 - protein, 324 aa, Rhizobium leguminosarum bv. viciae 3841
MSVSNANTASSNGVGAGIPVIDVGPFIRNEVGSADVVKAIEAACRDTGFFLVTGHGVSLDVTSRLYQLARAFFDYPQDWKTTQGRGTGVMGGVAFSPLAEEALAATLGIKTPGDYKESLNFGQNLPGDTWPNRPEGIERAFRDYFKEMEILAKHMRRIFCQAIGLDQDYFEPSFENHLSALRVINYPEQDEAPLPGQMRAGVHTDYGFMTILRSEASAGGLQVRNRNGDWLDAPSIEGAYVINIADAFMRWSNDEWVSTPHRVANPPSGFKGTARRQSIPFFLNPSKDTVIECLPPFLKGGAKYEPITYGEYIDLKTKQAFSKG

SEQ ID NO: 52409 - protein, 253 aa, Brassica napus
RKTGSAPRVRSEQERLTSEFWHEAEILSKLHHPNVMAFYGVVRDGPGGTLATVTEYMVNGSLRHVLLSNRQIDRRKRLIIAMDAAFGMEYLHSKNIVHFDLKCDNLLVNLKDPARPICKVGDFGLSKIKRNTLVTGGVRGTLPWMAPELLSGSSSKVSEKVDVFSFGIVLWEILTGEEPYANMHYGAIIGGIVNNTLRPTVPSYCDPEWRMLMEQCWAPDPFVRPSFPEIARRLRTMSSTAAKAHAASHQVHK

SEQ ID NO: 52410 - protein, 483 aa, Pediococcus pentosaceus ATCC 25745
MAEQGGSQVKRALKTRHISMISLGGSIGTGLFVASGSAISTAGPGGALLAYVGMGVMVYFLMTSLGEMATYMPVSGSFSTYATKYVDPAFGFAMGWNYWFNWAITVAVDISTIALIMKFWFPHAPGWIWSLLALVLVFLVNALTVKAFGETEYWIALIKLVTVIIFLVVGVLTIVGIMGGKATYLENFVYHKAPFVGGIPAILSVFVVAGFSFQGTELIGITAGESETPETSVPKAISQVFWRILLFYILAIFVIACIIPYTSPNLLGSSARDVSISPFTLVFRRAGLAGAAGVMNAVILTSVLSSANSGMYASTRMLYSLSKQGFAAKIFGKTSKRGIPYLALLGTTIVGLLTFISSIMGPKIYIWLVAASGLTGFVAWVGIAIAHWRFRRAFIKQGHDVSELRYRAKWFPFGPLFAFVLSIIVIAGQDIHSIANFDWQAIGITYMAIPLFIVLYTYYKIRYKTKLIPLEEIDLSRPDITKE

SEQ ID NO: 52411 - protein, 389 aa, Acinetobacter sp. ADP1
MNPPLPQAPINWIAVFALIFLPVLAIIAIPLYAYHHDFSIGAWVSMFVLLGMSSLGITAGYHRLWAHRAYEATLPLKIMLMIMGTFAVQNSILFWASGHRTHHRHVDDIEKDPYSIKNGFWYAHFGWMLRNYPAAEPDFKNAPDLLNDKLVMFQHKYYVALVIATHVVILTAVGWAVGDIWGVVLLGGLLRLILSHHVTFFINSLCHMWGKRPYTDENTARDNFWLAIATWGEGYHNYHHIFQYDYRNGVKWWQYDPTKWLIWSCSKLGLAKNLRRIPSFNIKKAELAMKFKYAEQDLAIYGHDVNSDLAQMKQRIAQEYDAFTHTLNDWAKLKEQELQSKKAAVAEKLHQMDHKLKVDFQLLEHRLSHHRECLETLMRNVKKRNTVSE

SEQ ID NO: 52412 - protein, 801 aa, Bacillus cereus G9241
MKKRLVMIGNGMAGIRCMEEILKHDSDSYEITIFGDEPHPNYNRIMLSHVLQGKTNMQDIIMNEYSWYEENEITLYTNEKVQSINREEKIIMTEKNRTLTYDKLILATGSSAFILPVEGSTLPGVTGFRTIEDTQFMIDTAKEKKKAVVIGGGLLGLEAARGLIDLGMDVHVVHLMPRLMEQQLDTKAASLLREDLEAQGMKFLMEKKTVKILGTDYVEGIQFEDGEVVDCNLIVMAVGIRPNTQIARDAGLIVNRGIVVNDYMLTNDESIYAVGECAEHDGIAYGLVAPLYEQGAILAKHITNLQTDGYTGSIVGTQLKVAGCDLFSAGQIYKDDQTKAISIFDECKRSYKKVLIRDNKVVGIVLYGDTADGTRLFSMLKKEEDIQEYTPASLLHKAGEESELDVATMSVDDTICGCNGVTKGTIVHAILEQELTTFEEVKGCTKAAGSCGKCRPLVEQVLSHTLGDAFDASAQSAGMCGCTPLSRDEVVAAIHEKGLKSPKEVRNVLDFAHEDGCSKCRPALNYYLRMAIPEEYEDDKSSRFVNERMNGNIQHDGTFSVIPRMYGGVTTADDLMKIAEVAKKYDVPLVKITGASRIGLYGVKKQDLPNVWADLHMTSGYAYSKSLRNVKSCVGSRFCRFGTKDSLGLGMFLEQSLEMVDTPHKMKMGVTGCPRNCAEVLTKDFGVVCVENGYQLYIGGNGGTEVREADFVMIVPTEDDVLRIATAYMQYYRETGIYGERTAYWTERLGFDHIKEILQDANMVTTLNERFQIARSTYTEAWGQALETKSLKAMYEVATMK

SEQ ID NO: 52413 - protein, 236 aa, Triticum aestivum
HYRTNLYQKQGWFRPGIPGILWTTGPPRRRGWSPRTLTWTEGVEKARVPPPSKLYTYIVQPWPPPVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 52414 - protein, 223 aa, Neurospora crassa
MFGPRHFSVLKTTGSLVSSTFSSSLKPTATFSCARAFSQTSSIMSKVFFDLEWEGPVLGPNNKPTSEIKAQSGRINFTLYDDVVPKTARNFKELCTGQNGFGYKGSSFHRIIPEFMLQGGDFTRGNGTGGKSIYGEKFADENFAKKHVRPGLLSMANAGPNTNGSQFFVTTVPTSWLDGRHVVFGEVADDESMKVVKALEATGSSSGAIRYSKKPTIVDCGAL

SEQ ID NO: 52415 - protein, 91 aa, Prochlorococcus marinus str. MIT 9303
MSSDPLTPDVSARICRHMNGDHAEAVMNYARYYGGIKDPQTAKMILITSETMELEVDGDALEIKFDHTLTDSEDAHHTLVAMLKAMPKSSG

SEQ ID NO: 52416 - protein, 360 aa, Helicobacter pylori 26695
MSLANDLLEILSSQSPNDKRIRVLLEYISVLERTPWDLESLLRDYNFVFSNTTGQHNQALERKETPYFDSVIVDEAAKANPLELLMVMALAKERIILVGDDRQLPHYLDDEIGKKLEDESQDAQDEIEKALKDSMFKKLKERAQKLKELDGKECFITLNMQYGMHPLLGELVSDVFYKPHNESFESPLKGKHLEEKPFKHNLRVLDNKPLAWIDVKESKEKRNADGSYYRESEITAIKECLDLFMKDEPDFTFGVITFFSEQKRLLEQALKGYANLEIGTVDSFQGKEFDVVFLSSVRTRHTEGFGFLKISSCLCVALSRQKRALIVAGDREKFDTPESKDKVSGLFEFLQSCKKEGKIL

SEQ ID NO: 52417 - protein, 377 aa, Solanum tuberosum
  misc_feature (73)..(73): Xaa can be any naturally occurring amino acid
MADVEDIQPLVCDNGTGMVKAGFAGDDAPRAVFPSIVGRPRHAGVMVGMGQKDAYVVDEAQSKRGILTLKYPXEHGIVNNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTEYMVKILTERGYSFTTTAEKEIVRDVKEKLAYLALDFEQELETTKTGSAVEKNYELPDGQVITIGAERFRCPEVLYQPSLIGMEAAGIHETTYNSIMKCDVDIRKDLYGNHVLSGGSTMFPGIADRMSKEIQALAPSSMKIKVVAPPERKYSVWIGGSILASLSTFQQMWIAKAEYDESGPSIVHRKCF

SEQ ID NO: 52418 - protein, 1217 aa, Mesorhizobium loti MAFF303099
MTAGPLPDARSTGPAMPLDTIRQQIRANYLPDEDEAVKRLAEATGLSAADRDAISARAADLVRAVRGSSDPRLMEVFLSAYGLSTKEGVALMCLAEALLRVPDTETMDDLIADKIAPHDWSAHSGGSSSIFVNASTWALMLTGRVLDEGEGGIEGTLRSMVRRLGEPVIRKAVAAAMREMGEQFVLGRTIAEAVKRGRPMTQKGYLYSFDMLGEAARTEADALRYHKAYADAISSLDAGSNGPDIRQNHGISVKLSALHPRYEVAQKEEMLPVMAERLLSLALAARHSRMGLNIDAEEADRLDLSLDVIERVLAEPELAGWNGFGVVVQAYGPRAAFVIDWLYALARKYDRTIMVRLVKGAYWDTEIKRAQTLGLAGYPVFTRKANTDVSYMACAKKLLGMTDRIYPQFATHNAHTVAAILSMATNRDSFEFQRLHGMGEALHETVRQAEGTRCRIYAPVGAHSDLLAYLVRRLLENGANSSFVHQLTDEDVEPEDIARDPLETVESQGPAANPAIARPSQIFGAGRRNSRGFDITDTVTLAAIDKARAAFAGPDRWHAKPITRAAGYGKPHPVVNPAKPDEVVGTVHEAAAKQVAIAVRIAVEAQPAWAKRPVGERAAILNRAADLYEANAVEFFALATREAGKSLADGVAEVREAVDFLRYYAAEAANAETGTQARGAIVCISPWNFPLAIFTGQIAAALVTGNSVIAKPAEQTPLIAFRAVELLREAGVPEDIIQLLPGDGPSVGGPLTADPRIAGVCFTGSTEVAKLIEKQLAETAAPDAMLIAETGGLNAMIVDSTALPEQAVRDILASAFQSAGQRCSALRVLYVQKDVEKKMLDMLKGAMEALNIGDPWRISTDVGPVIDDEAQASIRDYCTRKGLEGRLIAKLEAPKDGRFVAPHVFRVKGIEEMEREVFGPVLHVASFDADEIDAVIAAINRKGYGLTFGLHTRIEGRVQHFVDGIHAGNIYVNRNQIGAVVGSQPFGGEGLSGTGPKAGGPHYLRRFRKGPEAGTEVGEGHKVTATELADNLPDPALGGWSTRPDRIAILRKHLRGKGAAAIGAAAAIDFGQVDLPGPTGEANTLSLSPRGRVLCLGPDAETLLAQTIQALAAGNAVLAVAPGAPAALSALTGKGLPLAAIDGRPDPVEARALRVDVVAFSGTPEAARIVRQVIADRTGPIVPLVSEVLNPAAYAHERAVCVDTTAAGGNASLLAAA

SEQ ID NO: 52419 - protein, 385 aa, Triticum aestivum
MEGGGARNVSAAAAQTKESADDGSCKPLPPCCVKAQAAVAESEAKCHATVVSGWFTGTRSRSGKPSKAQYFNNPMWPGEAHSLKVEKILYQGKSPYQEVLVFESSTYGNVLVLDGIVQLTDKDECAYQEMVTHLALCSIPSPKNVLVVGGGDGGVLREIAKHDSVESIDICEIDQLVIDVCKDFFPRLYVGYKDPRVKLHVGDAVEFLRNSPEGKYDAIIVDSSDPIGPAQELVEKPFFQTIARALKPGGVLSNLAESMWLHTHLIQDMLSICREVFKGGVHYAWASVPTYPSGVIGFLLCAKDGPPVDFLTPVNPIEKIEGATKDGREMRFYNSEIHRAAFILPTFVKRELEAYNTSTEKEKPEKPTAKPVKMKVMRDSAITAS

SEQ ID NO: 52420 - protein, 377 aa, Pisum sativum
MAEAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDGLMKILTERGYTFTTSAEREIVRDMKEKLAYIALDYEQELETAKTSSAVEKTYELPDGQVITIGAERFRCPEVTVQPSMIGMESPGIHETTFNSIMKCDVDIRKDLYGNIVLSGGSTMFPGIADRMSKEITALAPSSMKIKVVAPPERKYSVWIGGSILASLSTFQQMWIAKAEYDESGPSIVHRKCF

SEQ ID NO: 52421 - protein, 306 aa, Mesorhizobium loti MAFF303099
MAGNGVASIGECMLELSGQTGPNWCMGFAGDTFNTLWALHALSEDRPATYVSAFGDDPFSQGQIGFFAENGIGIGSSPVIPGARPGLYAITLTGAERSFTYWRGDAAARQLASDPAALSKNLENQALVYFSGITLAILDDASRKTLLEAVTKARAAGSLIAFDPNYRPRLWRNRESAQAAIVEALGVTDVALPTFPDEQMLFGDETPRATAERLGQWVGEVIVKNGEQPALIAESGTLHDVPAIHVAAPVDTTGAGDSFNGGYLAARLAGHGPQEAASRAHRVAAAVVQVRGALAPFETLRAAFDS

SEQ ID NO: 52422 - protein, 357 aa, Pisum sativum
MAVKEATSETKKRSGYEIITLTSWLLQQEQKPIIDAELTIVLSSISMACKQIASLVQRANISNLTGTQGAVNIQGEDQKKLDVISNEVFSNCLRSSGRTGIIASEEEDVPVAVEESYSGNYIVVFDPLDGSSNLDAAVSTGSIFGIYSPNDECLPDFGDDSDDNTLGTEEQRCIVNVCQPGSNLLAAGYCMYSSSVIFVLTIGKGVFVFTLDPLYGEFVLTQENLQIPKSGKIYSFNEGNYKLWDENLKKYIDDLKEPGPSGKPYSARYIGSLVGDFHRTLLYGGIYGYPRDKKSKNGKLRLLYECAPMSFIVEQAGGKGSDGHQRVLDIQPTEIHQRVPLYIGSTEEVEKVEKYLA

SEQ ID NO: 52423 - protein, 485 aa, Mesorhizobium loti MAFF303099
MLQKTSHFMRQANLINGEWVQADSGQTVDVNNPATGLKIGTVPKSGKAETRRAIEAADAAFKTWRKTTALERSKLLRKLHDAMMDNQDVLAELLTIEQGKSLFESKGEIGSAAAYILWFAEEGRRTYGDVVPSPWADRRILVTKEPVGVIAAITPWNFPSSMLARKLGPALAAGCTAVVKPASQTPYSGLAWGALAEEVGFPKGVVNILTGSASEIGDEICANPLVSKITFTGSTEVGKLLIQKSSVTVKKVSMELGGNAPFIVFDDADIERAVAGAITAKYRNSGQTCVCTNRFLVQAGVYDKFVEKLAAASNGLKVGSGLEEGVQQGPLIDEKAVEKVEELIADATSKGGKIVAGGKRHALGGSFFQPTVIANATPKMRFMKEEIFGPVAPVFKFETEAEAIALANDTEFGLACYFYTGDLGRAFRVMEGLKYGMVGVNEGLITTPEAPFGGVKESGLGKEGGHQGIEDYLDTKYVCIGGLGL

SEQ ID NO: 52424 - protein, 103 aa, Arxula adeninivorans
MSGRGKGGKGLGKGGAKRHRKILRDNIQGITKPAIRRLARRGGVKRISALIYEETRSVLKTFLESVIRDAVTYTEHAKRKTVTSLDVVYALKRQGRTLYGFGG

SEQ ID NO: 52425 - protein, 469 aa, Xanthomonas oryzae pv. oryzae KACC10331
MSVENVEKLIKDNKVEFVDLRFVDMRGVQQHITFPANIIEPALFEEGKMFDGSSIAGWKGINESDMVLLPDAGTAYLDPFFADPTIVLTCDILDPATMQSYERDPRGIAKRAEAYLKSSGTADQAFFGPEPEFFIFDSVRFANDMGHTFFQVGSEEAAWNTGEKYDGGNSGYRPGVKGGYFPVPPTDTLHDLRAEMIKTLEQVGIETEVHHHEVATAGQCEIGTKFSSLVQKADELLTMKYIIKNVAYRNGKTATFMPKPIVGDNGSGMHVHQSLAKGGVNLFTGDGYGGLSQLALWYIGGIFKHARAINAFANSGTNSYKRLVPGFEAPVMLAYSARNRSASCRIPWVTNPKARRIEMRFPDPLQSGYLTFTALMMAGLDGIKNQIDPGAPSDKDLYDLPPEEEKLIPQVCSSLDQALDALDKDREFLKAGGVMSDDFIDGYIALKMQEVTKFRAATHPLEYQLYYGN

SEQ ID NO: 52426 - protein, 377 aa, Oryza sativa (japonica cultivar-group)
MADAEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDYLMKILTERGYSFTTTAEREIVRDMKEKLSYIALDYDQEMETAKTSSSVEKSYELPDGQVITIGAERFRCPEVLFQPSFIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 52427 - protein, 534 aa, Zea mays
FITSLYKKAGSCRTMEPAYVVTLSFLFLFLFLLHHLLGRHRRRTNNGKNKRTQLPPSPPAIPVLGHLHLLRKPIHAALARLAERYGPVFFLRLGSRQAVVVSSAACATECFTENDVCFANRPRFPTLLLVSFGGATLPMCRYGPYWRNLRRVATVQLLSAHRVSCMLPVISAEVRAMARRMYQSAAAAPAGAARVELKRRLFELSHSALMETIARTKTSRAVADDDTDMSPEAQEFMKALDVFLPLLSGANAWDYLPVLRWLDVFGVRNKILRAVSARDAFLRRLIDAERRRLEEGGENNDKKSMIGVLLSLQKSEPEVYTDTMIMALCSSMFAGGSETTATTAEWAMSLLLSHPDVLKKAQAEIDASVGHSRLLGADDLPRLGYLHCIISETLRLYPVVPTLVPHESTADCTVGGHRVPSGTMLLVNVYAIHRDPAIWADPAAFRPERFEDGRADGLFVMPFGMGRRKCPGEALALRTLGLVLGTLIQCFDWDTVGGAEVDMAEGGGITLPRAVPLEAICKPRHAMLGVLKGL

SEQ ID NO: 52428 - protein, 520 aa, Streptococcus pyogenes M1 GAS
MTEISILNDVQKIIVLDYGSQYNQLIARRIREFGVFSELKSHKITAQELREINPIGIVLSGGPNSVYADNAFGIDPEIFELGIPILGICYGMQLITHKLGGKVVPAGQAGNREYGQSTLHLRETSKLFSGTPQEQLVLMSHGDAVTEIPEGFHLVGDSNDCPYAAIENTEKNLYGIQFHPEVRHSVYGNDILKNFAISICGARGDWSMDNFIDMEIAKIRETVGDRKVLLGLSGGVDSSVVGVLLQKAIGDQLTCIFVDHGLLRKDEGDQVMGMLGGKFGLNIIRVDASKRFLDLLADVEDPEKKRKIIGNEFVYVFDDEASKLKGVDFLAQGTLYTDIIESGTETAQTIKSHHNVGGLPEDMQFELIEPLNTLFKDEVRALGIALGMPEEIVWRQPFPGPGLAIRVMGAITEEKLETVRESDAILREEIAKAGLDRDVWQYFTVNTGVRSVGVMGDGRTYDYTIAIRAITSIDGMTADFAQLPWDVLKKISTRIVNEVDHVNRIVYDITSKPPATVEWE

SEQ ID NO: 52429 - protein, 368 aa, Arabidopsis thaliana
MSSSPEKKRRKKLSPESNSLPNDLIVTILARLSQSYYPKLSLVSKTFRAILASPELYQTRILLSRTETFLYVCLSFPGEPNPGWFTLYRKPNQTLTTKKKKNSVHLLAPILNSPPVEFPSLIAVGSYLYAFRAAIEEAPRMRLALTNSDLDGYMYLAGTSDSLNCVEVYNTDTQTWIPVPPNKRIFKLQHMKGMLYMKVSKLLSFVAQDAEELAPLFPKLRSLLSTEVVAFKPKVSEGYEVLGFSVNTDLGRGSFCMIEEITYHYDPSVKFRWRRRQGGVWRSLVGLEGLPKFARYSSVKLADCGGKLVVLWHKYVPASGYEEKMVWCAEISLEKRSKKEIWGKIEWFDAVLRVPKYYQFVGAKSATV

SEQ ID NO: 52430 - protein, 204 aa, Prochlorococcus marinus str. MIT 9303
MRQSSLLRFAKTLAAHYSNKQQAQKDPIKFARINIYFRPLLWDVFQGPGFYSEQSYDYAPWRPYRQGVHKLLASKEVFILENYSLQEPKRFAGAGFYPDLLNHLCADTLLPRRGCAMHFKEVKPNQYRGQVEPGNNCLVPRNNTMTYLVSEVEFDEKIWISRDRGFDPKTHEQLWGSKHGPLHFQRIVNLGDHVNESWLRSASH

SEQ ID NO: 52431 - protein, 549 aa, Yarrowia lipolytica CLIB122
MPAVATTPFEGQKPGTSGLRKKVTVFQQPHYTENFVQAIMDSIPEGAKDATLVIGGDGRYYNDKVCQIIAEIAAGNGVKKLIVGQDGILSTPAASHVIRKRGATGGIILTASHNPGGPTEDFGIKYNLANGGPAPESVTNKIFDVTTKIKEYQRVDVGEVDLKTVGTKQYGPIEIEIIDSVADYVAMIKDIFDLELIKDFLKSNPDFKVLFDGLNGVTGSYAQAIFLGELGLDKSSIQNCTPLPDFGGLHPDPNLTYAKTLVDAVDSGSIPFGAASDGDGDRNMIYGANTFVSPGDSVAIIADHADKIPYFKKQGVYGLARSMPTSNALDLVGKKKGLNVYEVPTGWKFFCALFDSDKLSICGEESFGTGSNHIREKDGLWAVIAWLNIIAGVGKEDPKKASIAAIQEDFWKTYGRTFFTRYDYENVSSEGAAKVVAGLNDKLNSLVGTKIGSLEVAEAGDFEYTDLDGSVSSHQGLYVKFTNGARFVIRLSGTGSSGATIRLYVEKHESDPSKFGESAQDYLEDIINEVVSYLKFKELVGRDEPTVRT

SEQ ID NO: 52432 - protein, 176 aa, Glycine max
MCDDEVAALVVDNGSGMCKAGFAGDDAPRAVFPSIVGRPRHQGVMVGMGQKDSYVGDEAQSKRGILTLKYPIEHGIITNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAI

SEQ ID NO: 52433 - protein, 516 aa, Arabidopsis thaliana
MKYLFFLVVTNGKINNIFSKTKTEVGNDVGKRVSESHLKKLRKKEAMGDHHDFINSGSWWKVSSSSSPSSSSSMRASSIESGGSAVFHDKLHHHSLATDHHLQMIGLGLSSQSPVDQWNQSLLFMCFVFVFFFFAGNKRRGDSKAETSFGVMLQENLNLDATSNANANTTSSTSSYQLQESDSSHHHQALWRDPQSDFKPQILTSGGNRGFFLDHQFSPHGSSSTDSSTVTCQGFAVDNSSNAMYAATTTTPNSSSGMFHHQQAGGFGSSDQQPSRNHQQSSLGYSQFGSSTGNYDQMASALPSTWFLRSSPPPKPHSPLRFSNNATFWNPAAAGNAGAPPPHDASSNFFPALQPPQIHPQSFDEQPKNISEIRDSSSNEVKRGGNDHQPAAKRAKSEAASPSPAFKRKEKMGDRIAALQQLVSPFGKTDAASVLSEAIEYIKFLHQQVSALSNPYMKSGASLQHQQSDHSTELEVSEEPDLRSRGLCLVPVSSTFPVTHDTTVDFWTPTFGGTFR

SEQ ID NO: 52434 - protein, 424 aa, Rhodopirellula baltica SH 1
MSFATLAGMKLPKFFRRFGPGLLVTAAFIGPGTVTKATTAGANFGHTLLWAIGFSVIATIVFQEMASRLGIVTGRGLGEAIRPTIPNALARGLAIVLVVSAIIVGNAAYQAGNIAGAAVGVAAATGMQHQTLVSIVIGLTAWCILMIGHYRSLQRILVALVVTMSCVFLLTALSVPIDWRSIALGWIQPTIPDGGLKEVLAIIGTTVVPYNLFLHATASAEKWSSDKKEPVSDENIRDAIQHSRGDTILSVGLGGLVTAAVMATATAAFFQSNTGFTNLADAARQLEPLLGNHARWLFGVGLFAAGLTSTITAPLAAAYAAAGCFGWPIDLKDWRLRTVFTTVIVFGTSFAASGSKPTDIITFAQIANGLLLPLLAIFLLAVMNNAALLGKHRNHWIANTLGVLTVVVVSVLGLRSLVSVSFAG

SEQ ID NO: 52435 - protein, 310 aa, Clostridium perfringens str. 13
MNKICVLGSMNMDLVLKVKDMPKVGETILSKSFQKIAGGKGANQAVAAKRSGAEVFMISKIGKDENGRELRDKLVEDNIDVKYVFEDRIEPTGMALIMVNDNGNNSIIVNAGSNMTLTKEEIHSAENLIKESDIIISQFETPENITIEAFKIAKENGKVTILNPAPAKKIKDELLNYTDIIVPNETEAELLTGIEIKDIEDAKKAGDIFLGKGVKFAIITLGEKGAALIGKDFCEIVPAYRVNAIDTTAAGDSFIGGLSSKLDTKNLGKETLISSIRFGNKVSSIAVQRKGAQPSIPYLKEVLEIYKGEE

SEQ ID NO: 52436 - protein, 148 aa, Brassica napus
IPGLDPRVRFNQEPLLPKFRVAERFEKPIMRAEPTITVHKIQPEDQFLIFASDGLWEHLSNQEAVDIVNTCPRNGVARRLLKAALQAAAKKREMRYSDLEKIERGIRRHFHDDITVIVVFLHSASFGVRTPVSVRGGGVLALAGNAIL

SEQ ID NO: 52437 - protein, 369 aa, Arabidopsis thaliana
MTNHNALISDAKGSIGVAVRVPNQSLFSPGGGRYISIPRKKLVQKLEADPSQTRIHTWIEAMRASSPTRTRPGNISPLTESDEEDEYSSWMAQHPSALTMFEEIAEASKGKQIVMFLDYDGTLSPIVENPDRAYMSEEMREAVKGVARYFPTAIVTGRCRDKVRRFVKLPGLYYAGSHGMDIKGPSKRNKHNKNNKGVLFQAANEFLPMIDKVSKCLVEKMRDIEGANVENNKFCVSVHYRCVDQKDWGLVAEHVTSILSEYPKLSLTQGRKVLEIRPTIKWDKGKALEFLLESLGFANSNDVLPIYIGDDRTDEDAFKVLRNKGQGFGILVSKIPKETSATYSLQEPSEVGEFLQRLVEWKQMSLRGR

SEQ ID NO: 52438 - protein, 580 aa, Photorhabdus luminescens subsp. laumondii TTO1
MSNIEIIQREIITIFAETFGLSKEEIKLEIPLVELGAESLLLFEALEPIHKQFGVKLSVRQFFAELQTVRQLSEYILMVGKNRVVEDNHSVTQPVLSDQEKRSEQSDTSDIPPINKERFFQWMLRSAPSIESEERKKYLASFISEYNERTIKSKIHSVAVRKNIADSRSGIGFKLSIKELLYPIVCTKFAGPVVKDIDGNDYIDMTMGFGAHLFGHSPPFVVKALTQQIDNSFGLGTRHEIGLEVAELIKEITGMDRVAFVNSGTEAVMNAVRAARALTRRNHIVLFSSSYHGHWDAVLARAGDYDEANATKPVSVGIPENMVADVSVFGFGSNEAIEFLKTNRTDIAAVLVEPVPTRDPGLSNPDYLRHLRRVTRELDILLIFDEIVTGFRSHPAGIQGLFGIEADIVIYGKTIGGGMPLGVITGRKKMLDSIDGGNWNFNDDSFPAAEPTFFGGTYFQHPLCMTAAKATLQEIKRRGETFTKVLTQRTESFVSRLNQLFLSRRVPIEARSFSSFFRLMHRDNMDLLYYNLLMRGVYIWEWRCWFISDAHDDTHLEKVYLAFVDSLDELEENNLLPRYS

SEQ ID NO: 52439 - protein, 400 aa, Solibacter usitatus Ellin6076
MTRTKVTLIYIDSGGGHRAAATALCEVIRQQQRPWDVRMVCIQDLLDPIDFIRKSTGVRFQDVYNIMLRRGWTRGTAQLIPMMHRVIRASHDSQVKVLREYWRGHRPDLVVSLIPHYNRALKEALEGAWPGTPYVTLLTDIADYPPHFWIERINQWVICGSRKAAAQAREIGIPAPRILQASGMILSPRFYEPLTVDRAAERVRLGLRPEMPVGLVLFGGEGSREMVRIARALNYSGSGVQLILVCGKNDAAAAELRALEAATPMLVVGFTREIPRLMEISDFFIGKPGPGSLSEALAKKLPVIVQRNAWTMAHELYNTEWIEELGAGVVIESFSKQLDGAVRQLLEPRRYAQYRGCAAATRNVAAYEIPEMLGSILSESRPDQACDFGAQSLPGSVRSA

SEQ ID NO: 52440 - protein, 99 aa, Glycine max
  misc_feature (42)..(42): Xaa can be any naturally occurring amino acid
  misc_feature (59)..(59): Xaa can be any naturally occurring amino acid
YGVNNLSSKLSRELAYIITDKIKVCGGYTIPRKDRPGITQYXLFVIIKTNEAPAIGPHXAVMHPDDLRIKDGGPHVFAQVDYKIGVKGIAFLVLQRMEI

SEQ ID NO: 52441 - protein, 278 aa, Triticum aestivum
  misc_feature (111)..(111): Xaa can be any naturally occurring amino acid
  misc_feature (139)..(139): Xaa can be any naturally occurring amino acid
  misc_feature (142)..(142): Xaa can be any naturally occurring amino acid
  misc_feature (149)..(149): Xaa can be any naturally occurring amino acid
  misc_feature (154)..(154): Xaa can be any naturally occurring amino acid
MYAFARGSQPHVCPVSSPPTVHHSTASLPRSPRIASARFSRYRNHTARAYRRGTGAPDMSAAGDRDLRELAPLEAILFDIDGTLCDSDPFHFLAICELLQEVAFNNVVPIXLEHLQGMDLLDAQQALFRNLAAGALKGXDGXQELCTWXEGRNXKRATVTNAPRANAELMLSLLGLTSFFPVLVIGSECERAKPSPDPYLKALDLIGASPDHTFIFEDSASGIRAGVAAGVAVVGLTTGNPEKVLRDAGASLLIEDFRDPKLMAVLQELDPAPADKQG

SEQ ID NO: 52442 - protein, 473 aa, Brucella melitensis 16M
MRIGKMEMQTRYPDVKLFIDGTWRDGSRGETIEIFNPATDEVIGHIARATTADLDDALAAVDRGFEAWSKVSAFDRYKIMRRAADIFRSRGEEVARLLTMEQGKPLAEARIEAAAACDLIDWFAEEARRSYGRIVPPRQAYVMQAEVKEPVGPVAAFTPWNFPINQAVRKISAALAAGCSILLKAAEDTPAAPAELVRAFAEAGLPDGAINLVYGDPAEISAYLIPHPVIRKVSFTGSTQVGKQLAALAGLHMKRVTMELGGHAPVIIAADADVEQAIKVVSGSKFRNAGQVCISPTRFLIENSVYDQVVEGMAAYATSLKVGDGLEAGTTMGPLVNAKRVNAMERLVQDAREHKARVVTGGERIGNRGNFFEPTILADVPRDAAIMNEEPFGPVALLNRFDALDEALSEANRLNYGLAAYAFTGSSAKAARISSTVRSGMITINQLRSGPAGSALRRDQRFRLWNGRRCRRA

SEQ ID NO: 52443 - protein, 135 aa, Brassica napus
MTMMMMRSFSMAMLLFTLVSSISIVSSASSSPEAEFVKKTISSHKIVIFSKSYCPYCRRAKSVFSELDQVPHVVELDEREDGWNVQSALGEIVGRRTVPQVFINGKHIGGSDDTVEAHESGELAKLLGLSTKAEL

SEQ ID NO: 52444 - protein, 556 aa, Streptococcus pyogenes M1 GAS
MKSDIEIAQSVALQPITDIVKKVGIDGDDIELYGKYKAKLSFEKMKAVEANEPGKLILVTAINPTPAGEGKSTMSIGLADALNQMGKKTMLALREPSLGPVMGIKGGAAGGGYAQVLPMEDINLHFTGDMHAITTANNALSALIDNHLQQGNDLGIDPRRIIWKRVLDLNDRALRQVIVGLGSPVNGVPREDGFDITVASEIMAILCLATDLKDLKKRLADIVVAYTYDRKPVYVRDLKVEGALTLILKDAIKPNLVQTIYGTPALIHGGPFANIAHGCNSVLATSTALRLADYTVTEAGFGADLGAEKFLNIKVPNLPKAPDAIVIVATLRALKMHGGVAKSDLAAENCEAVRLGFANLKRHVENMRQFKVPVVVAINEFVADTEAEIATLKALCEEIKVPVELASVWANGAEGGLALAKTVVRVIDQEAADYKRLYSDEDTLEEKVINIVTQIYGGKAVQFGPKAKTQLKQFAEFGWDKLPVCMAKTQYSFSDNPSLLGAPTDFDITIREFVPKTGAGFIVGLTGDVMTMPGLPKVPAAMAMDVAENGTALGLF

SEQ ID NO: 52445 - protein, 282 aa, Arabidopsis thaliana
MSDALNMTLDEIVKKSKSERSAAARSGGKGVSRKSGRGRGGPNGVVGGGRGGGPVRRGPLALARRKRSLPWQNQNDLYEETLRAVGVSGVEVGTTVYITNLDQGVTNEDIRELYAEIGELKRYAIHYDKNGRPSGSAEVVYMRRSDAIQAMRKYNNVLLDGRPMKLEILGGNTESAPVAARVNVTGLNGRMKRSVFIGQGVRGGRVGRGRGSGPSGRRLPLQQNQQGGVTAGRGGFRGRGRGNGGGRGNKSGGRGGKKPVEKSAADLDKDLESYHAEAMNIS

SEQ ID NO: 52446 - protein, 436 aa, Pediococcus pentosaceus ATCC 25745
MEDIQKQGAKNVELSTPKTILLAFQHLLAMYAGDILVPLLIGAALKFNAQQMTYLISVDIFMCGVATFLQVKRTPLTGIALPVVLGSAVEYLAPMEHIGNTMGWGYMYGGVIAAGIFVFLISGLFASLRKFFPIVVTGSLITLIGFTLIPVAFQNIGGGNVADKNFGSSSNLILGFLTALVIILIQVFAHGFIKRISVLIGIIVGSVIAVVMGLIDPTPISQAHWIQIPMPFYFATPKFEWSSILTMLLAAVTCMIESTGVYFALADITKRNLTADDLKRGYRSEGIAAILGGIFNTFPYSTFSQNVGIVQLSGIKKLKPIYFSAGMLLILGLIPKFSAIATLIPTSVLGGAMLVMFGMVGAQGIKMLANVKMTVNNLLVIAVSIGIGLGVTTQPTLFHILPTSVQTILDNGMVVGCITAIIMNILLNGNQAVDGE

SEQ ID NO: 52447 - protein, 536 aa, Yarrowia lipolytica CLIB122
MKPLYITADIFDFITSYTNIDLYRQPNTMTKLHSQVLIVGGGFSGIATSIKLLKDWKVTDFHVYDRNEKFGGTWAANTYPGAASDIPAVWYCLASDPKIDWESAYPSQQELSEYIAGVVDKYGLKSFATFNSEIERIEWIPNERLWKATIAHNGNTITHTARVLFMGQGCLVTPNHVKIKGMEDFQGPIMHTAEWKPFDYDNKDVVVIGNGCSAAQVTSEVAKTAKSVTQFARSPQWIVPRTPVTIGPILRTILSWFPFLIPVLRFFVFCLLEMNWNMFRGGWWSDFDRSMRTKVAVKIAKKNMPEKYHETAIPKYQLGCKRIIFDCGYWAALKMESVLLTFDKLVEVGKNSVKDINGNQYPADLIVDATGFNIGRSMTSVDVIGENGMPLSEFWDGKVAAYETVMVPNYPNMFMLFGPNATTGHNSVIFGIENGLKFVESVASDVIQGRSDYVTVKPQAYDQWVQRIQAAIKQTNFATGGCVSWYMSVGEATHNAVSYPWTQLRFWWRARFPHYDDIYVENKSQKVTPGKAIKAE

SEQ ID NO: 52448 - protein, 688 aa, Neurospora crassa
MADQLSSGMGNLSIDQQPPSGPQMGGQGQMRRSYIPPHLRGKMGDAAPPMAGPNGLNNSAWAGNNNYDARGPGGGGNWPAPGGPPGPGFEGQQGAGWGGPRPQGGFNPNAYRGNAGAGAGAGAGGGGGSFSNRGSGDGQWRDGKHIPGPANPRVERELFGTPDDPSKQHTGINFEKYDDIPVEASGDNVPEPVLTFSNPPLDNHLISNIQLARYNVPTPVQKYSIPIVMGGRDLMACAQTGSGKTGGFLFPILSQSFHTGPSPIPASAAGAYGRQRKAYPTALILAPTRELVSQIYDEARKFAYRSWVRPCVVYGGADIGSQLRQIERGCDLLVATPGRLVDLIERGRISLCNIKYLVLDEADRMLDMGFEPQIRRIVEGEDMPKVNDRQTLMFSATFPRDIQILARDFLKDYIFLSVGRVGSTSENITQKVEYVEDIDKRSVLLDILHTHAGGLTLIFVETKRMADSLSDFLINQNFPATSIHGDRTQRERERALEMFRNGRCPILVATAVAARGLDIPNVTHVINYDLPTDIDDYVHRIGRTGRAGNTGIATAFFNRGNRGVVRELLELLKEANQEVPAFLETIARESSFGGGRGGRGGGRGGGRGRTQTADYRKFGGSGGGGFGGGFGGAPASGGYGGGGYGGGGPPAGGYGGGGGAGYGGGGGGGGYGGGGYGNPGGAGGQSWW

SEQ ID NO: 52449 - protein, 543 aa, Ustilago maydis 521
MKVAIVGAGFAGISTAKYLQQYGHDVTVFEACDDLGGVWSKARRYPGLATQNSKETYSLSDMDMPRHYPTWPAAQQVQDYLDAYTDKHNLRRLMQFGTRVERAHPTQHGWEITTKKGTTTQSHHFEHLVVATGTFSRGKIPDYKGIDEFKAAGGHICHSSDLGLDPKTVQDKNVLVVGYGKSSCDVANAVSASANSTTLVARRLIWKLPRMIRGIPYQYLLLTRLGESLFEYITPSAFEKWFNSGSGRMIRNAMLNSLQWVVTGQLKLDHLGLVPEGPFEEIARSTISLSTEGLYKNIEAGKVCVKRDAEIELLTKDASGRPVAVLKDGSTLACDLLICATGFHQNVPFLPVDIQKKFLDQNDNFLLHKHILPIGVPNLTFNGYNSSLFCPTSSEAAALWISAHLAGLTHLPPEDEMLQAAKQKLAWLDARSNGKHAHGTNLVPFSLHSIDDTLKDVDLGLGTCATIRQWLLPVRPRDYAGLGARLGKRIHEANAAKLKHYASTVSETLTVKWEILAPDSVEDGVGFNDERSSQEQQDVADGL

SEQ ID NO: 52450 - protein, 216 aa, Glycine max
  misc_feature (155)..(155): Xaa can be any naturally occurring amino acid
MSNSKVQTTPIVVEKVNCIKKIQKLTKIKSKGLSICITNPTKKMSVASSFPCIKIPACSSSPSCTSSSTSSFRFSSSKPYAAVSIRNSQTEGPLRRPVAPPVREPSSSVPQPLKPSPPSQVPPQKASPVAGDDNNVITLEFQRQKAKELQEYFKXKKLEDANQGPFFGFIGQNEISNGRWAMFGFAVGLLTEYATGSDFVDQVKILLSNFGIVDLE

SEQ ID NO: 52451 - protein, 360 aa, Magnaporthe grisea 70-15
MATARALRIGLIAGDGIGKDVVPAGRRVLEALPASLGLRFSFVDLQAGFQTFEETGSALPDRTVETLKGECDGALFGAVSSPTKPVKGYSSPIVGLRKKLDLYANVRPVKTVVSAPRPIDMVIVRENTEDLYVKDERTFDAPDGSGPVAEAIKRISYRASHRIASMAGEIALRRQKIRAAGAPSIHSSPLVTITHKSNVLSQTDGLFRSTAKEALADPKYAGSVAVEEQIVDSMVYKLFRQPEDYDVIVAPNLYGDILSDGAAALVGSLGLVPSANVGDGFVMGEPCHGSAPDIMGKNIANPIATLRSAALMLEFLNEEEAAAKIYAAVDANLVEGKVLSPDLGGKATTDQVLEDILRRL

SEQ ID NO: 52452 - protein, 230 aa, Rhodothermus marinus
MPGKPVNLASPNERKLNFWERLYLPAVVQGLAYTWRKMRSPRYTFQYPDELWYPPDSYRGRPVLVEENGRPRCVACGLCARACPPLAISMQAKEVDDVKEREPAWFEINMLRCIYCGYCEEVCPEEAIVMSKEYDLTFQSRDEAIFGLEKLLVPAERLKDRLEWLDRYKDPQYGQHWEFRKENNLHSLKDRPFLKWLLEEEGMEELKSTHLRPEEPVAAERSWGGVRAEG

SEQ ID NO: 52453 - protein, 156 aa, Zea mays
  misc_feature (27)..(27): Xaa can be any naturally occurring amino acid
  misc_feature (63)..(63): Xaa can be any naturally occurring amino acid
  misc_feature (94)..(94): Xaa can be any naturally occurring amino acid
  misc_feature (108)..(108): Xaa can be any naturally occurring amino acid
MAAAAAMMVSGGRAALVVAGRALRGGXAMAAAQQASNVRATYHLYNPAQNGWDLNRVSAYCAXTWDADKPLSWRQKHGWTAFCGPAGQKGPGRXCGKCIRVKNRATGXASIVARIVDQCSNGGLDLDYETVFKKIDTNGQGYQMGHLNVDYQFVAC

SEQ ID NO: 52454 - protein, 427 aa, Arabidopsis thaliana
MGGSGNWIRSLISNRKPVNDQQEKLSDKSSKKKWKLWRISSESLASSSFKSRGSYAASSLGSELPSFSADEAFTTAMAALIRAPPRDFLMVKREWASTRIQAAFRAFLVCESSLISSYMSYSSCGLIISTHGSSCSLCCLRLFFFQARQAFRALKAVVRIQAIFRGRQVRKQAAVTLRCMQALVRVQSRVRAHRRAPSDSLELKDPVKQTEKGWCGSPRSIKEVKTKLQMKQEGAIKRERAMVYALTHQKFRVLSLIVIMSHELFWQSRTCPSPSGRAITHHGLRKSSPGWNWYDDVGTFSRKSSESSVLSEYETVTVRKNNLSSTRVLARPPLLLPPVSSGMSYDSLHDETSTSSTSQSPVAFSSSVLDGGGYYRKPSYMSLTQSTQAKQRQSGLSCNGDARRSAGSDQCTDLYPPGNVWAKSQRS

SEQ ID NO: 52455 - protein, 103 aa, Zea mays
MSGRGKGGKGLGKGARKRHRKVLRDNIQGITKPAIRRLARRGGVKRISGLIYEETRGVRKIFLENVIRDAVTYTEHARRKTVTAMDVVYALKRQGRTLYGFGG

SEQ ID NO: 52456 - protein, 331 aa, Glycine max
  misc_feature (118)..(118): Xaa can be any naturally occurring amino acid
MPPNITTVVANVTTEQLPKARGGSSGRAFVTFLAGNGDYVKGVVGLAKGLRKAKSMYPLVVAVLPDVPEEHREILKSQGCIVREIEPVYPPENQTQFAMAYYVINYSKLRIWEFVEYXKMIYLDGDIQVFGNIDHLFDLPNNYFYAVMDCFCEKTWSHTPQFQNGYCQQCPDKVQWPSHFGSKPPLYFNAGMFVYEPNLDTYRDLLQTVQLTKPTSFAEQDFLNMYFKDKYKPIPNMYNLVLAMLWRHPENVELDKVQVVHYCAAGSKPWRFTGKEENMDREDIKMLVKKWWDIYEDETLDYNNNSVNVERFTSALLDAGGFQFVPAPSAA

SEQ ID NO: 52457 - protein, 532 aa, Brucella melitensis 16M
MRHRRMSNLSAVFRLMRAGWILTREGVISALPVEGLSGLPALGHRIAGFLARPRARQMERSERMSRAMNKLGPSYVKLGQFLATRPDIVGHDVAADLELLQDRLDFFPQAGAVAAIEGSLGRKIDDLYVRFDAPIAAASMAQVHPAEVMKDGAPQKVAVKVIRPGVRQRFARDLESFFMVARMQERHMPFTRRLRPVQVVETLSQTTRIEMDLRLEAAALSEIAENIKGDEGFRVPKVDWERTGRDVLTLEWIDGIKMSDIPALEAAGFDLKKLAETLIQSFLRHTLRDGFFHADMHPGNLFVDHQGLVVAVDFGITGRLDKQQRRFLAEILYGFITRDYMRVAEVHFEAGYVPYTHDVASFAQAIRAIGEPIHDQPAETISMAKLLTLLFEVTELFDMETRPELLMLQKTMVVVEGVSRTLDPHFNMWKAAEPVVGDWIRKNLGPQGMVLDAKESAYALLHFTRKTPELLQRIDRISVALDTMAANGLRFDDATAEAIGRAEAQHSRWGRIAQVVIAVSMAAIAIKLYIWL

SEQ ID NO: 52458 - protein, 407 aa, Arabidopsis thaliana
MNSHFLTNDLILEVLSRLPLKSVARFHCVSKRWASMFGSPYFKELFLTRSSAKPRLLFAIVQNGVWRFFSSPRLEKSSSTLVATAEFHMKLSPNNLRIYHDNTPRYFSIGYASGLIYLYGDRYEATPLICNPNTGRYTILPKCYTYRKAFSFFGFDPIDKQYKALSMIYPSGPGHSKILTFGDGDMNWKKIKYRVLHDIYSQGICINGVLYYLGDTSDWDNDHDVTSGNVLVCFDLRSESFTFIGLECGQLINYKGKLAVIFWDDVDDDDVKDDAIDEMHVWVLEDVEKKEWSKYAYTWTEDKLYRSQVSVVGMTASGEIVFSMRKYTSEQPFYVYYFNPERNNLRRVEIQGFEAFTKFGTVYTFVDHVEDLNVYNLKHFKSVHPPSVQPEYDESDSESEEDREIII

SEQ ID NO: 52459 - protein, 445 aa, Bacillus licheniformis ATCC 14580
MKNETALKRSLTLGPLVVIGLAYMDPLVVFDSYGVVAQLTKGHVPAAYVFTVAALLLTALSYGSMVKAYPKAGSVYTYAYESIHPHAGFLAGWTIMLDYLFLPMVNFAIGSAYLTAAFPEVPHGFWVVLLALSITVVNVLGIRLTANITGLFVAFQVIVALTFAGFMIAGLAGGLGTGELISADPFFHSDIEPSLIVSGATILCFSFLGFDAISTMSEETVNPKKNIPLAIFLTVAIGGTLFTAISYLMQQIYPSYDNFRHADSASLEIALYTGGAFLKSFFLAGTMVAVISSSLSSHASASRLLYAMGRDSSLPKRFFGYVHPTLKTPVFNILFIGLISLTAMIGELEVIYSFISFGALIGFIFVHLSVIGHYYIRRQEKGFLKTLRYLVMPFLGASFCGWLLLSISKNALIIGAGWLIAGFIYFLFRIRSLPDVTFGFDRDPR

SEQ ID NO: 52460 - protein, 544 aa, Marinobacter hydrocarbonoclasticus
MLGQMMNMELTVNSLIDHAARYHGDAEIVSIGTDGNPSRSDWATVSERSRQLASALRTAGYVQGDRCATICWNNVGHLECYLGISGGGMVCHTINPRLFPEQLVYVINNAQDKVIFFDKTFLPIVSNIRDRLETVEEFVLMSEPDEEIAAQFPGLLFYEEFLQRGTPNANWPEIAENQASSLCYTSGTTGNPKGVLYSHRSTVLHALVAAQPDALNLSARDVVMPVVPMFHVNAWGVPYITAMVGAKLVLPGPGLDGQSLVKLIDSESVTIALGVPTIWQGLLSALDELGSSAQSLKRTVIGGSACPPSMMSEFRGKYGVEVVHAWGMTETSPIGTVNALLSKHNTLSEEGRNKIRESQGRPPYGVQLKIVGEDGHQLPEDGIAQGNLRIRGHWVVADYFGVEPNQTLEEDGWFETGDVASINDDGFMTIRDRSKDIIKSGGEWISTVELEGIAMGHSAINEAAVVAASHDKWDERPILLAVKIPDANITEEELLAHYQGKVAKWQIPDRAIFVEGLPRNATGKVLKNKLRSEYGEVLVNKPAS

SEQ ID NO: 52461 - protein, 558 aa, Marinobacter hydrocarbonoclasticus
MDFEQFYQDKYPAGIPREIDLNKYKNMVDVFEQAVQKFADKPAFTAVGVTLTYRDLDTQSRNFAAWLQNKTDLKPGDRIAVQMPNVTQYPVVVFGAMRAGLIVVNTNPLYTTREMEHQFNDSGAKALVVLANMADNAEKVLPHTGIEHVIVTEIADMHSPIKRTLMNAAVKHLKKMVPAFNIPGAHKLPAVLSAGAREKFTPVDIKLDDLAVLQYTGGTTGVAKGAMLTHANLVANLTQVRPMLEDQVEEGKEVVIAPLPLYHIYSFTLNCGIMLEAGAHNVLIPNPRDIPGFVKELQKQKFSAFIGLNTLFVALCNNEDFQDLDFSGLKLTASGGMALTSDTAKMWQRVTGCEISEGYGMTETSPVVTFNPRSAIQIGTIGLPIPSTVVKTIDDDGNETPVGEPGELCVKGPQVMRGYWQRPDDTQKSFTDDGFLKTGDVALIQEDGYIRIVDRKKDMIIVSGFNVFPNEIEDVVTTHPKVVECAAVGIPDAKSGEAVKVYVVPTKEGVTANELKEFCRERLTAYKVPKHFEFRDELPKSNVGKILRRELRDEANAK

SEQ ID NO: 52462 - protein, 256 aa, Rhizobium leguminosarum bv. viciae 3841
MTEKPRFWIGTSWKMNKTLTEAEQFARGLEAADGARDPRIHRFVIPPFTAVREVKAMLAKTSVKVGAQNMHWADQGAWTGEVSPVMLKDCNLDLVELGHSERREHFGETDETVGLKTEAAVRHGLIPLICIGETLSDRESGKAADILATQVRGALSKLSGAQKSAEILLAYEPVWAIGEKGIPATADYADARQSEIIAVAEAVLGRKIPCLYGGSVNPQNCEELISSPHIDGLFIGRSAWNVEGYLDILARCAAKL

SEQ ID NO: 52463 - protein, 204 aa, Zea mays
MASSMLSSAAVVTSPAQATMVAPFTGLKSSSAFPVTRKANNDITSIVSNGGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQWISFIAYNPQASPVFNSRWRTFKKKSTPSPISPLAGSF

SEQ ID NO: 52464 - protein, 140 aa, Francisella tularensis subsp. tularensis SCHU S4
MTKQRTLSIIKPDAVEKNVIGEIYSRFEKAGLRIIAAKMKHLSKAEAERFYAVHKDRPFFSALVEFMISGPVMIQVLEGENAIAKNRELMGATNPKEAKAGTIRADFADSIDANAVHGSDAEDTAAQEIRYFFSDTEIFG

SEQ ID NO: 52465 - protein, 398 aa, Rhodopirellula baltica SH 1
MVPNWRHPSRMIASTILRAPNARTAQPNLSFDLAKELAEKHGTPLLVVSRSKAIETYWAMKNALPGVDLYYAAKANPDLHFLSTLNGENAFIDVCSPGELKAALAAGFTPDRMLHTHPCKTDANLWECYEAGVNWFVFDNPIEAEKIRRLTPDVNLLLRLATTGASSRINLSAKFGCPMHEALELLATAKAKGLKVRGFSFHVGSQCLNPQDYVEVLRSVREVWDEATKAGHHLEVLDIGGGFPAPYREDAPSIEAFGEVITNGLREIFGDLPIRLIAEPGRGLCTESVTLITRVIGKSRRWELPWFFLDDGIYGSFSGKIFDHTDFPLLVENDGSRETVPCVVAGPTCDSTDIVSRDQWLPDLEVGELVLVPSMGAYAAASASPFNGLPMANSVAID

SEQ ID NO: 52466 - protein, 881 aa, Pseudomonas syringae pv. tomato str. DC3000
MQDLDPVETQEWLDALESVLDKEGEDRAHYLMTRLGELATRSGSQLPYAITTPYRNTIPVTHEARMPGDLFMERRIRSLVRWNALAMVVKTNIGDPDLGGHISSFASSATLYDIGFNYFFQAPTDEHGGDLIYFQGHASPGVYARAFLEGRITEDQMNNFRQEVDGKGLSSYPHPWLMKDFWQFPTVSMGLGPIQAIYQARFMKYLEHRGYIPEGKQKVWCFLGDGETDEPESLGAIALAGREKLDNLIFVVNCNLQRLDGPVRGNAKIIQELEGVFRGAQWNVTKVIWGRFWDPLLAKDVDGILQRRMDEVIDGEYQNYKAKDGAFVREHFFNSPELKAMVADLSDDEIWKLNRGGHDPYKVYAAYHEAVNHKGQPTVVLAKTIKGYGTGAGEAKNTAHNTKKVDVDSLRHFRDRFDIPVKDAELEALPFYKPEEGSAEARYLSERRAALGGFVPQRRAKSFNLPTPPLDTLKAILDGSGDREISTTMAFVRILTQLVKDKEVGQRIVPIIPDEARTFGMEGMFRQLGIYSSVGQLYEPVDKEQVMFYREDKKGQILEEGINEAGAMSSFIAAGTSYSSHNQPMIPFYIFYSMFGFQRIGDLAWAAGDSRTRGFLIGGTAGRTTLNGEGLQHEDGHSHILASTIPNCRTFDPTYGYELAVIIQDGMRLMFEEQQDVFYYLTVMNESYAQPAMPAGVEAGIVKGMYLLEEDTREAAHHVQLLGSGTILREVREAAKILRDEFNIGADVWSVTSFNELRRDGLAVERNNRLHPGQKPELSYVEQCLNGRKGPVIASTDYMKLFADQIRQWVPTKEYKVLGTDGFGRSDSRKKLRHFFEVDRHFVVLAALEALADRGDIEPKVVAEAIVKFGIDPEKRNPLDC

SEQ ID NO: 52467 - protein, 462 aa, Escherichia coli O157:H7 EDL933
MTANSPLQRVGQEKGIAMGSQELQRKLGFWAVLAIAVGTTVGSGIFVSVGEVAKAAGTPWLTVLAFVIGGLIVIPQMCVYAELSTAYPENGADYVYLKNAGSRPLAFLSGWASFWANDAPSLSIMALAIVSNLGFLTPIDPLLGKFIAAGLIIAFMLLHLRSVEGGAAFQTLITIAKIIPFTIVIGLGIFWFKAENFAAPATTAIGATGSFMALLAGISATSWSYTGMASICYMTGEIKNPGKTMPRALIGSCLLVLVLYTLLALVISGLMPFDKLANSETPISDALTWIPALGSTAGIFVAITAMIVILGSLSSCVMYQPRLEYAMAKDNLFFKCFGHVHPKYNTPDVSIILQGALGIFFIFVSDLTSLLGYFTLVMCFKNTLTFGSIIWCRKRDDYKPLWRTPAFGLMTPLAIASSLILVASTFVWAPIPGLICAVIVIATGLPAYAFWAKRSRQLNALS

SEQ ID NO: 52468 - protein, 449 aa, Francisella tularensis subsp. tularensis SCHU S4
MNAQKYIDSVIAQVEKRDGHEKEFIQAVKEVFSTLKPALEHNPKYIEENILARMVEPERGISFRVPWVDKDGNIQVNRGYRYQFNGAIGPFKGGIRFHPSVYSGIIKFLGFEQVFKNSLTTLPMGGGKGGADFDPKGKTDAEIMNFCQSFMIELQRHIGPDIDVPAGDIGVGGKEIGYMYGQYRRIRACFENGVLTGKSLESGGSLIRPEATGYGAVFFLDEMLKHDGETLQGKTVVTSGYGNVAWGVCKKVAQLGGKVVTISGSKGFVHDPEGITTDEKIEFLLKIRNGEKTMQDYSKEFNASWHAGQKPWGIKADIAIPAATQNEIDVEDAQKLIDSGVKYVVEASNMPTTNEAIEFLMKKGIILAPGKAANAGGVAVSGLEMSQNSARLSWSAEEVESKLQQIMANIFHACKFASSKYNLGYNLVAGANLAGFEKVAEAMIQQGRY

SEQ ID NO: 52469 - protein, 409 aa, Triticum aestivum
MAARKDNAVLIACQAPNGRVTRAQAANRGRFGVPHPAPVPVRTERKPATKGKAKRGASDENTCASALTSAPPPKRRAALKDVTNISCANSFRNCTAVTKLQSRPTQKVGRNPSKNKQCAKKAPKPPLPTLSGTSFVVNDSHNVEETQKAELLPPKEEPTALLENKGSLSLWNFARNRESGVHEPFFQGRNTRDKSETADSNTGDYVGLNVIDIDKDNGNPQMCASYAAEIYRNLMAAELIRRPKSNYMETLQRDITKGMRGILIDWLVEVSEEYKLVPDTLYLTVYLIDQFLSRKYIERQKLQLLGITSMLIASKYEEICAPRVEEFCFITDNTYTKNQVLKMECEVLNDLGFHLSVPTIKTFLRRFLRAAHASQKAPCATLGYLGNYLAELTLTDYSFLKFHPSVVAA

SEQ ID NO: 52470 - protein, 218 aa, Oryza sativa (japonica cultivar-group)
MSFLEQATERKAPPPARLGSITKLTAASSSFANLFSTFLGPVSSPEPRPRRSFDGGATGVGLGIVAAMSHACLTTEAEPIAIGAAARRRAREEAELSESYTCVITHVAGVDGASGSVRKRVYFGFGDGGGGWLVEADEEPAPAADFLSRCFLCDKRLDGLDIYMYRGEKAFCSSECRCHQMLMDDHADNCGSEALKANDYSASPHSAPLPFSLSVAAA

SEQ ID NO: 52471 - protein, 71 aa, Triticum aestivum
  misc_feature (16)..(16): Xaa can be any naturally occurring amino acid
  misc_feature (24)..(24): Xaa can be any naturally occurring amino acid
  misc_feature (28)..(29): Xaa can be any naturally occurring amino acid
  misc_feature (38)..(38): Xaa can be any naturally occurring amino acid
  misc_feature (40)..(40): Xaa can be any naturally occurring amino acid
  misc_feature (42)..(42): Xaa can be any naturally occurring amino acid
KSQCNPRPQVLHSFVXGRIATLRXVVKXXALDKWNLYXVXWXYNTQEEREEAGAISGIQLIDLPDFSKQLK

SEQ ID NO: 52472 - protein, 375 aa, Oryza sativa
  misc_feature (306)..(306): Xaa can be any naturally occurring amino acid
MGDEVQALVIDNGTGMCKAGFAGDDAPRAVFPSIVGRPRHTGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVLDSGDGVTHTVPIYEGYALPHAILRLDLAGRDLTDYLMKILTERGYSFTTTAEREIVRDIKEKLCYVALDFEQEMHTAASSSALEKSYELPDGQVITIGNERFRAPEALFQPSFLGMESAGIHETTYNSIMKCDVDIRKDLYGNVVLSGGTTMXPGIADRMQKELTALAPSTMKIKIIAPPERKYSVWIGGSILASLSTFQQMWISKEEYDESGPSIVHRKCF

SEQ ID NO: 52473 - protein, 254 aa, Spinacia oleracea
MAYEEAIAALKKLLSEKGELENEAASKVAQITSELADGGTPSASYPVQRIKEGFIKFKKEKYEKNPALYGELSKGQAPKFMVFACSDSRVCPSHVLDFQPGEAFMVRNIANMVPVFDKDKYAGVGAAIEYAVLHLKVENIVVIGHSACGGIKGLMSFPDAGPTTTDFIEDWVKICLPAKHKVLAEHGNATFAEQCTHCEKEAVNVSLGNLLTYPFVRDGLVKKTLALQGGYYDFVNGSFELWGLEFGLSPSQSV

SEQ ID NO: 52474 - protein, 303 aa, Thermosynechococcus elongatus BP-1
MSDFLPYAYLNGQFVPFEEAKISVATHALHYGTAALGGLRGLPNPANPKEILLFRLEDHCRRLSRSAYYLGYELPTSEIKARIIEWVQKNQPRVPFYIRPLVYTSGLGIAPRLHDIEKDFLIYGLPLGDYLAATGVTCRISSWQRQCDRSFPLRGKLTTSYIVSALAKTEAVSSGFDEAILLNEQGKVCEATGMNLFLVREGQLITPSVDQDILEGITRRSVIELAQAAGVKVMERPVDRTELLIADEVFLTGTAARIVPVSRIETYTLPSDRPLTLQLQKQLQAIVEGREPQYRHWVDVIPL

SEQ ID NO: 52475 - protein, 465 aa, Myxococcus xanthus DK 1622
MAETFDVVIIGSGPGGYVGAIRAGQLGLKTAIIEKDKRLGGTCLHRGCIPTKSLLWTAELFHHVREAADFGVDVSSPAINWPNAMKHKDKIVTKGANGIDFLMKKNKVTVVKGHGRIAGKGKVEVTAADGSKQVLEAKNIILATGSVPKSLPNVPVDHKRVLNSDSILQIDRVPKSIIVLGAGAVGCEFASVFNHVGSKTSIVEYMPALLPIEDADISKELEKIFKRRGIDVHTGSAVEKVEHTADGVRVTMKVGNETKTLEAEILLSAVGRSPVTEDVGLDKTNIQAERGYIKVDSMLRTSEPNVYAVGDIIPTPMLAHMASAECVVAVEHIAGKNPQPINYDLTPSATYCYPEVASVGLTEKKAKERGYDVKVGIAPMGAVTKASISNEATGMIKIVSDRKYDEVLGVHLIGPHATELLAEACVALKLEITTEELANTIHAHPTLSEIVHEGAEATLGHPRHF

SEQ ID NO: 52476 - protein, 455 aa, Kineococcus radiotolerans SRS30216
MDREGAPPALTRGAGTRCHPGQAPEPGEGSRTRTGCPRSLRRVSTGLDRGASAPPPGAPPPPPDPRVVARMRRFGPTVFAEMSALAARTGAVNLGQGFPDADGPASLLEDAVAAIRSGRNQYPPGTGVPALLEAVAEHQHRFYGLTLDPGTEVLVTAGATEAIAASLLALCGPGDEVVVLEPAYDSYAAVIALSGAVQRSVPLVPGPDGSTLDAQDLRAAFSARTRVVLLNTPHNPTGTVLSPAQVAAVAALAVEHDAVVLTDEVYEHLVFDEHRHVPVATLPGMAERTLTVSSAGKTFSVTGWKVGWVSGPAPLVAAVRMVKQFLTYVNAGPFQPAVAGALALPDDFYLGLAADLQRRRDLLVEGLLSAGFGVSVPAGTYFVVADPRPLGHDDGTALCRELPGLAGVVGVPVSAFCEPGSPAAAAVRPLVRFTFCKSDAVLEEACRRLQALRPR

SEQ ID NO: 52477 - protein, 337 aa, Thermosynechococcus elongatus BP-1
MVRVAINGFGRIGRNFMRCWLQRKANSKLEIVGINDTSDPRTNAHLLKYDSMLGIFQDAEITADDDCIYAGGHAVKCVSDRNPENLPWSAWGIDLVIEATGVFTSREGASKHLSAGAKKVLITAPGKGNIPTYVVGVNHHTYDPSEDIVSNASCTTNCLAPIVKVLHEAFGIQQGMMTTTHSYTGDQRLLDASHRDLRRARAAAMNIVPTSTGAAKAVGLVIPELQGKLNGIALRVPTPNVSVVDFVAQVEKPTIAEQVNQVIKEASETTMKGIIHYSELELVSSDYRGHNASSILDASLTMVLGGNLVKVVAWYDNEWGYSQRVLDLAEHMAAHWA

SEQ ID NO: 52478 - protein, 129 aa, Zea mays
MTFLILLMPGFIQVGYYYFFSSQVRRSVVYGDQPRNRLDLYIPEDNSRPCPVVAFVTGGAWIIGYKAWGALLGRRLAERGIIVACIDYRNFPQGTSVNGVTDCTMLPPRGGELVMVSRCWSDGRMNLLF

SEQ ID NO: 52479 - protein, 499 aa, Arabidopsis thaliana
MTMISDLSKDLVEEILSKAPITSLGAVRSTHKQWNALSKGRLLYKAEAKDQFLGFMVMDHRFLSMIFHLNGILKGDGEGFDRPSIREVGDIVNQIDISKVFQCDGLVLCVPSDNSSVVVWNPYLGQTKWIEAREPHDESDMFALGYDKDKNHKILRLYDECYYYYEVYNFKTESWGEEDHLPGWDIDSYNRGVSLNGNTYFLTQEQRAKDKYRVFLLCFNFTTEKFENFIAMPFKYHRKYVGTLSCVGNEKLAALYQRWDTGEMAIWVTTKIESNEVLWSNLFKVDMKPLVRFGFQQCKDEAGSFFIDEEKKLAVVFNLDKKRGKRNNKTRCYHTAYIIGEKGYLKKEVLGEAVEVRKDVYRSALVCSSSYVPSLEKINQIEEEEEDKCKSIKMVDTKRQLETSFGLDFELHEDSCFFIDEEKKLAVVFDLAESKRCKTANAYIIGVQIDDPIARRDKRERNRKWMSKRKEKKRKGTNKQQGLTPMKKKQEVHLLLINR

SEQ ID NO: 52480 - protein, 548 aa, Pseudomonas syringae pv. tomato str. DC3000
MSELIRVPDIGNGEGEVIELMVKVGDRIEADQSVLTLESDKASMEIPAPKAGVIKAMKVKLGDRLKEGDELFELEVEGEASAAPAPAAEPAAAAAPAAAEKPAEAAPAAAEPAPAAAATVQDIHVPDIGSSGKAKIIELMVKVGDSITADQSLITLESDKASMEIPSPAAGVIESIEVKLDQEVGTGDLILKLKVAGAAPAAAPAPAASAPAAAPAKAEAAAPAAAPAPKAEAAPAPAAPAKDGAKVHAGPAVRQLAREFGVELSAVSATGPHGRVLKEDVQVYVKAMMQKAKEAPAGGASGGSGIPPIPEVDFSRFGEIEEVPMTRLMQLGASGLHRSWLNIPHVTQFDQADITDLEAFRVAQKGAAEKAGVKLTVLPLLLKACAHLLKELPDFNASLAPSGKAVIRKKYVHIGFAVDTPDGLLVPVIRDVDQKSLLQLAAEAAVLAEKARSKKLTANDMQGACFTISSLGHIGGTGFTPIVNAPEVAILGVSKATIQPVWDGKAFQPKLMLPLSLSYDHRVINGAAAARFTKRLSELLTDIRTILL

SEQ ID NO: 52481 - protein, 1010 aa, Bacillus licheniformis ATCC 14580
MFYCSLVREEKWIIRYIHKQERGMEMAEQKKITINGVEMEASEEQTVLQLLNNSSIEVPQICYHPSLGPIETCDTCIVSINGELKRSCSAEVKDGDVIDTLSPDVKKAQVIGMDKILYNHELYCTVCDYNNGGCEIHNTVKEMKVNHQSIPFDQKPYHKDESNPFYRYDPDQCILCGRCVEACQDVQVTETLTIDWERKRPRVIWDNDVPINESSCVSCGHCSTVCPCNAMMEKGMEGEAGYLTGIDDETLRPMIEITKGVETGYGSILAISDMESAMRDERIKKTKTVCTYCGVGCSFDVWTKGRDILKVEPQEEAPANGISTCVKGKFGWDFINSEERLTKPLIREGDHFREAEWEEALTLIASKFTDLKEEFGPDSLAFITSSKCTNEESYLMQKLARGIIGTNNVDNCSRYCQSPATAGLFRTVGYGGDSGSIADIAQADLVLIIGSNTSESHPVLSTRIKRAHKLRGQKVIVADIRKHEMAERSDLFVQPRAGSDIVWLNAIAKYLIENGKADERFLQERVNGRDEYVKSLTPYTLEYAEEKTGIDQETLIQMAEMIGQADSVCALWAMGVTQHIGGSDTSTAISNLLLVTGNYGKPGAGSYPLRGHNNVQGASDFGSMPDRLPGYEKVTDEQVRQKYEQAWGVPLPKEPGMTNHEMIEKIHSGKLKAMYVKGEEMGLVDSNINHVHAAYEKLDFFVVQDIFFSRTAEFADVVLPASPSLEKEGTFTNTERRIQRLYQVFEPLGESKPDWQIIMEVANKLGADWHYEHPADIMEEAAKLSPIYAGVTYERLEGYNSLQWPVSADGKDSPLLFTERFPFPDGKAILYPVHWTEPEEFGEEYDIHVNNGRLLEHFHEGNLTYKSKGISKKTPEVFLEISPELAAERGIQDGTLVRLTSPFGNVKVKCLITDRVKGKEVYLPMNDSGEAAINLLTGSHADKDTDTPAYKETSAKMEILKRDGSNPLPKINHRNGNPQPQIGVQVQKKWARKDYIFPGDAVKRGIGHNG

SEQ ID NO: 52482 - protein, 520 aa, Rhizobium leguminosarum bv. viciae 3841
MTQTAHPDSVLIVDFGSQVTQLIARRVREAGVYCEIVPFQSAEEGFHRLQPKAVILSGSPASTVDEGSPRAPDIIFDSGLPVFGICYGQQTMCMQLGGKVESGHHREFGRAFLEVDRDCQLFEGLWSSGSRHQVWMSHGDRVTALPDGFEVVATSSNAPYAFIADEKRKYYGVQFHPEVVHTPDGAKLIGNFIHNIAGIKGDWSMSAYRQKAVEQIRAQVGDKRVICALSGGVDSSVAALLIHEAVGDQLTCILVDHGLMRKDEAAGVVAMFREHYNLHLLHVDAADRFIGELEGVSDPETKRKIIGRLFIETFEEEARKLGGADFLGQGTLYPDVIESVSFTGGPSVTIKSHHNVGGLPERMKMQLVEPLRELFKDEVRALGRELGLPDSFIGRHPFPGPGLAIRCPGGITREKLEILREADAIYLDEIRKAGLYDAIWQAFAVLLPVQTVGVMGDGRTYEFVCALRAVTSVDGMTADFYHYDMEFLGRAATRIINEVRGINRVVYDVTSKPPGTIEWE

SEQ ID NO: 52483 - protein, 438 aa, Bacillus thuringiensis serovar konkukian str. 97-27
MQRFKLKEDVTMEQKPVLDVNEVPKPGKWLFLSIQHLFAMFGSTVLVPFLTGLNPSVALISSGLGTLAFLLITKGQVPAYLGSSFAFIAPIITAKTAGGPGAAMLGGLLAGLVYILISLGIKKSGSKWIMKLLPPIVVGPVVMVIGLALAHTAVNMAMNGADGKYSFTHFSVALVTLAITIICSIFGRGFFSIIPVLLGIIGGYIFAYFQGLVDLKPVAEAKWFVVPDFTVPFVTYTPEFSWKIVLLMVPVALVTISEHIGHQIVLGNVIKRDLIEKPGLHRSIFGDGVATLIASLIGGPPNTTYGENIGVLAITRAYSVYLFIGSAVFAIMFGFIGKISALIHSIPTPVMGGVSILLFGVIASSGLRMMVDDKTDLSDKRNLMIASVILVIGIGGAVLHVGESFQVEGMALAAIVGVLLNLLLPETKQIKQSNQIAS

SEQ ID NO: 52484 - protein, 459 aa, Mesorhizobium loti MAFF303099
MTYQNYSLKQLQQIDAAHHLHPFTDHKELREAGSRIITHANGPFIYDSEGTELLDGMAGLWCVNIGYGRDELAEAAYAQMKELPYYNSFFKCSTPTPVLLSKKLAEIAPKNVNQVFYGSSGSEANDTALRLVRHYWVIEGKPEKNRVISRKMAYHGSTIAGTSLGGMDAMHKQLNGAVPNIVHVMMPYAYELALPGESDHDFGLRAAKSVEDAILEAGVDKVAAFIGEPVMGAGGVKIPPASYWPEVQRICRKYDVLLMLDEVITGYGRTGEWFAAQTFGIEPDTITTAKALTSGYQPLSALLVGDRITSTLVEKGGEFNHGYTYSGHPVACAVALKNLEIIEQEGLVDRVRNDTGPYFAKALQECIAGHDLVGEVRSIGLMGAIEIVKDKATKERFLPSGSAAVTVRDHAIANGMMLRATGDTMILSPPLIWTRDTIDMACERIGKALDLAQADLRKR

SEQ ID NO: 52485 - protein, 843 aa, Hebeloma cylindrosporum
MATFLPLLTEENLPLFNALNLIGPIVLDAQRSVSLPRTPQHSYLLVDNSPVDLQDIASWLDEGVEKVIVPLASVKELIGVIPPDRLILLLDVANVSAFSEKVRNGVSGVLLKTPSIDFDFISSISKFFAGSTIHVLSTSAILPTPANIRELRSIGATLIIPESQLTLAPTSATQLNIGDAFLAPVVTDRADGLFPTMVTSETGHSLGLVYSSRESCKGKHNHRERYIPSRKHGLWRKGETSGATQDVVRIRLDCDSDSLEFRVVQHGAGFCHLNRRSCFSEASGLSLLEATLISRLESAPEGSYTKRLFNDANLLQSKIMEEADELCRATTKEEIAFEAADLFYFALTKCVAAGVGVADIEHSLDRKAKRITRRTGNAKPQWTSGESTAAPEKKETEKGKVVDGPIRMRTSDLSTLSAQERAQLLRRPVLKSDEMIEKVKPIVEAVRTRGDDALLEFTAKFDKAQLTSTVLLPPFAPESMVVEENVRKAIDVAYGNIRKFHEAQKSDSTLVVETMPGVVCSRFARAIARVGLYVPGGTAILPSTALMLGIPAQVAGCKEIVLATPPRSDGSISPEVMYVAHLVGASAILKAGGAQAVAAMAYGTKTVPKVDKIFGPGNQWVTAAKMLVQNDTDALVSIDMPAGPSEVLVIADHTANPASSRQNLLSQAEHGVDSQVVLVAINLSAEHLASIEREVDEQAHALSRVDIVRQSIVKSIIVKVSSVDEALAFSNDYAPEHLILHLEKPSEKVAMVDNAGSVFVGPYTPESCGDYASGTNHTLPTNGYARQFSGVNTLSFQKHITSQEITQAGLRGLGPVVATLADCEGLQAHANAVRVRLVNPQIS

SEQ ID NO: 52486 - protein, 348 aa, Brucella melitensis 16M
MTGEDMQAIIDAEQSFKFPVLVGDIGGTNARFSILVDSNAEPKEFPVLQTADYATIDEAIQHAILDQTAIQPRSVILAVAGPVDGDEIDLTNCDWVVRPKKMIADLGFEDVTVLNDFEAQALAVVSLEGHHMEQIGGKPEEAVATRVVLGPGTGLGVAGLVCTRHAWVPVPGEGGHIDIGPRTERDYQIFPHIERIEGRVTGEQILSGRGLRNLYLGICAADKITPTLETPVDITSAGLDGSNPQAAETLDLFATYLGRLAGDLALIFMAHGGVYLSGGIPVRILSALKAGSFRAAFEDKAPNKAIMRDIPVRVITYQLAALTGLSAFARTPSRFEVSTEGRRWRMRR

SEQ ID NO: 52487 - protein, 1051 aa, Coprinopsis cinerea okayama7#130
MDVDQQQNNAALKRKADVEDATTTSENGAAMDEDEDLNEPGPSSLKKPRLGSPRPVVLDDFETEAKREVAASAGLTGAAETNSRLELRHQVRHQVAVPPGYDYTPISKHVPPAKWDREYKFELDPFQRVSVYAIQRNESVLVSAHTSAGKTVVAEYAIAQCLNRKQRVIYTSPIKALSNQKYREMLAEFGDVGLMTGDVTINPSASCLVMTTEILRSMLYRGSEIVREVAWVIFDEIHYMRDAERGVVWEETLILLPHSVRYVFLSATIPNAMQFAEWICKSHDQPCHVVYTDFRPTPLQHYLFPAGGEGIYLVVNEKGEFRDDNFAKAMGKIQENMADDPADPFAGKGRKGKSKKGGEKKGPSDISKIIKMIMVKNYNPVIVFSFSKRECEGLALTLSKFEFTNQEEQDLIANIFENAIDNLSKEDRQLPQIVNLLPLLKRGIGFHHGGLLPILKEVIEILFQEGLIKVLFATETFSIGLNMPAKTVVFTATRKFDGKDFRNISGGEYIQMSGRAGRRGLDDRGVVIMMCDEKLEPSAAKGMLKGVADRLDSAFHLGYNMILNLMKVEGISPEFMLERCFFQFQSSAAIPQLEDELKAEQEAHRKIVVPDEALVSQYYDLRQQLDQMGADFREIVTHPAYSLPFMKPGRLVKVKHGKHDFGWGIVVNYQKRTPPRNRPGPSVDSLPPHEQYVIDVLLNLASTHSPSAKDRDAMAATPDGIQPCPQGQKGAPQVVPVLLSTIDSISHLRIVLPKDLRQDQARETAWKSVLEVQRRFPKGIALLDPVENMNIKDEKFKELVKKIAATEQKLFSSPLHKDPRLPELYTLFSQKKESLERISALKKRIQSTQDVLQMEELKCRKRVLRKLGFTTANDIVDVKGRVACEISSGDELLLTELIFNGAFNTLKPEQCAALLSCFVFGEKSDQQTKLTEELTAPLRVMQELARRIAKVSKESLLTIDEDEYVSSFKVELMEAVVQWCRGASFSDICKLTDQLFEGSLIRVFRRLGELLRQMAQAANVIGNEELKEKFETALEMLERPNSVIFCSSLYL

SEQ ID NO: 52488 - protein, 542 aa, Chromobacterium violaceum ATCC 12472
MLLGQMMDQPLLIADLLAHAERFHGDTEIVSRTVEGPMHRYTYRDAARRARQLANALPSLGVAPGDRVGTLAWNGYRHFEIYFAVSGSGAVCHTVNPRLFPEQIAWIVNHAEDKVLMFDSSFLPLVAQIADQLKTVERFVLLADHASLPADSGIPDLLSYEDLVHGHSDVYDWPRLDENAASSLCYTSGTTGNPKGVLYSHRSTVLHAYGSSLPDSFDLSARAVVMPVVPMFHANAWGLPYSCAMNGSKLVLPGPKLDGASLQQLIAEEGVTTTIGVPTVWLQLLQHCQREQLSLAPLKRVIAGGSAVPESMIEQLAERGIEMRQLWGMTELSPFGTTCTLKLKHQGLAGKDLNALLTKQGRPVYGVDIRIVDDAGLPLPHDGVSFGNLQVRGPWVLSQYFKRELDANHSADGWFHTGDVVTIDADGYMRITDRTKDVIKSGGEWISSIDLENILVGHPAVAEAAAIAVPHPKWDERPLMVVTLKPGARATREELLAYFDGKIAKWWTPNDIAFVDELPHTATGKLLKMKLREQFRDHRWPE

SEQ ID NO: 52489 - protein, 370 aa, Rhodopseudomonas palustris CGA009
MGVSFDKMDGSLWLDFDVQPTASPTPDADRAAKLENPGFGRVFTDHMAVVRYDQTNGWHAARVEARANFPLHTATAVLHYAQEIFEGLKAYKREDGGVNLFRPDANAKRFRDSADRMAMAPLPEAVFIEAVEQVVKIDRNWIPGGEGSLYLRPFMIASEVFLGVKPSAEYIFAVIASPVGSYFKGGPAPVSIWVSETYTRAAIGGTGGVKCGGNYAASLRAQAEAIERGCDQVVFLDAIERRYVEELGGMNVFFVFEDGSLSTPPLGTILPGITRDSIIALAREAGRKVREEAYTIDQWRADAASGKLKEAFACGTAAVISPIGKVCSNHGDFVINGGQAGEVAMGLRKQLVDIQYGRAADTHGWIKKVF

SEQ ID NO: 52490 - protein, 458 aa, Nostoc punctiforme PCC 73102
MTFDYDLFVIGAGSGGLAASKRAASYGAKVAIAEYDLVGGTCVIRGCVPKKLMVYASHFPALFSEASGYGWKVGNAELDWEYFITSIDKEVRRLSQLHINFLEKAGVELFSGRATLLDSHTVEVDGRKVTADKILIAVGGRPIKPDLPGMEYGITSNEIFHLKEQPKHIVILGAGYIGTEFACIMRGLGSEVTQITRGDKILNGFDEDVRTEIEEGMTNHGIRLIKNNVVKTVERVAEGFKLTLSGEDQEPIIADVFLVATGRTPNVDGLGLENAGVDVVASSIEGPGYPTTSAIAVNEYSQTNQPNIFAVGDVTDRINLTPVAIGEGRAFADSEFGNNRREFSHKTVPTAIFSNPEAATVGLTEAEAREKLGDAVTIYRTRFRPMYYTLTGKQEKTMMKLVVDSNTEKVLGAHMVGDSSAEIIQGVAIAVKMGATKKDFDATVGIHPSSAEEFVTMR

SEQ ID NO: 52491 - protein, 1317 aa, Pseudomonas syringae pv. tomato str. DC3000
MATTTLGVKLDDPTRERLKAAAHSIDRTPHWLIKQAIFNYLEKLESGATLLELNGATGKDSEDRGELAEDAGLQCFLDFAESIQPQSVLRAAITSAYRRPEQEVVPMLLEQARLTAPVAEATNKLAASIAEKLRNQKSAGGRAGIVQGLLQEFSLSSQEGVALMCLAEALLRIPDKGTRDALIRDKISNGNWQPHLGNSPSLFVNAATWGLLLTGKLVATHNEAGLTSSLSRIIGKRGEPMIRKGVDMAMRLMGEQFVTGETIGEALANASRFEAKGFRYSYDMLGEAALTEHDAQKYLASYEQAIHSIGKASHGRGIYEGPGISIKLSALHPRYSRAQYERVMDELYPRLLSLTLLAKQYDIGLNIDAEEADRLELSLDLLERLCFEPQLTGWNGIGFVIQAYQKRCPYVIDYVIDLARRSRHRLMIRLVKGAYWDSEIKRAQVEGLEGYPVYTRKVYTDVSYIACARKLLAAPEVIYPQFATHNAHTLAAIYQIAGQNYYPGQYEFQCLHGMGEPLYEQVVGKVADGKLNRPCRVYAPVGTHETLLAYLVRRLLENGANTSFVNRIADHSISIQELVADPVNQIERMATQEGGFGLPHPRIPLPRDLYGTERANSSGIDMANEHRLASLSSALLSTAHNDWKAAPMLGCPASEGTLAAALNPSDLRDVVGHVQEASLQDVDNAIQCALSAGPIWQATPPAERAAILERAADLMEGEIQPLMGLLVREAGKTFANAIAEVREAVDFLRYYAVQARNDFTNDAHRPLGPVVCISPWNFPLAIFSGQVAAALAAGNPVLAKPAEQTPLIAAQAVRLLLEAGIPEGVVQLLPGRGETVGAGLVGDERVKGVMFTGSTEVARLLQRNVADRLDSQGRPIPLIAETGGQNAMIVDSSALTEQVVIDVVSSAFDSAGQRCSALRVLCLQEDSADRVIEMLKGAMAESRLGNPERLSVDIGPVIDAEAKAGIEKHIQAMRDKGRTVYQVAIAESAELKRGTYVMPTLIELESFDELQREIFGPVLHVVRYKRKELGLLIDQINASGYGLTLGVHTRIDETIAKVIDNVNAGNVYVNRNIVGAVVGVQPFGGEGLSGTGPKAGGPLYLYRLLSTRPLDAIEKSFVRGDALVAPDTRLREVMSKPLQALKAWAASSQHAELDVLCGQYAEQSQSGITRQLAGPTGERNSYAILPREHVLCLADDENDLLTQLAAVLAVGSSAVWPETDISKPLFARLPKEVQARIKLVPDWAKDEVAIDAVLHHGDSDQLRAICQQIAQRSGAIVGVNGLSHGETNVPLERLVIERALSVNTAAAGGNASLMTIG

SEQ ID NO: 52492 - protein, 432 aa, Bacillus cereus G9241
MINSTFLTNRVFSTWYYFSLLLYKEKGCDLVKTPKIVVLGAGYGGMITTVRLQKALSVNEAEITLVNNNSYHYQATWLHESAAGTLQDEKICLDIQDVIDTNKVNFVQDTVVEIKAAEKRIILKDSELEYDYLVIGLGFESETFGITGLKEHAFSIANINATRQIREHMEASFAKYADEKRDELVTIVVGGAGFTGIEYVGELANRVPELCKQYNVPREKARIICVEAAPTALPGFDPALVEYAVKQLEKKGVEFRIGTAIKEATEEGIIVANGDDTELIKSETVVWAAGVRGNGIVEESGFEAMRGRVKVDEYMHAPGYEDVFMVGDAALIINEEINRPYPPTAQIAIQQGYNIAHNLTVLVRGKGEMKKFAFDNKGSVCSLGHDDAMGVVMGKKLTGWKASFMKKVIDNRYLFLLGGPLLVLKKGKLKFF

SEQ ID NO: 52493 - protein, 115 aa, Magnaporthe grisea 70-15
MSRVGKLAPEVNRALFVKNLSYNVTPEELFDLFGKFGPIRQVRQGIASNTKGTAFVVYEDVMDAKQACDKLNGFNFQNRYLVVLYHQPEKMARSKEDLEARKENLAQLKKQHGID

SEQ ID NO: 52494 - protein, 212 aa, Methanopyrus kandleri AV19
MSGKRNAARKAAEEVCRRGYEVIGVGAGTTVEAFLEELVKREADVLVFTTIPGTIDACRRIGLNVTTIPPEELPVAIDGADAVDPDGNLLKGGGACHSLEKAIDYTADEFWVVVDESKLVENLWELPVPVEVLRGCYELTVRTLEEFGEVRPRTCDEKYGPVVSDSGNPIVDLHVDDWDPAELERELNSVPGVVECGVFPGDKVDRIIVGRS

SEQ ID NO: 52495 - protein, 542 aa, Methanopyrus kandleri AV19
MSDKVLVIGAGPNRIGQGIEFDYCTVHAVWAIQEEGYKAIIVNNNPETVSTDYDTSDKLYFEPITLEDVLNIVEKERPIGVLTQFGGQTSVNLTVPLAERGVRVLGTDPDDVDRLEDRDRFSKLLKKLGIPQPESGTANDPEEAVEVAEDIGYPVLVRPSYVIGGRAMEIVYDEEDLRRYIEEAAKVSPEHPILIDRFIEGGIECEIDGARDEAGNVLIPGIMEHIEEAGVHSGDSACVVPPQTLPEHAQETVLEYAEDIAEGANVIGLINIQFVYDPEEDEVYVIEANPRASRTVPFISKAVGIPLAKIGTKAILGREIPEVLDEMGLEPPDGDPGIVAVKEAVFSFEKWPGVDPVLGPEMKATGEVMGIDRTFGAAYWKAQLAAGHELPLEGTAVISVADRDKPDIVPIARKLQRLGFDLLATRGTASHLREHGIECEVVRKVSEGSPNIVDLIREGEIDLIINTPTEGKDARRDGYAIRRAAVKFKVPYITTIAAAKAAVEAIELVKEKGVTVNCLHDIHKGDWTPREVKPEELTRYGG

SEQ ID NO: 52496 - protein, 506 aa, Arabidopsis thaliana
MWPEVVRNLSKGQSSTVTNNILLSEHKSISTKDKSAHAFSSSKFSKILRDQKHQQMEIVIASLALVVVLWCIWRILEWVWLKPKMLESYLRRQGLVGTRYTPLVGDLIKEVYNKFYDFEKTHTFPLTSLLTDGLANADGDKWVKHRKIINPAFHFEKIKNMVPTFYKSCIEVMCEWEKLVSDKGSSCELDVWPWIVNMTGDVISRTAFGSSYKEGQRIFILQAELAHLIILALGKNYIPAYRHFPTKNNRRMKTIVKEIQVILRGIISHREKARDAGEAPSDDLLGILLKSNSEQSKGNGLNMEEIMEECKLFYFAGQETTSVLLAWTMVLLSQHQDWQARAREEVMQVFGHNKPDLQGINQLKVMTMIIYEVLRLYPPVIQMNRATHKEIKLGDMTLPGGIQVHMPVLLIHRDTKLWGDDAAEFKPERFKDGIAKATKNQVCFLPFGWGPRICIGQNFALLEAKMALALILQRFSFELSPSYVHSPYRVFTIHPQCGAHLILHKL

SEQ ID NO: 52497 - protein, 505 aa, Arabidopsis thaliana
MEISVACVTVSVVVVVVSWWVWRTLQWVWFKPKMLESYLRRQGLAGTPYTPLIGDLKRNVNMLTEATSKPIKLTEDITPRVLPHPFQMLKTHGRTFFTWLGPKPTITIMDPELIKEVFNKVYDYPKAQTFLLGRLIATGIINYDGDKWAKHRRIINPAFHIEKIKNMVPAFHQSCSDVVGEWSKLVSDKGSSSCEVDVWPWLVSMTGDVISRTAFGSSYKEGQRIFELQAELVHLILQAFWKVYIPGYRMKAAAREIQVILKGIVNKRLRAREAGKAAPNDDLLGILLESNLGQAKGNGMSTEDVMEECKLFYFAGQETTSVLLVWAMVLLSHHQDWQARAREEVKQVFGDKEPDTECLSQLKVMTMILYEVLRLYPPVTHLTRAIDKEMKLGDLTLPAGVHISLPIMLVQRDPMLWGTDAAEFKPERFKDGLSKATKSQVSFFPFAWGPRICIGQNFAMLEAKMAMALILQTFTFELSPSYVHAPQTVVTIHPQFGAHLILRKL

SEQ ID NO: 52498 - protein, 175 aa, Oryza sativa
MAPTVMASSATSVAPFQGLKSTAGLPVSRRSTNSGFGNVSNGGRIKCMQVWPIEGIKKFETLWYLPPLTVEDLLKQIEYLLRSKWVPCLEFSKVGFVSRENHRSPGYYDGRYWTMWKLPMFGCTDATQVLKELEEAKKAYPDAFVRIIGFDNVRQVQLISFIAYKPPGCEESGGN

SEQ ID NO: 52499 - protein, 520 aa, Oryza sativa (japonica cultivar-group)
MAVRRRRPGPVAAAVLLLLAVATQAAASPIKTVVVVVMENRSFDHMLGWMKRLNPEIDGVTGGEWNPTNASDPSSGRVYFGEGAEYVDPDPGHSFQEIRQQIFGSDDASGPARMDGFVQQARSLGDNMTAAVMNGFSPDSVAVYRELVGEFAVFDRWFASVPSSTQPNRLFVHSATSGGATSNNPELLAKGYPQRTIFDNVHDAGLSFGVYYQDVPAVLFYRNLRKLKYLTKFHPFHGAFRDHAARGSLPNYAVVEQHYMDSKSHPANDDHPSHDVFQGQMLVKEVYETLRASPQWNQTLMVVTYDEHGGFYDHVPTPVTGVPSPDGIVGPPPYNFAFDRLGVRVPAIVISPWINKGTVVHGPNGSPTATSEYEHSSIPATVKKLFDLPQDFLTKRDAWAGTFESVVQGRTEPRTDCPEQLPMPMRIRLTEANEEAKLSEFQQELVQLASVLNGDHQLSSLQDTIRDRMNVREGIAYMRGAVKRFFETGMSAKRMGVDDEQIVKMRPSLTTRTSPAIEQP

SEQ ID NO: 52500 - protein, 240 aa, Medicago sativa
RGKIQIKRIENTTNRQVIFSKRRNGLLKKAKELAILCDAEVGVMIFSSTAKLYDFASTSLRSVIGRYNKSKEEHNQLGSTASEIKFGQREAAVLRQQLHNLQESHRQIMGEELSGLTVKELQGLENQLEISLRGVRMKKEQLFMDEIQELNRKGDIIHQENVELYRKVYGTKDKNGTNRVLSLTNGVGIGDDSNRTCESPAQPATETRTTTALMHSLEISVLTCKQGKWTQILISYMNGI

SEQ ID NO: 52501 - protein, 354 aa, Oryza sativa (indica cultivar-group)
MARRRRGFPATLLVTLLRLVGCLLLVCLAAPPCAAQQVKTSHAQFAFHLPLPDGVTGAESLAFDSSNHGPYTGVSHGRVLRWGGAAAGWTTFAHHQDYRKIPMCTTPVAPPEETESMCRRPLGLAFHDRTGDLYIADALHMRVGPRGGEAEVLAAGEDGVPFNFVNGIDVDQATGDVYFTDSSTTYPRRFNSEIMMNADATSRLLKYDAATKQVTVLRSGLPYANGVAVSRDGSHAVVAHTVPCQAFRYWIKGPNAGEYELLADLPGYPDNVRRDARGGYWVALNQEKVRLDATAAAAVAPPAKHLVGVRLDGDGVEVEELTTAKGVTLSEVVERGGKLWLGSVELDFIGLIMQ

SEQ ID NO: 52502 - protein, 288 aa, Rhodococcus sp. RHA1
MSAPRVAVVGSINMDLLTATERLPAPGETILGTAFAATPGGKGANQAIAAARAGGDVTFIGAVGSDVFALDLRQALVDAEVDTRYLREVDGPSGIAAITVDAAGENSIVVVPGANSTVADLTPTELAAVADADVLLCQLEIPLRTVLAAAAHATAHGTVVMLNPSPAQALPDELVKLVDVLLVNQTEAAQLGAEVTGAISHVVTTLGSSGADYAGSDGTTLHADSSEVEVVDTTGAGDAFAGALAVSWRRGPAIAVPFACTAGALATTRRGASTSSPTLAEIEAALPG

SEQ ID NO: 52503 - protein, 339 aa, Clostridium tetani E88
MNYIKFDEKKPLDVIPIGRVTIDFNPNEINRPLEESRTFTKYLGGSPGNIAVGLARLGKKVGFLSTVSDDQFGNFVVNYLKNEGIDISQINRAKNGEKLGLTFTEILSPKESSILMYRKGIADLQLSSKEVSEDYIKSAKAIVISGTALSKSPSREAAFVALEYAKKHNTRIIFDLDYREYTWNCKEEIAIYYSLAARMSDVIMGSREEFNLMEGLISPEESNDKETAERWIGYGNKIVVIKHGKDGSTAYLHDGTSYKIKPFPVKLLKSFGGGDAYASAFIYGIMEGWDVIDALEFGSASAAMLVASHSCSEAMPKVEEIKQFIKEKKEEHGEMVVRG

SEQ ID NO: 52504 - protein, 656 aa, Chromobacterium violaceum ATCC 12472
MSEMSRREFLKLSAAGMAAGALPPGLAAAMAIRPAGRSLSAVKHVVVFMQENRSFDHYFGALGGARGFGDRSALQLRNGSSVFRQPNLSNGEYPFRLDTTRTNAQYLTDLDHSWTGTHAAWNQGKYDGWIAAKSSLTMGYFTRADIPYHYALADAFTLCDHYFCSVQGPTNPNRLYLWSGMVDPAGKNGGPVTDNSEKGYSWTTYPERLQAAGVSWKVYQVLGDNYDDNALAWFNQYRSAKPGNPLCDRGMSSVPKVSGNSVQDLVAAIRNDAVNGTLPQVSWIVAPEAYSEHPSAPPAAGAYLLDRVLQALTANPDVWASTVLLLNYDENDGLFDHMPPPVPPAGTAAEFIGGKPIGLGPRVPMLVLSPWSRGGHVCSQVFDHTSVIRFLETWTGVQEPNISAWRRQICGDLSSALDFSSRNASVPAFPDTAALLTQAQQSKGWPAPTAPLPGQMPAPEGGRRPARALPYQCNAYGSTDLAGGIFWVHMQNSGSQAVHYAIYANQYRSDGPWQYDVTGGGEIKDYFHAQTYGGGLYDLTVYGPNGFLRRFAGNLRSAMGVLEAVSAVSVVAGVPQLTLQLNNQGAKVATFQVSGNGYGGAAPQQVVVTPGGSQLLSWNLSGVYGWYDFTVTCTGDGSFVRRLVGHVETGAASVTG

SEQ ID NO: 52505 - protein, 175 aa, Lactobacillus johnsonii NCC 533
MAIDFKEHIASVQDFPNKGIVFRDITPILQDGKLYRAATHELADYAKSRGAEVIVGPEARGFIVGCPVATELGVGFVPARKPHKLPREVESASYDLEYGSNVLEMHKDAIKPGQKVVICDDLMATAGTLHATKELIENLGGEVVGAAFYIELTDLKGREQFPDLDIYSLVKYSDA

SEQ ID NO: 52506 - protein, 131 aa, Coccidioides immitis RS
MTIPYSTRPLSSKGMEHLTHLRYRKQSRDNIIGITRPAIRYVRMLAASLSRTSSPFSPFIRLARRGGVKRIQKSIYDTAREVLLDRLRMIIRQIVEVLESGGSSSKTRKVVYVLQRIGSRIYGFGTTLKLK

SEQ ID NO: 52507 - protein, 320 aa, Zea mays
FYGGYAYHGNSFEQTYRCYPASFFDKPHLEGGDKVIMPPSALDRLASLHIEYPMLFELHNDATQRISHCGVLEFVAEEGMIIMPYWMMQNMLLQEGDTVHVKNATLPKGTYVKLQPHTTDFLDISNPKAILEKTLRNFSCLTTGDSIMVAYNNKQYYIDIVETKPASAVSIIETDCEVDFAPPLDYKEPEKLRQPTVLASKAPAEDGNTAAEDEPKFKPFTGFGKRLDGKASKLQASEVPSTALSAPSDSNKRANQQISAPAASGASSYSRQKTGKLVFGSSASNNKEPQKAPAKEEQPAKKDDEPRFQAFSGKSYSLKR

SEQ ID NO: 52508 - protein, 465 aa, Yarrowia lipolytica CLIB122
MISAIRPAVRSSVRVAPMANTAFRAYSTQDGLKERFAELIPENVEKIKKLRKEKGNTVIGEVILDQAYGGMRGIKGLVWEGSVLDPEEGIRFRGLTIPDLQKQLPHAPGGKEPLPEGLFWLLLTGEIPTDAQVKGLSADWASRAEIPKHVEELIDRCPPTLHPMAQLGIAVNALESESQFTKAYEKGVNKKEYWQYTYEDSMNLIAKLPVIASRIYRNLFKDGKIVGSIDNSLDYSANFASLLGFGDNKEFIELLRLYLTIHADHEGGNVSAHTTKLVGSALSSPFLSLSAGLNGLAGPLHGRANQEVLEWILEMKSKIGSDVTKEDIEKYLWDTLKAGRVVPGYGHAVLRKTDPRYTAQREFALEHMPDYDLFHLVSTIYEVAPKVLTEHGKTKNPWPNVDSHSGVLLQYYGLTEQSYYTVLFGVSRAIGVLPQLIMDRAYGAPIERPKSFSTEKYAELVGLKL

SEQ ID NO: 52509 - protein, 368 aa, Ralstonia eutropha JMP134
MKTKAAIAWKAGAPLTIEDVDLEGPRAGEVLVEIKATGICHTDYYTLSGADPEGIFPAILGHEGAGIVTDVGPGVTSLKPGDHVIPLYTPECRQCKFCLSRKTNLCQAIRATQGKGLMPDGTSRFSIDGKPIFHYMGTSTFANHIVVPEIALAKIRPDAPFDKVCYIGCGVTTGVGAVIFTAKVEAGANVVVFGLGGIGLNVIQGAKMVGADKIIGVDLNPEREAMARKFGMTHFINPKDVGNVVDHIIQLTDGGADYSFECIGNTQVMRQALECCHKGWGKSIIIGVAEAGAEISTRPFQLVTGREWKGSAFGGARGRTDVPKIVDWYMDGKLNIDDLITHTLPLDRINEGFELMRRGESIRSVVLY

SEQ ID NO: 52510 - protein, 128 aa, Brassica napus
DWKILHKIALDVARALAYLHEQCSPKVLHRDIKPSNILLDNNYNAYLSDFGLSKLLGASQSHVTTGVAGTFGYVAPEYAMTCRVSEKADVYSYGIVILELISDKRALDPSFSSHENGFNIVSWAHMML

SEQ ID NO: 52511 - protein, 433 aa, Zea mays
MARHFKYVILGGGVAAGYAAREFAKQGVNPGELAIISKEPVAPYERPALSKGYLFPQNAARLPGFHTCVGSGGERLLPEWYSEKGIELILSTEIVKADLASKTLTSAAAETFTYETLLIATGSSVIKLTDFGVQGAESNNILYLRDIADADKLVAAMQAKKGGKAVIVGGGYIGLELSAALKINNFDVTMVYPEPWCMPRLFTAGIAHFYEGYYANKGIKVVKGTVAVGFDADANGDVTTVKLKNGSVLEADIVIVGVGGRPLTRLFIGQAADEKGGLKTDAFFETSVAGVYAIGDVATFPLKLYNEQRRVEHVDHARKSAEQAVRAIKAKESGESVAEYDYLPYFYSRSFDLAWQFYGDNVGDDVLFGDNDPASAKPKFGSYWVKDGKVVGVFLEGGSAEENQAIARVARAQPPVADVQALKQEGIEFASKI

SEQ ID NO: 52512 - protein, 586 aa, Aquifex aeolicus VF5
MKWVNKGTVERVKQEFKDEVKYYETKHTKGFEVSHDFLKPLLKFLKERERFLHFVDMTCIDFPEHPNRFQGVYILYNPEENERVIVKSWAKDGKLPTVEDLWPGAKWAEREAYDMFGVVFEGHENLRRMFMWEGYEHYPLRKDFPLQGIPEVELPSLTEVLHGRTDPPSHDFELVHTKLPTLEDLERTEKARLKKKAELVLNWGPLHPGTHGTIWFLFDLEGEKVVQSDVILGQLHRGMEKLAENLHYFQFIPYTDRMDYISAICNELAYVETVERLLGVEVPEKARYIRTMFAELQRINSHLLWLGTGALDLGALTVFLYAFREREKIMDIIEGNAGYRLTSCFLRIGGVHYDLAEGTLDVVKHFIKDFPNRLKEYHTLLTRNRIWLRRTKDVGVITREDVHNYGLSGPVARGSGVPYDLRKLQPYAAYDEVEFDIPVGEVGDVYDRYLVRMEEMAQSVRIIEQCVQKLEKLPKDAPYLNKEHPAVIPPKEDVFHDLESMVKSFRVVVHGEDAPPGEVYFAGENPRGELGFFIYSKGGGKPYRTRIRSGALYNLSIFPKLIQGRTIADAIALLGSLDPVVGETDR

SEQ ID NO: 52513 - protein, 717 aa, Pseudomonas putida KT2440
MSPRTPKKTRSVAPSRIREGMPFPLGATWDGLGVNFALFSANATKVELCLFDSTGEQELERIELPEYTDEIYHGYLPDAHPGLVYGYRVYGPYEPENGHRFNPNKLLIDPYAKQLVGSLKWSEALFGYTIGHPDGDLSFDERDSAPFVPKCKVIDPAFTWGRDQRVQIPWERTIIYEAHARGISMRHPAVPEELRGTFAGLANDELLKHIKDLGVSSIELLPIHAFVNDQHLLDKGLNNYWGYNSIAFFAPHPRYLASGKIAEFKEMVAHLHDAGLEVILDVVYNHTAEGNERGPTLSMRGIDNASYYRLMPDDKRYYINDSGTGNTLDLSHPCVLQLVTDSLRYWAGEMHVDGFRFDLATILGRYHDGYSERHGFLVACRQDPMLSQVKLIAEPWDCGPGGYQVGNFAPGWAEWNDRFRDTARAFWKGDEGQLADFAARLTASGDMFNNRGRRPYSSVNFITAHDGFTLRDLVSYNHKHNEDNDENNQDGTDNNLSWNCGVEGPTDDPAINALRMRQMRNYFATLLLAQGTPMIVAGDEFSRTQHGNNNAYCQDSEIGWVNWDLDEEGQELLAFVKRLTRLRLAYPVLRRSRFLVGDYNEAIGVKDVTWLAPDGSEMSVEQWEDPHGRCLGMLIDGRAQVSGIARPGAEATVLLIVNAHHDIVPFKLPAVPEGDYWSCLVDTDRPELRKGQHLQFDSTFEVKGRSMLLMVLQYDEE

SEQ ID NO: 52514 - protein, 241 aa, Haemophilus influenzae R2846
MLKIQKLSIAALMVSAVISSQVFAEDNTFDEKAASYAVGTLMGSQMKDLVDSHKEVIKYDNVRILDGLKDALEGKVDVRKDEKIQKTLESIEAKLVAASKAKAEAIAKQAKEEGDKFRAEFAKGKDVKTTQSGLMYKIESAGKGDTIKSTDTVKVHYTGKLPNGKVFDSSVERGQPVEFQLDQVIKGWTEGLQLVKKGGKIQLVIAPELGYGEQGAGASIPPNSTLIFDVEVLDVNPKSEK

SEQ ID NO: 52515 - protein, 511 aa, Polygonum tinctorium
MAITSIAHLRVVNANMSIPLARLRVVNANISIPLKRTSFPKKFLFGAGSASYQYEGAAHIDGRGLSVWDVFTKEHPEKIADQSNGDVAQDFYHRYKEDIKSMKEMGLESFRFSISWSRILPNGKISGGINKLGIKFYNNLIDELLANGIKPLVTIYHWDLPQALQDEYGGFLSPKIVDDFLEYANLVFKEFGDRVKHWATLNEPNIMTQQGYVFGAHAPGRCSHFEWNCPAGNSGTEPYIVGHHLLLCHAAAFQLYKQKYKDDQKGIIGITTATQMAIPLNDNVANLLAASRAIDFNIGWFLHPVVYGEYPQTMRERLGSRLPKFTEKESEMLKQSFDFIGLNYYSTDYAAASSFSVDPVNVSYTTDSRATLSAIKDGVPIGDPTFMSWLHIYPEGILTLLRYVKERYNNPFVMITENGMADENKGSLAEDPMALKDNVRIRYHREHLYYVLEAIKEGVNVGGYYAWTWMDDFEWGSGYTPRFGLNFVDFDNDLKRTPKDSYFWFKDFLAN

SEQ ID NO: 52516 - protein, 388 aa, Lactobacillus johnsonii NCC 533
MAQRDYYDVLGVDKNASESEISKAYRKLAKKYHPDLNHEPGAEEKYKEVNEAYEVLHDKQKRAQYDQFGQAGVNGQGGFGGQGFGGFGGQGGYSSQGFGDFGDIFGDIFGSAFGGGRSRVDPTAPQKGQDLDYTMTIDFMDAIKGKKTDITYTRSEVCPTCDGSGAEKGTHPITCDKCHGSGVMTVTRQTPLGVIQQQTTCDKCGGRGTIIEHPCQTCHGQGTVDKKQTLQVTVPAGIDNGQQIRLSGQGEAGKNGGPYGDLYIVFRVKPSKEFRRNGTTIYTEAPISFAQAALGDKIRVNTVHGPVDLTIPAGTQPNTNFKLRGQGVPKINGTGNGDQEVTVKVVIPKKINDKQKEALVDYVKAGGGNISPQEKNFFERLKDKLNGE

SEQ ID NO: 52517 - protein, 415 aa, Zea mays
MAASNGEGHGRFDVIVVGAGIMGSCAAYAASSRGARVLLLERFDLLHHRGSSHGESRTIRATYPQAHYPPMVRLSRRLWDEAQADAGYTVLTPTPHLDLGPRDDSALVASMRNGGATEVVAGDESSSWPWAGVFRVPDGWTAARSELGGVMKATKAVAMFQALAVKRGAVLRDRTEVVDITSSKRGEGEGSIISVRTSSGEEFHGTKCIVTVGAWTSKLIKSVTGLELPVQPVHTLICYWKVRPGREQELTPEAGFPTFASYGDPYIYSTPSMEFPGLIKIAMHGGPPCDPDGRDWSTGAGDLVEPVARWIDAVMPGHVDTAGGPVVRQCCMYSVTPDDDYVVDFLGGEFGKDVVIGAGFSGHGFKMGPAVGRILAEMALDGEASTAAEAGVDLRPLTIGRFAGNPKGNLSASQG

SEQ ID NO: 52518 - protein, 329 aa, Thermosynechococcus elongatus BP-1
MAMTVVLGADVGGTKTLVELWEVGGRDWQLLYRAKYPSRDFPNLTALLQMFLKESPAHPQRACLGIPGPVIDQVAQVTNLGWRVSAAELETALQIPGVTLLNDFAAVAYGALVLPPTDFVVLQERPRRPQAPIALLGAGTGLGEALLIWQGDRYQVMPLEGGHTDFPPRNEEEVGLLRYLWQTYERVSVERVVSGPGLVAIYDYLKSVHFAAESAGVAAAMARGEDPAAVVSQYGLAGDPLCAEALRMFVEAYGAEAGNLALKSLPLGGVLIAGGIAPKILAKMADGTFLQGFVNKGRFRPLMEQLYVAVIINPEVGLRGAVHLAAQGV

SEQ ID NO: 52519 - protein, 336 aa, Oryza sativa (japonica cultivar-group)
MDEKVKMESKLSSAAAFVEGGVQDACDDACSICLEAFCDNDPSTVTSCKHEYHLQCILEWCQRSSQCPMCWQPISMKDPMSQELLEAVEQERNIRANRLNTAAVFHHPVLGDFEVPVGADDAELEERIIQHLAAAAAMRRSHRHGRRDGHRSRSGSHSRPQIVVFSRNEAIPGGSLHASSGQDEDHEQSSDLGSAHPFAALAAVDQGHMSGGSQLYVGHSDQGASNPSLHDERAMSRYKDSITKSTRGWKERWFSRSNTISGLGTEVRREVNAGIAAVSRMMERLETKDDTGPSAVPAASACSPSDANNQRTVSPNHAAVVNETSSTTCASGSGSQ

SEQ ID NO: 52520 - protein, 139 aa, Rhodococcus sp. RHA1
MTERTLVLIKPDAVARGYVGEILGRIERKGLTISALDLRTAPGDIAAAHYAEHEGRPFYPGLLEFITGGPLVAAVLEGPRAIAAFRQLAGGTDPVEKAVPGTIRGDFGLEAQENLVHGSDSVESAEREIALWFPHLAAN

SEQ ID NO: 52521 - protein, 433 aa, Geobacter sulfurreducens PCA
MRFDPQQLRIDGVYAQRQPGTFMLRIKVPAGILSAEQAEAVADIADRFAGGLLHLTTRGSIELHGLTEDHLSSVWRGLAAVGLTSRGACGGAVRGVVCGSVTAAAWPLVQSLAHKLHLHFTRNPHFEALPKKFKIGVFTGDNEGRHLIQDLSLVHRENEADAPRYDVWAAGGLGREPSPAFLVEEAVAEDRIIPLVEAIVRVYKERAPKGKRLKHLVRDLGREDFLALVAERRGDQPLPLADSFSGELFPSVAAGGVCVEAPVFAGELTTGGLRSLAAVARDVAGGFMVLTGDQNVRFLLPESVRRQDALDAVAAAGFAADRPEQRVAFRICPGSHECAMGLAPTRDVARAVIGAMGDDAAALRWSISGCPNSCSQPQLARVGIVTAKSVKGEDGQRRPLFDLYRREDDGSLGVVVGSGLELEELVAAVRLER

SEQ ID NO: 52522 - protein, 472 aa, Zea mays
MVASKAAPFDEVSSVEAGAYGGRDDDGRPRRTGTFWTASAHIITAVIGSGVLSLAWAIAQLGWVAGPAAMLLFAFVTYYTATLLAECYRTGDPDTGKRNYTYMDAVRSNLGGAKVAFCGAIQYANLVGVAIGYTIASSISMQAVSRAGCFHKRGHAVPCKSSSNPYMILFGAVQILFSQIPDFDQIWWLSIVAAVMSFTYSAIGLSLGIAQTVANGGFKGSLTGISIGADVTSTQKVWHSLQAFGDIAFAYSFSNILIEIQDTIKAPPPSESKVMQKATRLSVATTTIFYMLCGCMGYAAFGDKAPDNLLTGFGFFEPFWLIDVANVAIVVHLVGAYQVFCQPIFAFVERRAAAAWPDSAFVARELRVGPLALSVFRLTWRSAFVCATTVVAMLLPFFGNVVGFLGAVSFWPLTVYFPVEMYIKQRRVPRGSTKWVCLQTLSVACLVVSIAAAAGSIADVIEALKVYHPFSS

SEQ ID NO: 52523 - protein, 350 aa, Zea mays
LPHWHAWSSWSQGACHCGKLLGWAQHLAAPGRVSHALSEDALAHALMDNKFPTETLKDYEEWTIDLGKLHLGMPFAQGAFGKLYRGTYNGMDVAIKLLERPEADPEKAQLLEQQFVQEVMMLATLRHPNIVKFIGACRKPLVWCIVTEYAKGGSLKNFLSKRQNRSVPLKLAVKQALDVARGMAYVHGLGFIHRDLKSDNLLISGDKSIKIADFGVARIEVKTEGMTPETGTYRWMAPEMIQHRPYNQKVDVYSFAIVLWELVTGNVPFANMSAVQAAFAVVNKGVRPAIPHDCLPALAEIMTMCWDTNPEVRPPFAEIVRMLEQVEVEVLTTVRKARFRCCIAQPMTLD

SEQ ID NO: 52524 - protein, 452 aa, Nostoc punctiforme PCC 73102
MAFDYNLFVIGAGPGGLAAAKKAASYGVRVAIAEQESIGGTCVNRGCIPKKLIVYAADFALQKQIAPSYGWSECQTYFDWTLFIKSVHQHLDTLNQSYFQQLHKAGIELISDRATFIDAHTVDINGLKVTADKILIAVGGQPLKPKIPGIEYAITSREMFQLPYLPKRLAIIGGGYIGVEFSSMMHAFGCQVTVIEKDEMILSGFDDEIRSAVEQGLRKRGIKLLTSSTVQEIKYSDESLLLTITGKKREIITADTILVATGYAPNTKNLGLENAHVELGEHGAIKVDEYSRTTQENIFAVGDCTSRVQLSPVAKAEGIAFANTVFGNKVQKLDYDYVPSAVFCRPEAAGVGMTEAKAREKFGESVQCYYTQFQPLLYQLTDQNEPTTMKLVLNGDSGQVLGAHLVGEHAADIIQSLGVAIRKGITKEDLDEIIGIHPTVGEEFFSLDRVQE

SEQ ID NO: 52525 - protein, 396 aa, Zea mays
MASVTDETAKIEGLTSAAAFVEGGIQDACDDACSICLEAFCESDPSALTGCKHEFHLQCILEWCQRSSQCPMCWQPITMKDPTSQELLEAVERERNIRTNQTRNTTIFHHPALGDFELQHLPVGNDAELEERILQHLAAAAAMGRAHHLGRREGHRGRSGSHGRPHFLVFSTQPNSPSAGTISSSSAHMEGENDSNPATPRASESSPRAIRIGEVGNQSPGMLTYDAEQDAVVSSGNSTPVSSPRFFNRRHSTGQSTPDRAGPSDIQSFSDSLKSRLNAVSMKYKESITKSTRGWKERLFSRNSSVADLGSEVRREVNAGIASVSRMMERLETRGNSRTSDSPAASTSEVPPATESSNERVTESNSAAAAGGGGTTTTGTSASNASAPCVATSGSN

SEQ ID NO: 52526 - protein, 951 aa, Vibrio vulnificus CMCP6
MKLIKRSDSVTKEQKQLGISRRVFMRNSSLAAGGAIAGASLFAPGMIRKAEAKSVDASAPIEVKRTICSHCSVGCGIYAEVQNGVWTGQEPAFDHPFNAGGHCAKGAALREHGHGERRLKYPMKLENGKWKKLSWDQAIEEIGNKVLEIREQSGPDSVYWLGSAKHNNEQAYTFRKMASMWGTNNVDHQARICHSTTVAGVANTWGYGAMTNSFNDMHNCKSMLFIGSNPAEAHPVAMQHILIAKEKNSCKIVVADPRRTRTAAKADHYVSLRPGTDVAFIWGVLWHVFNNKWEDKEFIRQRVFGMDEIRAEVAKWNPKEVERVTGVSEEDVYQTAKLLSEHRPGCIVWCMGGTQHTTGNNNTRAYCVLELALGNLGKSGGGANIFRGHDNVQGATDLGVLSHTLPGYYGLAEGSWKHWAKVWGIDFDWLKNRFDQNKYNGKQPMFNMGIPVSRWIDGVLENKDSIEQNDNIRAMFYWGHAVNSQTRGVEMKKAMEKLDMMVIVDPYPTVAAVMNDRTDGVYLLPATTQFETHGSVTASNRSIQWRDQVIEPLFESKPDHEIMYLLTKKLGFADQLFKNVRVVNNQPVIEDITREFNKGMWTIGYTGQSPERLKAHQQNWHTFHKTTLEAEGGPANGETYGLPWPCWGTPEMKHPGTHILYDTSKPVAQGGGTFRTRFGVEFEGKSLLADGSYSKDSDIQDGYPEFSDKLLKQLGWWDDLTAEEKVLAEGKNWKTDLSGGIQRVAIKHGCIPFGNGKARTIVWEFPDRVPLHREPLYTPRRDLIADYPTWDDAASIYRLPTLYKSIQDQDKSQEYPIILTSGRLVEYEGGGEETRSNPWLAELQQEMFVEVNPKDANDLGFKDGDMVWVEGAEKGRIHVKAMVTRRVRPGMAFIPFHFGGKFQGEDLRNKYPEGTDPYVIGESANIATTYGYDPVTQMQETKVTLCNIRKA

SEQ ID NO: 52527 - protein, 1143 aa, Oryza sativa (japonica cultivar-group)
MGPDGTVEHLGCGQGVVIGAARQGEDQVGFLQELRSMPTTESMTVRTVRRKLRSAMAWGISEKASGLRSLSWTGWLRSPTTASSSACRPRREDVLVHEIAGELRRLGDHAPHLLHVVVVAGPPPAHHHARDDVAGDTHQRGVDVDVLGVGGTPAERADEARHLLAADMAEPEEERMEPPPPPPYIHIETNDFLHRRHKRQKEEDIAVCECQYNLLDPDSACGDRCLNVLTSTECTPGYCLCGVYCKNQRFQKSQYAATRLVKTEGRGWGLLADENIMVTEFTLILWSANVVKYIQAGQFVMEYCGEVISWKEAKRRSQAYENQGLTDAYIIYLNADESIDATKKGSLARFINHSCQPNCETRKWNVLGEVRVGIFAKQDIPIGTELSYDYNFEWFGGAMVRCLCGAGSCSGFLGAKSRGFQEATYLWEDDDDRFSVENVPLYDSADDEPTSIPKDILIKDEPNTQDGNNNTIQNTGIPIIASSSEFTPMNVEPSIASSNEFTPMNVEPLNVSSNELTPMTIEPLNAIPMGVDFTQNGSIEYGAQCAEDALQNSTRGVANLQNQSAPRDNNHTELVAVKRRPTLRGGKAKRGMRKQLNVVGICDRLASEVAREEILYCEEMKNEAAAEIDSLYDEIRPAIEEHERDSQDSVATSLAEKWIEASCCKYKADFDLFPLFRISRVMGKSEHGNLLVSLSDGLPHYSLAAAVGLAIGVAGLCKALHSSLVIPPVSQKKLLSNSDRLYYTGGLKNLGNNCFLNVILQALASCDGFVSSLDNLLGSEDVLPEEKSEKMPLIFALSSLIKVENKVLVPVTLVVSGITEQWWSGGIVTYCNTVNTLSLDFENFYCLPLSPVATINGDIINGCSLVDCLEHFTALEHLDNYRCDHCWHNVAAKYLSLKSEVDEEKINKLHTCVDYGTCSCRHIFTPEEMTCSISSQATKQLAITHFPKILCIHLLRASVGLDGEFVKRGGHISFPLLLDLSPFAGGALIPGQGPKPSAMNKQRHGQQTLHLWRQLNAEMPVNMFPAATDGDSSSHHCGDESINTLGRSFYVGNRDADSRFLSSSSLTDKLYGLSSVVEHYGVCGGGHYAAYRRVTPNSDSNEPVQSLASFRKEWLYVSDDHVSHVSECEVLAAEATLLFYERL

SEQ ID NO: 52528 - protein, 1070 aa, Francisella tularensis subsp. tularensis SCHU S4
MQATNQNIWIQDKFGNFTHLNATHQVYLDFETNSIRFRIQADGFLHGYVIANFNNWQKLEEYKLTWTTDNDDGSLWLTKDVFNISTLNAGTNQYSFILVSLAGEEFKVSINDHDLIPLSFNWQVAKGTLEIKASENYVVSGFNLELIAITKSITGYQNIVDVEWQVSPQNSKITLTNGKLLIDPSVSNLTEVKVSCFAKNNPDLKAERIFTVIKEKRKGSLVHLIKKDQQYKGENFDWDLWNFNKNKPAYSVSLSHRSDFGLYGLCQKKNVIARKRIWDINWHNDWAEQTSCFKISKKHQNYYIVHGDATIYRSLEDVINKTNPRIIHAVMNEASQIIAYLSDIPRIGTSFELWVNSKKVENVGLIVKHRSKQLIFTGLPPINPHDLVEIRANNTFSAAKVLMGEYLNNFYYPNNIGVSFSDELISLRIWSPTAIKVEVLIYNEDLDNNKKQPDVVHELTAERSYGTHHIEICRKNYENKYYIYRLYFEDLDNKGQRCIKTTYAVDPYAYGVGLNGRKGFLVDLNNPKVTPEQWQQSHNPNCLNREDAIIYEAHLRDFTISPESGVSEELRGKYLGAVENNTYYIDSATNQKVSTGIDSLVELGVTHIHLLPIFDFSSVDEEKNNEKDNRNWGYDPQNYNAPDGSYSINPYDPLQRIRGARNMILGFHQKGIGVIMDMVYNHMTETSNLDKIIPKYYFRTDALGNFTNGSGCGNELASEKPMVSKFIQDSVIHWVKNYKIDGIRFDLMELIDINTIKNIVSKVKQINPNVIIYGEPWKGGDSPLINGTHRGTQRNQQFSIFNDYFRDAIRGNNNPGNGFINGDPHNPSNIGNVIEGLRGSIYSLTAMPGESVNYIDAHDNYTLWDQVEKSQSHDIPQGYYRKNLPENIFEHRFVRQNALALGIILTAQGIPFIHGGSEFLRTKQGDHNSYKSGDNINAFHWSDKLRYKAFFDYIAGLIRIRKEHPAFRMRDRETIEKHLNMTTAHHDSKSGVIISHFKNNANGDSWQDIIVIYNATSIDGYDVNALMPIPAGKIWHIVANHEKAGVDTIQTVNSSELPGLKSYSLMIIHS

SEQ ID NO: 52529 - protein, 272 aa, Magnaporthe grisea 70-15
MGHEDAVYLAKLAEQAERYEEMVENMKIVASEDRDLTVEERNLLSVAYKNVIGARRASWRIVTSIEQKEESKGNSSQVGLIKEYRTKIEAELAKICEDILSVLDKHLIPSAKSGESKVFYHKMKGDYHRYLAEFAIGDKRKDSADKSLEAYKAATEVAQTELPPTHPIRLGLALNFSVFYYEILNAPDQACHLAKQAFDDAIAELDTLSEESYKDSTLIMQLLRDNLTLWTSSEAEPTASTGHAEAPAAAAATEEKPAEAAAAAEEAPKPAE

SEQ ID NO: 52530 - protein, 544 aa, Francisella tularensis subsp. tularensis SCHU S4
MAIQTVSTKPFANQKPGTSGLRNKVIAFQQPRYLENFVQSIFNSLDDIEGKTLVVGGDGRYYNDVAIQIIVRMAAANGFAKIIVGQNGIFSTPAVSCVIRKYEAFGGIVLSASHNPGGPKGDFGIKYNVSNGGPAPEKITDRIFSETKKINQYFISDAAKESVDLDKLGTYKIENTTVEVINSVIDYAELMQQIFDFDKVRELFAKGFKVRFDSMCAVSGPYAKYIFETLLKAPAGTVVNAQPLEDFGGFHPDPNPVNAEDLVKHMRSGKYDFGAASDGDADRNMIVGKQIDVSPSDSLAIMAANAHLIPVYSKGIKGVARSMPTSTAVDRVAESLRLPCFETPTGWKFFGNLLDAEKITLCGEESYGTGSNHIREKDGVWAVLFWLNLVAVTGKQVDQLVEEHWQKFGRNFYSRHDYEAIDTAIANSIIDSLRERLSSLVGAQLNDEKVAKADDFSYIDPIDGLVSNHQGIRIIFEDGSRIVFRLSGTGTQGATLRIYLEKYESDSSKFSIPTQQALASLIEIAEDLTNIKSLTGMTEPTVVT

SEQ ID NO: 52531 - protein, 201 aa, Aquifex aeolicus VF5
MGVKKLSRKDYLNILESILFIDFLKGLSVTLKNLLRRPITTEYPKEKLTPPKRFRGAHGHYVWDGTEPDSLKAIEKFMSYEKAKSRCVACYMCQTACPMPTLFRIEAVQLPNGKKKVVRFDMNLLNCLFCGLCVDACPVGCLTMTDIFELANYSRRNEVLRMEDLEKFAIDFKQRRGNEPDRIWPNDEEREKLWGKIEWSG

SEQ ID NO: 52532 - protein, 721 aa, Pyrobaculum aerophilum
MNMISYALLGVILGISGVIYAVYLAVWVLRQDPGNEKMRFISQAIATGARAYLFRQYRTLAVLLVILAVLILVAIDMPRRTFGLTALAFIVGALGSMLAGYLGMYVTTRSASRVAQAAATGGMGKALLVSWRAGAVMGLSLASIALLLISGFYLVFRSVLPDDWAVPLVALGFGASLVTLFMRVGGGIYTKAADLGADLVGKVEAGIPEDDPRNPGVIADNVGDNVGDVAGMAADVYESYIVTVTAAIFLAAILGLPTQFIEAIILFAALALVATFAGVNLLKTTGVKHPLSSISLAIYATIGLTVVLFFIGAFTLGLDSTKALALAATTSLGAVIAPLIVKITDYYTSYNYGPVRKIAEQAKISPATVIITGYGVGLMSAIPVIAVIVAVLGISYMIGYYTVPVSGFGELSKYLAGIFGTAMASVGLLVVAGIIITADSYGPVSDNAGGVVEMAGLPDEVREITDVLDSVGNTTKATTKGYAIASAALAALVLFIALIFEIVYSASKILGKGIVDMISESLSGLQLINANVLIGAFLGVALVYFFSSRTLEPVGRTAMEIVEEIRRQFREKPGILEWKEQPDYARVVDIATRRALGEFLIPGLAAIVLPLITGLLLGWNALAGLIMGAIVAGVPRALLMANAGGAWDNAKKYIEIQGLKKTEMHKAAVIGDTVGDPMKDTVGPSLNPLIKVLNTLSVVFTYVIVSTNIALGIWPSGLLPF

SEQ ID NO: 52533 - protein, 377 aa, Listeria monocytogenes EGD-e
MAKRDYYEVLGISKSASADEIKKAYRKLSKQYHPDINKEAGADEKFKEISEAYEALSDPQKRAQYDQYGHVDPNQGFGGGGAGGGFGGGGFSGFEDIFDTFFGGGGRQQDPNAPRQGSDLQYTMRLKFKEAIFGKDAEIEIPREENCDTCHGSGAKPGTTPEKCSHCGGKGSINVEQNTPFGRVVNKRTCQYCNGTGKEIKEKCPTCHGKGRVTKTKKIKVKVPAGVNDGQQMRVSGEGEAGINGGPNGDLYVVFVVIPDEFFEREADDIYVEVPITFVQATLGDEIDVPTVHGKVRLKIPSGTQTGTTFRLRGKGVPHLRGNGTGDQHVIVKVIVPKKLDDKQKEILREFASTTGDKVDEQTSGFFDKMKRAFKGD

SEQ ID NO: 52534 - protein, 376 aa, Oryza sativa (japonica cultivar-group)
MWRPLRPASTAARDLDQDAHRPEWDLDQSGIGSMRHRVVPPIGVDGWKAQGLFIGEQVTDEEVCTDGTQSVYFTDLLVNDVDESQFAAPTSDPISNGAPTAAKISQGRTKNFTTQEDILLVSAWLNVGMDPIQGVDQSQGTYWARIHEYFHANKEFESTRSESSLLNRWSAIQHDVNIFCGCMSRIEARNQSGSRVDDKIANACELFKEEDKKHRKFNLMHCWNILKDKPKWMDNRKKVGCAKKPSNKKQKTVANSSPTSVEPADLDVYCSDAQPSVRPDGKKAAKQKLRQGRTIEAVDYLMEKKKEADVVRELKKEEMCKKAFALQEERCKRAFALQEERNKLEREKFEFQKKEAEKAEKVEEERILGLDLSTMN

SEQ ID NO: 52535 - protein, 1163 aa, Thermosynechococcus elongatus BP-1
MDAAATYQVGGSLPTTSAVYVRRQADADLLAALTAGEFCYILNSRQMGKSSLRVQVTQQLMTRGCRCTAIDITKIGSQNIQPEQWYASFVGALIQGFQLTDVVSLRAWWRDRQLVSPIQRLSDFVETVLLAYTREPLVIFIDEIDSLLSLPFATDDFFAWIRACYNQRADCPEYRRLTFALFGVATPDQLIQDKQRTPFNIGCAIDLQGFTLAEATPLLKGIAHLSDNPDQLLAEILKWTGGQPFLTQKLCRLLQQHGSFMPAAMLSQRLAQFVQEHILQDWERQDEPEHLKTIRNRLLADEQRIGRLLGLYQRILEGGGVPLDGSTEQRALALTGLVCQRQGKLQVFNPIYAQVFDAQWVEQQLAQLRPYSEDFQAWLRSGGRDSSRLLRGQALEEALVWASGKSLSDLDYQYLSASQEANQKAIQDTLLLERQEKEAISAANRILEAARHKANRLTQRAFMALGIVSVISLGVAAILAKTYADLQASQESLVLEQTSNDLLEQFQRQELSALLAGIQAGRDLKRLVGDRPLSQYPTTRPLFVLNFFLDHIQARNQWQSKHTPLMAAFLTADGQQLSISASGLVEFWRVNGERLKAQSLEMGNVKLARISPRGDRLGLLNDKGEISLWRIEPQKLVLERRLPALPINNFRFSPKGQELTATTTTGNILRWSLGGELLATIATPSQSINSLSYAIHGDRLATADEEGWIRVWSRQGKLLQAWQVQGDLPVPQTSLTYLSNGQLATVGKDGTLRLWNTKGQQINQWCVSAAPVYFVGTSPVGYRLLTLSTDNTLRLWQPTGELIAELGGHERLINTVSFNPTGSVLLSSDRGGQMTLWYLDHYRTEYWLANQESIWTVALDPQAATLVTGGKDGRVKHWRRDGTLLATTPVLDPQGINQVLFSPRGQRVAIATEGGKLVIWNLADQSQRTWQLPIKVPLYTLSMDSQGRYLAAGDEKGTIYLIDLQRPEKIQQRKSEGEVWSLSFHPALPLLASTGSVGTIEVWNFESDRLAYRLNPGAGWLASLEFSANGQFLAAAGESGSVYLWSIHGKNPPPYPRVFRAHQRSIVSLGLSPDGEMIATASSDRSVRVWNQRGQLIMLLDRISAIPYSIDVSGHDQLYVAIGTEDDEVWISPLASLGQLLTSACDWLKDYRHQNPAVVQACP

SEQ ID NO: 52536 - protein, 171 aa, Oryza sativa (japonica cultivar-group)
MSPGEEDVEASSDSGGSATRRCAACKFLRRRCSRDCVLAPHFPASDPHRYACVQRVFGAGNTARMLQQLPVQERGRAADSMAAEAYRRVQDPVYGCAGVINRLQDQIRAAQCELAWTHAQIAMHSAAAAHARTTLPPGQRDGGGGGAPSTQQATTSAAWQLEDFASEFSFP

SEQ ID NO: 52537 - protein, 126 aa, Chromobacterium violaceum ATCC 12472
MAKEIIHTDKAPAAIGAYSQAVKAGNTVYLSGQIPLDPATMTVVEGGFAAETHQVFKNMKAVCEAAGGSLDQIVKLNAYLTDLSNFATFNEIMGQYFSQPFPARAAVGVASLPKGVLVEAEAVLVL

SEQ ID NO: 52538 - protein, 257 aa, Salmonella enterica subsp. enterica serovar Paratyphi A str.
MSVPLILTLLAGAATFIGAFLGVLGQKPSNRMLAFSLGFAAGIMLLISLMEMLPAALDTEGMSPVLGYGMFIIGLLGYFGLDRLLPHAHPQDLVQKRQQPLPGSIKRTAILLTLGISLHNFPEGIATFVTASSNLELGFGIALAVALHNIPEGLAVAGPVYAATGSKRTAIFWAGISGMAEILGGVLAWLILGSLVSPIVMAAIMAAVAGIMVALSVDELMPLAKEIDPNNNPSYGVLCGMSIMGLSLVILQTIGIG

SEQ ID NO: 52539 - protein, 519 aa, Oryza sativa (indica cultivar-group)
MAGGAMVQTVGGKTYPGKMTAFVFFTCLVASSGGLIFGYDIGISGGVTSMDSFLSEFFPSVYAQAKASKDTNQYCKFDSQLLTLFTSSLYLAALATSFVAAWVTRVFGRKWSMFCGGVTFLAGSALNGAATDVMMLILGRILLGIGVGFANQSVPLYLSEMAPANLRGMLNIGFQLMTTIGILSANLINYATSSIEGGWGWRIGLGLAGVPALIITLGALVLPDTPNSLIARGYAGDAKRVLVKIRGTDDVHDEYDDMVAASEEAASIEHPWRNILHRKYRPQLTIAILIPCFQQLTGINVIMFYAPVLFLTIGFAGDASLMSAVITGLVNMFATVVSIISVDRLGRRVLFLQGGTQMFISQVVVGTLIALQFGVAGVGEMSRSYAILLVLFICMYVAGFAWSWGPLGWLVPSEVFALEIRSAGQSIAVCVNMMLTFVIGQAFLTMLCHLKFGLFYFFAGWMLVMTTFVALFLPETKGVPIEEMNHVWSRHWFWGSYVTAHDVAAAGAGGGGNRRSHNV

SEQ ID NO: 52540 - protein, 51 aa, Phaseolus vulgaris
MKQFRVLTCQTVADMIKGKTPEEIRKTFNIKNDFTPEEEEEVRRENQWAFE

SEQ ID NO: 52541 - protein, 171 aa, Murraya paniculata
HNLLFILGFNAFGGFSIFLPRLIDAIASDKTGLQAKLRSEVKEKCGTSSLTFESVKSLELVQSVVYETLRLNPPVPLQYARARKDFQLSSHDSVYDIKKGELLCGYQPLVMRDSKVFDDPESFKGERFMGEKGSELLNYLYWSNGPQTGTPNDMNKQCAGKDYVTLVACLT

SEQ ID NO: 52542 - protein, 258 aa, Prochlorococcus marinus str. MIT 9303
MTSRSLLVFDFDGVIVDGMGEYWWSARHACMQLVGLDFGPDPLPDAVPEAFRLLRPWIHQGWEMVLLAAELLRSDGPLLRHGAKAFSADYHLRCQQALEAWGWQPGQLQEALEQVRRSALEADRSNWLARHRPFPGVIERLRGLHDEGFDLVVLTTKGAEFTAELLKCFQLAPHGLYGHESGRKPEVLLRLAAERPLRGFVEDRRATLETVLATPGLSSLPCYLASWGYLKPEDCRTLPMGIRLLEPEALAAPLASWP

SEQ ID NO: 52543 - protein, 545 aa, Prochlorococcus marinus str. MIT 9303
MKPKRITDDLDRLLDLLPLAVQQALATPNSREQLLEVVLDLGRVPEARYPGRALALGEQCLTRDDLQTTVDRLGQFGADNRAGIERTLHRISAIRNRQREVVGLTCRVGRAVFGTVAMVRDLLDSGQSLLLMGRPGVGKTTALREIARVLADDLQRRVVVIDTSNEIAGDGDIPHPAIGRARRMQVSLPEQQHQVMIEAVENHMPEVIVIDEIGTELEAQAARTIAERGVQLVATAHGNALPNLIKNPTLSDLVGGIQAVTLGDEEARRRRTQKTVLERAAEPTFPVAVEINTRNRWSIHADVAATVDQLLRGQLPRPQLRELDSDGSVRLVDAQPSRSSSPRPALAAVPLPDPKAPSPRAAPPAQDPAEAISAERSDQRALQVLCCGITPQLVDEAIRRHGWPVRWVDDLNEADVVLSIRKGLGHQPTLRRQARESRVPVLVIKSDTLPQVERALERLLARRAGPQDQLSHSESQDGDQEDALAALEECRLAVEKVVLPYGRPVELLPRSEQVRQMQVDLVTRYRLSSDVFGQAEQQRLRVYPP

SEQ ID NO: 52544 - protein, 175 aa, Triticum aestivum
MAPTVMASSDTSVAPFQGLKSTAGLPVSRRSNGASLGSVRNGGRIRCMQVWPIEGIKKFETLSYLPPVSTEALLKQVDYLIRSKWVPCLEFSKVGFIFREHNASPGYYDGRYWTMWKLTMFGCTDATQVINDVEEVKKEYPDAYVRIIGFDNMRQVQSVSFIAFKPPGCEEYGKA

SEQ ID NO: 52545 - protein, 106 aa, Glycine max
MGRKKGYAEFEESPPDDFDPANPYKDPVAMLEMREHIVREKWIQIEKAKIIREKLRWCYRIEGVNHLQKCRHLVNQYLESTRGIGWGKDGRHPSLHAPKVDPVESE

SEQ ID NO: 52546 - protein, 289 aa, Francisella tularensis subsp. tularensis SCHU S4
MIANINNKKIFHETLYHSYHQSIAISEILYEHKTDYQHLVIFNNPIFGNVMVLDGIVQTTEKDEFIYHEMLVHVPVIAHGNVKNILIIGGGDGGMLREALSHKAVESVTLVEIDQAVIDMCQEYFPGHSKGAFDHPKAKIVIQDGCEFVKNPPRKYDLIICDSTDPIGPGEVLFTSKFYKDCKEAINPGGIMVTQNGVIYFQIDELKKTLERFEPLYKDVSFYTAAVPTYVGGSMAFGWGTDELSYRNHDIQVIAQRFLKSGIKTKYYNPAIHIAAFALPQYVIDTLKK

SEQ ID NO: 52547 - protein, 367 aa, Corynebacterium glutamicum ATCC 13032
MTSLEFTVTRTENPTSPDRLKEILAAPKFGKFFTDHMVTIDWNESEGWHNAQLVPYAPIPMDPATTVFHYGQAIFEGIKAYRHSDETIKTFRPDENAERMQRSAARMAMPQLPTEDFIKALELLVDADQDWVPEYGGEASLYLRPFMISTEIGLGVSPADAYKFLVIASPVGAYFTGGIKPVSVWLSEDYVRAAPGGTGDAKFAGNYAASLLAQSQAAEKGCDQVVWLDAIEHKYIEEMGGMNLGFIYRNGDQVKLVTPELSGSLLPGITRKSLLQVARDLGYEVEERKITTTEWEEDAKSGAMTEAFACGTAAVITPVGTVKSAHGTFEVNNNEVGEITMKLRETLTGIQQGNVEDQNGWLYPLVG

SEQ ID NO: 52548 - protein, 168 aa, Ehrlichia ruminantium str. Welgevonden
MINKRSLLASFINLPYSLFITFKGMYITLRYMFKPKVTLNYPLEKNPLSTRFRGEHALRTYKNGEERCIACKLCEAICPAQAITIEAQERDTDNSRRTVRYDIDMTKCIYCGFCQEACPVDAIVEGPNFEYATETREELMYNKSKLLHNGQIWEEAIDLRIKKNSKFY

SEQ ID NO: 52549 - protein, 109 aa, Glycine max
MPNDSVLRLGLVGTLSTCLLSATSHHDHIFLPSQLHDHDSPRCTATDPSLNYKPVIGILTHPGDCACGRLSNATRVSYIDDYYEKFVESGGARAIPLIYNEPPENLNKK

SEQ ID NO: 52550 - protein, 171 aa, Methylococcus capsulatus str. Bath
MDKLRAKIRDIPDFPKPGILFRDITPLVKDPAALRLAIHQLVHPFVGEDITAVAGMEARGFIFGALAAWELGVGFVPLRKPGKLPYNVQSIDYDLEYGSARLEVHLDALGVGDRVLMVDDLLATGGTARASCSLVESLGAEVAACAFVIELDALEGREALHGRRVHSLLHY

SEQ ID NO: 52551 - protein, 311 aa, Ralstonia eutropha JMP134
MSIDILAYGEPLVEFNQQPDDPTRYLQGFGGDTSNFCIAAARQSATTGYISAVGADSFGERLMALWTRERVDTRHVRVDPVAPTGVYFVSHDNHGHRFDYLREGSAASRYQHEHLPLGAIAQASFLHLSGISLAISTSACDAGLAAMEHARKAGTKVSLDTNLRLRLWSLARARGIMREAFSLTDVCLPSWDDITVLTGLDDRDAIVDYLLGCGIGLVALKLGEEGAYVATPESRTLVQPFAVKPVDATGAGDCFGGSFIARLAAGADPFEAARYANVAAALSTTGYGAVAPIPSAETVLARLAQSVSVIA

SEQ ID NO: 52552 - protein, 675 aa, Corynebacterium glutamicum ATCC 13032
MAFSVEMPELGESVTEGTITQWLKSVGDTVEVDEPLLEVSTDKVDTEIPSPVAGVILEIKAEEDDTVDVGGVIAIIGDADETPANEAPADEAPAPAEEEEPVKEEPKKEAAPEAPAATGAATDVEMPELGESVTEGTITQWLKAVGDTVEVDEPLLEVSTDKVDTEIPSPVAGTIVEILADEDDTVDVGAVIARIGDANAAAAPAEEEAAPAEEEEPVKEEPKKEAAPEAPAATGAATDVEMPELGESVTEGTITQWLKAVGDTVEVDEPLLEVSTDKVDTEIPSPVAGTIVEILADEDDTVDVGAVIARIGDANAAAAPAEEEAAPAEEEEPVKEEPKKEEPKKEEPKKEAATTPAAASATVSASGDNVPYVTPLVRKLAEKHGVDLNTVTGTGIGGRIRKQDVLAAANGEAAPAEAAAPVSAWSTKSVDPEKAKLRGTTQKVNRIREITAMKTVEALQISAQLTQLHEVDMTRVAELRKKNKPAFIEKHGVNLTYLPFFVKAVVEALVSHPNVNASFNAKTKEMTYHSSVNLSIAVDTPAGLLTPVIHDAQDLSIPEIAKAIVDLADRSRNNKLKPNDLSGGTFTITNIGSEGALSDTPILVPPQAGILGTGAIVKRPVVITEDGIDSIAIRQMVFLPLTYDHQVVDGADAGRFLTTIKDRLETANFEGDLQL

SEQ ID NO: 52553 - protein, 343 aa, Haemophilus influenzae R2846
MKDLDWNNLGFSYIKTDYRFIAHWKDGKWDEGKLTTDNTLHIHEGSTALHYGQQCFEGLKAYRCKDGSINLFRPQANAERMQRTADRLLMPRVPTELFVRACKEVVKANQDWLGPYGSGATLYLRPFLIGVGENIGVKTAPEFIFSVFCCPVGAYFKGGLAPSNFITTDYDRAAPMGTGGVKVGGNYAASLLPHELAAEQGTPERKFADAIYLDPKTHTKIEEVGAANFFGITKDNKFITPKSESILPSITKYSLLHIAKERLGMEAIEGDVYIDQLDQFVEAGACGTAAVITPVGGIQHNGKFHVFYSETEVGPVTRRLYDELTGIQFGDVEAPEGWIVKVE

SEQ ID NO: 52554 - protein, 567 aa, Torulaspora delbrueckii
MSTTEHTPVDHLSPAVSASGSGLSTPSNKAERDDIKDFDAAADREAAVDIPKRPASSYIGVSILCLMVAFGGFVFGWDTGTISGFVNLSDFLQRFGQRSKDGVYYLSKVRMGLIVSIFNIGCAIGGIILSKIGDIYGRRIGLVAVTVIYVVGILIQICSFNKWYQYFIGRIISGLGVGGIAVLSPMLISEVSPKQIRGTLVACYQLMITLGIFLGYCTNYGTKTYNDSTQWRVGLGLCFAWAIFMIGGMLFVPESPRYLVEHGNIEEAKRSLSRSNKLSVDDPAVLAELDAISAGVEAEKLAGSASWGELFSTKTKVFQRLIMGVMLQSLQQLTGDNYFFYYGTTVFKSVGLKDSFQTSIIIGVVNFFSTFVGIFCIERFGRRTCLLWGAASMVCCFVVFASVGVTKLWPEGPSHQDISSKGAGNCMIVFTMFFIFCFATSWAGGCYVIVSESFPLRVKSKGMAIATAANWLWGFLIAFFTPFITGAINFYYGYVFMGCLVFGYFYVFFFVPETKGLTLEEVETMWLEGVLPWKSAAWVPPDRRGADYNAEEMAHDDKPMYKRFFSK

SEQ ID NO: 52555 - protein, 360 aa, Gloeobacter violaceus PCC 7421
MDGNKPMDVPQLMHAAVFYGVGDLRYEQVPVPEVAADEVLVQVRACGLCQSDIKKLRYPLLDPPRIFGHETSGTIVRAGEAVEHWRVGERVVVLHHIPCFHCPYCLNENYSMCRVYKEVTTTAGFAPAGGGFAEYVKVPGHIVRSGGLMAIPDGVSFEEASFVEPTNCCLKAVKKAQVQPGQWVLITGAGPIGLMFAMLCRQFGAKPIVTDLLASRVERARALGAEAALDARSADLTARIHALTGGLGVDVALLAVPSVQAFSQALDATRKGGKILFFAEFAESVQIPLDPNVLYRREIDLMGSYSSSFKVQHLAADLVFGRRIDVQALISDFYPLAELAAAVEQAVHPTPETCKILIRP

SEQ ID NO: 52556 - protein, 444 aa, Oryza sativa (indica cultivar-group)
MYGGGGVAAGGATTTTGSHGGGGGDWWSAAVSSCSAPAPETMQGFGGWSAAVVAVDGGGNTSRSAAGNTASSESPGSLATGSSITFQEPAGGVADPAAIAVHAQTVAGGGGGGGWNQQPFLDGSGFHGYMSSSRNDHHTNHHHHQINTPSLMSNSSSNNGVMLQEHQHDQNYQFLSNLGFELLSSPTSPYGGGGGFRSSLLRSLTEPAAAAKPNDSPGFQQYHHHQPAMNLQPPAAAAGREPLQFTNSTAAPFWNPSSGFTVAAEGTALGGAGASPAQPTPASLAAKRALEGVGDSSSIITKKAKADSTPLKKSRTGTPSALPTTFKVRKEKLGDRVTALQQLVSPFGKTDTASVLHETIEYIKFLHDQVGALSAPYLKNRQQVPHLKNSTGVDNDGGGGGEATAASKRDLTGRGLCLVPISSTFAVASETPVDFWTPFGAAFR

SEQ ID NO: 52557 - protein, 1285 aa, Coprinopsis cinerea okayama7#130
MPSYHGHRYSESVNQNRKAQLANAYNELGKELASSKIRVVGNYTLGKVIGEGAYGKVRLGTHRLTSTRVAIKQIPKAMSATLTREIHHHRQLHHPHITQMYEVIATESHIWIVTELCCGGELFDYLVEKGRLSEEETKIIFGQLCLAVAYLHETGIVHRDLKLENVLLDERCRVKLGDFGFTREYERGSLMETFCGTTGYAAPEMLQGKKYQGPEVDVWSLGVILYCLLTGTLPFDDDNEDVMRQMIIKGEFEDPAWLSLESRDLIKNILVKDPMKRFTIPQILAHPWFTTKDLTYEPESPLSVDTSLLTIPQPDEENPDELTIDTNFINGASTSPPRTPDNDPDGDPFNSTPNSITHRASSSTLRREDDAVESKSLKLRPISWSNSSGSKIPPPSKIRTPARTKRRSVSSVLSLSVDNAKSGEGDAEPTPLTPLPPPTSHSLDFASLLTTPTPIIFSTPLERELLNSLSALGMDTAQIVHSVLSDACDSAGAIWWMLKKKAEKRALEEPTDVVSPTTATEPHGRTNGAESELKSSRKVRKVQAGVQTESLVPSPTYLSKPAPQLAFVPPTPTFAKPSTPPRAVSPTRSPMLSPSSSTTHELPRSHPSTPGSSMKESKGRKNRSGSVSIMQRATTALEAAGLVRKKSTEGVREQREKSKDKDNDNEKRNTSGEESRSSHSHDPRGSKLTKSPPLKAQRDYNVPATPPPSETHDSTQIGSPWVLADAKNGAGPSHAPLRGEMPHSHSAPNLDTATIKAPTQHRNKANILTSLRLWFNEDRKGKRKDSTDSNPRVPSTPQQTYTRTAGGGGTAKRRGSNASAKVMRNSTGHRAKRPSMSSRRSSSVNSRRSSITSMQIPVLDSPQQLSNIRAMGSHTPNSERGDHSSRPSSIHSISSRQKPRHRKSPSASSSGSLHLRTASPMQKYHRRAGSGSSTRVIRQSLARPPHARSNSATSSLYSPPSSRPTSFYEQSETETGNVIGNTSSSSSAPRNSSPYRSRKYSDSDSIGGSRPPTSFLASKRSNPFSSPALGGGTLSKSSWKKSWGIEPPGWQNRTTHLPVEVLVISSSNEPATLRDVFSGRHSFSTTTGAGDDSDWVDEDDDIPAFAGGLGQMGASISSSSSSSAPINPEPIVTLSPAPRHRNTKRNGGGKQSMVVVVSTASNQTWTVTTTAIAIATKPLNCALLPHNLHSNLSINSTMSEPYDPYLPRAGSSSGNPGSTGGGAGNAKTAAIQAQIDDTVGIMRENITKVAERGERLDSLQDKTDNLAVSAQGFRRGANRVRKNMW

SEQ ID NO: 52558 - protein, 891 aa, Arabidopsis thaliana
MNGLDFFFSPSPIVDTSTGNNGGDDDWGDFVDSSDAFDSDRNGADSSHNRIESEKKSQANWVTSRGPVPLSVFGEEEEDDTESSASVPSFGFSFDSFSSKRNDSNGSVNRVVDSNTNHTVEISGLIPNLYRKNGHSDNNHGNSGGFNVDLSSSNRKIENSAVSLETNPLNLGTERSVKASNVLNSSTIEVTLDPNYSDLGFADKSDDDLDGWEFKTAESMFGTLGGSYKQEEREKAVQNTADVSSGVWSSPAINGTGPNFDTAKVDAVKLVAERENGDDDPWDNGGWEFKVAEAKEPKRDLTNKESNGWGFGFGFEPVSKLETTNSFQSSVEKETKKMENGSISFPSNGDVNSGGTSWAFKQPSLEIGNEKEEKEVQTGKPKGVLPLSFFEDEKSETSDTLVHEDSFVLASDFPVREKTKAPSPTVSISDLISRLYSQVEEKNAVNILENSATASNEVNGEDDSWEFQGPKMPITDSGIAEGADDFDSTWEFQGPSPALKMSDVTEVVDEFDDDSWEFQGPTQPVKDSMSRIGDNGLWEYKHSSVENEVGNQSSVPNGFGELHDKTVIRIEPNDYQDLFHKLKIELYHIALYHLEKLKEARDKAADSDEVQKCDSEIEDLQNLLNNDVLISGVNLESLQPGSSGMTELYKALQEPKFRELDSEDLLTERLLSAEKDWKSTIELLKHATLTLKIINLGSLEQQSKYASTWFEISSTCAQELRHAASIWKQVIKNDVQEEILSKPQGKSYALSVGEIYRVVKILRASTRLYKPWILLAPTSSNVLAVLDECLKLWLSSGLVEALLNSHDDSADQLLESIKYINEVDAFTLYTCITSATSPTCYISGLNTDIVPGIKTVEWNGEHYLLPLANIWANLISRDPPNLPGHHFPIVS

SEQ ID NO: 52559 - protein, 254 aa, Myxococcus xanthus DK 1622
MAYKVSKDPRTDIRERTYVPNLLRGLGITAKHFFRNLFGTRDTNTQVVDRTGASLMTTVAYPEEKPIYPEGYRGLHRLVPREDGKPRCVACYMCATICPAQCIYIEAGEYEDEASDSEDRVIEKYPTQFVIDELRCIVCGLCVDACPKDAIRMDTYTHTPPEYTRQNFVYDIPKLLKGAPVSHPSDPWNKREGSEEPHHVHKEAHTRIGEGLVELKLPHGEHGGHGKALPAGAQAGHQAVVTQQGPIQVTKFIK

SEQ ID NO: 52560 - protein, 248 aa, Chromobacterium violaceum ATCC 12472
MSGKLVIGNWKMNTRGDSARQLAAALLADGQTNREGVGIAAPAVYLAALAEQLKGGKIALSSQDVSRFAADGAFTGEVSAAMLADVGCRYALVGHSERRQYFREDNAALLAKMRNAIAAGVTPVLCVGETLAQREAGDYLNVVREQLAILSDIADGEYVVAYEPVWAIGTGKVASLEQIAEIHAFIKNWCLQNAGGSAKIRVLYGGSVKAENAEAILATENVDGALVGGASLDADSFRVICQAAGKMI

SEQ ID NO: 52561 - protein, 153 aa, Arabidopsis thaliana
MGCCCCLPSIPESSRTIDEHLPLSRATPSSLSNAYSSPLSPPIPLAITNINLQTSPPKLPRTQGNSSEASPGLTQVVPEKKTWHVDDLTDFELKKQYREAIDECPICLEEYEIDNPKLLTKCGHDFHLACILAWMERSEACPVCDKELVLTES

SEQ ID NO: 52562 - protein, 463 aa, Dioscorea elephantipes
SGKPFYAIMHRIDVGLVIDLEPVNPADVPVTAAAALKSYKLAAKAISRLQSLPSGNIPLLCDVLVKEVSELIGYDRVMAYKFHEDEHGEVIAECRRSDLEPYLGLHYPATDIPQASRFLFMKNKVRMICDCSAPPVKVIQDKRLPQPLSLGGSTLRAPHGCHAQYMANMGSIASLVMSVTINEDDDETGSGDQQQNGMKLWGLVGCHHTSPRFVPFPLRYACEFLLQVFGIQLNKEVELATQQREHILRTQLSCDMLLRDAPIGYLLNSPNVMDLVKCDGAALYYKNQFWLLEITPTEAQIRDIFAWLLEYHNSTTGLSTNSLTEAGYPGAVELGDAVCSMAATKITSKDFIFWFRSHTSKEIKWGGAKHDPGDRTDEGRKMHPRSSFKAFLEVVKRRSLPWEDVDMDAIHSLQLILRGSLQDEPVTDNSKTIVNATPDDAKQIQHMDELRIVTTEMVRLMET

SEQ ID NO: 52563 - protein, 466 aa, Hedyosmum sp. SM-2000
SGKPFYAIIHRVTASFIIDFEPVKPYEVPMTAAGALQSCKLAAKAISRLQSLPGGSMERLCETVVQEVFELTGYDRVMAYKFHEDDHGEVFSEITKPGLEPYLGLHYPATDIPQAARFLFMKNKVRMICDCHAKPVKVFQDEKLTFDLTLCGSTLRAPHSCHLQYMANMSSIASLVMAVVVNEGEDEGENVDSGQQQQQKRKRLWGLVVCHNTTPRFVPFPLRYACEFLIQVFAIHVNKEIELESQIREKNIFRTQTLLCDTLMRDAPLGIISQNPNILDLVKCDGAALLYKSKVWRLGLTPNEPQIHDISLWLSEYHMDSTGFSTDSLHEAGYQGAVALGNIVCGMAAVWITSKDMLFWFRSHTAAEVRWGGAKHDPDDTDDNRRMHPRSSFKAFLEVVKKRSIPWKDYEMDAIHSLQIILRGNFSDSEKTHANTTFDSRLNDLKLEGMEELQAVTNEMVRLIET

SEQ ID NO: 52564 - protein, 402 aa, Pseudomonas syringae pv. tomato str. DC3000
MADQGSPRRFARIDRLPPYVFNITAELKMAARRRGEDIIDLSMGNPDGATPPHIVEKLVTVAQREDTHGYSTSRGIPRLRRAISNWYKKRYEVDIDPESEAIVTIGSKEGLAHLMLATLDQGDTVLVPNPSYPIHIYGAVIAGAQVRSVPLVPGVDFFAELEKAIRGSIPKPKMMILGFPSNPTAQCVELDFFERVVALAKQYDVLVIHDLAYADIVYDGWKAPSIMQVPGAKDIAVEFFTLSKSYNMAGWRIGFMVGNPELVNALARIKSYHDYGTFTPLQVAAIAALEGDQQCVLDIAEQYRQRRNVLVKGLHELGWMVENPKASMYVWAKIPEAYAHLGSLEFAKKLLAEAKVCVSPGIGFGEYGDDHVRFALIENQDRIRQAVRGIRSMFRADDKLKS

SEQ ID NO: 52565 - protein, 397 aa, Hedyosmum sp. SM-2000
DLEPVNPAEVPVIAAGALKSYKLAAKAISKLRSLPSGNISLLCDVLVREVSELTGYDRVMAYKFHEDEHGEVIAECRRSDLEPYLGLHYPATDIPQASRFLFMKNKVRMICDCSAPPVKVIQDKRLGQPLSLCGSTLRAPHGCHAQYMTNMGSIASLVMSITINEDDEETDNEQQLQQEKPKKLWGLVVCHHTSPRFIPFPLRYACEFLIQVFGIQLNKEVELAAQVREKHTLKTQTVLCDMLLRDAPMGILTQSPNVMDLVKCDGAALNYKNQFWLLGTTPTEAQIKDLAEWLLECHDGTTGLSTDSLTEAGYPGSYVLGDAVRGMAAVKITSKDFLFWFRSHSAKEIKWGGAKHDPIDKDDDGRKMHPRSSFKAFLEVVRQRSVPWEDIEMDAIQ

SEQ ID NO: 52566 - protein, 417 aa, Chromobacterium violaceum ATCC 12472
MAEIRNYTLNFGPQHPAAHGVLRLVLELDGEVVQRADPHIGLLHRGTEKLAESKTFIQSLPYMDRLDYVSMMCNEHAYCLAIEKMMGIEVPERAQYIRVMFAEITRILNHLLWIGAHALDIGAMTMFLYAFREREDLMDCYEAVSGARMHAAYFRPGGVYRDLPDSMPQYTVSKIKNAKELARLNEGRKGSMLDFIEDFTKRFPTYVDEYETLLTDNRIWKQRTVGIGVVTPERALNLGMTGPMLRGSGIAWDLRKTQPYDVYDKMDFDVPVGVGGDCYDRYLVRVEEMRQSNRIIQQCVAWLRANPGPVITDNHKVAPPSREGMKSNMEDLIHHFKLFTEGMHVPEGEAYAAVEHPKGEFGIYLVSDGANKPYRLKIRAPGYAHLAALDEMATGHMIADVVAIIGTQDIVFGEIDR

SEQ ID NO: 52567 - protein, 465 aa, Heuchera canadensis
SGKPFYAIVHRVTGSLIIDFEPVKPYEVPMTAAGALQSYKLAAKAITRLQALPSGSVERLCDTMVQEVFELTGYDRVMAYKFHDDDHGEVVSEITKPGLEPYLGLHYPATDIPQAARFLFMKNKIRMICDCRAKHVKVLQDEKLPFDLTLCGSTLRAPHSCHLQYMENMNSIASLVMAVVVNDGDDESESSNPAQPSKRKRLWGLVVCHNTTPRFVPFPLRYACEFLAQVFAIHVSKELELENQILEKNILRTQTLLCDMLMRDAPLGIVSQSPNIMDLVKCDGAALLYKDKIWRLGVVPTDSQLQDIASWLSKYHMDSTGLSTDSLYDAGFSRALSLGDVVCGMAAVKINSNDILFWFRSHTAAEIRWGGAKHETGEKDDNRKMHPRSSFKAFLEVVKTRSLPWKDYEMDAIHSLQLILRNTFKDIETVDANTNKIHTKLSDLKIEGMQELEAVTSEMVRLIET

SEQ ID NO: 52568 - protein, 463 aa, Listeria monocytogenes str. 4b H7858
MNSLFRRKPIEDLMHNKSGSTHLKQTLGPLDLTLLGVGAIVGTGIFILPGTVAAKNAGPAIIFSFVIAAIVCAIAAMCYSEFASSVPVAGSAYTYGYVVFGELIGWLLGWALILEYGLAVASVASGWSSYLNALLSGFHISIPEAISGPFNPEVGTFINLPAIIIVLVIAFLLTLGIKESTRVNTIMVVIKVGVILLFLVVGVFYVKPDNWQPFMPFGISGVMNGAALVFFAYLGFDAVSSAAEEVKDPQRTMPIGIIGSLLICTVLYVAVSAVLTGMVPYTDLNVTDPVAYALQVINQDWVAGIISLGAVVGMITVILVMSYGATRLIFAMGRDGLLPKVLAEINQKYQTPVKNTWIFAVIVAIISGLVPLDRLAELVNIGTLLAFMMVSIGIIFLRKNKDIQARGFKVPFYPVLPIVSFLLCAFLISRLSVHTWILCGIWFVIGLIVYFAYGRKHSELLKK

SEQ ID NO: 52569 - protein, 381 aa, Arabidopsis thaliana
MSASSSSFEQPQVITCNAAVAWRAGEPLVMEEVEVSPPQPLEIRIKVVCTSLCRSDLSAWESQSLLPRIFGHEAAGIVESIGEGVTEFEKGDHVLAVFTGECGSCRHCISGKSNMCQVLGMERKCLMHSDQKTRFSIKGKPVYHYCAVSSFSEYTVVHSGCAVKVDPLAPLHKICLLSCGVAAGLGAAWNVADVQKGSSVVIFGLGTVGLSVAQGAKLSGAAQILGVDINPAKAEQAKTFGVTDFINSNDLSEPIPQVIKRMTGGGADFSFECVGDTGIATTALQSCSDGWGMTVTLGVPKAKPEVSAHYGLFLSGKSLKGTLFGGWKPKSDLPSLIDKYMNKEIMIDEFITHNLSFDEINKAFVLMREGKCLRCVLHMPK

SEQ ID NO: 52570 - protein, 115 aa, Clostridium perfringens str. 13
MNEIIRAIEKEQIREDLTQFNIGDTIKVHVRIKEGNRERIQVFEGTVIKKQNGGLRETFTVRRVAYGVGVERTFPINAPIIDKIDVVRRGKVRRAKLFYLRDRVGKAAKVKELTR

SEQ ID NO: 52571 - protein, 336 aa, Methylococcus capsulatus str. Bath
MDRRAVIAPRCALICLITLMIQAACTPVINRPGPVVASPQLHAAHFIAADGAVLPVRHWLPAGTRPKAVVVAVHGFNDYSLAFEPLGSYLKTQGIGCYAYDQRGFGLAPGRGLWAGVDAYTEDLETFVGQVRTRHPGVPVYLLGESMGGAVAIVAMTSARPPRADGLILSAPAVWSRDTMPWYQSLLLAVSSHTIPWLRLTGEGLGVMASDNIEMLRGLGRDPNVIKATRVDAIHGLADLMDTAQERVPALKTRTLVLYGERDEIIPRTPLMALLDKLPAGTRFAYYHRGYHLLLRDLQAERPWRDIAAWIATPAAPLPSGAERQVAEGLPAADGT

SEQ ID NO: 52572 - protein, 415 aa, Glycine max
  misc_feature (228)..(228): Xaa can be any naturally occurring amino acid
  misc_feature (277)..(277): Xaa can be any naturally occurring amino acid
MVPIFLYIVAFICTCGAIALSLLHIYKHLLNYTEPTYQRFIVRIVFMVPVYALMSFLSLVLPQGSIYFNSIREIYEAWVIYNFLSLCLEWVGGPGSVVLSLTGRVLKPSWFLMTCCLPPLALDGRFIRKCKQGCLQFVILKPILVVVTLILYAKGKYKDGNFSPKQSYLYLTIIYTFSYTMALYALALFYVACKDLLQPFNPVPKFIIIKSVVFLTYWQGVLVFLAAXSEFVKDADEAALLQDFFICVEMLVAAVGHFYAFPYKEYSSANIGGSRGXASLGHALKLNDFYHDTVHQFAPTYHEYVLYNHSEGEEGTKKYRSRTSVPIGPEMDSVRNKHMSGDKLDDIQLSSLSSTSSTPSNSGSIPDASNSDATNSSLLVDMSNSVSEPYDLTFIDLDVSSYPEEVPAADKAGGR

SEQ ID NO: 52573 - protein, 477 aa, Corynebacterium glutamicum ATCC 13032
MAFETPEEIVKFIKDENVEFVDVRFTDLPGTEQHFSIPAASFDADTIEEGLAFDGSSIRGFTTIDESDMNLLPDLGTATLDPFRKAKTLNVKFFVHDPFTREAFSRDPRNVARKAEQYLASTGIADTCNFGAEAEFYLFDSVRYSTEMNSGFYEVDTEEGWWNRGKETNLDGTPNLGAKNRVKGGYFPVAPYDQTVDVRDDMVRNLAASGFALERFHHEVGGGQQEINYRFNTMLHAADDIQTFKYIIKNTARLHGKAATFMPKPLAGDNGSGMHAHQSLWKDGKPLFHDESGYAGLSDIARYYIGGILHHAGAVLAFTNATLNSYHRLVPGFEAPINLVYSQRNRSAAVRIPITGSNPKAKRIEFRAPDPSGNPYLGFAAMMMAGLDGIKNRIEPHAPVDKDLYELPPEEAASIPQAPTSLEASLKALQEDTDFLTESDVFTEDLIEAYIQYKYDNEISPVRLRPTPQEFELYFDC

SEQ ID NO: 52574 - protein, 374 aa, Methylococcus capsulatus str. Bath
MTDIFDPSDEFGPARIIQVREPSVGLRATVIIDNVALGPAIGGLRIASAGSTADGCRLARTMTLKSAAADLPHGGGVAMLHPAPGSPENACRQHRVRALACALRSEDQFIFAPDMGSGETTMAWIRDENGRAVGLPRELGGIALSRIGAAGWGLYHATEVALRYCGFKLEDARVVIQGFGTVGQNTARYLVENGAVVVGIADSGGTLYHPRGLDIAELVAIKAKGGSVVDSSEGERLAPDAAVDLDCDIWIPAAGSDVITPDNAARLKARLVVEAADASLAPAAERYLHEKGIICVPDFIANAGGLIGAAMECRGANKTQVLSAIKEKIRRNTEKVLQSVETDGTLPREAAVRLAMKPIVKAMSYRRWSGLSAD

SEQ ID NO: 52575 - protein, 245 aa, Ehrlichia ruminantium str. Welgevonden
MFNLLGKKFLITGASGGIGQAITKILHEAGAVLCISGTRESILEKTAAQYSGNIHTLTCDLTNNEQINTLIDSSCKIMGGIDGIICNAGITLDKLLLRTSDEDWNKVINTNLTTTFKLNRSACRAMLKNGHGRIINISSIVALTGNPGQASYAASKAGMIAMSKSIAKEFATKNITVNCIAPGFISTPMTDVLSEEQRANIMQHIPMQRMGTPEEIASVVLFLASDASKYITGQTIHVNGGMLMC

SEQ ID NO: 52576 - protein, 1043 aa, Ehrlichia ruminantium str. Welgevonden
MISALQVPNEIRRRMQLLYRTEENSYARYLTEKTEISQDSKIRIYSVAKQIIEKIRGGRNLGIIDAFMQEYGLSNEEGIALMCLAESLLRVPDDCTINDLIKDKIANSMWSNHIGNSSSMFVNAATWGLFIGGRVLKDTNDSTRWFSTINNLIKTMGEPIIRKAVQQAMYVLGKHFIKGRDIIEAIGNRKESELYSFDILGEASKTKKDAERYFTEYMKAIDSIGKSINNVTENLVDHDEISVKISALHNRYEFSQINEVLDEIVDKLLSICRLAKQNNIRVCIDAEEASRLEISLMILEKLRLDSSLDGWEGLGLAVQAYQKRAFSVLDFVEDIAVRSSHKMMIRLVKGAYWDYEIKNAQELGLSSYPVFTRKVYTDVSYLACAYKILTKQNTFYPCFATHNAYTLATILEIADKDHPGFEFQRLHGMGTSLYEYVTQEMAANIKCRVYAPVGSYQDLLPYLIRRLLENGANSSFINQMNDSNITLDQLIEDPLEKAKSFEYMPHPSISLPKDIFGDERINSAGIDITDSVTLVNFNEEMKEYKEHKFKALSIINGEELGSQAIEVFSPSNSEDVVGEVSFADATQAVSALDIAYDAFKEWSSMSVYDRAAILEKAADLIEENKAKLIVLLIREGGKVISDAIAEVREAVDFLRYYVAMGKKELGDSKKLPGPVGEDNYIYFRSRGVFICISPWNFPLAIFIGPIVAALITGNTVLAKPAEQTSIIAYEAVKLLYDAGVPKGVLHLLLGHGKELGEVLLKNEKIAGVAFTGSTETARIINQAIAEKEGAIIPFIAETGGLNTMIVDSSALIEQVTNDVIASAFKSAGQRCSALRVLFVQEEIADKQIEMICGAMEDLVIGDPMLLKTDIGPVIDDASREMLFAHADRMSREGKLLCKVNLGEDCDKGYFFPPCAYEIESISQLKREVFGPILHIIRYKKGDLHKILTEINNTGYGLTFAVQSRIQSNIDNIIDNINVGNVYVNRNQVGAVVGVQPFGGQGLSGTGPKAGGPYYLHRFLTEKVISINTTALGGNTTLMCLNDE

SEQ ID NO: 52577 - protein, 213 aa, Aquifex aeolicus VF5
MRVILFDLDGTLIDSAKDIALALEKTLKELGLEEYYPDNVTKYIGGGVRALLEKVLKDKFREEYVEVFRKHYLENPVVYTKPYPEIPYTLEALKSKGFKLAVVSNKLEELSKKILDILNLSGYFDLIVGGDTFGEKKPSPTPVLKTLEILGEEPEKALIVGDTDADIEAGKRAGTKTALALWGYVKLNSQIPDFTLSRPSDLVKLMDNHIVEF

SEQ ID NO: 52578 - protein, 313 aa, Aspergillus nidulans FGSC A4
MALITRKYGEIRQITGLSDHAVILQSHKVQYCPPLDRYYAIKVFRRSPGQSTDEYTKQVNAEFAVVANLHHQHVVSTFELLPIGGGNLAACMEYCAGGDLHSLITAGPSHRLPSEEADCLFKQLLRGISYLHKSGIAHRDLKPENLLLTHRACLKISDFANAERVRFDGDDSQHANDLAETERRSLEPTPYLAPERYLDEGDRYMSRSDPRALDIWAAAVIYVAMRTGRNLWKAATEKDEGFRAYVEERKAEKTNTVIQDSCHERGRKVIYAMLSTDPGKRPIATEILSSEWLQNIDCCIFDHSQAESNGFSA

SEQ ID NO: 52579 - protein, 273 aa, Listeria monocytogenes EGD-e
MEKYVVIGNPIRHSLSPAMQNRIFQELGMNAEYNSVLIEEDAFETEIKKLMDSGVRGFNITTPFKERILPFLDELDNLAAASGAVNTVLKKEDKWYGFNTDGKGYLEGLEEIRSITEDDSILITGAGGASKAIYLALSTHTDAKITVANRTTEKAIEMTKDNNNHHAITLEEAEKQLADFTIIIQTTSIGLEASKNKSPISLANVKQGTICSDIIYNPAETAFLKEAKKNGAITQNGLPMFVNQGALAFEIWTGIKPERSLMKEAVLEQLGGN

SEQ ID NO: 52580 - protein, 119 aa, Glycine max
  misc_feature (21)..(21): Xaa can be any naturally occurring amino acid
  misc_feature (87)..(87): Xaa can be any naturally occurring amino acid
  misc_feature (113)..(113): Xaa can be any naturally occurring amino acid
GLAVLTVPFTMEFPKAIFYYXVTSNLFSLIYKLILKIPNIKKTLNIPEIPITPPTTTITPQSPFSIFPALKQATSSTTNKQSSIPEXASEHSNKKISSSSIISRKLRSLEKRXKEKKKN

SEQ ID NO: 52581 - protein, 466 aa, Gloeobacter violaceus PCC 7421
MNTAEELLDVLVVGAGLSGLALAWKLKRAGCTFLVCQAGERVGGAITTAIADGFVCEGGPNSFQESPPLIELLTQLQLEDQIVTADPRLARFVWWENRLRSVPLTPAQLVRSDLLSWSGKARLLWELFVPALGEPREETVAEFVLRRFGEEVLSRLVDPLVSGMCAGDVGQLSIEATFERLVDLERRHGGVLRGLWRTARTRPPFKRLCTLRGGLEQLPQALAQRLQPQILLSHRLEALEHLAGDRWRAVVAGPQGEPVAIAARTVILSGSAHAMASVLRPLDAGLGRALESIYYPPVVSISLAYSKSQVPNAPEGFGHLIPRNQTLRSLGVIWNSSLFPHTAPPNWRLYTCFVGGTTDPATPNLSDTELASLAHRELQTVLGFQAGYQLLRVTRWPQAIPQYALGHPSKQERVERALLGLPGLFLVGNYFGGISLGDCVRHSGAVASRVLQFLTTVASNGSLRPA

SEQ ID NO: 52582 - protein, 210 aa, Gloeobacter violaceus PCC 7421
MKQHPGPHEAMIAAGLTPDEALERLLAGNCRFVAAKLENPHRTAAYVRSIAHSQHPFAVLVGCADSRVAPEILFDQGLGDLFVNRVAGNCVSDDILGSIEYAVEHLGCSLVLVLGHERCGAIQAAIAAATAGATFNGYVRHFIEAIRPAVEMCRAQAGDLDENALRANVLRNVEKIKTASDIIHSKLLSGEVKVLGGRYDLDDGVVTLLG

SEQ ID NO: 52583 - protein, 504 aa, Thermosynechococcus elongatus BP-1
MICSEEFWVLGSMVGSVLRLDQVLIPEDAPIRFGTDGWRGIIGAEFTFNRLLRAAKAAAAVLYQTYGDGRTPRIIVGYDRRFLAEHFATAVAQFLTSQGYEVWLSNCAAPTPAFSWAVKAEGAIGGLVITASHNPGIYAGLKVKGAFGGSVPTPVTEAIEAQLAQGEPPPVGEAKTDYQTFDPWPSYCAALRTHVDPSPIREAIATGKLHVCADVMHGVAAGGLERLLDWPIEEFRRDRDPLFGSGAPEPIGRYLAATQERLRQQHSATPTVCLVFDGDADRLAVIDGEGVLYTAQEMIPILIDHLAQHSPYRGAVIKSISSSDLVARVAAHHGLAVIETPIGFKYIGDRMLAGEAVLLGGEESGGIGYGHHLPERDALLSALYLLQALVTSGLSVGEYYQQLQLTTNFYSAYDRVDLTLTSLAQRQKLEALLGEHPFTQILDSPVSHWDTIDGYKFHLADGGWLLIRFSGTEPLLRLYCQGKTPEQVQHILQWASQWAVAVTG

SEQ ID NO: 52584 - protein, 614 aa, Aspergillus nidulans FGSC A4
MAAVSEITERTGQIAIDPSSQAPATKPITGFSGPFKTRLDQIYQSLTTESSNFSRDIQRDDQDPKDNNPLSSLAAFHAYMASPSASALRPAGPPDDSAPITDYFISSSHNTYLTGNQLYSDAAAKAYTDVGLGMVQVFENETANQSSDDDGTSSSSSSSDDEKSKDKPKVSIFGRKSPSSEPAADDGKVAEPAKVGPIRLEPKVLHGHTLTKGTTFREVCYAIRDSAFIVSDLPVIVSLEVHASLEQQETMVEIMEDAFDGMLIQVTPEMEAMETPPPLRDLKRKILVKVKWVSPSAENAEDVDDRTDDLEQLAPTKSAGASSQSASQAAQKPSKILHSLSRHAIFTKGFSFKQFSQPEAKVPGHVFSLSERAARQADEKYGKELFEHNRKYFMRVYPYGLRVNSSNLDPTFFWRRGAQIVALNWQNSDKGMMLNQGMFAGEQGWILKPQGYRSTEPESAPIPRRTVDLSIEVLAGQDLTLPPGDKNEKGFRPYVACYVHVETPEDAANPGLKGDDSTDSEKTSYKRVTKAGEGVNPDFGSQILQFPTLPGVVEELTFVRFKVKDDEIGFDSLASWACIRLTRLQEGYRVLRLYKCDGSDSGGFLLVRITKNIS

SEQ ID NO: 52585 - protein, 304 aa, Rhodococcus sp. RHA1
MTSRDLDAPTARPSYLCGLIGTGISKSLTPPLHEAEGRAQGVGYVYRILDLDTLGMGVEGLPQLLSAAKLLGFNGLNITHPCKQAVIPLLDDLSDDARKLGAVNTVHIEGGRLIGHNTDWSGFARNMDEGLEGAPMNHVVQLGAGGAGAAVAYAALTRGVGHFTIIDADAARSKDLRDSLAELFPDREIAAGDLSAVPAAVGAAQGLIHATPIGMAAHPGMALDAALLRPDLWVADVVYRPAETELLARAREIGARTLSGIGMTIGQAVDSFRIFTGLEPDAQRMREHMGLLLQAEDAAALAGA

SEQ ID NO: 52586 - protein, 369 aa, Chlamydomonas sp. W80
MSGKAVHARQASRARKGAPIRMESDASEKKLKVAINGFGRHRPSFLPRLGGPQQSRLLDAGSAINDSGGVKQASHLLKYDSILGTFDAEVKIVDDSHISVQRQVRIQIVSSRDPLQLPWKALDIDLVIEGTGVFIDTKGAGKHIEAGAKKVLITAPAKGDGIPTFVCGVNADDYKHEYPIISNASCTTNCMAPFVKVLEEKFGIIKGTMTTTHSYTGDQRLLDASHRDLRRARAAAMNIVPTSTGAAKAVALVLPSMKGKLNGIALRVPTPNVSIVDLVVQVEKKTFAEEVNAAFREAANGAQKGVLAVSDEPLVSVDFRCSDVSSTIDASLTMVMGDDMVKVVAWYDNEWGYSQRVVDLAEITAQKWE

SEQ ID NO: 52587 - protein, 184 aa, Triticum aestivum
KYPYIAGMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDKNRSI

SEQ ID NO: 52588 - protein, 435 aa, Heuchera canadensis
SGKPFYAIIHRIDVGLVIDLEPVNPADVPITAAGALKSYKLAAKAISRLQSLPNGNITLLCDVLVKEVSDLTGYDRVMVYKFHEDEHGEVIAESCRPDLEPYLGLHYPATDIPQASRFLFMKNKVRMICDCLASSVKVIQDKRLPQPLSLCGSTLRSPHGCHTQYMANMGTIASLVMSVTINEEDDEMVTDQPKGRKLWGLVVCHHTSPRFVPFPLRYACEFLIQVFGVCINKEVELASQTREKHILQTQTVLCDMLLRNAPVGIVTQSPNVMDLVKCDGAALYYKKKAWLLGSTPTDAQIRDITDWLLEYHGGSTGLSTDSLVEAGYPDALNLGDAVCGMAAIKITSNDFLFWFRSHTAREIKWGGAKHDPDEKDDGRKMHPRSSFKAFLEVVKRRSLPWEDVEMDVIHSLQLILRGSLQDETVDDSKTIVNES

SEQ ID NO: 52589 - protein, 383 aa, Acidovorax sp. JS42
MTTPHFPSRLPNVGTTIFTVMSALAAEHQAVNLGQGFPDFHCDPQLVDAVTRAMQAGHNQYPPMAGVPALRQAVASKIEALHARQYCPNAEITITAGATQAILTAILACVQPGDEVIVLEPCYDSYVPNIALAGGVVVRVPLKPGSFRPDFAKIAAAITPRTRLLIINTPHNPSATVWTADDMRTLEELLAPTDVLLISDEVYEHMVFDGAEHQSAARFAGLAERAFIVSSFGKTFHVTGWKVGTVAAPAAMTAEFRKVHQFNVFTVNTPMQYGLADYLQNPAPYLQLPAFYQAKRDLFRQGLEGSRLKLLPSTGSYFQCVDISAVSDLNEADFCQWLTREIGVAAIPLSAFYGDGFDQRVVRFCFAKKDETLRAAIERLRTL

SEQ ID NO: 52590 - protein, 116 aa, Lactobacillus johnsonii NCC 533
MDPLIQELTKEQLRDDMPDFRAGDTVRVHVRVVEGTHERIQMFEGVVIKRKGAGISATYTVRKMSSGIGVERTFPVNDPRVAKVEVLRHGRVRRAKLYYLRERHGKAARIAEKRRG

SEQ ID NO: 52591 - protein, 366 aa, Chlamydomonas sp. W80
MMATAGSSAAGARVSMRAASGIRASSSSRRAAVVVKAANVNIGDSLAEFLAVATPDTKLRQLMTSMSEATRTIAHKVRTASCGGTACVNSFGDEQLAVDMVADGILFEALKYSHVCSYACSEEVPEPVAMGGSGYSVAFDPLDGSSIVDTNFSVGTIFGVWPGDKLTGITGRDQAAAGMGVYGPRTVFVIAINGFPGTHEFLLQDDGKWLLVKSTEEIGEGKLFAPGNLRAIFDNPEYSKLVSYYLEEQYTLRYTGGMVPDVFQILVKEKGVFTNVTSPSTKAKLRLLFEVAPLALLIENAGGASSCDGLVCRALDVEVTAHEQRTQICYGSKGEVARFEKYMLGESSASLTLSRPSKRPCAERAR

SEQ ID NO: 52592 - protein, 578 aa, Houttuynia cordata
  misc_feature (481)..(481): Xaa can be any naturally occurring amino acid
  misc_feature (504)..(504): Xaa can be any naturally occurring amino acid
  misc_feature (574)..(574): Xaa can be any naturally occurring amino acid
SGKPFYAIVHRVTGSLIIDFEPVKPFEVPMTAAGALQSYKLAAKAISRLQSLPSGSMERLIDTMVQEVFELTGYDRVMAYKFHEDDHGEVISEVTIPHLDPYLGLHYPATDIPQAARFLFMKNKVRMICDCRAKPVKVYQDDKLSFDLTLCGSTLRAPHSCHLQYMENMGSIASLVMAVVVNEGGEEDRGGPADSSQQQLGRYRRKKLWGLVVCHNTRPRFVPFPLRYACEFLTQVFAIHVSKELELEETNSRKEILRTQTLLCDMLLRDAPMGIVNQTPNIMDLIKCDGAALFYKDKVFRLGIAPSETDIREIAQWLSAYHMDSTGLSTDSLHDAGYPKAAFLGDLVCGMAAVKITCSDMLFWFRTHTAAEIRWGGAKHDHSDRDDGKRMHPRSSFRAFLDVVKTRSLPWKDYEMDGIHSLQLILRTSVKEPEQVDSNKVIHAQLGDLKLDEMNELHAVTTEVVRLIETATVPILAVDVXGLINGWNAKISELTGMSLEQVMXKHLLTLVEDCSINVVRRMLCLALKGEEEQNIEFQVKTHGTRSDHGPVVLVVNACASRDVHGNVVGVCFVXQDVT

SEQ ID NO: 52593 - protein, 415 aa, Hypecoum imberbe
SGKPFYAIVHRVTGSLIVDFEPVKPYEVPMTAAGALQSYKLAAKAIAKLQSLPSGSMERLCNTVVQEVFELTGYDRVMAYYFHEDDHGEVIAEVTKPGLEPYLGLHYPATYIPQAARFLFMKNRIRMICDCRAKHVKVLQDEKLPADLTLCGSTLRAPHTCHLQYMENMGSIASLVMAVVVNESNDEEESSEPPSQAPKKKKLWGLVVCHNTSPRFVPFPLRYACEFLIQVFAVHVNKEFELDNQIHEKRILRTQTLLCDMLMRDAPFGIISQSPNVMDLVKCDGAALLYKNKIYRLGLTPSEFQINDIASWLTEYHMDSTGLSTDSLYDAGFPGALSLGDAVCGMAAVRITCKDMLFWFRSHTAAEVRWGGAKHDPDERDDGRKMHPRSSFKAFLEVVKTRSLPWKDYEMDAIH

SEQ ID NO: 52594 - protein, 516 aa, Rhodopseudomonas palustris CGA009
METEMPDFITLPALVRDTAQARPDRIAVIDGERQLRYAEFDALIDRIAATLQRDGLKPTDTISICALSSIEYAATFLAALRAGIAVAPLAPSSTAKDFSAMVRDSAAKILFTDDFAANAMKDAEIDAAVKRVAFDDGTSGEAFTRWLAPEGTKPAPVTIDPEWVFNIIYSSGTTGTPKGIVHSHQMRWAQYGKLDPIGYGPDAVTLLSTPLYSNTTLVCFNPTLAGGGTVVLMKKFDARGFLELAQKYRVTHAMLVPVQYRRIMALPEFGQFDLSSFQMKFCTSAPFAPELKADILKRWPGGLTEYYGMTEGGGSCTLLAHEFPNKLHTVGQPRPGHEIRMIDEDGNFLPNGEVGEIVGRSDTIMKGYLNQPQKTAEVFWTDKDGNLWVRSGDVGRFDADGFITLMDRKKDMIISGGFNIYPSDIEAVAAKHPDVLEVAVVGMPSEEWGETPVAFVAARPGRSIDPAELKTWTNGQVGKTQRLAEVVLVESLPRSAIGKVLKRELRDQRLGMKAAS

SEQ ID NO: 52595 - protein, 392 aa, Hypecoum imberbe
DLEPVNPSDVPITAAGALKSYKLAAKAISRLQSLPSGNIPLLCDVLAREVRELTGYDRVMVYKFHEDEHGEVIAECRELDLEPYLGLHYPATDIPQASRFLFLKNKVRMICDCSAQPVKVIQDEKLAQPLSLCGSTLRAPHGCHSQYMTNMGSVASLVMSLTINEDDDEMETSTQKGRKLWGLVVCHHTSPRFVPYPLRYACEFLIQVFGIQLNKEVELASQLMEKHILKMQTVLCDMLLRDAPVGIVAQSHNVMDLVKCDGAALYYRNKLWLLGVTPTEAQVRDIARWLLECHYGTTGLSTDSLMEAGYPGASGLGDAVCGTAAISITSKDFLFWFRSQTAKEIKWGGAKHDPMDKDGLRKMHPRSSFKAFLEVVKCRSVPWEDIEMDAIQ

SEQ ID NO: 52596 - protein, 459 aa, Illicium oligandrum
SGKPFYAIMHRIDVGLVIDLEPVNPADVPITAAGALKSYKLAAKAISRLQSLPSGNIGILCDVLVREVSELTGYDRVMAYKFHEDEHGEVIAEYRRTDLEPYLGLHYPATDIPQASRFLFMKNKVRMICDCYAPPVKVIQDKKLAQPLSLGGSTLRAPHGCHAQYMANMGSIASLVMSVTINEDYDETSSNQQKGRKLWGLVVCHHTSPRFVPFPLRYACEFLLQVCGIQLNKEVELVAQMKEKHILKTQTLLCDMLLRDAPIGIMTKSPNVMDLVKCDGAALYYGKQLWLLGITPTEAQIRDITEWLLECHDSTTGLSTDSLMEAGYPGATTLGDTVCGMAAIKVASKDFLFWFRSHTAKEIKWGGSKHDPADKDGKKMHPRSSFKAFLEVVKRRSLPWEDVEMDAIHSLQLILRGSLQQVLESETKAIVDARLDDEQIQGPDELRIVTNEMVRLIET

SEQ ID NO: 52597 - protein, 170 aa, Glycine max
  misc_feature (26)..(26): Xaa can be any naturally occurring amino acid
SLEKAYMSTKARGSSTACIITLKDQXIHAVNLGDSGFVVVRDGRTVLRSPSQQHDFNFTYQLESGGSSDLPSSAQVFHFPVAPGDVIVAGTDGLFDNLYNNEISGVIVEALRVGLEPQVAAQKIAALARQRATDKNRQSPFASAAQEAGYRYYGGKLDDITVVVSYVKSA

SEQ ID NO: 52598 - protein, 157 aa, Glycine max
AKVVVASVEDKLEIVASRKVKLEADMLLDEAAKLSYDLIVLPGGLGGAQTFANSETLVSLLKKQRESNIYYGAICASPALVLEPHGLLKGKKATAFPVMCNKLSDQSEVENRVVVDGNLITSRGPGTSIEFALAIVEKLFGRKLALELAKAVVFARP

SEQ ID NO: 52599 - protein, 468 aa, Pseudomonas syringae pv. tomato str. DC3000
MGLNDQWMQRDLKVLWHPCTQMKDHENLPLIPIKRGEGVWLEDFEGKRYLDAVSSWWVNVFGHANPRINQRIKDQVDQLEHVILAGFSHQPVIELSERLVKLTPEGLTRCFYADNGSSCIEVALKMSFHYWLNRGQPAKKRFVTLTNSYHGETMAAMSVGDVPLFTETYKALLLDTIKVPSPDCYHRPDGMGWEEHSRNMFAAMEQTLAEHHASVAAVIVEPLIQGAGGMRMYHPIYLKLLREACDRYGVHLIHDEIAVGFGRTGTMFACEQAGIRPDFLCLSKALTGGYLPLAACVTTDDVYDAFYDDYPTLRAFLHSHSYTGNPLACAAALATLDIFEQDNVIENNKALAQRMATATAHLVDHPHVAEVRQTGMAIAIEMVQDKATKTAYPWQERRGMKVFQHALERGALLRPLGSVVYFLPPYVITPEQIDFLAEVATEGIDIATRSSISVAVRENFHPDFRDPG

SEQ ID NO: 52600 - protein, 582 aa, Ralstonia eutropha JMP134
MSSNFQPASNWPALSLAEAHARLTAPGAPFETETRMIRGIPTTVWKNAPPTLRDLFQATQAFGERTFVVYEDERVTYAAFRRAALHVAHALVRDGIRPGDRVALAMRNLPEWPVAFYGALLAGAIVTPLNAWWTGAELEYGLNDSGSRVAIVDAERLDRLASHLTACPALERVYVSRAGAVDGEAKVVSLESVTGASPAWAILPDLALPDVAIDPEDDATIFYTSGTTGKPKGALGTHRNATTVAVASLFGPLRNLLRRGEPIPAPDPAAPQKAALLSVPFFHVTGCMAVLNSALANGGKIVLMHRWDALRALELIERERCTTAGGVPTIAWQLLEHPERDRFNLSSLESMSYGGAPASPELVRRIGETIPQSAPGIGWGMTETSATFTSHSAEEYVLRPDSSGPALPIGEMKIVDGRGQSLPVGETGELMVRGANVVRGYWNKPEATSQTFADGWLRTGDIGRLDDEGHLYIVDRMKDMLIRGGENIYCIEVESTLYEHPAVMDAALVGIPHKTLGEEPGAVVSLKPGMQATEDELRGFVAERLAAFKVPVRIVVLPDLLPRNANGKILKSNLRKLFEPAA

SEQ ID NO: 52601 - protein, 254 aa, Ralstonia eutropha JMP134
MSLFDLSGKVAIVTGSSRGIGRAIAEQMAVQGAKVVISSRKLEACQEVVDAINARHGAGTAIAVPANISSRDDLQRLVDETNRTFGKVDVLVCNAASNPYYGPMSGVSDDQFRKVLDNNVISNHWLIQMVAPQMIERKEGSIIIVSSIGGLRGSPTIGVYNISKAADFQLARNLAVEFGPHNVRVNCIAPGLIKTDFARALWEDPERYKQSTQGAPLRRIGEPIEIAGAAVYLASAASSFMTGQAMVVDGGVTI

SEQ ID NO: 52602 - protein, 372 aa, Arabidopsis thaliana
MGWLRKKKKPKSDIASERGAKLLEELIECCDGKSNPIKFFSADEILKATNDFSDSNFVLRLEVPFKWYSGKNENHPMILIKKDVGWWSGLRVDRLCRDIAVSSMVSGHKNFMKLVGCCLELDYPVMVYHSVKKHYKLEISEQPWKKRMKIAEDIATALAYLHTAFPRPFVYRILSHWNILLDEDGVAKLTDFSHCVSIPEGETFVRVDRDVGLYSYFADNYVRSGLVSDKTDVFAFGIFMGHRLLLGYEYYFEHYRGEEEESEDGFDSLMKRHARNLLSTLKEDRPMEEIADSKMIEKMGQISEQERCQMKAFLKLSLRCTGPSEEVPTMVEVAKELNKIQRSLFNDSSSLSSGQTQLDSAQDISSTVVLSN

SEQ ID NO: 52603 - protein, 405 aa, Glycine max
PDKFKEMATKVYDFQKPDTSPLFKLLASGFANYDGDKWAKHRKIVSPAFNVEKMKLLVPIFCQSCDDLISKWESLLSSSNGSCELDVWPFVQNVSSDVLARAGFGSSYQEGKKIFELQREMIQLTMTLFKFAFIPGYRFLPTHTNRRMKAIDKEIRESLMVIINRRLKAIKAGEPTNNDLLGILLESNYKESEKSSGGGMSLREVVEEVKLFYLAGQEANAELLVWTLLLLSRHPDWQEKAREEVFQVFGNEKPDYERIGQLKIVSMILQESLRLYPPVVMFARYLRKDTKLGELTIPAGVELVVPVSMLHQDKEFWGDDAGEFNPERFSEGVSKATKGKLSYLPFGWGPRLCIGQNFGLLEAKVAVSMILQRFSLHFSPSYAHAPSFIITLQPERGAHLILRKL

SEQ ID NO: 52604 - protein, 350 aa, Medicago sativa
MLDAVNEPENTELRHHDRRKCTHDRFMGSNFQLKDSDRPSSSIDSITNRADQILDDADVGECEIPWEDLVIGERIGLGSYGEVYRADWNGTEVAVKKFLDQDFSGAALSEFKREVRIMRRLCHPNVVLFMGAVTRPPNLSIISEFLPRGSLYRILHRPNCQIDEKQRIKMALDVARGMNCLHASTPTIVHRDLKSPNLLVDNNWNVKVCDFGLSRLKHNTFLSSKSTAGTPEWMAPEVLRNEPSNEKCDVYSFGVILWELATLRLPWSGMNPMQVVGAVGFQNGRLEIPKELDPLVARIIWECWQQDPNLRPSFAQLTVALKPLQRLVIPSHQDQVASPLPQEISVNSTP

SEQ ID NO: 52605 - protein, 353 aa, Rhodococcus sp. RHA1
MEHSFNQTSAPCADHPQRPIRESALTTIQTQTNRNGLDVLAIGRCGVDIYPLQTGVGLEHVETFGKFLGGSAANVTVAAARLGCRSALISGVGNDPFGRFVRTALTDLGVDNRYVGIDTEHPTPVTFCEIFPPDDFPLYFYRKPVAPDLQVTPADIDLDAVRDAKLYWSTVTGLSEEPSRSAHFAAWEARGRRTHTVLDLDYRPMFWSSAADATAQVQRALQHVTVAVGNREECEIAVGEANAHKAADALLDLGVELAIVKQGPKGVLGKTRSQSITVPPNDVQVVNGLGAGDSFGGTLCHGLLAGWPLEKILRYANAAGAIVASRLECSTAMPTADEVRALADSTTSEAVNV

SEQ ID NO: 52606 - protein, 138 aa, Exiguobacterium sibiricum 255-15
MEQTFLMVKPDGVERGLIGEIIARIERKGFVIREMKMMQVTEELAQAHYAEHAEKPFFGELVTFLTSGPVVALRVEGEDVVTVSRMMIGKTKPTEALPGTIRGDFANTMSENVIHGSDSVESAERELGLWFQGQPLNV

SEQ ID NO: 52607 - protein, 464 aa, Lardizabala biternata
SGKPFYAIIHRVTGSLIIDFEPVKPYEVPMNAAGALQSYKLAAKAIARLQSLPNASMDRLCDTVVQEVFELTGYDRVMAYKFHDDDHGEVVSEITKPGLELYLGLHYPATDIPQAARFLFMKNKIRMICGCNATHVKVFQDEKLPLDLTLCGSTLRAPHSCHLQYMDNMGSIASLVMAVVVNEGDEENDGSGPAQPQKRKRLWGLVVCHNTTPRFVPFPLRYACEFLIQVFAIHINKELELENQVLEKTFYVPQTLLCDMLMRNAPLGIVSQSPNIMDLVKCDGAALLYKNKIWRLGLSPSEFHIRDIASWLYEYHMDSTGLSTDSLHDAGFPGALSLGDGVCGMAAVRITSKDMIFWFRSHIATEVRWGGAKHDPSEKDDGRKMHPRSSFKAFLEVAKTRSLAWKDYEMDAIHSLQLILRNAFKDGDTADLNSSVIHSRLDNLKIDGMEELEAVTNEMVRLME

SEQ ID NO: 52608 - protein, 394 aa, Lardizabala biternata
DLEPVNRADVPVTAAGALKSYKLAAKAISKLQSLPSGNISLLCDVLVHEVSDMTGYDRVMVYKFHEDEHGEVVSECLRSDLEPYLGLHYPATDIPQASRFLFLKNKVRMICDCSARSVEIIQDKRLTQPLSLGGSTLRAHHGCHTQYMSNMGSVASLVMSITINDDDDDDETETTKRKGRKLWGLVVCHHTSPRFVPFPLRYACEFLIQVFGIQLTKEVELATQLREKHILQIQTVLCDLLLRNAPVGIFTQSPNVMDLVKCDGAALYYKNKFWLLGVTPTEAQIREIAAWILEYHDGSTGLSTDSLMEAGYPGASVLGNAVCGMAAINITSKDFIFWFRSHTAKEIKWGGAKHDPVDKDDGRKMHPRSSFRAFLEVVQWRSLLWEDIEMDAIQ

SEQ ID NO: 52609 - protein, 463 aa, Rhodococcus sp. RHA1
MSDTSLARRHRVVVIGSGFGGLFATKALKRTDVDVTLIDRTTHHLFQPLLYQVATGILSEGEIAPATRLVLEDQQNASVLIGGVEKIDVADRTVTSTHRGRTTVTEYDSLVVSAGARQSYFGNDHFAEHAPGMKTIDDALELRGRILGAFESAEVSTDPAERERLLTFVVVGAGPTGVEMAGEIAQLAHRTLAGAYRTIDPRDARIILLDAAPTVLPPFDEKLRRAAADTLEDLGVEIQLGAMVTDVDDDGLTVRDQDGDERRIEAACKIWSAGVAASPLGRQLAEQTGAATDRAGRVLVEPDLTLPGHSNVFVVGDMMNRDGLPGVAQVAIQGGRYAAQLIAAEVRAHRKGREKPERAPFRYTDKGSMAMISRFHAVAKVGRLQLTGLLAWLLWLLIHLVYIVGFKSRLATAMSWTWSFLGRTRGHLAVTEQQVVARTAINRLDAWEDSSRAVPEAAAAPAR

SEQ ID NO: 52610 - protein, 466 aa, Lilium superbum
SGKPFYAIVHRVTNCLIIDFEPVNHTESPTTAAGALQSYKLAAKAIAKLQSLPGGSVRRLCETVVQEVFELTGYDRVMAYRFHEDDHGEVFTEVTKPGLEPYVGLHYPATDIPQAARFLFMKNKVRMICDCRARPVKIHQDDKLPAEITFCGSTLRAPHSCHLQYMENMNSIASLVMAVVVNDDDEVLDEQGAPSRQQSGRKKLWGLVVCHHLSPRFVPFPLRYACEFLMQVFAIHVNKEFELENQIREKNILKTQTLLCDMLLRDGDPIGIVSQSPNIMDLVKCDGAALLYNNRIWQLGMAPTGSQIHDIAFWLAESHMDSTGLSTDSLLDAGYPGALALGDTVCGMAAARITTKDIVFWFRSHTASEIKWGGEKHDPEEEDDGRRMHPRSSFNAFLQVVKNRSLPWNDYEMDAIHSSQLILRGTLDDNGKSKKGSLDSGMGDMRLDGMVELQAVTNEMVRLIIT

SEQ ID NO: 52611 - protein, 394 aa, Lilium superbum
DLEPVNPDDIPVATAGALKSYKLAAKAISRLQSLPSGNISLLCDAMVREVSELTGYARVMAYKFHEDEHGEVIAECKRPDLEPYIGLHYPATDIPQASRFLFMKDKVRMICDCTAPSVRVIRDRQLLQPPSLCGSTLRAPHGCHAQYMANMGSIASLVMAVTVNEDDDETDSNNQPKARKLWGLVVCHHTSPRFVPYPLRYACEFLLQVFGIQINKEVELAAQAKEKHIFRIQTVLCDMLLRDAPIGIFKKSPNVMDLVKCDGAALYYKNQFWRLGTTPTEAQIKDIVNWLLECHDGTTGLSTDSLTEAGYPDASSLGDEVCGMATISITLKDFIFWFRSHTAKEIKWGGAKHEPTDKDDDGRKMHPRSSFKAFLEIVKLRSLPWEDMEMDAIQ

SEQ ID NO: 52612 - protein, 465 aa, Pachysandra americana
  misc_feature (232)..(232): Xaa can be any naturally occurring amino acid
SGKPFYAIVHRVTGSLIIDFEPVKPYEVPMTAAGALQSYKLAAKAIARLQSLPSGSMERLCDTMVQEVFELTGYDRVMAYKFHEDDHGEVVSEITKPGLEPYLGLHYPATDIPQAARFLFMKNKVRMICDCNAKHVKVLQDEKLPFDLTLCGSTLRAPHSCHLQYMDNMGSIASLVMAVVINEGDEDGEGSDPAQPQKRKRLWGLVVCHNTSPRFVPFPLRYACEFLAQVFXIHVNKEIGLENQILEKNILRTQTLLCDMLMRDAPLGTVSQSPNIMDLVKCDGAALLYKNKIWRLGMAPGDFQINDISSWLSEYHMDSTGLSTDSLYDAGYPGALALGDVVCGMAAVRITTKDMLFWFRSHTAGEVRWGGAKHERGEKDDGRRMHPRSSFKAFLEVVKTRSLPWKDYEMDAIHSLQLILRNAFRDVETMDLDTNTIRMQLNDLKIKGMEELEAVTNEMVRLMET

SEQ ID NO: 52613 - protein, 462 aa, Burkholderia mallei ATCC 23344
MQPAPLARPASHGADAAESAHDLVYGPDERPAPMIACVAALQHLLAILVPIVTPGLLICQALGVSSRDTTLIVSMSLVISGIATFVQCRRFGPLGAGLLIVQGTSFNFVGPLIAGGSLMVKQGTPVETVMAAIFGVVIAGSFVEMAVSRILPFVKRLITPLVTGVVVLLIGLTLIKVGLVSMGGGYGAIAKGSFGSAQNLTLSGLVLGAIIVLNRVPIVWVRSTALVIALAIGYLAAAAMGRLDFTGAREAALFQIPTPLHFGLGFSWALFVPMLIIYLVTSLEAIGDVTATSKISRQPVEGPLWMRRIKGGVLVNGANSLLAGVFNTFPSSVFAQNNGVIQLTGIASRHVGIWIAGMLVLLGLFPVVAGVLQAVPEPVLGGAAMVMFGAVAASGINILAGIRLDRRALLIIAVSLALGLGVSQAPEILTNLPHALGNVLESGVATGGICALVMNWFLPEKQ

SEQ ID NO: 52614 - protein, 446 aa, Corynebacterium glutamicum ATCC 13032
MNSEQEFVLSAIEERDIKFVRLWFTDILGHLKSVVVAPAELESALEEGIGFDGSAIEGYARISEADTIARPDPSTFQVLPLEAGISKLQAARLFCDVTMPDGQPSFSDPRQVLRRQVQLAADEGLTCMISPEIEFYLVQSLRTNGLPPVPTDNGGYFDQATFNEAPNFRRNAMVALEELGIPVEFSHHETAPGQQEIDLRHADALTMADNIMTFRYIMKQVARDQGVGASFMPKPFQEHAGSAMHTHMSLFEGDTNAFHDPDDSYMLSKTAKQFIAGILHHAPEFTAVTNQWVNSYKRIVYGNEAPTAATWGVSNRSALVRVPTYRLNKEESRRVEVRLPDTACNPYLAFSVMLGAGLKGIKEGYELDEPAEDDISNLSFRERRAMGYNDLPSSLDQALRQMEKSELVADILGEHVFEFFLRNKWREWRDYQEQITPWELRNNLDY

SEQ ID NO: 52615 - protein, 841 aa, Zea mays
  misc_feature (750)..(750): Xaa can be any naturally occurring amino acid
MAAPPEGNVRLGEGWDEDDVLEPQPLEVIAPDVKSKKRNPAPGVRVVGRRIYDPENGKTCHQCRQKTTDFAAACKQVKKKGWSGFLRYGESAEEAAGKEDWICPKCRGICNCSFCRKKKGEMPTGIMAHIAKASGCTSVHDLLKKGSDVVSAAQAILKVNGSDKGTKRSRGTDAAAEVATEKDVNIGIDINTVIADEGDENIGVDLNSLPSVDTKKRQKRQKLKHRTKKDPADATSHGVNTEPLQMDGNLDFLNSKTVRPRGTPVTKIAGAELDDEDTGAAIQFIEFCRAFTELRNWIDMQNDIAAEPVNAAREKARAAKEMELKERLKDNMNKIIVSPNEAAASNSEANKYIISQIKEAQEVKRAAINEYNKVQGLKSAKEIWDVLKTAHEGDEETKITKWETIEGELGRFVLNQGEEPQAMYNRLKTLMSPEEVIGKFVSFELMIKDSKHIANLEQDATSTTEVQPVAFKATEEKKEESISSRLPIDASKLDNEEMTLIIKSLRQILKQRRGKDHKLRSKRVCYKCGKPGHFIAKCPMYSDSDRGDDKRGKKKEKKKYYKRKGGDAHEKSQTQETLKGLLRRAQNEFGLRIKKIRSENGMEFNNSQIEGFLEDEGMKHELSSPYTPQQNGVVERKNRNLLDMARTMLDEYKTPDRFWAEAINTACYSINRLYLHQILKKTSYELLTKGFLLGYDSNTRAYRVFNKSTGLVEVSCDIVFDETNGYQVEQVDLDELDDEEVPCVALRNMXQDNEDEHQEDEPPQEEDKDQGGDEVDQDKKDDQEIQGQRSRHPRVHQAIQRDHPINSILGDIHKGGGECTKRFRFGADNERGTQNFTRNEV

SEQ ID NO: 52616 - protein, 394 aa, Oryza sativa
MPLRLPCAMETRPPRAAAPAPARVSRFRRLLVRVSAEPERAGGGGGGEVREKEEKAAEMEVGSVGLDRMVLSFMEDSAAAAVERPPRGRCGSCFNGGGDGSDDEEFDFLPSDSSATAAASAAAAAGDALDALKGLVQSASMAERNLLADASRIAERCRKGGKKKADVRCAVADGLAALGYDAAVCKSRWDKTPSYPAGEHEYIDAVVAAETRLVVEVDFRSEFEVARSTKAYRAALQALPPLFVGTPDRLGQIVAVVAEAARQSLRKKGLHVPPWRKPEYMRAKWLSPQVLRCSDKPPPPPPSPPPTPVSLSSFSGEFELRFDAKTPPNLSATAAGDDNDNDNDDEVEAKKITMVVSPSPWRPVEPEAASKKRSPPPPPRRPEGKVVTGLAAVL

SEQ ID NO: 52617 - protein, 499 aa, Aquifex aeolicus VF5
MKILKAHEMSSIDNKTIEEIGIPSLVLMENASKGVFENIRKYFPDAKNILVVAGKGNNGGDGLALARHLYLNGFSVDIFLAFGEVKGDAKTQLEILKKIGIEPLKKKPDFKEYDLIVDAIFGTGFQPPVKGEVANLIKEINNSSVPIVSIDIPSGLSADTGESFEPSVKADLTVTFQFPKICHYLYPAAKKCGKVEVVDISIPEFLAKDVKRDLLRKSDLKPYKREPDTYKTKEGSVLLVGGSVGKTGAVIMSAKAASRAGAGLVTVGIPRELNPIFESLLIEEMSLPLSGTSRLSVFCVEEILELKDRFHALGIGMGMDRYEEGQDIVISLLEKWEKPILIDADGINNLADYGDYTPLKDREIPAVLTPHIGEFSRLTGYDTKTITYNQIDIAQEFSEKNRCYLVLKGARTVISTPDGRAYLFADGTPALAKGGTGDVLAGILTALIAKMDTEEALKLGVYLHGLAGKVAEKKLHTESVKATDVTESLPEAFREIYVN

SEQ ID NO: 52618 - protein, 240 aa, Ehrlichia ruminantium str. Welgevonden
MSLLIVANWKMHGDFFTFSSFTKELSNRLINIEDKVKVVLCPPFIALSTYVNCPHNIKFGGQNCCYVSSGKYTGEISASMLYNSGCSYVIVGHSERRSTFHETDHDVRLKAECAIESGLIPIICVGETLLDRENGMLKDTLLSQCSKSFPKNGKFIIAYEPVWAIGNNKIPSTDVIIEALEIIRSYDYVSDIIYGGAVNHTNVGDIVSINQLSGVLVGSASLDMESFFNIICSAINVGQS

SEQ ID NO: 52619 - protein, 88 aa, Glycine max
  misc_feature (28)..(28): Xaa can be any naturally occurring amino acid
DHRIQPSNNVGPHHTGHRATSAPAEVLXKEKKYITSEELKGHNKEGDLWISIQGKVYNVSDWVKEHPGGDVPISNLAGQDVTDAFIAY

SEQ ID NO: 52620 - protein, 216 aa, Brassica napus
MKMKSVFDAPEIKSEFESAGINPNFMIPIWKYVIQNPDCVWDEIPSLPTAAYTLLHSKFKTFTSSLHSLFHSSDGTTSKLLIKLQNGAFVEAVIMRYDTRLGMCGGKPRPGGVRSTLCISSQVGCKMGCTFCATGSMGFKSNLTSGEIVEQLVHAPRLADIRNIVFMGMGEPLNNYNAVVESVRAMLKQPFQLSPKRITIFTVGVVHAINKLHNDL

SEQ ID NO: 52621 - protein, 320 aa, Exiguobacterium sibiricum 255-15
MSLHSIYRDVTKEVSLVDQFLIRHIASSDPTIDAAGQQLLQAGGKRIRPAFVLLASKFGQADRDELVRVAASLELVHMASLVHDDVIDDAELRRGKPTVMQHFDEEVALYSGNFLFGEAVKLIGEVGKPELVQVMVHAMREICEGEIEQIYDQYDWEQSIKRYIKRIERKTAILIEASCHLGAIVANCSPEDTKALRQFGRDIGLAFQIADDLLDFTAKRTELGKPVAEDLRHGHKTLPVFYASEDREFFRELQKIRSMPSHEEVAPLLDRLQRSDALERTQQTVDLYIRRAILRLNHLPKSSAKRSLEEVARYVGKRKG

SEQ ID NO: 52622 - protein, 428 aa, Oryza sativa (japonica cultivar-group)
MAATIVSVKARQIFDSRGNPTVEVDVCCSDGTFARAAVPSGASTGVYEALELRDGGSDYLGKGVSKAVDNVNSVIAPALIGKDPTSQAELDNFMVQQLDGTKNEWGWCKQKLGANAILAVSLAICKAGAIIKKIPLYQHIANLAGNKQLVLPVPAFNVINGGSHAGNKLAMQAEFMILPTGAASFKEAMKMGVEVYHNLKSVIKKKYGQDATNVGDEGGFAPNIQENKEGLELLKTAIEKAGYTGKVVIGMDVAASEFYNDKDKTYDLNFKEENNDGSQKISGDSLKNVYKSFVSEYPIVSIEDPFDQDDWEHYAKMTAEIGEQVQIVGDDLLVTNPTRVAKAIQEKSCNALLLKVNQIGSVTESIEAVKMSKRAGWGVMTSHRSGETEDTFIADLAVGLATLLRIEEELGAAAVYAGAKFRAPVEPY

SEQ ID NO: 52623 - protein, 391 aa, Vibrio fischeri ES114
MVVHLIHAIMARSLELPAIVGTNDITKQVKNGDMLILDAVNNKIVINPSEAELTESKKIRDDLVAEKEELAKLKDLPAITLDGHQVEVCGNIGTVKDCDGIIRNGGEGVGLYRTEFLFMDRDALPTEEEQYVAYKEVAEAMHGEPVIIRTMDIGGDKDLPYMDLPEEMNPFLGWRAVRISLDRREILRDQLRGILRASAHGKLRIMFPMIISVEEIRELKKAIEEYKAELRAEGHAFDENIEIGVMVETPAAAAIAHHLAKEVSFFSIGTNDLTQYTLAVDRGNEMISHLYNPLSPAVLLVIKQVIDASHKEGKWTGMCGELAGDERASLLLLGMGLDEFSMSGISIPRVKKIVRNATFADVKKMADEALQMPTAAEIEAHVEKFIAENTK

SEQ ID NO: 52624 - protein, 503 aa, Rhodococcus sp. RHA1
MSRCVSIPQKGQHLMSTTHSAASARGSGGAARNERSHKRFLTKLTVISTLGGLLFGYDTGVISGALLYMKDELNLSAVGEATVVSSLLFPGAAVGALLGGRLSDALGRKRTLLVCAGLFLIGALGCAMAPNVEIMVLARIVLGLGVGAAAVTCPLYLAEMAPVERRGRMVTINELMIVTGQMLAFSINALLDHLIEDPTVWRYMLAIASVPAVLLLLGMLALPDSPRWYASKGRLAETRSTLELSRSESEAAVEYASISLHAARDRNSKVSGAVHYLRDYPWMRRILWIGCGLAIVQQATGINTVNYYAPTILEQSGLGVSASLVATIAVGVTSVVMTILGIILLGFVNRRKMLLTGFIGVASSQAALSLVFLLPSSTGRSYIILAAMMVFVAFVQCFIGTCVWLLLSEIFPMAIRGFAMGIAVFVLWTTNALISFVFPILNSVLGSTGTFGLFVLVNLISVYFVYRFVPETKGRSLEELEDRLGAGRPDASAAGSTAAVAAH

SEQ ID NO: 52625 - protein, 232 aa, Triticum aestivum
  misc_feature (49)..(49): Xaa can be any naturally occurring amino acid
  misc_feature (197)..(197): Xaa can be any naturally occurring amino acid
  misc_feature (225)..(225): Xaa can be any naturally occurring amino acid
NKFVQKSRLVPVRNSRDIVDPRVRGFNYIKESFDKGTLHLIGLLSDGGXHSRLDQVQLIVKGASERGAKRIRLHILTDGRDVLDGSSVGFVETIEKDLAQLREQGVDARIASGGGRMYVTMDRYENDWSVVKRGWDAQVLGEAPHKFQNALEAVKTLRAEPKANDQYLPPFVIVDESGKSVGPIVDGDAVVTFNFRXADRMVMLAKALEFPDFDKFDRVRVPKIXYAGDASI

SEQ ID NO: 52626 - protein, 412 aa, Pachysandra americana
SGKPFYAIMHRIDVGLVIDLEPVNPADVPVTAAGALKSYKLAAKAISKLQSLPSGNISLLCDVLVKEVNELTGYDRVMVYKFHEDEHGEVVAECRRTDLEPYLGLHYPATDIPQASRFLFLKNKVRMICDCLAPPIRVIQDKRLEQPLSLCGSTLRAPHGCHAQYMENMGSIASLVMSVTINEDDDDDDVESDQQKGRKLWGLVVCHHTSPRFVPFPLRYACEFLIQVFGIQINKEVELAAQTKEKHILRNQTMLCDMLLRESPVGIVTKSPNVIDLVKCDGAALYYKNKFWLLGVTPTEAQIRDISEWLIEYHNGSTGLSTDSLMEAGYPGASVLGDAVCGMAAIKITSKEFLFWFRSQTAKEIKWGGAKHEPFNKDDARKMHPRSSFKAFLEAVKQRCLPWEDVEMDAIQ

SEQ ID NO: 52627 - protein, 554 aa, Pleea tenuifolia
  misc_feature (346)..(346): Xaa can be any naturally occurring amino acid
DLEPVNPADVPVTAAGALKSYKLAAKAISKLQSLPTGNISLLCDVLVREVSDLTGYDRVVAYKFHEDEHGEVIAECRRSELEPYLGLHYPATDIPRASRFLFMKNKVRMICDCSAAPVKVIQDKRLAQPLSLCGSILRAPHGCHAQYMASMGSVASLVMSVTIIEDDNETGSDQQEKGRKLWGVVVCHHTSPRFIPFPLRYACEFLIQVFCMQLTKEVELADQMREKHILQTQTVLCDMLLRDAPVGIFTQSPNVMDLVKCDGAALYYRNQFWLLGISPREAQIRDIAGWLLEYHDGTTGLSTDSLLDAGYPGASALGDEVCGMAAIRITDKDFLFWFRSHTAKEXTWGGAKHDLVEKDSDGRKMHPRSSFKAFLEVVEGRSLPWEDVEMDAIHSLQLILRDSLQGERASIDSKAIVNAPLDDAKKIQGMDELSLVTNEMIRLIETAAVPILAVDVLGNVNGWNIKAAELTGLVVQQAIGMPLIDLVEGDSIDVAKNMLFLALQGKEERDVEIKLKTFGHQEKNGPKILVVNACCSRDMKEDIVGVCFVAQDVT

SEQ ID NO: 52628 - protein, 712 aa, Oryza sativa (indica cultivar-group)
MQYRTQQAMLPAVKLSPGPVAFAGTNLRSRSASVSSVSSLKPSKFVVSSFRPLYLAPLDGPRAAGQKAQRQPLEFRCAASAADDKESKTEVVPVRSEAAQKLKISIYFATWWALNVIFNIYNKKVLNAFPYPWLTSTLSLACGSAMMLVSWATRLVEAPKTDLDFWKVLFPVAVAHTIGHVAATVSMSKVAVSFTHIIKSAEPAFSVLVSRFLLGETFPVPVYLSLLPIIGGCALAAVTELNFNMVGFMGAMISNLAFVFRNIFSKRGMKGKSVSGMNYYACLSIMSLVILTPFAIAMEGPQMWAAGWQKALAEVGPNVVWWVAAQSVFYHLYNQVSYMSLDEISPLTFSIGNTMKRISVIVSSIIIFHTPVRPVNALGAAIAILGTFLYSQSILVHSFAIGGKATLPRTREAKRRAIELAMYAMTPRCHLPPPCRAASTTPATSTALSTPPPSRAGPDELRSTWAHRAWTLAGSAAVLSSLSTSATLAAADADANGAAAAFAAPLAAALAAYSLADLATGVYHWLVDNYGDADTPVLGPQIAAFQGHHRHPSTITRREPCNNLHALARAVALALPPAGAALAAAGAPASAHAFAAVFAACVVLSQQFHAWAHGNPRRLPPGVGAMQRAGVLVSRAQHGAHHRAPYDNNYCIVSGMWNATLDRHRVFEAMEMVVFLRTGVRPRSWDEPDAAWTEDYDDTAAVAGGDTSLDTQ

SEQ ID NO: 52629 - protein, 467 aa, Pseudowintera axillaris
SGKPFYAIIHRVTGSLIVDFEPVKPYESPMAAAGALQSYKLTAKAISRLQSLPGGSLKRLIDTVVQGVFELTGYDRVMAYKFHEDDHGEVISEVTKPDLEPYLGLHYPATDIPQAARFLFMKNKVRMICDCNAKPMKVYQDEKLTFDLTLCGSTLRAPHSCHLQYMENMGSIASLVMAVVINEREEKDENSGSEQQQEQPKRKRLWGLVVCHNTTPRFVPFPLRYACEFLAQVFAIHVNKELELENQIQEKNILRTQTLLCDMLMRAAPLGIVTQSPSILDLVKCDGAVLLYQNKIWRLGIAPTESQILDIALWLSEYHMDSTGLSTDSLHDAGYPGALSLGDVVCGMAAVRINSKDTLFWFRSHTAAEIRWGGAKHDPNQKDDGRKMHPRSSFKAFLDVVKTRSSPWADYEMDATHSLQLILRGSLKEAEKVDTGTMIHSRLNDLKLEGVVELQAVTNQMVRLMET

SEQ ID NO: 52630 - protein, 395 aa, Pseudowintera axillaris
  misc_feature (154)..(154): Xaa can be any naturally occurring amino acid
DLEPVNPADVPVTAAGALKSYKLAAKAISKLQSLPSGNISLLCDVLVREVSELTGYDRVMTYKFHEDEHGEVIAECRRNDMEPYLGLHYPATDIPQASRFLFMKNKVRMICDCTARPVEVIQDKKLAQPLSLCGSTLTAPHGCHAQYMANMGSXASLVMSVTISEDDDEASSEEHRQKGRKLWGLVVCHHMTPRFVPFPLRYACEFLIQVFGIQLNKEVELAAQLREKNMLRTQTMLCDMLLRDAPVGIVTQSPNVMDLVKCDGAALYYRNQFWLLGTTPTEVQIRDIAEWLLEYHNNTTGLSTDSLMEAAYPGASILGDAVCGMAAVKITNKDFLFWFRSHTAKEIKWGGAKHDPSDKDGDGRKMHPRSSFMAFLDVVKRRSLPWEDVEMDAIQ

SEQ ID NO: 52631 - protein, 293 aa, Listeria monocytogenes str. 4b H7858
MNKENPLNKYHTGKFEKQRQDYPGLQSKMTPVPDTGESSYQGANKLTGKKAFVTGGDSGIGRAAVIAYAREGADVAINYHPDEEVDAQEVKAIVEEAGQKCVLLPGDLRKEGLAKDLVKKAYNELGGLDILVLNAGLQQYQLDIQKLPAEQLRDTFEVNVFSVVFAIQEALNYLKAGASIILTSSIQGVKPSAHLVDYAMTKSSLISLTKSLAAQLGEKGIRINAVAPGPIWTALQISGGQPQDSIPAFGQDQPLGRAGQPAELASAYVLLASDEASYTTGQVYGITGGAPIN

SEQ ID NO: 52632 - protein, 441 aa, Pteridophyllum racemosum
  misc_feature (157)..(157): Xaa can be any naturally occurring amino acid
PYEVPMTAAGALQSYKLAAKAIAKLQPLHSGNMERLCDTVVQEVFDLTGYDRTMAYKFHDDDHGEVISEVTKPGLEPYLGLHYPATDIPQAARFLFMKNKIRMICDCNAKQVKVLQDEKIPFDLTLCGSTLRAPHTCHLLYMKNMGSAASLVMAIVXNEGDEEEEASGPSQPQKKKRLWGLVVCHNTTPRFVPFPLRYACEFLLQVFAIHVNKEFELENQILEKNILRTQTLLCDMLMRDAPLGILSQSPNIMDLVRCNGAALLYKNKIHRLGLTPSDFQIHDIASWLSEHHMDSTGLSTDSLYDAGFPGALSLGDQVCGMAAVRITSKDMLFWFRSHTAAEVRWGGAKHNPSEEDDGRKMHPRSSFKAFLEVVKTRSSPWRDYEMDAIHSLQLILRNAFKDAETADLNATVIHSGLNNLKIEGMEELEAVTNEMVRLIET

SEQ ID NO: 52633 - protein, 133 aa, Brassica napus
  misc_feature (123)..(123): Xaa can be any naturally occurring amino acid
MIRIVQITIILCFSIAAVISISTDDESIYEILKQNGLPSGIFPKGVTEFNFDVKTGRFSVYLNRSCDAKYEAELRYQANVTGTIGDSHVADLSGISAQDLFLWFPVKGIRVDVPSSGLIYFDXGVVRKQYSLS

SEQ ID NO: 52634 - protein, 922 aa, Corynebacterium glutamicum ATCC 13032
MADQAKLGGKPSDDSNFAMIRDGVASYLNDSDPEETNEWMDSLDGLLQESSPERARYLMLRLLERASAKRVSLPPMTSTDYVNTIPTSMEPEFPGDEEMEKRYRRWIRWNAAIMVHRAQRPGIGVGGHISTYAGAAPLYEVGFNHFFRGKDHPGGGDQIFFQGHASPGMYARAFMEGRLSEDDLDGFRQEVSREQGGIPSYPHPHGMKDFWEFPTVSMGLGPMDAIYQARFNRYLENRGIKDTSDQHVWAFLGDGEMDEPESRGLIQQAALNNLDNLTFVVNCNLQRLDGPVRGNTKIIQELESFFRGAGWSVIKVVWGREWDELLEKDQDGALVEIMNNTSDGDYQTFKANDGAYVREHFFGRDPRTAKLVENMTDEEIWKLPRGGHDYRKVYAAYKRALETKDRPTVILAHTIKGYGLGHNFEGRNATHQMKKLTLDDLKLFRDKQGIPITDEQLEKDPYLPPYYHPGEDAPEIKYMKERRAALGGYLPERRENYDPIQVPPLDKLRSVRKGSGKQQIATTMATVRTFKELMRDKGLADRLVPIIPDEARTFGLDSWFPTLKIYNPHGQNYVPVDHDLMLSYREAPEGQILHEGINEAGSVASFIAAGTSYATHGKAMIPLYIFYSMFGFQRTGDSIWAAADQMARGFLLGATAGRTTLTGEGLQHMDGHSPVLASTNEGVETYDPSFAYEIAHLVHRGIDRMYGPGKGEDVIYYITIYNEPTPQPAEPEGLDVEGLHKGIYLYSRGEGTGHEANILASGVGMQWALKAASILEADYGVRANIYSATSWVNLARDGAARNKAQLRNPGADAGEAFVTTQLKQTSGPYVAVSDFSTDLPNQIREWVPGDYTVLGADGFGFSDTRPAARRFFNIDAESIVVAVLNSLAREGKIDVSVAAQAAEKFKLDDPTSVSVDPNAPEE

SEQ ID NO: 52635 - protein, 208 aa, Aquifex aeolicus VF5
MIKKVAAKPLSWLERIFFIDFIKGLRITLKNALRKTITTHYPYEKITPPKRFRGYFAHKVVDGTEPQPAFQEWVNRYNILVEYGKSRCVVCLRCKRACPVPQLFEIEGKKLPNGKRVVSVFNMNMLLCTYCGFCVDACPVDCLYQTDIHENASYTRKDAVLTLEILEQIGRDWQRRREREPDRIWIDDEQRMKLWGENNVKLPKPEEV

SEQ ID NO: 52636 - protein, 391 aa, Sulfolobus shibatae
DLDTLEALSQPERVIQVKIQIRGSDGKLKTFMGWRSQHNSALGPYKGGVRYSPNVTQDEVIALSMIMTWKNSLLLLPYGGGKGGIRVDPKKLTLKELEDLSRKYVQLIHNYLGSDVDIPAPDINTNPQTMAWFLDEYIKITGEVDFAVFTGKPSELGGIGVRLYSTGLGVATIAREAANKFIGGIEGSRVIIQGFGNVGSFTAKFLNEMGAKIIGVSDIGGGVISDDGIDVNKALEVVQSTGSVVNYPEGKKVTNEELLTSDCDILIPAAVENVINKFNAPKVKAKLIVEGANGPLAADADEIIKQRGIVVIPDILANAGGVVGSYVEWANNKSGGIISDEEAKKLIIDRMTNAFNALYEFHKRKFADQDLRTVAMALRVDRVVGMKARAI

SEQ ID NO: 52637 - protein, 352 aa, Oryza sativa (japonica cultivar-group)
MHKNSTPDMLILIQLFCLCYSLVRGYPPGGFVNFIQQNCPPQPQQQGENFHFVGHNMGFNPISPQPPSAYGTPTPQATNQGTSTNIMIDEEDNNDDSRAAKKRWTHEEEERLASAWLNASKDSIHGNDKKGDTFWKEVTDEFNKKGNGKRRREINQLKVHWSRLKSAISEFNDYWSTVTQMHTSGYSDDMLEKEAQRLYANRFGKPFALVHWWKILKDEPKWCAQFESEKDKSEMDAVPEQQSRPIGREAAKSERNGKRKKENVMEGIVLLGDNVQKIIKVHEDRRVDREKATEAQIQISNATLLAAKEQKEAKMFDVYNTLLSKDTSNMSEDQMASHQRAIRKLEEKLFAD

SEQ ID NO: 52638 - protein, 1040 aa, Saccharomyces cerevisiae
DPSDVSPIFNIPLKKQLLFCTKRAFQRSLGDKAYMTAQFISVVIQSLVIGSLFYEIPLTTIGSYSRGSLTFFSILFFTFLSLADMPIAFQRQPVVKKQSQLHFYTNWVETLSTTVFDYCFKLCLVIVFSIILYFLAHLQYKAARFFIFLLFLSFYNFCMVSLFALTTLVAPTISVANLFAGILLLAIAMYASYVIYLKNMHPWFVWIAYLNPAMYAMEAILSNELYNLKLDCSETIVPRGPTYNDVPFSHKACAWQGATLGNDYVRGRDYLKQGLSYTYHHVWRNFGIIIGFLVFFIACTLFASQYIKPYFNKDEIERNNSRLTRWLPFLNKKRGTRSSARNDSKYVGIPKSHSVSSSSSSLSAVPYQISPSNKEMALNDYNEQPITETVETQKHIISWKNINYTVGTKKLINNASGFISSGLTALMGESGAGKTTLLNVLSQRVETGVVSGEILIDGHPLTDEDAFKRSIGFVQQQDLHLDLLSVKESLEISCLLRGDGDRAYLDTVSNLLKLPSDILVADLNPTQRKLLSIGVELVTKPSLLLFLDEPTSGLDAEAALTIVKFLKQLSLQGQAIFCTIHQPSKSVISHFDNIFLLKRGGECVFFGPMDDACGYFMSHDNTLVYDKEHDNPADFVIDAVGNSNSSAGKDTAEEALTLNKEAIDWSALWESSVEKKLVKKETARLEDDARASGVDYTTSLWKQPSYLQQLALITRRQYICTKRDMTYVMAKYCLNGGAGLFIGFSFWHIKHNIIGLQDSIFFCFMALCVSSPLINQIQDKALKTKEVYVAREARSNTYHWTVLLLSQSIIELPLALTSSTLFFVCAFFSCGFNNAGWSAGVFFLNYMLFAAYYSTLGLWLIYTAPNLQTAAVFVAFIYSFTASFCGVMQPYSLFPTFWKFMYRVSPYTYFVETFVSILLHNWEIKCDMSEMVPGQPLTGQSCGQFMEAFIEEYGGYLHNKNTFTVCAYCTYTVGDDFLKNENMSYDHVWRNFGIEWAFVGFNFFAMFAGYYLTYVARIWPKVFKIITKVIPHRGKKPVQN

SEQ ID NO: 52639 - protein, 153 aa, Oryza sativa
IDCGVSIGTIFGIYMIKDKDNVTLDDVLQPGTDMLAAGYCMYGSSCTLVLSTGNGVNGFTLDPSLGEFILTHPNIKIPNRGKIYSVNEGSAKNWDAPTAKFVEKCKFPQDGSPSKSLRYIGSMVADVHRTLLYGGIFLYPADQKSPNGKLRVL

SEQ ID NO: 52640 - protein, 829 aa, Vibrio fischeri ES114
MKMTRRAFVKANAAASAAAVAGVTLPASATNLIVSSDQTKIKWDKAPCRFCGTGCSVLVGTQNGRVVATQGDPEAPVNKGLNCIKGYFLSKIMYGKDRVQTPMLRMKDGQYNKDGDFAPVSWDVALDTMAEKWKAALKKHGPTGVGMFGSGQWTVMEGYAAVKLMKAGFRSNNIDPNARHCMASAVGAFMRTFGIDEPMGCYDDFENADSFVLWGSNMAEMHPVLWTRISDRRLSHPHVKVNVLSTYYHRSFELADKGYIFEPQSDLAIANFIANYIIQNNAVNWDFVNKHTNFKQATTDIGYGLRDDDPLQMEAANPNSGAMSSISFEEYKKSVAPYTAQKASEMSGVSEEDLITLAKQYADPKTKVMSLWTMGMNQHTRGVWMNSLVYNIHLLTGKIATPGNSPFSLTGQPSACGTAREVGTFSHRLPADMVVANPKHRAISEKIWKLPEGTLNGKPGAHAVVQDRMLKDGKINAYWVMCNNNMQAGPNINTERLPGYRNPENFIVCSDPYPTATAQAADLILPTAMWVEKEGAYGNAERRTQAWYQQVQAKGEAKSDLWQIMEFSKRFKVEEVWGEELVAKAPEYRGKTMYDILFKNGQVDAFPLSEAQELNDDAKAQGFYVQKGLFEEYASFGRGHGHDLAPYDTYHTVRGLRWPVVDGKETLWRFKEGSDPYAKKGSDWDFYGKPDGKALIISAPYEAPPEVPNDEFDMWLCTGRVLEHWHTGTMTRRVPELYKAVPDALCYIHPADAKKRNLRRGDEVLISNKRGEVRVRVETRGRNRPPEGLVFVPFFDARILINKLILDATDPLSKQTDFKKCPVKITKIA

SEQ ID NO: 52641 - protein, 168 aa, Oryza sativa (indica cultivar-group)
SSNIDCGVSIGTIFGIYMIKDKENVTLEDVLQPGKNMVAAGYCMYGSSCTLVLSTGNGVNGFTLDPSLGEFILTHPDIKIPKKGKIYSVNEGNAKNWDEPTAKFVEKCKFPKDGSSPKSLRYIGSMVADVHRTLLYGGVFLYPADKKSPNGKLRVLYEVFPMSFLMEQ

SEQ ID NO: 52642 - protein, 461 aa, Pteridophyllum racemosum
SGKPFYAILHRIDVGFVIDLEPVNPLDVPVTAAGALKPYKLAAKAISRLQSLPSGNISLLCDVLAREVSELTGYDRVMVYKFHEDEHGEVVSECRKIDLESYRGLHYPATDIPQASRFLFMKNRARIICDCSATPVKVIQDEKLAQPLSLCGSTLRAPHGCHAQYMANMGSIASLVMFVTINDDDDDIKIETHKGRKLWGLVVCHHTSSRFVPYPLRYACEFLIQVFGIQLNKEVELAVQSREKRILRTQTLLCDMLLRDSPVGIVTQSPNVMDLVRCDGAALYFRNKFWLLGVPPTEKQIRDIVGWLMEHYVGTTGLSTDSLMEAGYPDSSVLGDAVCGMAAINFTSKDFLFWFRSQTAKELKWGGAKHDPVDMDDVRKMNPRSSFNAFLEVVKWRSLPWEDVEMDAIHSLQLILRESMKNEIVNDVKTIVNTTPVIDARLRGMDQLCVVTGEMVSLMET

SEQ ID NO: 52643 - protein, 333 aa, Glycine max
  misc_feature (85)..(85): Xaa can be any naturally occurring amino acid
  misc_feature (94)..(94): Xaa can be any naturally occurring amino acid
  misc_feature (100)..(100): Xaa can be any naturally occurring amino acid
  misc_feature (169)..(169): Xaa can be any naturally occurring amino acid
TKEEPEVIVISSDDESEEKPAAKGKKEREKSARKNAKAFSSVLSARSKAACGLPRDLLGSIDATDMDNELAAAEYLDDIYKFYKXTEKKGWVGXDGGSHXFFNAKMRSILGDWLIEVHRKFELMPETLYLTLNIVDRFLSVKAVPRRELQLVGISSMLIASKYEEIWAXPEVNDFECISDNAYVSQQVLMMEKTILRKLEWYLTVPTPYHFLVRYIKASTPSDKEMENMVFFLAELGLMHYPTAILYRPSLIAAAAVFAARCTLGRSPFWTSTLKHYTGYSEEQLRDCAKIMVNLHAAAPGSKLRAVYKKFCNSDLSAVALLSPAKENCLEQA

SEQ ID NO: 52644 - protein, 431 aa, Thermus caldophilus
MTENAEKFLWGVATSAYQIEGATQEDGRGPSIWDTFARRPGAIRDGSTGEPACDHYHRYEEDIALMQSLGVGVYRFSVAWPRILPEGRGRINPKGLAFYDRLVDRLLAAGITPFLTLYHWDLPQALEDRGGWRSRETAFAFAEYAEAVARTLADRVPFFATLNEPWCSAFLGHWTGEHAPGLRNLEAALRAAHHLLLGHGLAVEALRAAGAKRVGIVLNFAPAYGEDPEAVDVADRYHNRYFLDPILGRGYPESPFQDPPPTPILSRDLELVARPLDFLGVNYYAPVRVAPGTGPLPVRYLPPEGPVTAMGWEVYPEGLYHLLKRLGREVPWPLYITENGAAYPDLWTGEAVVEDPERVAYLEAHVEAALRAREEGVDLRGYFVWSLMDNFEWAFGYTRRFGLYYVDFPSQRRIPKRSALWYRERIARAQL

SEQ ID NO: 52645 - protein, 464 aa, Sarcandra glabra
SGKPFYAIIHRVTASLIIDFEPVKPYEVPMTAAGALQSYKLAAKAIARLQSLPGGSMEKLCDTVVQEVFDLTGYDRVMAYKFHEDDHGEVISAITKPGLEPYLGLHYPATDIPQAARFLFMKNKVRMICDCDAKPVKVFQDEKLVFDLTLCGSTLRAPHSCHLQYMANMNSIASLVMAVVVNEGEEDDSLEPGQQQQRKRKRLWGLIVCHNTTPRFVPFPLRYACEFLMQVFAIHVNKELELESQIQEKNIFRTQTLLCDMLMRDTPLGIVSQNPNVMDLVKCDGAALLYKKKIWRLGLTPSETQIHDISFWLSEYHMDSTGFSTDSLNDAGYPGALAIGDAVCGMAAVWITSKDMLFWFRSHTAAEVRWGGAKHDPDDKDDNRGMHPRSSFKAFLEVVKTRSLPWKDNEMDAIHSLQLILRGTFKDVENSHTKTMIYSQLNDLKLEGMEELQAVTNEMVRLIE

SEQ ID NO: 52646 - protein, 465 aa, Sarcandra glabra
SGKPFYAIMHRIDVGPVIDLEPVNPADVPVTAAGALKSYKLAAKAISRLQSLPSGNISLLCDVLVREVSELMGYDRVMAYKFHEDEHGEVIAECRRSDLEPYLGLHYPATDIPQASRFLFMKNKVRMICDCSAAPVKVIQDKRLGQPMSLCGSALRAPHGCHAQYMANMGSIASLVMSVTINEDDDETESDPQQQQEKPRKLWGLVVCHHTGPRFVPFPLRYACEFLIQVFGIQLNKEVELAAQLREKHMLKTQTVLCDMLLRDAPMRIVTQSPNVMDLVKCDGAALYYRNQFWLLGTTPTEAQIRDIAEWLLDYHDGSTGLSTDSLMEAGYPGASVLGDAVCGMAAVKITSKDFLFWFRSHSAKEIKWGGAKHDPINKDDDGRKMHPRSSFKAFLEVMKQRSLRWEDVEMDAIHSLQLILRGSLQEESENDSKAIVNASLDVAKIQGMDELRFVTNEMVRLIET

SEQ ID NO: 52647 - protein, 411 aa, Rhodococcus sp. RHA1
MSSTRTFVVVGGGLAGAKTAEALRDKDFDGSIVLLSEEEHLPYERPPLSKEHFAGKKALGDFTVHHGDWYRDHHVDLRLGTTATALDLTAHTVTLPDGSTLGYDKLALATGSRSRRPPISGSDAEGVHYLRTIDESDSLIDAVAGGGRLVVIGAGWIGLEVGASAREKGVDVTVVEAAEVPLLGSLGPEIGSVFAELHREHGVQLHLGATVEEIVVDDGKATGVRLSDGTVLPADAVLVAVGAAPNIEIAERAGLDVDGGVLVDAGLQTSDPDVVAVGDIAAQWHPQLGTRIRVEHWANALNQPAVAAATMLGHAAEYGNLPYFFTDQFDLGMEYVGYAPHDSYDRVVVRGDFAAREFVAFWLDADNHVLAGMNVNIWDVTDQIKQLVSSSAPVDPDRLADPEVPLTDLSG

SEQ ID NO: 52648 - protein, 423 aa, Smilax rotundifolia
SGKPFYAIVHRVTGCLIIDFEPVTPTEVPMPAAGALQSYKLAAKAIAKLQSLPGGSMEGLCSTVVQEVFELTGYDRVMAYKFHEDDHGEVFAEITKPGLEPYRGLHYPATDIPQAARFLFMKNKVRMISDCRAKPVKVYQDEKLPFDITFCGSTLRAPHSCHLQYMENMNSIASLVMVVVINEGEEDEEQGQQQHNRKRLWGLVVCHHESPRFVPFPLRYACEFLMQVFAIHVNKEFELENQIREKNILRTQTLLCDMLLRDSDPLGIVTQSPNIMDLVKCDGAALLYENEIWQIGLTPTESQIREIAFWFAEFHADSTGLSTDSLYDAGYPGAVALGDTVSGMAAARITSTDILFWFRAHTAAEIRWGGAKHDPSDKDDGKRMHPRSSFNAFLEVVKGRSLPWNNYEIDAIHSLQLILRGTL

SEQ ID NO: 52649 - protein, 394 aa, Smilax rotundifolia
DLEPVNPADVPVTAAGALKSYKLAAKAISRLQSLPSRNISLLCDVLVREVSELTGYDRVMAYKFHEDEHGEVISECRRSDLEPYLGLHYPATDIPQASRFLFMKNKVRMICDCSAASVKVIQDKKLAQPLSLGGSTLRAPHGCHAQYMANMGSIASLVMSVTINEDDEEMDGDQQQKGRKLWGLVVCHHTSPRFVPFPPRYACEFLLQVFGIQLNKEVELAAQAKGKHIFWMQTLLCDMLLRDAPIGIFTQSPNVMDLVKCDGAALYYRKQFWLLGITPTEAQIKDIVAWLLECHDGTTGLSTDSLTEAGYPGSSALGNAICGMAAIKITSKDFIFWFRSHTSKDIRWGGAKHEPADRDDESQKMHPRSSFKAFLEVVKLRSLPWEDMEMDAIQ

SEQ ID NO: 52650 - protein, 453 aa, Methylococcus capsulatus str. Bath
MSSDSNSAGPAFADLGLAQPLLRAVSEAGYVHPTPIQAQAIPLLLAGGDLLAAAQTGTGKTAGFTLPILHRLLEKQAPRRPRRPRCLILAPTRELAAQVLESVEGYGKYVPLKATVMFGGVGLNPQVRALAAGVDILVATPGRLLDHCGQNTVDLSAVEIFVLDEADRMLDMGFIRDIRRILGLLPKQRQNMLFSATFSDEIRTLADGLLNNPGYVEVARRNAASDLVDQTVHLVAQEHKRDLLTHLIRRHDWRQVLVFTRTKHGANRLAEKLAEDGIPAAAIHGNKSQSARTRALADFKDGTVPVLVATDIAARGLDIDQLPHVVNFELPNVPEDYVHRIGRTGRAGRAGSAVSLVAKEELKLLGSIERLIKRPIQRGTVEGFNPPSRPRIERRDDRSRRPQEVRDGGGRQSPPGQPKARAGLGSRSAARHAQKPQQRQAGNRLRSQGGKRG

SEQ ID NO: 52651 - protein, 90 aa, Oryza sativa
ILAGDHLYRMDYEKFIQAHRETDSDITVAALPMDEKRATAFGLMKIDEEGRIVEFAEKPKGEQLKAMMVDTTILGLDDVRAKEMPYIASM

SEQ ID NO: 52652 - protein, 293 aa, Vibrio fischeri ES114
MFSGSIVALVTPLDTDGEVDYNSLKSLVDYHIKAGTNGIVAVGTTGESATLSVEEHVKLVMKTLEFADGRIPVIAGTGANATHEAVTFSKLFHDSGVAGCLSVTPYYNKPTQEGLFQHYKAISEATDIPQILYNVPGRTAVDLLPETVARLAELDNIVALKDATGDLDRVAITRELCGENFIQLSGDDATALDFVKLGGHGVISVTSNIAAKDMATMFALAAQGKFEEAEIINQRLMPLHNDLFVEANPIPVKWAAHRLGMITHSDIRLPLTELSLSAQPTVEQALKSAGLLK

SEQ ID NO: 52653 - protein, 307 aa, Brassica napus
MAAALPLSPVSHQLCRRSNRFWYNAMTPRFCSPVFSTTSPCLIGVKGIGSSSQLRPRHPLISSAASTDYLLHDVGATVAVLSGAYALVLLFESLTKRDVIPQRLSRKLVHILSGLLFALSWPIFSASTEARYFAAFVPLVNGLRLVVNGLSVSPNSTLIQSVTREGRPEELLKGPLFYVLALLVAAVFFWRDSPTGMISLAMMCGGDGIADIMGRKYGSYKIPYNPRKSLAGSISMFIFGFFISIGLLYYYSSLGYLHMNWETTFTRVAIVSLVATLVESLPITDQIDDNVSVPLATILAAYLSFGY

SEQ ID NO: 52654 - protein, 392 aa, Spathiphyllum wallisii
PYEVPMTAAGALQSYKLAAKAISRLQSLPGGSMQKLTDTVVQEVFELTGYDRVMAYKFHEDDHGEVVSEITKPGLEPYLGLHYPATDIPQAARFLFMKNKVRMICDCHAKPVKVYQDEKLTFDLTFCGSTLRAPHSCHLLYMKNMNSIASLVMAVVVNEGDEEDEPLEHGQQLQQKRKRLWGLVVCHNTTPRFVPFLLRYACEFLMQVFAIHVNKEFELENQIREKNILRTQTLLCDMLLRDAPLGIISRSPNIKDLVKCDGAALLYQNKIWRLGSTPTESHIRDIASWLSEYHMDSTGLSTDSLYDAGYPGALTLGDAVCGMAAARITSKDILFWFRSHTAAEIRWGGAKHDPADEDDGRRMHPRSSFKAFLEVVKTRCLPWKDYEMEAIH

SEQ ID NO: 52655 - protein, 465 aa, Spathiphyllum wallisii
SGKPFYAIMHRIDMGLIIDLEPVNPADVPVTAAGALKSYKLAAKAISRLQSLPSGNISLLCDVLVREVRELTGYGRVMAYKFHEDEHGEVVSECRRPDLEPYLGLHYPATDIPQASRFLFMKNKVRMICDCSAQPIKVIQDKRLAQPLSLCGSTLRAPHGCHAQYMANMGSIGSLVMSVTINEDEDDDSSGEQQQKGRKLWGLVVCHHTSPRFVPFPLRYACEFLMQVFAIQLNKEVELAAQTREKHILRTQTLLCDMLLRDTPVGIFTQSPNVMDLVKCDGAALYYQNQFWLLRVTPTEAQIRDIAAWLIDCHNSTTGLSTDSLSEAGYPSASTLGDAVCGMAAIKITSRDLIFWFRSHTAKEIKWGGAKHDPVDRDDDGRKMHPRSSFKAFLEVVKRRSLPWEDVEMDAIHSLQLILRSSLQDENVRDNSKGIVNVISDDAKKIQGVDELRTVANEMVRLMET

SEQ ID NO: 52656 - protein, 337 aa, Oryza sativa
MGKIKIGINGFGRIGRLVARVALQSEDVELVAVNDPFITTDYMTYMFKYDTVHGQWKHSDIKIKDSKTLLLGEKPVTVFGIRNPDEIPWAEAGAEYVVESTGVFTDKEKASSHLKGGAKKVFISAPSKDAPMFVCGVNEDKYTSDIDIVSNASCTTNCLAPLAKVIHDNFGIIEGLMTTVHAITATQKTVDGPSSKDWRGGRAASFNIIPSSTGAAKAVGKVLPDLNGKLTGMSFRVPTVDVSVVDLTVRIEKAASYDAIKSAIKSASEGKLKGIIGYVEEDLVSTDFVGDSRSSIFDAKAGIALNDNFVKLVAWYDNEWGYSNRVIDLIRHMAKTQ

SEQ ID NO: 52657 - protein, 983 aa, Burkholderia sp. 383
MSLDTNNVRQGGCGSGQCACKSAAQARAGNPFDDTDYGTPQRHADTDVTLEIDGQPVTVPAGTSVMRAAIEAGVNVPKLCATDSLEPFGSCRLCLVEIEGRRGYPASCTTPAEAGMKVRTQSDRLQSLRRNVMELYISDHPLDCLTCPANGDCELQDMAGVVGLREVRYGFDGANHLRDKKDESNPYFTYDPSKCIVCNRCVRACEETQGTFALTIAARGFESRVAAGESESFMASECVSCGACVAACPTATLQEKSVVQLGQAEHSVVTTCAYCGVGCSFKAEMKGTQVVRMTPHKNGLANEGHACVKGRFAWGYATHKDRITKPMIREKITDPWREVSWDEALTYAATQFRKLQDKYGRDSIGGITSSRCTNEETYLVQKLVRAAFGNNNVDTCARVCHSPTGYGLKTTLGESAGTQTFASVGQADVIVVMGANPTDGHPVFGSRLKRRVREGAKLIVIDPRRIDVVDGPHVKATHHLQLRPGTNVAIVNALAHVIVTEGLVADAFVAERCETRAFEQWRDFVSRADNSPEATAGVTGVPAESVREAARLYATGGNAAIYYGLGVTEHAQGSTTVMGIANLAMATGNIGREGVGVNPLRGQNNVQGSCDMGSFPHELPGYRHIGDEVVRAQFEAAWSAKLQPEPGLRIPNMFDAALDGSFKGLYCQGEDIVQSDPNTQHVAAALSEMECIVVQDIFLNETAKYAHVLLPGSSFLEKDGTFTNAERRISRVRKVMPPLAGYADWEVTLMLSRALGYEMDYAHPSEIMDEIARLTPTFSGVSYAKLDTLGSIQWPCNEHAPEGTPTMHIDAFVRGKGKFVITQFIASPEKVTQRYPLILTTGRILSQYNVGAQTRRTENVQWHEEDRLEIHPHDAQDRGIRSGDWVGIESRAGQTVLRALVTERMQPGVVYTTFHFPESGANVITTDSSDWATNCPEYKVTAVQVLPVAQPSDWQQAYARFNAEQLDLLERRAAATATVTTGK

SEQ ID NO: 52658 - protein, 536 aa, Populus tomentosa
MNPQEEFIFRSKLPDIYIPKNLPLHSYVLENLSNHSSKPCLINGANGDVYTYADVELTARRVASGLNKIGIQQGDVIMLFLPSSPEFVLAFLGASHRGAIITAANPFSTPAELAKHAKASRAKLLITQACYYEKVKDFARESDVKVMCVDSAPDGCLHFSELTQADENEAPQVDISPDDVVALPYSSGTTGLPKGVMLTHKGLITSVAQQVDGDNPNLYFHSEDVILCVLPMFHIYALNSIMLCGLRVGASILIMPKFEIGSLLGLIEKYKVSIAPVVPPVMMSIAKSPDLDKHDLSSLRMIKSGGAPLGKELEDTVRAKFPQARLGQGYGMTEAGPVLAMCLAFAKEPFDIKPGACGTVVRNAEMKIVDPETGASLPRNQPGEICIRGDQIMKGYLNDPEATSRTIDKEGWLHTGDIGYIDDDDELFIVDRLKELIKYKGFQVAPAELEALLIAHPEISDAAVVGLKDEDAGEVPVAFVVKSEKSQATEDEIKQYISKQVIFYKRIKRVFFIEAIPKAPSGKILRKNLKEKLAGI

SEQ ID NO: 52659 - protein, 467 aa, Tacca chantieri
SGKPFYAIIHRVTACLIVDFEPVKPSELPMTAAGALQSYKLAAKAIARLQSLPGGSMERLCDTVIEEVFELTGYDRVMVYKFHEDDHGEVFREITKPGLEPYQGLHYPATDIPQAARFLFMKNKVRMICDCRAKPVKIYQDDKLPLDLTFCGSTLRAPHSCHLQYMENMNSIASLVMAEVVNEGEEDDENLEPGQTQQQKKKRLWGLVVCHHESPRFVPFPLRYACEFLMQVFAIHVNKEFELENQIREKNILRTQTLLCDMLLRDTTPVGIMNQSPNIMDLVKCDGAALLYQNKVWRLGLTPTEAQIRDIAYWLAEYHMDSTGLSTDSLHDAGYPGALGLADVVCGMAAARITSKDMLFWFRSHIAAEIRWGGAKHDPADKDDGRRMHPRTSFKAFLEAVKMRSLPWKDYEMDAIHSLQLILRGTFSDSRNVNSRASLDARVNDLKLEGMVELQAVTNEMVRLMET

SEQ ID NO: 52660 - protein, 280 aa, Brassica napus
MAETLKEDSIMIREVWNDNLLEEFALIREIVDKYTFIAMDTEFPGVVLKPVETFKYNNDLNYRTLKENVDLLKLIQLGLTFSDEDGNLPTCGTDKFCVWQFNFREFNIGEDIYASESIELLRQCGIDFKKNVERGIDVVRFGELMMSSGVGQEDSISWVTFHGGYDFGYLVKLLTCKELPLKQADFFKMLFVYFPTVYDIKYLMTFCNGLFGGLNRLAELMGVERVGICHQAGSDSLLTLGSFRKLKERYFPGSTEKYTGVLYGLGVEDSATSTTSTVAN

SEQ ID NO: 52661 - protein, 536 aa, Populus tomentosa
MNPQEEFIFRSKLPDIYIPKNLPLHSYVLENLSNHSSKPCLINGANGDVYTYADVELTARRVASGLNKIGIQQGDVIMLFLPSSPEFVLAFLGASHRGAIITAANPFSTPAELAKHAKASRAKLLITQACYYEKVKDFARESDVKVMCVDSAPDGCLHFSELTQADENEAPQVDISPDDVVALPYSSGTTGLPKGVMLTHKGLITSVAQQVDGDNPNLYFHSEDVILCVLPMFHIYALNSIMLCGLRVGAPILIMPKFEIGSLLGLIEKYKVSIAPVVPPVMMSIAKSPDLDKHDLSSLRMIKSGGAPLGKELEDTVRAKFPQARLGQGYGMTEAGPVLAMCLAFAKEPFDIKPGACGTVVRNAEMKIVDPETGASLPRNQPGEICIRGDQIMKGYLNDPEATSRTIDKEGWLHTGDIGYIDDDDELFIVDRLKELIKYKGFQVAPAELEALLIAHPEISDAAVVGLKDEDAGEVPVAFVVKSEKSQATEDEIKQYISKQVIFYKRIKRVFFIEAIPKAPSGKILRKNLKEKLAGI

SEQ ID NO: 52662 - protein, 465 aa, Tetracentron sinense
SGKPFYAIVHRVTGSLIIDFEPVKPYEVPMTAAGALQSYKLAAKAIARLQSLPSGSIERLCDTVVQEVFELTGYDRAMVYKFHEDDHGEVVSEITKPGLEPYLGLHYPATDIPQAARFLFMKNKVRMICDCRAKHVKVLQDEKLPFDLTLCGSTLRAPHSCHLQYMENMNSIASLVMAVVVNEEDEEGESSSSEQSQKRKKLWGLLVCHHTTPRFVPFPLRYACEFLAQVFAIHVNKELELENQILEKNILRTQTLLCDMLMRDAPLGIVSQSPNIMDLVKCDGAVLLYKNRIWQLGSTPSEFHIHDITSWLSEYHMDSTGLSTDSLYDAGFPGALALGDGVCGMAAVRITSKDMLFWFRSHTAAEVRWGGAKHEPGEKDDGRKMHPRSSFKAFLEVVKTRSLPWKDYEMDAIHSLQLILRNAFKDVENEGLNTSTIRTQLNDLSIEGTEELEAVTNEMVRLMET

SEQ ID NO: 52663 - protein, 293 aa, Triticum aestivum
MHSVVRNGSSQATGSKAASQKFPSKGQIANKLSMKEVNEQSLRKDHLARKQPVLPNGRPQPSQSQRMQSALYGQRPQQSSQSQRPQQSSQSQRPQQSSQSQRPQQSSQSQRPQQPQQSSQSQRPQQSLQRQRPQQSSQLQSSQSQRQLPQSNRPQQMLQRQRPLSSQGHYPEQRRVQANDRVKPSERQPSRQVSANGRDDRAKKKQLGKRRFDDDIEDEDDPMAMIRSMFRYDPSKYAGRDDDDSDMEADFATIEMEEKRSARIARQEDEEELRLLEEEERREQERKRRRVGR

SEQ ID NO: 52664 - protein, 390 aa, Tetracentron sinense
DLEPVNPADVPVTAAGALKSYKLAAKAISRLQSLPSGNLSLLRDVLVQEVSDLTGYDRVMVYKFHEDEHGEVVAECLISDLEPYLGLHYPATDIPQASRFLFMKNKIRMICDCLAPPVKVIQDKRLVQPLSLCGSTLRAPHGCHAQYMENMGSIASLVMSVTINDDDDEIESDKRGRKLWGLVVCHHTSPRFVPFPLRYACEFLIQVFGIQLNKEVELVAQLREKQTLRTQTVLCDMLLRDAPVGIVTQSPNVMELVKCDGAALYYRSTFWLLGVTPTEAQIRDIAEWLLEYHNGSTGLSTDSFMEAGYPGAAVLGDAVCGMSAVKITSKDFLFWFRSHTAKEIKWGGAKHDPFDKDDGKKMHPRSSFKAFLEVVKWRSLPWEDMEMDAI

SEQ ID NO: 52665 - protein, 223 aa, Debaryomyces hansenii CBS767
MAKTATIKRDTNETKIQIAISLEGGHIALEESIFKNSANETKDDSHATQATSTQVIQVQTGIGFLDHMLHALAKHSGWSLIIECIGDIHIDDHHTAEDVGITLGLAFHKALGQVKGVKRFGCGFAPLDEALSRAVVDLSNRPYAVIELGLKREKIGDLSCEMIPHVMESFAQGAAITIHVDCIRGFNDHHRAESAFKALAVAIKEATSSNGTDDVPSTKGVLF

SEQ ID NO: 52666 - protein, 340 aa, Arabidopsis thaliana
MLGGNNDNPVPQVLMNDSQFRYQSNTSLNQLHLLGTMRAGCTIDPVNYFANDNLAPMMRLNSTRGRETENNNIMQRQQKLQISLNYNYNNNNTVVQDEVPKQNLVSTGLRLSYDDDERNSSVTSANGSITTPVYQSLGDNIRLDLNRQNDELDQFIKFRADQMAKGVRDIKQRHVTSFVTALEKDVSKKLQEKDHEIESMNKKNRELVDKIKQVAVEAQNWHYKAKYNESVVNALKVNLQQVMSHGNDNNAVGGGVADHHQMKEGFGDSEIDDEAASYNYLNIPGMPSTGMRCKLCNVKNVSVLLVPCRHLSLCKDCDVFTGVCPVCQSLKTSSVQVFFF

SEQ ID NO: 52667 - protein, 845 aa, Debaryomyces hansenii CBS767
MGVISKTSFERTEVIGRGKFGVVYKGYNKQTKQVVAIKVLNLDTEEDEVIDVQQEIQFLTELKNVPNVTHYYGSFLNDTRLWIVMDYCAGGSLRTLLKCGVFEEKYIGVIMRELLIALQAVHKLGFIHRDLKAANVLITKEGNVRLCDFGVATQITSNALKRTTMAGTPYWMAPEVIREGDTYNAKADIWSLGITIYEIATGNPPYCDKDAMWAMQMISKLTPPRLEGREYSSALKETIALCLDENPEERPSAEDLLKCKFIKFYKGHPTVVLKEVITRYLLWRDRDSSRDSVAYMNLEENMMPTHRRSSENNEIENDQQLQVKWDFDSLSSRDYIIENDIDMEQVEENYQDSYAYNEEDAANETYQTQSTLQMGNTMNNTRSKFGMNTLNNESNFSSDRNKATGSATNSEIPKSLLNLFQEASPEMSAVPSTIGGQGFELPPSFTPSDQRLESPTIEIPDMDNYGGYADKSTTTNTGQPSLNKPPTLYHSQSASGNLETRFSTSASANRQRKLTISNTFGSNSSASHQPPRTPSSTTSSNMKTPSPKPVPTTTLLNAASMANTSSPSKSMKALQSNSNPLLQPINFKLTNESNGSSANGASNLGPTNNNINTTNNTTNGNGNSNLGPSQSMNGNTNTSDTNINQLSSSHLQNAATAKPKRPRPGFHIQMPTPSNSINTLSALTHDFDPHNGNQLSQGENVNQFGINPSQIGNLPLTMTPVTEKENLIYPGTGSENTTDSEATNTSSNPRHHPVLLKKANTSSVVPTSNLPTTSNPSTINSFLPRTTSLSGSNVSREKSSQSFPHIPTINGEFFLDTTPKYKLVSELDAMIKLFNQGLETLENDI

SEQ ID NO: 52668 - protein, 227 aa, Pyrococcus abyssi GE5
MVEVKKHKFPGVYIVIDDDGSEKIATKNLVPGQRVYGERVIKWEGEEYRIWNPHRSKLGAAIMNGLKNFPIKPGKSVLYLGIASGTTASHVSDVIGWEGKIFGIEFSPRVLRELVPIVEDRKNIVPILGDATKPEEYRALVPKVDVIFEDVAQPTQAKILIDNAEVYLKKGGYGMIAVKSRSIDVTKEPEQVFREVEKELSEYFEVIERLNLEPYEKDHALFVVRKT

SEQ ID NO: 52669 - protein, 547 aa, Oryza sativa (japonica cultivar-group)
MDISLASLVLVLLAFVLPLLYLLLQLPGKKSGGGGGDGPRLPPSPAGCLPLLGHLHQLGPLPHVALRSMAAAHGPVLRLRLGRVPTVVVSSAAAAEEVLRARDAAFSSRPRSAMAERILYGRDIAFAPYGEYWRQARRVCVVHLLSAQRVSSFRRVREEEAAALADAVRAAGRGGGRAFDLSGLIVAYASAVVSRAAFGDESARGMYGGADGGRAVRKAFSDFSHLFGTKPVSDYLPWLGWVDTLRGRERKARRTFEALDGVLDKVIDDHRRRRDSGRRQTGDADAGHRDFVDVLLDVNEMDNEAGIHLDAIEIKAIIMLAAHLVDGCIRQDMFVAGSDATSKPMEWAMAELVSHPRHMRRLQDEIRAVVGGGRVTEDHVDKLPYLRAALKEALRLHAPLPLLVARETVADTEIMGYHVAARTRVVINGWAIGRDTAVWGETAEEFMPERFLAGGNGGGAAAADYKVQGFEMLPFGGGRRGCPGVTFGMATVEMAVASLLYHFDWEAAAADGKGGREGTPLLDMSETSGISMGLKHGLPLVAKPRFP

SEQ ID NO: 52670 - protein, 590 aa, Arabidopsis thaliana
MAMVDEPLYPIAVLIDELKNDDIQLRLNSIRRLSTIARALGEERTRKELIPFLSENSDDDDEVLLAMAEELGVFIPFVGGIEFAHVLLPPLESLCTVEETCVREKAVESLCKIGSQMKENDLVESFVPLVKRLAGGEWFAARVSACGIFHVAYQGCTDVLKTELRATYSQLCKDDMPMVRRAAASNLGKFATTVESTFLIAEIMTMFDDLTKDDQDSVRLLAVEGCAALGKLLEPQDCVARILPVIVNFSQDKSWRVRYMVANQLYELCEAVGPDCTRTDLVPAYVRLLRDNEAEVRIAAAGKVTKFCRLLNPELAIQHILPCVKELSSDSSQHVRSALASVIMGMAPILGKDSTIEHLLPIFLSLLKDEFPDVRLNIISKLDQVNQVIGIDLLSQSLLPAIVELAEDRHWRVRLAIIEYVPLLASQLGIGFFDDKLGALCMQWLQDKVYSIREAAAAANNLKRLAEEFGPEWAMQHLVPQVLDMVNNPHYLHRMMVLRAISLMAPVMGSEITCSKFLPVVVEASKDRVPNIKFNVAKLLQSLIPIVDQSVVDKTIRQCLVDLSEDPDVDVRYFANQALNSIDGSTAAQS

SEQ ID NO: 52671 - protein, 188 aa, Mannheimia succiniciproducens MBEL55E
MDRTLGNKMNEQLQLIKSSIKSIPNHPKEGIIFRDITSLIEVPEAFQATVDLIVGNYKNQGITKVVGTESRGFIFGAPVALALGLPFVLVRKPRKLPRETISQSYQLEYGEDTLEMHVDSVKAGDNVLIIDDLLATGGTVDATIKLIKRLGGDVKHAAFVINLPELGGEERLRSLGVEPFTLVNFEGH

SEQ ID NO: 52672 - protein, 413 aa, Zea mays
MSEDPACSRRSRCDLGGDERWLSGPAGDDHFDRLPDALLLVIFNRIGDVKALGRCSLVSLRFHELVPLVDSVFVRVDCVIPDEPPSSSSSPSTPFSPTASVRARGVFSQIARIVLGGIVKPIQALGQILSPANSASGFPASSDSSPSSSSSSSPLPPADVSHHSPSEVLRSFKELRHLRIELPAGELDMDDGVMLKWKADFGSTLGSCVILGASSASASASVSPSSAGSDSTSTAPSVDGGRTEPDECVDSGSIPESFYTNGGFKLRVVWTISSLIAAAARHYLLQPIIADHKTLERLDLTDADGQGVLTMDKCQLQELRVRPVSTSRGSHRTLMPELSMWLWYAPCIELPGGLVLNGATLVAIKPSEEGTGDTVWNGAAGAAWVLDAFEEPYRTAVRMLLKQRTYSLEMNSF

SEQ ID NO: 52673 - protein, 558 aa, Desulfitobacterium hafniense DCB-2
MAFKSDIEIAQESTMLPVAEIAEKLNIAEEYVESYGKYKAKIDYNLLKERGDTPDGKLILVTAINPTPAGEGKTTTTVGLGDALTHLGKKVVIALREPSLGPVFGVKGGAAGGGYAQVVPMEDINLHFTGDLHAIGAANNLIAALLDNHIYQGNALDIDVRRITWKRCMDMNDRQLRYINDGLGGKANGMPREDGFDITVASEIMAILCLSSDLDDLKQRVERIIVGYNRKGEPVTAGQLKAQGAVAALLKDALKPNLVQTLEHTPSFIHGGPFANIAHGCNSVMATKMALKLGDYVVTEAGFGADLGAEKFLDIKCRLSGLEPDAVVIVATVRALKSHGGVAKADLNQENLAALKEGLPNLLKHVENITVNFGLPAVVAINRFPTDTLAEVQLVEEECKKLGVNVALSEVWEKGGAGGVELAEEVLKLMDSPKNFTFAYDIDLGLKEKITAIATKIYGADGVDFIGSSTKDIEGIESIGYRNIPVCMAKTQYSLSDDQKKLGRPTGFRISIRSVKVSAGAGFAVALTGDIMTMPGLPKVPAAESIDVDNTGRISGLF

SEQ ID NO: 52674 - protein, 103 aa, Brassica napus
  misc_feature (69)..(69): Xaa can be any naturally occurring amino acid
  misc_feature (95)..(95): Xaa can be any naturally occurring amino acid
MDLDDFRSVMDNACVDVWTFIDTAILVASLDYGQELKRRRDNIVERLYATSMANKCRNCDFGGGGGEVXRLMGVVVTRRREKGEEVREKSVNGRXDDDEDDGY

SEQ ID NO: 52675 - protein, 465 aa, Xanthorhiza simplicissima
SGKPFYAIVHRVTGSLIIDFEPVKPYEVPMTAAGALQSYKLAAKAIARLQSLPSGSIERLCDTVVQEVFELTGYDRAMVYKFHEDDHGEVVSEITKPGLEPYLGLHYPATDIPQAARFLFMKNKVRMICDCRAKHVKVLQDEKLPFDLTLCGSTLRAPHSCHLQYMENMNSIASLVMAVVVNEGDEEGESSSSEQSQKRKKLWGLLVCHHTTPRFVPFPLRYACEFLAQVFAIHVNKELELENQILEKNILRTQTLLCDMLMRDAPLGIVSQSPNIMDLVKCDGAVLLYKNRIWQLGSTPSEFHIHDITSWLSEYHMDSTGLSTDSLYDAGFPGALALGDGVCGMAAVRITSKDMLFWFRSHTAAEVRWGGAKHEPGEKDDGRKMHPRSSFKAFLEVVKTRSLPWKDYEMDAIHSLQLILRNAFKDVENEGLNTSTIRTQLNDLSIEGTEELEAVTNEMVRLMET

SEQ ID NO: 52676 - protein, 391 aa, Xanthorhiza simplicissima
DLEPVNPADVPVTAAGAMKSYKLAAKAISRLQSLPSGNITVLCDVLVQEVSDLTGYDRVMVYKFHEDDHGEVVAECRVPELEPYLGLHYPATDIPQASRFLFMKNKVRMICDCSAAPVKVIQDNKLAQPLSLGGSALRAPHGCHALYMANMGSVASLVMSVTINEDDDQMETDQQKGRKLWGLLVCHHTRPRFVPYPLRYACEFLIQVFGMQINKEVELATQFREKHILQTQTVLCDMLLRDAPIGIVTQSPNIMDLVKCNGGALYYRSRFWLLGVTPTEAQIKDIAEWLLQYHNASTGLSTDSLMEAGFPGASVLGNEVCGMAAIKITTKDFLFWFRSHTAKEVKWGGAKHNPTEKDDGWKMHPRSSFKAFLEVVKHRSLPWEDVEMDAI

SEQ ID NO: 52677 - protein, 150 aa, Cucurbita moschata
MAMGMLEVHLISGKGLQAHDPLNKPIDPYVEINYKGQERMSKVAKNAGPDPLWDEKFKFLAEYPGSGGDFHVLFKVMDHDAIDGDDYIGDVKIDVKDLLAEGVRKGWSEIRPRMYHVLAHKIHFKGEIEVGVSFKLQGGGGCAGCYPWEN

SEQ ID NO: 52678 - protein, 304 aa, Oryza sativa
MGSHLSIPVKEKSFFTVPSHQSTQLAVVELGWTMFGATCLACLDSGFFYVVDHGISQELMDDVFAQSKKFFDLPINEKMELLRDEKNRGYTPMLDEILDPENQVNEVLPRWRKVMEQYHSEALRVAKSIARIIALALNLEEDFFDKPEMLGEPIATLRLLHYEGKVSNPAEGVFGAGAHSDYGLITLLATDDVVGLQDRNAQPQVWEYVAPVKGGFIVNLGDMLERWSNCIFRSTLHRVVLDGRERHSIAFFVEPSHDCVVECLPTCKSESNPPKFPPITCSAYLSQRYKDTHADLTAYSSNKA

SEQ ID NO: 52679 - protein, 702 aa, Burkholderia mallei ATCC 23344
MPTPTPDRLEPGRSYPLGAHWDGLGVNFAVFSAHARRVQLCLFDPTGRREIARLDLPECTDEIWHGYLPDAHPGTVYAFRADGAYEPQHGHRFNPHKLLLDPYARKLVGQFRWSDALFGYRLHSSRADLSIDRRDSAPAMPKCVVVDEAVDWSTDRRPCVPWRDTVIYEAHVRGVSMRRAELRAPERGTFAALACPAFIDHLLALGVTSVELLPVHAFMHARALVNLGLCNYWGYDTAAFFAPEPSYLATRRLDEMRIAIRQLHAAGIEVLLDVVYNHTCEGNQLGPTICWRGLDNASYYRLAPDDPRRHIDETGCGNTLDLSHPRVLQMVMDSLRYWSNAFNVDGFRFDLCATLGREAAGFDPGAGFFDALRQDPVLATRKLIAEPWDVGPGGYQLGRHPAGFAEWNDRFRDTVRRFWRGDAGMRPELAARLAGSADLFNHHGRRTWSTVNFVAAHDGFTLADLVSYAAKHNDANGEDNRDGRDDNCSANWGAEGPTEDRQVRAVRARVARSLLTTLFAALGTPMLLGGDEFGRTQQGNNNAYCQDNELSWFDWSAAESADGRTMIHFVGRLAALRRAYPVLSEPRYPSGERDGAPGLHEIDWFDERGDALTVPAWHDRERRALTMRRVGNGRAGRPEALLLMLNASSDAIVFHAPPPSLVYRILLDSAAPDAAPRLMPADGVEIAAHAAVIAAASVPEAG

SEQ ID NO: 52680 - protein, 393 aa, Ehrlichia ruminantium str. Welgevonden
MSDHVKITPMTLNFGPQHPAAHGVMRLVLEMGGEVIERIDPHIGLLHRGTEKLIEYKTYLQALPYFDRLDYVSPMAQEHAYSLCVEKLLKCEVPIRAKYLRVIFCELTRILNHLLNISSQALDIGAMTPLLWMFEEREKILNFYERASGARFHSAYIRPGGVAADIPEDLIHDIFQFVNTFPKFMDDVDSLLTENRIWKQRNVDIGVVSKKQALNWGFSGPMLRACGIPWDLRKSQPYEIYDELEFKIPIGEKGDCYDRYLVRMAEIRESIRLVEQCLNRIPDGPVKTDDRKIAPPKRSEMKKSMEALIHHFKLYSEGYSVPAGETYMAVEAPKGEFGVYIVSDGTNKPYRCRIRAPGFAHLQAIDMMAKGHMLADLTAIIGSLDIVFGEIDR

SEQ ID NO: 52681 - protein, 451 aa, Glycine max
MEVVEKEKKKYITSEELKGHNKEGDLWISIQGKVYNVSDWVKEHPGGDVPISNLAGQDVTDAFIAYHPGTAWSHLDKFFTGYHLSDFKVSEVSKDYRKLASEFSKLGLFDTKGHVTSCTLASVAVMFLIVMYGVLRCTSVWAHLGSGMLLGLLWMQSAYVGHDSGHYVVMTSNGFNKVAQILSGNCLTGISIAWWKWTHNAHHIACNSLDHDPDLQHMPVFAVSSRFFNSITSHFYGRKLEFDFIARFLICYQHFTFYPVMCVARVNLYLQTILLLFSRRKVQDRALNIMGILVFWTWFPLLVSFLPNWPERVMFVLASFAVCSIQHIQFCLNHFAANVYVGLPSGNDWFEKQTSGTLDISCSSSMDWFFGGLQFQLEHHLFPRLPRCQLRNISPLVSDLCKKHNLPYRSLSFWEANQWTIRTLRTAALQARDLTNPAPKNLLWEAVNTHG

SEQ ID NO: 52682 - protein, 200 aa, Ehrlichia ruminantium str. Welgevonden
MKLKSIMSQCQFIIGATSIKSLPDFSIPEVALAGRSNVGKSSLINAITNNRKNARISSKPGCTRQINFYLINKGLMVLVDLPGYGYSKADRATVNSYICLMEYYLLNRKNLSKVVLLIDAKVGFKEIDLDFIRWLEVHQILYQLVLTKIDRVQSNVLDVIVSDIQNFNLNFIIYPIINVSSKCKQGIEELIYEIAQCIKK

SEQ ID NO: 52683 - protein, 429 aa, Listeria monocytogenes EGD-e
MQNYSKSEKAFKEAKKVLPGGVNSPVRAFNSVDASPVFMDHGKGAYITDVDGNEYIDYVLSWGPLILGHTDPAVVNAITKAALKGTSFGTPTEIETELAKLVIERVPSIEIVRMVSSGTEATMSAIRLARGYTKREKILKFEGSYHGHGDSLLIKAGSGVATLGLPDSPGVTKGLAADTITVPYNDIEGAKLAFEKYGEEIAAVIVEPVAGNMGVVPPIEGFLEGLRELTTKFGSLLIFDEVMTGFRVDYYSAQGYYVVTPDLTCLGKVIGGGLPVGAYGGKKEIMEQIAPAGSIYQAGTLSGNPLAMNAGFETVRQLTPQHYDVFRTLIKRMEEGLTEISARRQVPLSINKAGSMFGFFFTDQKVINFDTAKTSNLEFFRNYYREMLGQGIFLPPSQFEGVFISTMHTENEIDKTLEAFDTTCKILRG

SEQ ID NO: 52684 - protein, 260 aa, Exiguobacterium sibiricum 255-15
TPGTYGTGEPITGDTEGFWKHYCVWPMAWLIREISHFFNGDYGIGIIVTTLLVRLVILPLMIKQTKSMGGMQVIQPEMVKLREKYSSKDQETQQKLQQEMMKLYQEHNVNPLAGCLPILIQMPILIAFYNAIIYTPAIFQHTFLWFDLGKPDPYFILPILSAIFTYLQQKLSMAGQDDNPQMKIMLYVFPIMIFVMGVTLPSALSLYWVVGYIFSIIVTIAIMKPMREKIKAQTEATIASKREQEAANATPAPKKPKKKR

SEQ ID NO: 52685 - protein, 194 aa, Listeria monocytogenes EGD-e
MDVNNVELIISAVRPEQYPETDLPEYALAGRSNVGKSSFINTMIRRKSMARISQKPGKTQTLNFYKIEEALFFVDVPGYGFAKVSKTEREKWGVMIETYITSREQLRGVIQIVDLRHKPTEDDRMMYEFLKYYDIPVIVIATKADKIPRSKWQKNAKIVRETLDFDPDDKFVLFSSETKMGKDEAWQFIKEGME

SEQ ID NO: 52686 - protein, 220 aa, Brassica oleracea var. alboglabra
GGAGGGFGGGAGGGHAGGGAGGGHGGGAGGGFGGGAGGGHGGGAGGGFGGGAGGGKGGGLGGGGGVGGGHGGGVGGGFGGGAGGGKGGGVGGGFGGGAGGGKGGGLGGGHGGGVGGGFGGGAGGGKGGGVGGGHGGGAGGGFGGGAGGGHGGGAGGGFGGGAGGGHGGGAGGGFGGGAGGGHGGGAGGGFGGGAGGGHAGGGGAGGGFGGGAGGGGGGGF

SEQ ID NO: 52687 - protein, 192 aa, Yersinia pseudotuberculosis IP 32953
MTKHVAVLLAHGFEEAEAVIFIDIMRRLDIRVDILSCEATTALSTYFETPISADALLSDRLDHHYDAVMMPGGPKGTDSLTANPQVIAFLRRHIAQDKYICALCSSGAKVLAAHHLLAGRTYSTGDKLADKFADGVYLDQDVVVDGKFITAKGLGVSFEFAFTVARHLLSDNLPKVEHQASHIYFKHGSAQT

SEQ ID NO: 52688 - protein, 204 aa, Brassica napus
  misc_feature (28)..(28): Xaa can be any naturally occurring amino acid
  misc_feature (113)..(113): Xaa can be any naturally occurring amino acid
  misc_feature (149)..(149): Xaa can be any naturally occurring amino acid
  misc_feature (176)..(176): Xaa can be any naturally occurring amino acid
  misc_feature (191)..(191): Xaa can be any naturally occurring amino acid
LRDSFSAPGFIPDKNIVIGQPKRIHNAXILVAYTAMDTDKVKIYGARVRVDSMTYVAEIEGAEKEKMKDKVNKILAHGINCFVNRQLIYNFPEELFADAGVLAIEHADFEGIXRLGLVTGGEIASTFDNPESVKLGHCKLIEEIMIGEXDKLIHFSGVAMGQACSIVLRGASHHVXLDEAERSLHDALCVXLSQTVNDSRVLLG

SEQ ID NO: 52689 - protein, 69 aa, Zea mays
MGFWVTTLIFLLAGVAASLFTLLCCNRGPSTNLFHLTLVTTAVICCWMMYAIVYLAQMKPLINPILSGE

SEQ ID NO: 52690 - protein, 382 aa, Corynebacterium glutamicum ATCC 13032
MARDYYGILGVDRNATESEIKKAYRKLARKYHPDVNPGEEAAEKFREASVAHEVLTDPDKRRIVDMGGDPMEQGGGAGAGGFGGGFGGSGGLGDIFDAFFGGGAGGSRGPRSRVQPGSDTLWRTSITLEEAYKGAKKDLTLDTAVLCTKCHGSGSASDKKPVTCGTCNGAGEIQEVQRSFLGNVMTSRPCHTCDGTGEIIPDPCTECAGDGRVRARRDIVANIPAGIQSGMRIRMAGQGEVGAGGGPAGDLYIEVMVRPHAIFTRDGDDLHASIKVPMFDAALGTELDVESLTGEEVKITIPAGTQPNDVITLDGEGMPKLRAEGHGNLMAHVDLFVPTDLDDRTRELLEEIRNHRSDNASVHREGGEESGFFDKLRNKFRK

SEQ ID NO: 52691 - protein, 520 aa, Arabidopsis thaliana
MASVSAIGVLKVPPASTSNSTGKATEAVPTRTLSFSSSVTSSDDKISLKSTVSRLCKSVVRRNPIIVSPKAVSDSQNSQTCLDPDASSSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEYLILAGDHLYRMDYEKFIQAHRETDADITVAALPMDEQRATAFGLMKIDEEGRIIEFAEKPKGEHLKAMKVDTTILGLDDQRAKEMPFIASMGIYVVSRDVMLDLLRNQFPGANDFGSEVIPGATSLGLRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETATEKSLLSAKGSVPIGIGKNSHIKRAIIDKNARIGDNVKIINSDNVQEAARETDGYFIKSGIVTVIKDALIPTGTVI

SEQ ID NO: 52692 - protein, 321 aa, Oryza sativa
SRKQKVGEKPLLARSTFIQAARNNALLAVPALLYAINNYLKFIMQLYFNPSTVKMLSNLKVLVIAVLLKFIMKRRFSVIQNCHVLSFNVDDHNLQSGLLVTHYVTEWEALALLLIGISINQLRTVPAGNTAFGLPVTAIAYIYTLIFVTVPSLASVYNEYALKSQYDTSIYLQNLFLYGYGAIFNFLGILGTALFQGPESFNILRGHSRATMFLICNNAAQGILSSFFFKYADTILKKYSSTVATIFTGLASAAFLGHTLTINFLLGISVVFISMHQFFSPLAKAKDDKPAELLELEDTQNHRSSESSFVNMTAGAAEDVV

SEQ ID NO: 52693 - protein, 808 aa, Mannheimia succiniciproducens MBEL55E
MTNHWVDIKNANVVVVMGGNAAEAHPVGFRWAIEAKKQNGAKLMVVDPRFNRTAAVADFYSPIRSGTDITLLSGVIKYLLDNNAIQHEYVKHYTNASFLINEGYGFEEGLFTGYDEAERSYDKSTWSYQLDENGQPKRDLTMQDPRCVINLLKKHVERYTPEMVERVCGTKQKAFLEFAETIASTAVPNRTMTILYALGWTHHSVGAQNIRAMAMIQLLLGNIGMAGGGINALRGHSNVQGTTDMGLFPSMLPGYIPLPTETDTSLESFLNRITPKTAAEGQTNYWQNTPKFVVSMLKTFYGENATKDNEWGFHNLPKQYKKKMDHLQYIDLMDQGKITGYLCQGYNPLASYPDKNKISSALRKLKFLVVMDPLKTDTSEFWQNHGEYNDVNPAEIQTEVFRLPTVCFAEEDGSIANSGRWLQWHYKAAEPPKEAKPDVDILSEIREVMLEMYEKEGGPSIDTIKAMTWNYQNPLEPKAHEIAKESNGYALEDLYDANGNLIAKKGELLSSFAQLRDDGTTSAANWIYSGQWTPKGNQMDNRDNSDPSGLGNTLGWAFAWPANRRVLYNRASADLAGKPWDPKRPLIKWNGKNWNYIDIADFGTAPPNSNVMPFIMNNEGISRLFALDKMVDGPFPEHYEPIESPIGTNPLHPNVISNPVARILDNDKASFGNASEFPYVGTTYRLTEHFHWWTKNADLNMIAQPQPFVEISEDLANEKGIAQGDVVKVTSKRGYIKAKAVVTKRIKSLDVDGKKVHTIGIPLHGGFIADGRKSFLPNALTGRVGDANTQTPEFKTFLVNIEKTTEAL

SEQ ID NO: 52694 - protein, 177 aa, Arabidopsis lyrata
MENMGTRVIEPLIMGRVVGDVLDFFTPTIKMNVSYNKKQVSNGHELFPSSVSSKPRVEIHGGDLRSFFTLVMIDPDVPGPSDPFLKEHLHWIVTNIPGTTDATFGKEVVSYELPRPSIGIHRFVFVLFKQKQRRVIFPNIPSRDHFNTRKFAVEYDLGLPVAAVFFNTQRETAARKR

SEQ ID NO: 52695 - protein, 195 aa, Mannheimia succiniciproducens MBEL55E
MQVTRRKFFKICAGGMAGTSVAALGLMPTAALAAPREYKLLRAKETRQSCTYCAVGCGMLMYSIGDGAMNSRGKLTHVEGDPDHPVSRGALCPKGAGVLDFVNSPNRIQYPEYRAPGSDKWERISWHDAIHKIAKLLKDDRDANWESANEEGTPVNRWLTTGFLTASAASNETALISQKWARAFGLLVLDNQAST

SEQ ID NO: 52696 - protein, 450 aa, Magnaporthe grisea
MATKSVLMLGSGFVTRPTLDVLTDSGIKVTVACRTLESAKKLSAGVQHSTPISLDVNDDAALDAEVAKHDLVISLIPYTFHATVIKSAIRQKKHVVTTSYVSPAMMELDQAAKDAGITVMNEIGLDPGIDHLYAIKTIEGVHAAGGKIKTFLSYCGGLPAPESSDNPLGYKFSWSSRGVLLALRNAASFYKDGKVTNVAGPELMATAKPYFIYPGFAFVAYPNRDSTPYKERYQIPEADNIVRGTLRYQGFPQFIKVLVDIGFLSDEEQPFLKEAIPWKEATQKIVKASSASEQDIVSTIVSNATFESTEEQKRIVAGLKWLGIFSDKKITPRGNALDTLCATLEEKMQFEEGERDLVMLQHKFEIENKDGSRETRTSSLCEYGAPIGSGGYSAMAKFVGVPCAVAVKFVLDGTISDRGVLAPMNSKINDPLMKELKEKYGIECKEKVVA

SEQ ID NO: 52697 - protein, 192 aa, Glycine max
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRYWTMWKLPMFGCTDATQVLKELQEAKTAYPNGFIRIIGFDNVRQVQLISFSWSLKVLEFPQASKCEKFAKHL

SEQ ID NO: 52698 - protein, 293 aa, Gloeobacter violaceus PCC 7421
MSFGRVLTAMITPFDGEGNVHYAEAEKLADYLAAHGSDTLVVCGTTGESPTLSWEEEYELFDVVRRAVAGRAKVVAGTGSNATREAVVATRKAAALGLDGTLQVCPYYNKPTQDGLFEHFRAVAQAGDLPVILYNVPGRTGVHLAPETVARLAEVPGIVAIKEASGSLDQVSAVRALTCEDFVIYCGDDSLTLPMLAVGATGVVSIASHLVGEPIQQMIRAFENGHNDKARRIHLHLLPLFRGLFWETNPIPVKLALALQGWDVNHLRLPLVAGSEELGSRLEKLLHQLELLV

SEQ ID NO: 52699 - protein, 445 aa, Zea mays
  misc_feature (388)..(388): Xaa can be any naturally occurring amino acid
  misc_feature (398)..(398): Xaa can be any naturally occurring amino acid
MATRNHRAAAAPQPANRGAARVAGKQKAAAAGTRRALGDIGNVVSDALDRAIKLPEGIHRPITRSFGAQLMKAALANKNADAAVAPAQPVAARAVTKPARKVTTKNVPRPGAGQAPKENKKPSAEGAAAGSGRSVQKNRRKKPACTLSTVLSARSKAACGLTEKPKEPIEDIDKFDGDNQLALVDYVEDIYTFYKTAQHESRPIDYMGNQPELSPRMRSILADWLIESHRRFQLMPETLYLTIYIVDRYLSLQPTPRRELQLVGVAALLIACKYEEIWAPEVNDLIHIADGAFNRSQILAAEKAILNSMEWNLTVPTPYHFLLRFAKAAGSADEQLQHTINFFGELALMDYGMVMTNPSTAAACAVYAARLTLGRSPLWTETLKHHTXPQRAADHGRXAKTLVGSHAASASPDARLKAVYQKYATEQFGRVALHPPAPAALPDLV

SEQ ID NO: 52700 - protein, 266 aa, Zea mays
  misc_feature (205)..(205): Xaa can be any naturally occurring amino acid
MASTSSIGDVGASGSKGVACKTFPASANTSSSHQESHNVDAKSRVEDVWKKMNGGFPNKMPKPAMTKLSSTATEKKNKPTNNWMTVLGLSPSKACNSSQGSKNGLKWTQHETREDAKKLAAKALAAAKNAAAVASGRGKVEITEVRDFAGKDIEIKKLVDPNSKEAIEKAKAAGAAPSAVDSILEQIRKKQKLSVLDKTKKDWGXEYKEENRGLGEELDAYKKSSNQYLDKQSFLQRTDSREFERERDARLSMMAKRRTDTREDDV

SEQ ID NO: 52701 - protein, 554 aa, Shewanella sp. MR-4
MCSIFSILDIQSDAKELRQVALEMSKLMRHRGPDWSGIYASDKAILAHERLAIVDIEHGAQPLLTEDGSLILAVNGEIYNHKELKAQLGDKYSYQTNSDCEVILALYQEYGTEFLDKLNGIFAFVLYDKAKDAYLIGRDHMGIIPLYTGRDAAGNFYVASEMKALMPVCKTVAEFQPGQYLYSSIGEPVQYYTRDWQSFDAVKDNGASQEELRDALEAAVKRQLMSDVPYGVLLSGGLDSSVISAITQTFAKRRIEDDDQSGAWWPQLHSFAVGLKGAPDLAAAKKVADAIGTIHHEINFTFQEGLDAIKEVIYHLETYDVTTIRAATPMYLMARKIKAMGIKMVLSGEGADELFGGYLYFHKAPNAQAFHEELVRKLDKLHLFDCLRANKAMAAWGLEARVPFLDKEFMDVAMRINPEAKMSKDGRIEKHILRQAFEHKLPKEVAWRQKEQFSDGVGYSWIDGLKAHAAEQVDDLQLANAKFRFPYNTPETKEAYFYRCFFEEHYPLASAAETVPGGKSVACSTPEALAWDESLRGIIDPSGRAVRSVHAASY

SEQ ID NO: 52702 - protein, 306 aa, Burkholderia sp. 383
MTATTTPAAAPATAGPAPSSSPAPTMGRLRTVDGLELASYRWPAGGGTAPPRATIALVHGLAEHAGRYAALAGRLNAAGIDVLAIDLRGHGQSPGKRAWVERFDGYLNDADALVAEAARGNSPLFLMGHSMGGAVAALYAIERAPTRGHALTGLVLSSPALAPGRDVPRWMLAVSRVISRVWPTFPAIKIDAALLSRDPAIVAANRADPLVHHGAVPARTGAEILDAMARIESGRGGLRVPVLVYHGTEDKLTEPDGSRAFGARVGSPDRTLTLYEGGFHETMNDLERDRVIDALIAWIHARAPAR

SEQ ID NO: 52703 - protein, 400 aa, Arxula adeninivorans
  misc_feature (380)..(380): Xaa can be any naturally occurring amino acid
MADFIRTQIFGTCFEITSRYVDLNPVGMGAFGLVCSARDQLTNQNVAIKKIMKPFSTPVLAKRTYRELKLLKHLRHENLITLSDIFISPLEDIYFVTELLGTDLHRLLTSRPLEHQFIQYFLYQILRGLKYVHSAGVVHRDLKPSNILINENCDLKICDFGLARIQDPQMTGYVSTRYYRAPEIMLTWQKYDVEVDIWSAGCIFAEMLRGKPLFPGKDHVHQFSIITELLGNPPDDVIETIGSENTLNFVKSLPKRERIPLSQKFPNADPDAVDLLEKMLVFDPRKRINAADALAHPYLAPYHEPSDEPVASEKFDWSFNDADLPVDTWKVMMYSEILDFHNVDSSAVEQQQQQPQPPQPQLQQQQQPPQQPQQPQQPQXAQQPVQPVQGDYVPQVAPRS

SEQ ID NO: 52704 - protein, 430 aa, Triticum aestivum
TLALDIAYTCYINLEDLASALRIALLLDNKSIQYVKQVYTATDDLVLKKQFSYIIARHGLAMEIDDEIAADENDKEMLQEIVNNTKLSEGYLTLARDIEVMEAKSPEDIYKVHLIDGRGASSSLDSARQNLAATFVNAFVNAGFGQDKLMTAPSDSSSSGSSGNWLFKNKEHGKASAAASLGMILLWDTDSGLAQLDKYLHSTDTHVVAGALLGIGVVTCGVKNDCDPALAILMEYVNKDDSNIRIGAILGLGIAYAGSQKDELRVQLSAILGDPQATLEVLVFTAVALGLVFVGSCNEEIAQSIIFFLMERSEAELAEPIIRLLPVALGLLYLGKQESVEATAEVSKTFDEKIRKYCDVTLMSLAYAGTGNVLKVQKLLGICSQHLEKGETHQGPAVLGIALIAMSEELGAEMAVRSLERLLQYGEARY

SEQ ID NO: 52705 - protein, 348 aa, Triticum aestivum
  misc_feature (247)..(247): Xaa can be any naturally occurring amino acid
  misc_feature (276)..(276): Xaa can be any naturally occurring amino acid
  misc_feature (286)..(286): Xaa can be any naturally occurring amino acid
  misc_feature (298)..(298): Xaa can be any naturally occurring amino acid
  misc_feature (310)..(310): Xaa can be any naturally occurring amino acid
MPHRGAVLVFLLALAAAPLAAVAWRPWPPRVASGALAGLGASKKFEGSSNFVKLEYHMGPVLAADITVHPIWYGAWPADQKRTIRAFLRSLSPQASGEKEGAVPSPSVADWWRTVRLYTDQTTANVSAVVALGQEKCDARMSRGASLSRMDIQSVVKDAVTARTRPLPVDAGGVYLVLTSPEVRVENFCGQVCGFHYFTFPSVVGYTLPYAWVGNSAGRCPEVCAYPFAIPAYVPGRRPEAPPNGDXGVDGMVSVIAHELAEMASNPLANAWYAGXDPSFPTEIAXLCEGIYGTGGGXVAYPGQLLTDGXRSGASYNLNGVGGRRFLVQWVWDPYRSYCSGPNALDHQ

SEQ ID NO: 52706 - protein, 339 aa, Mannheimia succiniciproducens MBEL55E
MKDLDWKNLGFGYTKTDYRYIAYWKNGEWQKGELTKDNTLHISEGSPALHYGQQCFEGLKAYRTKDGSIQLFRPDQNALRMQQSADRLLMPRVPVDMFIDACKQVVKANEEWVGPYGSGATLYLRPFLIGVGDNVGVHPAKEYIFSIFVCPVGAYFKGGLAPSKFLISTHFDRAAPHGTGAAKVGGNYAASLYPGKYAKEHGFADCIYLDPATHTKIEEVGSANFFGITKDNKFITPISPSILPSITKYSLLYLAKERLGLEVEEGDVYVKDLDQFAEAGACGTAAVITPISGVQIDDKYHVFYSETEIGPITQKLYDELTGIQFGDKPAPEGWIVKVE

SEQ ID NO: 52707 - protein, 112 aa, Oryza sativa
AFLHACVDRKSIILGKYHYSFYILTLAMQLRMLLTVDEDLKPLSVPVRVGQAVDVVGQAGRPKTITGFQTHSTPVLLAAGERAELATEKYLPLTPVLEGFVILRKNPEYHED

SEQ ID NO: 52708 - protein, 489 aa, Glycine max
MAASRRLRDLQSQPANKICVDCSQKNPQWASVSYGVFMCLECSGKHRGLGVHISFVRSVTMDSWSEIQIKKMEAGGNDKLNAFLLQYGIPKETDIVAKYNSNAASVYRDRIQALADGRPWRDPPVVKEAVRSSSAAFKGKPPLSASSNNNGGWDNWDADDGFGSARGGSDLRRNQSTGDVRGFGGGGNVARSKSTQDIYTRAELEASAANKEEFFARKRAENESRPEGLPPSQGGKYVGFGSGPAPPQRGNQQNDYFSVVSQGLGKLSLAAASAANVVQAGTKELSAKVKEGGYDYKVNETVNVVSQKTTEIGQRTWGMMKGVMALASQKVEEFARDNPNWTSDNWQRNESDRNGFYQEFNRENNGRNSSTREGQHSSGGQTNTFHSSSWDDWGHNDFRKEEPAKGSAPQSSGGKFDNYNSSSWDDWDQEDTRKKEPAKGSSARSSDGWAGWDNAKDDGFDDIYGSASNSKGVTHNDKSGAAWTGGGFL

SEQ ID NO: 52709 - protein, 199 aa, Brassica napus
MADETKNVHEHEAPKVATEESSTATGEVTDRGLFDFLGKKKDETKPEETIDSEFEQKVHISEPVPEVKHEEEKEEKKHSLLEKLHRSDSSSSSSSEEEGEDGVKRKKKKDKKKVTTTEGEVKTEEEKKGFMDKLKEKLPGHGKKPEEKPEDASPAPVVAPPVEEAHPAEKKGILEKIKEKLPGYHSKTVEEEKKDKDDH

SEQ ID NO: 52710 - protein, 389 aa, Mannheimia succiniciproducens MBEL55E
MGERAHPTLVTKIMAKQDYYETLGVQKGADEKEIKRAYKRLAMKYHPDRTNGDKAAEEKFKEVNEAYEILMDKEKRAAYDQYGHAAFEQGGFGGGAGGFGGGFGGFGGFEDIFSEMFGGGASRQRVVRGEDLRYDIEITLEEAVRGTTKDIKINTLAACDHCDGSGAEKGSKVETCPTCHGHGRVRRQQGFFMTETTCPTCQGSGKKIEKPCKHCHGDGRVHKKKNLSVKIPAGVDTGNQLRLSGEGAAGENGAPAGDLYVVIHVKDHHIFERDGSNLYCEVPISFTMAALGGEIEVPTLDGRVKLKIPAETQTGKLFRMRGKGVTSTRAGYAGDLICKIIVETPVKLNEEQKELLRKFEESLEGQSKQRPKSSSFLDGVKKFFDNLGK

SEQ ID NO: 52711 - protein, 174 aa, Ginkgo biloba
PAAHGVLRSLLKINREVVDCIESHIGSLHRGTEKLMEYKIYIQALPYFDRSDYVSMMAQEHAYPSAVEKLPNREVPLRAQYIRVLFREITRISNHSLASTTHATDVGALTPSLWASEEREKLLESHERVPGARMHASSIRPGGVAQDLPLGLCRDIYSFAQQFAPRIDESEEMS

SEQ ID NO: 52712 - protein, 193 aa, Brassica oleracea
MQDQLMCHGCRNTLLYPRGATNVRCALCNTINMVPLHPPPPPPHHAHAGMDMAHIVCGGCRTMLMYTRGASSVRCSCCQTVNLVPATPPTNQPAHVNCGNCRTTLMYPYGAPSVRCAVCQFVTNVNMGNGRVPFPTNQPNGTASSPGPMPSTSTQSTPPSQTQTVVVENPMSVNESGKLVSNVVVGVTTDKKK

SEQ ID NO: 52713 - protein, 569 aa, Bacillus halodurans
ERLKAPEGPPSDVERIKEESNYLRGTLKESMLEPISAGISDDDNRLMKHHGSYLQDDRDLRNERQKQKLEPAYQFMLRVRMPGGVATPEQWLVMDELAQKYGNGTMKLTTRETFQLHGILKWNMKKTIQAIHSALLDTIAACGDVNRNVMCTSNPYQSEIHQEVYEWSKKLSDDLLPRTRAYHEIWLDEEKVAGTPEAEEVEPMYGPLYLPRKFKIGIAVPPSNDIDVFSQDLGFIAIVEDDKLVGFNVAIGGGMGMTHGDKATYPQLAKVIGFCKPEQIYDVAEKIITIQRDYGNRSVRKNARFKYTVDRLGLETVKNELENRLGWSLDEAKPYHFDHNGDRYGWVKGVKGRWHFTLFVEGGRVTDYADYKLMTGLREIAKIHTGDIRLTSNQNLIIANVTSQKKKKINELIEQYGLTDGKHYTALRRSSIACVALPTCGLAMAEAERYLPKLIDKIDEIIEENGLKNEEITIRMTGCPNGCARHALGEIGFIGKAPGKYNMYLGAAFDGSRLSKMYRENIGEEEILKELREILPRYAKERKEGEHFGDFVIRAGIIKETTDGTNFHD

SEQ ID NO: 52714 - protein, 282 aa, Shewanella sp. MR-4
MGSVTTKKHANGLDYVEVNTALCQARIFLQGAQIDHFQPVGKPPLLWVSSADDYQPGNGIRGGVPVCWPWFGMSNQANFPQHGFARTRIWTLESVEMRNQLVDLRFSLTISEEDKVFWPHHTQVNVLFTLGETLSISLVNINLGDVPVTLTQALHSYFPIEDIHQLKATGFSGAQYIEFAEGPFPQTTDDVLFDRETDRVYTNLGPVQHLHTPKGVIEVSRENSHSAVLWNPWIEKSTRLARFNDDDYLTMVCLEAANVLEDKLTLAPGESHSLVTHIRWAD

SEQ ID NO: 52715 - protein, 394 aa, Brassica napus
  misc_feature (366)..(366): Xaa can be any naturally occurring amino acid
MALLRPHLHRFHSNALHQSAPHTKSTADAGGGLVVYPTYGRRRRHRCSAIAIDAPSSLAGVTPIRWGYTSVQGFREEMEDDIVIRSEALDSFSFAAVFDGHAGSSSVKFLREELYKGCVEALQVGSLLKGGDFGAIKGALVEAFESVDQSLLKWLETKGEEDESGSTATVMLIRNDVSYFAHIGDSCAVLSRSGQIEELTDSHRPYGSSKAAVQEMKRIKDAGGWIVNGRICGDIAVSRAFGDIRFKTKKHEMLKKGVDEGRWSEKFVSRIEFKGDMVVATPDIYQVPLTSDVEFIILASDGLWDYMKSKDVVSFVREQLREHGNVQLACEALAQVALDRRSEDNISIIIADLGRTEWKKLPVQRXQNMVVELAQAAATVGIVTVGIWMTSLLS

SEQ ID NO: 52716 - protein, 706 aa, Nitrosomonas europaea ATCC 19718
MTIRNILVTSALPYANGSIHLGHLVEYIQTDIWVRFQKMQGHTVYYVCADDTHGTPVMLRAEKEGISPEALIARVHAEHLRDFTGFHIAFDQYYSTHSDETRYYAEDIYRKLKEAGLIAVRAIEQLYDPIKNLFLPDRFVKGECPKCGAAEQYGDSCEACGAAYTPTELKNPYSAVSGATPVRKTSEHFFFKLSDSRCADFLRRWTHEGNHLQAEAANKMAEWLGEAGENKLSDWDISRDAPYFGFEIPGETGKYFYVWLDAPIGYMGSFKKLCARKGIDFDAYWKKDSTTELYHFIGKDILYFHALFWPAMLENAGYRTPTQIFAHGFLTVNGEKMSKSRGTFITAESYLEQGLNPEWLRYYYAAKLNGSMEDIDLNLDDFVARVNSDLVGKYINIASRCAGFISKRFGGKLVSGEDYRLLQQMVDEHFAGWQPGVIEAAYEARDFSAAVRHIMRRADEVNELIHELAPWEIARDETRERELHRACSLGIQMFYLLSCYLKPILPRTAAQIEDFLNLGELSWQKQQAGQPLSDTLLPPGHVINPYQHLMTRIDPKQITALITANQQTMQQTMNTETESHSPQRHGQAQQHPVAPIAETISIEDFVKIDLRIARIVDAQHVPGADKLLQLTLDIGSEQRTVFAGIKSAYDPEQLKGRLTVMVANLAPRKMKFGLSEGMVLAASGENGGGPFLLAPDSGAQPGMRVK

SEQ ID NO: 52717 - protein, 209 aa, Triticum aestivum
  misc_feature (117)..(117): Xaa can be any naturally occurring amino acid
MAVRVWVSAILLAFLLAASPFAQVARAQSEEDAAMQEVVDGADLGYVGDDTPVSSEEPLSPAPGVETVCVFPKNAGKIVPAGEETELLVGLQNEGESTLNVVAVHSTLHLPYDHKIXFYNASVPVSVQATFPYTFAVSKFLQPGAYDLVGYIVYEIDQHPYQNVFYNGTIEVVEVGGLLSVESVFLITLGIALLGLLGLWAYGQVQQLS

SEQ ID NO: 52718 - protein, 270 aa, Oryza sativa
  misc_feature (196)..(196): Xaa can be any naturally occurring amino acid
MAEAVASGAAGRWTLRGKTALVTGGTRGIGHAVVDELAALGAAVHTCSRKEAELGERLREWEGKGFRVTGSVCDVSVREQRERMLREVAGLYGGKLDILVNNVGTNFSKQTTEYSADDYSFIMATNLESAYHLCQLAHPLLKSSGSGSVVFISSVSGVVAVSSGSVYAMTKGAMNQLAKNLACEWAKDNIRTNSVXAPWYMKTSLVEDELARKDFADSVVRRTALKRVGEPEEVSSLVAFLCMPGASYITGQTISVDGGMTINGLYPTQD

SEQ ID NO: 52719 - protein, 130 aa, Burkholderia sp. 383
MNLIAKLEQEEIERALAGKTIPEFAPGDTVIVNVNVVEGNRKRVQAYEGVVIAIRSRGLNSNFIVRKISSGEGVERTFQTYSPLLASIVVKRRGDVRRAKLYYLRERSGKSARIKEKLVSKDRTAAASQE

SEQ ID NO: 52720 - protein, 364 aa, Mycobacterium tuberculosis CDC1551
MVPELMFDEPRPGRPPRHLADLDAAGRASAVAELGLPAFRAKQLAHQYYGRLIADPRQMTDLPAAVRDRIAGAMFPNLLTASADITCDAGQTRKTLWRAVDGTMFESVLMRYPRRNTVCISSQAGCGMACPFCATGQGGLTRNLSTAEILEQVRAGAAALRDDFGDRLSNVVFMGMGEPLANYARVLAAVQRITARPPSGFGISARAVTVSTVGLAPAIRNLADARLGVTLALSLHAPDDGLRDTLVPVNNRWRISEALDAARYYANVTGRRVSIEYALIRDVNDQPWRADLLGKRLHRVLGPLAHVNLIPLNPTPGSDWDASPKPVEREFVKRVRAKGVSCTVRDTRGREISAACGQLAAVGG

SEQ ID NO: 52721 - protein, 357 aa, Pseudomonas fluorescens Pf-5
MAKMKAAVFVEKNRIVLEDKDIPEIGPLDALVRITTTTICGTDVHILRGEYPVAKGLTIGHEPVGVIERLGSQVRGFHEGQRVIAGAITPSGQSYACLCGCGSQDGPDTRHGFRATGGWKFGNTIDGCQAEYVRVPDALANLCPIPDGLSDEEVLMCPDIMSTGFSGAERAEVNIGDSVAVFALGPIGLCAVAGARLKGATTIIGVDTVAARMSVARGLGATHVVDFKHGDVVKQIMDLTDGRGVDVSIEALGTQGTFESALRVLRPGGKLSSLGVYSSDLRIPLDAYAAGLGDLSILSTLCPGGKERMRRLMEVVASGQVDLKPLVTHRFKLDDIEAAYELFASQRDGVMKIAITP

SEQ ID NO: 52722 - protein, 427 aa, Mannheimia succiniciproducens MBEL55E
MTDSNTLFSRAQQVIPGGVNSPVRAFKGVGGTPVFIQKAKGAYIWDTDDKQYVDYVGSWGPMILGHNHPAILSAVIKTAENGLSFGAPTPIEIDLAELVCKLIPSMEMVRMVSSGTEATMSAIRLARGYTNRDKIIKFEGCYHGHADSLLVKAGSGALTLGQPNSPGVPADFAKHTLTCTYNDLESVKQAFEQYPQDIACIIVEPVAGNMNCVPPQNNFLQGLRELCNQYGAVFIIDEVMTGFRVALGGAQSYYNVEPDLTCLGKVIGGGMPVGAFGGKKEIMQFIAPTGPVYQAGTLSGNPIAMAAGLACLTELQKAGNQERLAQLTEKLALGLKALADKHHVPFTVNYVGGMFGLFFTDKAQVTCYQDVMACDTEKFKVFFHKMLDEGVYLAPSAFEAGFMSLAHTDADIDRTLTAADKAFAALA

SEQ ID NO: 52723 - protein, 298 aa, Picea glauca
MAMLSGGLQKEEEMAKIDKACEEWGFFQVVNHGVPHSLMDDITRMGKEFFRLPAEEKEKYAIRDFQGYGQIFVVSEEQKRDWGDLLGLIISPPQSRNLSVWPSVPSEFRQIVEAYNMEIRSLAVKILSLIAENLHLKPDYFEQSFGNTYQKMRMNYYPACPRPDLVLGLSPHADGSGITLLLQDEKVEGLHVRKDDIWVAVQPIPYALVINIGNLLEVITNGRYKSIQHRAVTNKHKSRLSIDVFYSPGFDAEIGPAPELIDESHPCLFRKFIHEDHIKYYMSRKVDGKTSFYEYAGV

SEQ ID NO: 52724 - protein, 269 aa, Neisseria meningitidis Z2491
MPDFSMSNLAVAFSITLAAGLFTVLGSGLVMFSKTPNPRVLSFGLAFAGGAMVYVSLTEIFSKSSEAFAEIYDKDHAFAAATMAFLAGMGGIALIDRLVPNPHETLDAQDPSFQESKRRHIARVGMMAAFAITAHNFPEGLATFFATLENPAVGMPLALAIAIHNIPEGISIAAPVYFATRSRKKTVWACLLSGLAEPLGAALGYLVLQPFLSPAVFGSVFGVIAGVMVFLALDELLPAAKRYSDGHETVYGLTMGMAVIAVSLVLFHF

SEQ ID NO: 52725 - protein, 276 aa, Zea mays
MASSLSFVSSSHLTLRTPSLTLRKLSPPRTSVSFSVKAQSVALSQDDLKKLAAEKAVEAIKPGMVLGLGTGSTAAFAVDQIGKLLSSGELHDIVGIPTSKRTEEQARSLGIPLVALDTHPRIDLAIDGADEVDPNLDLVKGRGGALLREKMVEAVAERFIVVADDTKLVKGLGGSGLAMPVEVVQFCWKFNLVRLRDLFKEFGCDAKLRVGEGGEAYVTDNSNYIIDLYFKEPLKDGFAAGREIGKLEGVVEHGLFLGMATSVIIAGKNGVEVMNK

SEQ ID NO: 52726 - protein, 490 aa, Oryza sativa
MAVSLKSSGSFCSTPPQWLHSTRDRILYGYSHSNAKECTCKKTKRPAPLCVKATSTKVELDFNDPSWKQKFQEDWDKRFNLPRITDIYDLKPRPTTFSLKKNRSPAGDENGTPMDKWNGYVNSDDRALLKVIKYSSPNSAGAECIDPDCSWVEQWVHRAGPRKEIYYEPEEVKAAIVTCGGLCPGLNDVIRQIVFTLETYGVKNIVGIPFGYRGFFEKGLKEMPLSRHLVENINLAGGSFLGVSRGGAKTSEIVDSIQARRIDMLFVLGGNGTHAGANAIHEECRKRKLKVSVVAVPKTIDNDILLMDKTFGFDTAVEEAQRAINSAYIEVPFTLDGEYGVLRHLEHLLKTKGFCVVCVAEAAGQELLQKSGATDASGNVILSDIGVHMQQKIKMHFKDIGVPADVKYIDPTYMVRACRANASDAILCTVLGQNAVHGAFAGFSGITSCICNTHYVYLPITEVITVPKRVNPNSRMWHRCLTSTGQPDFH

SEQ ID NO: 52727 - protein, 105 aa, Glycine max
  misc_feature (36)..(36): Xaa can be any naturally occurring amino acid
QAHQPKSLRYIGSMVADVHRTLLYGGLFLCPADQNXPNGKLPVLYEVFPMSFLMEQAGGQSFTGKERALDLVPTKLHQRSPIFPGSYDDVEEIKALYAAAEGEPQ

SEQ ID NO: 52728 - protein, 456 aa, Zea mays
MGDHAEMLHATPAIYNGAGAAPRGGWWSTAVPATTCSTELAGFTTWSSALAASYDLAAEGAKANKSATTASSESPGNNSSVTFQEPAGGVGTAVVQQPLAGCADWTHPYLSSGAATLHGFMQDGHQQDMSSSTTEQSPMAASSLIMNPSSNNLALALQQGHHHQEPDHQQMLSNFGGSEAELLLSPTTSPYGFQSSLLRSFMEPTAAAAKPALPGYRQQYDQYQQMGMGQARSFAPAGGAASREALQFTNDAPSWNPSAAAAGFGVPPAPAPVDQASSSVRSVKPSPAARATATLALKTALEGVGESASSIITKKKANGELAPAFKKSRLQTPSPLPTFKVRKEKVGDRVTALQQLVAPFGKTDTASVLHETIEYIKFLHDQVGVLSAPYLKNNGHQVPYLKRSSPDRSEDDSSHAGERSLKGRGLCLVPISSTFAVASEVPVDFGWSTAFAASFR

SEQ ID NO: 52729 - protein, 51 aa, Brassica napus
YKQLTLEEAEEKMDNRRKTADGYQRWMMKGGESDKEAGGSSGRGRKKSSGG

SEQ ID NO: 52730 - protein, 278 aa, Arabidopsis thaliana
MSGEVWRWNKQAEMNSIRDCLKHCNSIAIDTEFPGCLKETPMDASDEIRYRDMKFNVDNTHLIQLGLTLFGKGITKTWEINLSDFNESKSLKNDKSIAFLKNNGLDLDKIREEGIGIEEFFMEFSQILNEKHGKMRWVTFQGSYDKAYLLKGLTRKPLPETSKEFDETVQQLLGRFVYDVKKMAGLCSGLSSRFGLQRIADVLQMRRVGKAHHAGSDSELTARVFTKLIFDLVNSRKESTGRRADDQQYQLEQQQHQQQLMMTRCYIPIPVQGRNYVL

SEQ ID NO: 52731 - protein, 159 aa, Oryza sativa
MFPEKESVTHLLARYLLHPSNSVWGMVMRYHHAYLAPAAEMIGVQIRMFSWASIPVDDMYKQVMACSSQERILPDTDGGDAPAPARTNTSGGGATTAILVASLQVEYYERLKGKYYEHALAPGPRAAAATCQGKLAVSENVTRHIKRCEDLAGGIKLFD

SEQ ID NO: 52732 - protein, 449 aa, Streptomyces globisporus
MRIDPPGPPLRALPGLLRKLAVDRLGMMRDAAGLGDAVRVSMGPKKLYIFNRPDYAKHVLADNSDNYHKGIGLVQSRRVLGDGLLTSDGETWREQRRIVQPAFKPGRINQQAAAVAEEAAKLVALLRGHEGGGPVDVLQEVTGLTLGVLGRTLLDSNLTAHESLAHSFEEVQDQAMLEMVSQGTVPAWLPLPPQARFRRARRELYRVADLLVADRRSRMADGGPGDDALSRIIVAADRRRDDPARARNRLREELVTLLLAGHETTASTLGWTLHLLERHPEVRDRVRAEARAALGDGVPGPEDLHRLTYTTMVVQEAMRLFPPVWILPRVAQQRDVVGGYTVSAGSDVLVCPYIMHRHPGLWEDPERFDPERFEPRQTADRPRYAYIPFGAGPRFCVGSNLGMMEAVFVTALVTRDLDLRTVAGHRAVAEPMLSLRMRGGLPMTVSTAR

SEQ ID NO: 52733 - protein, 116 aa, Nitrosomonas europaea ATCC 19718
MEDCLFCKIVRGEIPATKIHEDEDTLVFLDIHPAAPVHLLVVPKQHIGSLSEVDASHQQLLGKMLWLAPRLAASQGCTDGFRTIINTGRVGGQEVFHLHLHVIGGKDRLPAMVHHD

SEQ ID NO: 52734 - protein, 112 aa, Nitrosomonas europaea ATCC 19718
MTASTILQRLARTIEARKNADPSISYTAKLLNSSQDKVLKKIAEEAAETIMACKDNDREQIIYETADLWFHCLIMLTRHDISPEDILRELERREGISGIEEKLSRSQPNKTE

SEQ ID NO: 52735 - protein, 129 aa, Nitrosomonas europaea ATCC 19718
MTDKWLDTINWSADGLIPAIAQDKNNGKILMVAWMNREALKRTVESGEAVYWSRSRKKLWHKGEESGHTQKISAIHLDCDEDILLLSVEQKGGIACHTGRQSCFFRQLKNGEWVVTEPVIKDPSQIYTK

SEQ ID NO: 52736 - protein, 317 aa, Brassica napus
MASETENIKYEESFIKNTRGMKLFTCKWLPANKEPKSLIFICHGYAMECSITMNSTARRLVNAGYGVYGMDYEGHGKSDGLSAYVPNFDHLVDDVSAHYTSICEREENKCKMRYLLGESMGGAVLLLLHRKKPEFWDGAVLVAPMCKIAEEMKPNPVVISVLSKLSGVIPTWKIIPGQDIIETAFKQPEVRKQVRENPYCYKGRPRLKTANELLRISTDLEKRLDEVSLPFMVLHGEDDKVTDKAVSGQFYEVASSSDKTFKLYPGMWHGLLYGETPENIEIVFTDIIGWLDKRASDGNGGFESELKRKEDGFTLKE

SEQ ID NO: 52737 - protein, 1068 aa, Oceanobacillus iheyensis HTE831
MPKRTDINKILVIGSGPIIIGQAAEFDYSGTQACHALKEEGYTVILANSNPATIMTDHTVADKVYMEPLTEEFLTKIIRKENPDAILPTLGGQTGLNLAMELFHKGILEDHQVQLLGSAPASIEKAEDRELFRKLMNELGEPVPESAIVHTVEEAFDFAHTIGFPLIVRPAYTLGGTGGGMCYNEEDLKEITKNGLSLSPVNQCLIERNIAGFKEIEYEVMRDKNDQAIVVCNMENIDPVGIHTGDSIVVAPSQTLSDREYHLLRNASLRIIRALEIEGGCNVQLALDPNSFQYYIIEVNPRVSRSSALASKATGYPIAKIAAKIAVGYSLDEIINPITGKTYSMFEPALDYVVTKFPRFPFDKFTAGDRRLGTQMKATGEVMAIGRNLEESLLKGVRSLEIGTEELYLKKAANITEETLVKRLIRADDERIFLVAEALRQGYSVDWVFNHTKIDPFFLHAIERVVNMEVILKSDVGNLENLTKAKQWGLSDSEIARLWEMEVDDIYQIRKENQIMPVFKMVDTCAAEFASETPYFYSTYEEENESIVTERKKILVLGSGPIRIGQGIEFDYATVHSVYAIKEMGYEAIIMNNNPETVSTDFTISDKLYFEPLTLEDVMHVVELEQPEGVIVQFGGQTAINLAEGLERRGVRILGTGLDAIDRAEDRDKFEVLLDELDILRPKGKAVPRLDQAIDTANEIGYPVLVRPSYVIGGSRMEIVYNEQELENYLKKSSHIDSAHPILIDKYLTGMEVEVDAISDGETTIIPGIMEHIERAGVHSGDSMAVYPPQRLSTTVKEKCLDAAIKISKALQVKGLINIQFIIREEDVYVLEVNPRASRTIPFLSKITGITMANIATRCILGEKLADQGFETGILPEQDQVSVKIPVFSFEKLRSVDTILGPEMKSTGEAIGYDRTLEKALYKGMIAAGLTVPQEGGVLLTVADKDKAEMLEVAEHFHQLGFVLYATEGTAEYVKHEGKLPVVPVAKIGAEEPNVLSIIESGQVQFVINTLNSGQKPRSDGFLIRREAVEHGIACLTNMDTVNAILRVIDATSFSAKPIGIDKKVVMS

SEQ ID NO: 52738 - protein, 197 aa, Nitrosomonas europaea ATCC 19718
MLMRTAQVTRNTQETQITVTINLDGQGKAELDSGVPFLDHMLDQIARHGMFDLSVAAKGDLHVDAHHTVEDIGITLGQALNRAVADKKGLVRYGHAYVPLDEALSRVVIDLSGRPGLQFNTTFTRAVIGNFDVDLIQEFFQGFVNHAMVTLHIDNLTGKNAHHQAETIFKAFGRALRMAVTTDPRCDNLIPSTKGVL

SEQ ID NO: 52739 - protein, 765 aa, Arabidopsis thaliana
MLEMERVAELKRLPSKGPVSGHLSRRPYLDFETRDAPGMHLESLRERAARYNTGRSVNPTTTLGRELSQVLNVHREDMMMTQFGGNMNDFQEFEPVVSSVRTMKAKYPLLEIEEIGAADDDVTCKGSNDMSEEAGSSSFRGVSHPPEPDDMDLITTVYVPISEKNKPDSVCLMKSMSTTKGPFIEDISLCVPPKKPSPRVLSPAESIVEEPATSLSPFSVARASQNTENSLLPPDSDKECVWDASLPPSTNVSPHSSSVESMNLARAMSIANSSSATSTTQRSDVVLSMDKNYFDRSISMVLDSFESTKTSASRASDSSGLSEESSWSNFTGSLNKPHKGNDPWWNAILAIRTRDGILGMSHFKLLKRFGCGDIGSVYLAELSGTRCHFAVKVMDKASLEDRKKLNRAQTERDILQLLDHPFLPTLYTHFETDRFSCLVMEYCPGGDLHTLRQRQPGKHFSEYAARFYAAEVLLALEYLHMLGVVYRDLKPENVLVRDDGHIMLSDFDLSLRCAVSPTLIKTFDSDPSRRGAFCVQPACMEPTSACIIQPSCFLPRSIFPNKNKKNKSRKTQADFFKSHSGSLPELVAEPNTRSMSFVGTHEYLAPEIIKGEGHGSAVDWWTFGIFVHELLYGKTPFKGSGNRATLFNVVGEQLKFPESPATSYAGRDLIQALLVKDPKNRLGTKRGATEIKQHPFFEGVNWALIRCSTPPEVPRQMETEPPPKYGPIDPVGFGSNSKRMMGPPAVSAAAADTKSGGKFLDFEFF

SEQ ID NO: 52740 - protein, 582 aa, Bradyrhizobium sp. BTAi1
MPVVSVTGLSAVACRARQVEPHDRSNARTLKSTPFQRRLIMLSNLDTPVRHAVLDEAHIGDIKGALGTIKKNDTGPRNGWRARLMTLLAILGPGLIVMVGDNDAGAFGTYTQAGQNYGTSLLWTLILLIPVLYVNQEMVLRLGSVTGVGHARLILERFGKFWGAFSVVDLFLLNALTIVTEFIGISLALEYLGLPRGVGVIAAAAVIIAAAGTGNFRRFERFSLFLVFGSLLLVPVLVWVHPPVSQIAHDLVVPQFPEGGKLSEVMLLIIAIVGTTVAPWQLFFQQSYVIDKRITTRFLSYGRIDLVLGIVLVVIGAVAMMAFTAATFAGRPEFGNFQDAGAVAAGLGAYVGKTAGVFFALALLDASVIGAMAVSLSTAYAIGDVLSLRHSLHRKPQDAKGFYAVYGGLVTLAAALVLTPGMPLGLLTNAVQTLAGVLLPSATVFLLLLCNDKAVLGPWINGRWMNLFTGAVVGVLVMLSIILTASVLYPNMSESTILAILGIGGVFTLAVAVAFLFIHREEPANAKNEMVRATYRMPPLDELPSARMTPMTRLWMLVLRGYLILAGGLVLVRIVQLSLVGR

SEQ ID NO: 52741 - protein, 404 aa, Fulvimarina pelagi HTCC2506
MPSSPAETSSSIYPTYNRAPISFESGEGVWLKANDGKRYLDCAGGIAVNALGHAHPHLVDALKSQAEKLWHVSNLFEIPGQKRLADRLCQATFADRVFFTNSGAEALECAIKTARRFHHVNGAPERVNILTFEGAFHGRTLATIAAGGQAKYLEGFGPKAPGFMSLPFGDHDALRMAAAEPDVAAILVEPVQGEGGVRKLPLPCLTGLRELCDERGILLIYDEVQTGIGRTGRFFAHQNAGGAEPDILATAKGIGGGFPLGACLATEAAGSAMTPGTHGTTYGGNPLAMAVGNAVLDIVLDEGFLEGVRDKAILFKQSLESLKDRFPDVLEEVRGTGLLIGLKTVCPNTEAVAALRTEGLLTVPAGDNVVRLLPPLTITSEEIREAVQRLENAFAALSENKKSA

SEQ ID NO: 52742 - protein, 202 aa, Triticum aestivum
MCDDSVAALVVDNGSGMCKAGFAGDDAPRAVFPSIVGRPRHQGVMVGMGQKDSYVGDEAQSKRGILTLKYPIEHGIVTNWDDMEKIWHHTFYNELRVAPEEHPVLLTEAPLNPKANREKMTQIMFETFNTPAMYVAIQAVLSLYASGRTTGIVFDSGDGVSHTVPIYEGYALPHAILRLDLAGRDLTDYMMKILTERGYSST

SEQ ID NO: 52743 - protein, 754 aa, Solanum demissum
MRNLIAHFRLKKKTVHPKKENPNFFPPLKHFRNVEQTSLVKCGIFKISQDFELGVVEFAKWKVGLQQKIFPQSEELLLYHSYIPSYLHIGCLSPLLAVLRNGLSLVHFLGWGRGLRSGKSNEVEVQMLKTCDLGSRNQVGIEKPVLSVSPSPYYGDIASCLRLILCCWEVTSIWRNGRGVCKLTPDTRVIKKYELSSRIIRKVEGRLRFNWHPFLRLGCVSILPTVYQLLHASWHYPSDAKPSAFGAVLHVISTSILGITAITITNTIAGEESVHKLASLLLIVLGGSYIILFLCGKGGHSHSHNQPMEKMAVAGLVLVPALSPCATTLPVFLAVGNSSSMMVLAIIVLLFSTITVMTSLVALSFYGASQLKFHWVECYDKLLVGSVLSLVGILTLIFHDHDHEGGSAGGHAAFCPKSETLREFGLFRFKSGYLTPDGKPKKGPTRGSIVVHAMTGTYGINYGKISDNIPAPEDVLRLLRMNKIKNIRIYDADSRVLRAFSGSGIEISVCLPDKLLKDVSQNGSIALEWIQVNLQPYLPGTSIRGIAVGNEILGGDTSISEALVPAVRSVYRALRRLGLTNTIEVSTPHSEAIFSSTYPPSNGIVDPKTKLHYDNMFDAMVDATYVALEKLGYTKMQVIVSETGWASKGDDNEPGADPKNARTYNFNLHKRLMKKKGTPYRPKMMAKGYVFALFNENLKPGPTSERNFGLFKADGSIAYDIGFKGLVSSASSKCKIRKLQIIALFLTNPEQGWI

SEQ ID NO: 52744 - protein, 143 aa, Brassica napus
  misc_feature (76)..(76): Xaa can be any naturally occurring amino acid
  misc_feature (93)..(95): Xaa can be any naturally occurring amino acid
  misc_feature (97)..(97): Xaa can be any naturally occurring amino acid
  misc_feature (125)..(125): Xaa can be any naturally occurring amino acid
  misc_feature (131)..(131): Xaa can be any naturally occurring amino acid
  misc_feature (138)..(139): Xaa can be any naturally occurring amino acid
  misc_feature (142)..(142): Xaa can be any naturally occurring amino acid
ISKDQLKDYVWKTLNSGKVVPGYGHGVLRKTDPRYVCQREFALKHLPDDPLFQLVSKLYEVVPPILTELGKVKNPXPNVDAHSGVLLNYYGLXXXRXGGGLFGVSRSLGICSQLIWDRALGLPLXRPKSVXMDWLDKXXSLXR

SEQ ID NO: 52745 - protein, 400 aa, Debaryomyces hansenii CBS767
MTIESTTNVEYGFGTKAIHAGAPIDPTTGAVIEPLSLSTTFAQSEPSKPVGLYEYSRSANPNRDNFEAAVAALEKAKHAIALSSGSATTALIIQSLPMNSHIISGGDVYGGTHRYFTKVGVTHGVTSTFVGNLVEDLESKIQENTKLVWLETPSNPTLTVTDIAKVASILKNHEAKTGSKILLAVDNTFLSPYISNPLEHGADVVVHSVTKYINGHSDVVMGVLATNSDELHDRFRFLQNAIGSIPSPFDSWLAHRGLKTLHLRVRQAATSAQQIAQFLTQHPAVLKVNYPGLKSDPNHEIVVKQHRDSLGGGMISFRINGGAKAASTFTSSTKFFTLAESLGGIESLVEVPAIMTHGGIPKEERESNGVFDDLVRVSVGIEDTDDLIEDVRQALEKASK

SEQ ID NO: 52746 - protein, 341 aa, Yarrowia lipolytica
MSMLEPQTFWDGSDRRTMKTRIILQLSSLLIPLQPMDPLLLPLSQWLTPNPMTCLSTLPHRTTMSTSQAPLGSIQSTPRSRWTLSRSIIRKTETFSDRVALRAILLMRIIFDLCTGYKHPKEGEAHLPKFRMTTRQWLDRFLFLESIAGVPGMVAGMIRHLHSLRALRRDRAWIESLVEEAYNERMHLLTFLKLQKPSVQMRTGLLIGQIIFYNLFFISYLISPATCHRFVGYLEEEAVITYTRCLEDIDAGRLPELASMEVPDIARTYWHMEDDCTMRDLIQYVRADEAKHCEVNHTFGNLHQTSDRNPFALVIDNGRPQPSKDLTTFRSVGWRRDEIAN

SEQ ID NO: 52747 - protein, 349 aa, Yarrowia lipolytica
MTLLTTTSLLRTSRALAKVSVSVSRPTQFQHRFMATATSKEDYVKDPGDTKTLANTKMNDSSIYGADDSQKYETTPMWVHPIYTKEQMENLVVRHREAKTFSDKCALAAIRTMRWSFDLFTGYRHPKPGQENLKRFEMTPDKWYQRFLFLESIAGVPGMVGGMCRHLQSLRALKRDRAWIETLLEEAYNERMHLLTFLKMHKPGYFMRTMILLGQGVFFNLFFMAYLMSPRICHRFVGYLEEEAVITYTRCITDIDAGRLPEWEGHKVKIPEIAIDYWHMGPNPTMRDLIEYIRADEAKHCEVNHTLGNLDQDHDRNPFALKIDNGHPQPSKDLSTYKGQGWSRDENAN

SEQ ID NO: 52748 - protein, 86 aa, Glycine max
LLRVAFVTKADGFLQEVHSQKSEVHNQPGFDPESVANRLKQQEKQRLIRQVEALLDLAIGLKWYLFCPSRHFDSYDCSHLTVHGSV

SEQ ID NO: 52749 - protein, 583 aa, Candida albicans SC5314
MGQILSQPVVEKHSDEHKDKYLAYGISCMQGWRINMEDAHATILNLYDLPLKKSLSSNSEQDEDEEDEEEEADSQDSTTTNTTKSHQQQNQKEDLQQNNDKQNSQQDIKDGDNDTQMSDSDENHHHAAPQQQHIAFFGVYDGHGGEKAAIFTGEKLHHLIKETKEFKQKDYINALKQGFLNCDQEILKDFYMRDDDSGCAATSAIITPDLIVCGNAGDSRTIMSTNGFAKALSFDHKPSNEGEKARICAAGGYVDMGRVNGNLALSRGIGDFDFKKNVDLPAEEQIVTCYPDVIQHNIDYKSDEFVVLACDGIWDCLTSQKCVECVRRGIYERKSLSIICEEIMDLCCAPTSDGSGIGCDNMSIAIVALLDYTKNETLDQWYEKIISRVEQQQQQKNDPNSLNKYGPISQPYNELYKEMYGEYYDIGQQGQGGNGRSNIGSGSGRGSGASGSSSGGGASINGNSIFGRSGYDDEEDDDEEKNIERRRRDQDESNLNGGAISLQKLLASNAITNENGVIYLDTSSAQSLLAHFGVADAGAHGDEEDEEEEGEDVHQGLAHEEEEEEEKEGSKIEEISEKIDDEV

SEQ ID NO: 52750 - protein, 424 aa, Oryza sativa (indica cultivar-group)
MPLRPPSFQPLPDPCSPAAVKESDPCARHRRLRCHGRSEQFLIIFLIGLEESGFGEVYKCYLDGGSPVVVKKYICQNSKEGFAKEITVHGQINHKNVVRLLGYCAEENASMIVIEFISGGNLRDLQDNDNPIPLDARLSIGVECAEALAYTHSSMYQPVIHGDIKPDNILLDNNLGARLSDFRISRAKASENGISTGLVKNFTKALGEGNQKKAMMFDVGVANKSNMKSSMVVIVLIHNSASAMICLGKKVIWLSKNKSPMLHVGGLESRPLGGLVDFIKNTTNPMHHVTEGCQLQPINVENGNNGNATRTEKHLGWSTEEDLRLVSAWLNNSNNPIESNFKKNDKYWADVAAAYNSTTPSSRFRQVKQVKDRFSKIKKKVGNFCCSWKEANSLCASGECNVDLMAKAQKIYENDFKDGPFLLT

SEQ ID NO: 52751 - protein, 448 aa, Mycobacterium leprae TN
MSSTNNHQVVKLDRVPLPVEAARIAATYWQITRAAARVATKLAGKGPWQQKVIREIPQTFANLGPTYVKFGQIIASSPSAFGESLAREFRGLLDQVPPADTNEVHKLFVEELGDAPSKLFASFSEEPFASASIAQVHSAILHSGEHVVVKIQRPGIRRRVAADLQILKRFAQAVELAKLGRRLSAQDVVADFSDNLAEELNFRLEAQSMEAWGSYLHTSPLGKNIRVPKVHWEFTGERVLTMEQVHGIRIDNADAIRKSGFDGVELVKALLFSVFEGGLRHGLFHGDLHAGNLHVDDQGRIVFFDFGIMGRIDPRTRWLLRELVFALLVKKDHAAAGKIVVLMGAVGTVKPEARAAKDLENFTTPLAMKTLGDMSYTDIGRQLSALSDAYNVKLPRELVLIGKQFLYVERYMKLLAPEWQIMLDPELTGYFANFMVEVSREHQSDVEI

SEQ ID NO: 52752 - protein, 1248 aa, Solanum demissum
MFNKLLLVWFFVVTLVLGYVFSETEFEVLLEIKKSFLDDPENVLSNWSDKNQNFCQWSGVSCEEDTLKVVRLNLSDCSISGSISPSIGFLHDLLHLDLSSNLLSGPIPPTLSNLSSLQSLLLYSNQLTGPIPNEIGLLKNLQVLRIGDNVGLTGLIPSSLGDLENLVTLGLASCSLSGMIPPELGKLGRIENMNLQENQLENEIPSEIGNCSSLVAFSVAVNNLNGSIPEELSMLKNLQVMNLANNSISGQIPTQLGEMIELQYLNLLGNQLEGSIPMSLAKLSNVRNLDLSGNRLTGEIPGEFGNMDQLQVLVLTSNNLSGGIPKTICSSNGNSSLEHMMLSENQLSGEIPVELRECISLKQLDLSNNTLNGSIPVELYELVELTDLLLNNNTLVGSVSPLIANLTNLQTLALSHNSLHGNIPKEIGMVENLEILFLYENQFSGEIPMEIGNCSRLQMIDFYGNAFSGRIPITIGGLKELNFIDFRQNDLSGEIPASVGNCHQLKILDLADNRLSGSVPATFGYLRALEQLMLYNNSLEGNLPDELINLSNLTRINFSHNKLNGSIASLCSSTSFLSFDVTNNAFDHEVPPHLGYSPFLERLRLGNNRFTGEIPWTLGLIRELSLLDLSGNELTGLIPPQLSLCRKLTHLDLNNNRLYGSIPFWLGNLPLLGELKLSSNKFSGPLPRELFNCSKLLVLSLEDNSINGTLPLEIGELKSLNILNFDKNQLSGPIPSTIGNLSKLYILRLSGNSLTGEIPSELGQLKNLQSILDLSFNNISGQIPPSVGTLTKLETLDLSHNHLTGEVPPQVGEMSSLGKLNLSYNNLQGKLDKQYAHWPADAFTGNPRLCGSPLQNCEVSKSNNRGSGLSNSTVVIISVISTTVAIILMLLGAALFFKQRREAFRSEVNSAYSSSSSQGQKKPLFASVAAKRDIRWDDIMEATNNLSNDFIIGSGGSGTVYKAELFIGEIVAIKRIPSKDDLLLDKSFAREIKTLWRIRHRHLVRLLGYCNNSGEGSNVLIYEYMENGSVWDWLHKQPANNNKRKTCLDWEARLKIAVGLAQGVEYLHHDCVPKIIHRDIKSSNILLDSNMEAHLGDFGLAKAVHDNYNSYNTESNLWFAGSFGYIAPEYAYSSKATEKSDVYSMGIVLMELVTGRMPTDGSFGEDIDMVRWIESCIEMSREELIDPVLKPLLPNEESAALQVLEIALECTKTAPAERPSSRKVCDLLLHAFNDKVVHSDKMSPDNYV

SEQ ID NO: 52753 - protein, 348 aa, Staphylococcus aureus subsp. aureus MW2
MTYNIVALPGDGIGPEILNGSLSLLEIISNKYNFNYQIEHHEFGGASIDTFGEPLTEKTLNACKRADAILLGAIGGPKWTDPNNRPEQGLLKLRKSLNLFANIRPTTVVKGASSLSPLKEERVEGKDLVIVRELTSGIYFGEPRHFNNHEALDSLTYTREEIERIVHVAFKLAASRRGKLTSVDKENVLASSKLWRKVVNEVSQLYPEVTVNHLLVDACSMHLITNPKQFDVIVCENLFGDILSDEASVIPGSLGLSPSASFSNDGPRLYEPIHGSAPDIAGKNVANPFGMILSLAMCLRESLNQPDAADELEQHIYNMIEHGQTTADLGGKLNTTDIFEILSQKLNH

SEQ ID NO: 52754 - protein, 251 aa, Triticum aestivum
  misc_feature (116)..(116): Xaa can be any naturally occurring amino acid
  misc_feature (124)..(124): Xaa can be any naturally occurring amino acid
  misc_feature (130)..(130): Xaa can be any naturally occurring amino acid
  misc_feature (147)..(147): Xaa can be any naturally occurring amino acid
  misc_feature (177)..(177): Xaa can be any naturally occurring amino acid
  misc_feature (206)..(206): Xaa can be any naturally occurring amino acid
  misc_feature (240)..(240): Xaa can be any naturally occurring amino acid
MAAVGLLGVCPAPAPGGPARQAGASPAAGSWGWRARPRSLRSVPPPGGAGRGGARAARPPRAAMGGGDLYALDFDGVFCDSCGESSLSAVKAAKVRWPWVFEQVDAALEEWIVEQXMHTLRPVXETGYEXNLLLGKVAWLRSKIPSXALRKSSVARWGLASKHILGNWAKLLPPLIXDEWQEDRESLVDPFGRVRDDWLENDLSGXWIGANGFYPGTADALTLSGPELFIVPTKQSRFRXTLKMVDKFPKG

SEQ ID NO: 52755 - protein, 698 aa, Debaryomyces hansenii CBS767
MQQGEVLLFQRKALKKNKLRLKDVESGEIVNISSDGNYSGSDNEMANNLQAGGRIFHWRKLTYKVKIKSEERVILNNVHGWVKPGQITALMGASGAGKTTLLNALSDRLTTGDITAGTRMVNGHELDTSFQRSIGYVQQQDLHLETSTVREALTFSAYLRQPKSVPKSEKDSYVGNIIRLLEMEKYSEAVVGVPGEGLNVEQRKRLTIGVELVAKPKLLVFLDEPTSGLDSQTAYSICKLIRKLADHGQAILCTIHQPSAILLKEFDRLLFLQKGGETVYFGDLGDNCQTLIEYFERYGAPKCPTEANPAEWMLEIIGAAPGSHANQNYHDAWVNSREYKAVNEELDVMEQELVKKPKDNSPEDMTKYAVPFWCQYKHVTHRVFQQYWRTPSYTYSKIFMTVFSSLFNGFIFFKADKSLQGLQNQMFSVFMFLFILDTLVQQYFPNFIAQRDLYEVRERPSRSFSWVAFILAQITAEIPWQIFSGTIAFFCWYYPIGLYRNAEATDAVSERGALMWVVIILFFIYCSTIAQLCISFNELANNAANLVSLLFTMCLTFCGVLASSDAMPRFWIFMYRCNPFTYLVSVILSLGLADSDVTCSDKELLKFKPQSGRTCGEYMQPYMEKTGGYLISNDSTESCNFCTTSSTNMFLSKVGADYSKKSRDIGIFVCFIVINIIGTIFLYWVARVPKGNRQKLSK

SEQ ID NO: 52756 - protein, 808 aa, Arabidopsis thaliana
MESPHSNLLPEVDSLPDGFVDGATEPPLNSPKTQEETTNHETVAIEKTEKPRTFPVPLCETDGNEDDEVADLIQESIKLELEFEQKEKEASPPISQTLSEGSTQNSTLSKEMDSLKPKKQEVVESKRKGSKNMFKSEKEFLEFMLKYQQVLSERDSAITVRDKLESLCRELQRQNKMLMEECKRVSTEGQTLRSDLSTKFQDAIMDVSIKLDEQKNESLTQLKENEMLRTKLKHLADQFMLSEQQHEQRLKQKTLELQISALKIKQHEEKLIHEQSQMKVYADQVSQLLSTEKNLRLQLTSDGDKFQQFQDALVKSNEVFETFKQEIDKMSKAIKELRKENAFLKNKTEKSDITLIELVEERERLKKLLEKTKKQKDKLESLCRSLQAERKQKETNSSQENDSAFTKFTTDLEKNSYFNICHNDQLILCNLKPNRTEPFEPKKKRMLGILRQRAIDGASTLRRTRFALVSARSYAAGAKEMTVRDALNSAIDEEMSADPKVFVMGEEVGQYQGAYKITKGLLEKYGPERVYDTPITEAGFTGIGVGAAYAGLKPVVEFMTFNFSMQAIDHIINSAAKSNYMSAGQINVPIVFRGPNGAAAGVGAQHSQCYAAWYASVPGLKVLAPYSAEDARGLLKAAIRDPDPVVFLENELLYGESFPISEEALDSSFCLPIGKAKIEREGKDVTIVTFSKMVGFALKAAEKLAEEGISAEVINLRSIRPLDRATINASVRKTSRLVTVEEGFPQHGVCAEICASVVEESFSYLDAPVERIAGADVPMPYAANLERLALPQIEDIVRASKRACYRSK

SEQ ID NO: 52757 - protein, 545 aa, Candida albicans
MSSKIERIFSGPALKINTYLDKLPKIYNVFFIASISTIAGMMFGFDISSMSAFIGAEHYMRYFNSPGSDIQGFITSSMALGSFFGSIASSFVSEPFGRRLSLLTCAFFWMVGAAIQSSVQNRAQLIIGRIISGIGVGFGSAVAPVYGAELAPRKIRGLIGGMFQFFVTLGIMIMFYLSFGLGHINGVASFRIAWGLQIVPGLCLFLGCFFIPESPRWLAKQGQWEAAEEIVAKIQAHGDRENPDVLIEISEIKDQLLLEESSKQIGYATLFTKKYIQRTFTAIFAQIWQQLTGMNVMMYYIVYIFQMAGYSGNSNLVASSIQYVINTCVTVPALYFIDKVGRRPLLIGGATMMMAFQFGLAGILGQYSIPWPDSGNDSVNIRIPEDNKSASKGAIACCYLFVASFAFTWGVGIWVYCAEIWGDNRVAQRGNAISTSANWILNFAIAMYTPTGFKNISWKTYIIYGVFCFAMATHVYFGFPETKGKRLEEIGQMWEERVPAWRSRSWQPTVPIASDAELARKMEVEHEEDKLMNEDSNSESRENQA

SEQ ID NO: 52758 - protein, 237 aa, Arabidopsis thaliana
MSSQICRSASRAARSLLSSAKNARFFSEGRAIGAATVVHATGKVPQYASNFGKSGSGFVSNSWITRLLALPAAAFMLQDQEALAAEMERTFIAIKPDGVQRGLISEIITRFERKGYKLVGIKVMVPSKGFAQKHYHDLKERPFFNGLCNFLSSGPVVAMVWEGEGVIRYGRKLIGATDPQKSEPGTIRGDLAVVVGRNIIHGSDGPETAKDEISLWFKPEELVSYTSNAEKWIYGQN

SEQ ID NO: 52759 - protein, 216 aa, Gluconobacter oxydans 621H
MACGRDTLAKLLGGVRKFETDVYPENAELFESLASSQSPSTLFITCADSRISPSLITQTEPGELFIVRNVGNIVPAYGEMLGGVSSAIEYAVGALKVKNVIICGHSNCGAMGALMDLNSPKLDSLPTVKSWMRPWRSRTRGPGRSEGRGCRAGRHPFACRIQRAAPARASAHPSHRRPGAGTGCAEASGLVLRHPQGRDPHSRRGHAQDAHGRERA

SEQ ID NO: 52760 - protein, 838 aa, Candida albicans
MIFPILPVISSPEDKQSIDEFSLVGQVLFPIESVSPKKHFIHQFPHDLDIFVNAIDNATTDQIVELLNVGIKQVFVNEKQYHDAIEAGSPSSRFVVAVDVPSTELLTSEASFVTSKPFSESDLKKYNANENRVIYIESNFTQDGAIELAKNYVPVIPSTKLTVKREEENKISISAVFVSTLTTDRPDGLYTTLITTPSPSYTALGIVYSSKDSIIAAIEEKVGVYQSRKRRDELWYKGKTSGATQKLVKLSKDCDSDVIQFMVEPRTGYGFCHRETKFTCFGDDIADSPARGLPKLDSTLQDRLENAPEGSYTKRLFDDEKLLIAKLKEELDELIEAKSKEEIAWECADLVYFAMVWCIKHGVRLADIEKNLDVKSLKVSRRKGDAKPQYQEAPVNSSYKLEIVSVDDAAAVERAMTRPVQKTADIMKLVLPIIEKVKSDGDKALIELTSKFDGVKLDAPVLQAPFPADLMDISEEMKAAIDLSMQNIEKFHAAQLPKEKVMTVETSPGVYCSRFAKPIENVGLYVPGGTAVLPSTAMMLGVPAKVAGCKNIIVASPPSRATGKLTPEVVYVAHKLGAKCIVMAGGAQAVTAMAYGTESVLKCDKILGPGNQFVTAAKMYVQNDTQALCSIDMPAGPSEVLVIADSNADADFVASDLLSQAEHGVDSQVILIGVGLSDEKLNEFQAAVERQAKVLPRKDIVAKCLAHSYILLAKTYKEAFDLSNQYAPEHLILQIDDAPSYVPDSIENAGSVFVGALSPESCGDYSSGTNHTLPTYGYARQYSGVNTATFQKFITSQEVTEKGLQNIGKAVMELARVEGLEAHRRAVEIRMERMAETK

SEQ ID NO: 52761 - protein, 242 aa, Oryza sativa
QGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLQLLSFFILELSLVEYQMLKYRPSLLSAAAVYTAQCALTRCQQWTKTCELHSRYTGEQLLECSRMMVDFHQKAGAGKLTGVHRKYSTFKFGCAAKTEPALFLLESGAGGYNLKKQPC

SEQ ID NO: 52762 - protein, 473 aa, Parthenium argentatum
MDPSSKPLREIPGSYGIPFFQPIKDRLEYFYGTGGRDEYFRSRMQKYQSTVFRANMPPGPFVSSNPKVIVLLDAKSFPILFDVSKVEKKDLFTGTYMPSTKLTGAYRVLSYLDPSEPRHAQLKNLLFFMLKNSSNRVIPQFETTYTELFEGLEAELAKNGKAAFNDVGEQAAFRFLGRAYFNSNPEETKLGTSAPTLISSWVLFNLAPTLDLGLPWFLQEPLLHTFRLPAFLIKSTYNKLYDYFQSVATPVMEQAEKLGVPKDEAVHNILFAVCFNTFGGVKILFPNTLKWIGVAGENLHTQLAEEIRGAIKSYGDGNVTLEAIEQMPLTKSVVYESLRIEPPVPPQYGKAKSNFTIESHDATFEVKKGEMLFGYQPFATKDPKVFDRPEEFVPDRFVGDGEALLKYVWWSNGPETESPTVENKQCAGKDFVVLITRLFVIELFRRYDSFEIELGESPLGAAVTLTFLKRASI

SEQ ID NO: 52763 - protein, 415 aa, marine gamma proteobacterium HTCC2143
MDAFQYHNGQLQAENIPLAVIAERFGTPTYVYSRGYLEQQFLSYQRALAGRQHMICYAVKANSNIAVLNVLARLGAGFDIVSGGELERVLAAGGDPAKVVFSGVAKTPAEMRQALEAGIHCFNLESESELGVLQQVAADLGVSASISIRVNPDVDANTHPYISTGLKENKFGIDIDRAPAVYRRARDLSHINIIGVDCHIGSQLVDTTPFLDALDRLLKLIDTLANDGIHISHLDLGGGLGVCYTDEQPPSPAEYIEKVLTHIGDRDITLAFEPGRSICANAGVLLTKVEYLKCNPEKNFAVIDAAMNDMIRPALYQAWMDIKAVCPRKNEPTKTWDIVGPVCETGDFLGKDRQLELREGDLLSVSSAGAYGFTMSSNYNSRVRAAEVMVDGDDVHLIRARETVADLMQGEALLP

SEQ ID NO: 52764 - protein, 426 aa, Yersinia pestis KIM
MTPSDLVFDQQHIWHPYTSMTEPLPCYPVVGAEGVELQLADGRRLIDGMSSWWAAIHGYNHPVLNFAAHQQLDKMSHVMFGGITHPPAVKLCRQLVAMTPPPLECVFLADSGSVSVEVALKMALQYWQAKGERRQRILTLRHGYHGDTFGAMSVCDPQNSMHSLYQGYLAENLFANAPQCGFDDPWDPQDIANFVALITQHANEIAAVILEPVVQGAGGMRIYHPSYLREVRALCDKHQILLIADEIATGFGRTGKLFACEHAQIVPDILCLGKALTGGYLTLSATLTTRAVAETISKGDAGCFMHGPTFMANPLACAVASANLSLLAENSWQQQVSKIEDQLKRELLPLAQEDTVADVRVLGAIGVVEMKKPVNVARLQRSFVEQGVWIRPFGKLIYLMPPYIISQHALTRLTAAVAAAVVDRGS

SEQ ID NO: 52765 - protein, 591 aa, Mesorhizobium sp. BNC1
MCGICGEVRFDGRTPSVSAISGMMEALAPRGPDGAGIVSHGNAGFGHRRLRIIDLSEKAQQPMVDSALGLTIAFNGCIYNYPELREALEAKGYSFFSHGDTEVILKAWHAWGETCVERFHGMFAFVIQERDTGRIVMARDRFGIKPLYLAEKSGVLRFASSLPALVKAGDVDTSIDRVALHHYMTFHAVVPPPRTILNGVRKLPPATIRVIEADGRSTERRYWDPPYRRDPADAGVSAEEWRDRVHEALRLAVKRRMVADVPVGVLLSGGVDSSLIVGLLAEAGQTGLMSFSVGFEEANGEKGDEFVYSDLIAKEFGTDHHKIFVPSDRLMDALPGTFAAMSEPMVSYDNVGFYLLSQEVSKHIKVVQSGQGADEVFGGYHWYPPLARSNDVVADYAKVFFDRSHETLKRQLGANWINGEDYSRGLVAAELMRPGADSPVDRALRLDANVMLVDDPVKRVDNMTMAWGLEARVPFLDHELVELAARIPPEEKLKDGGKGVLKDVARLVVPHEVIDRPKGYFPVPQLKYVAGPYLEMVRDALGSQRARERGLFRQDYLDRLFAQPADHITPLRGSELWQAGLLELWLQTHGI

SEQ ID NO: 52766 - protein, 160 aa, Hippophae rhamnoides subsp. sinensis
DEYGNPIHNGSTGINTTGYQQQTAGLYGTGHGSGYGTGGTQFGTTQHTAGHGTGGTLTSTAPAGHGQTKLRRSGSGSSSSSEDDGQGGRRKKGLKEKIKEKLPGGHKDQHQPGQYKSVTTTIITPDSGYYEQSGQQHQQQHDKGIMDKIKDKLPGSFSLI

SEQ ID NO: 52767 - protein, 185 aa, Arabidopsis thaliana
MAEEIKNVPEQEVPKVATEESSAEVTDRGLFDFLGKKKDETKPEETPIASEFEQKVHISEPEPEVKHESLLEKLHRSDSSSSSSSEEEGSDGEKRKKKKEKKKPTTEVEVKEEEKKGFMEKLKEKLPGHKKPEDGSAVAAAPVVVPPPVEEAHPVEKKGILEKIKEKLPGYHPKTPVEEEKKDKE

SEQ ID NO: 52768 - protein, 228 aa, Pseudomonas fluorescens Pf-5
MAVQIGFLLFPEVQQLDLTGPHDVLASLPDVQVHLIWKEPGPVVASSGLVLQATTSFADCPPLDVICIPGGTGVGALMEDPQALAFIRQQAARARYVTSVCTGSLVLGAAGLLQGKRATTHWAYHELLAPLGAIPVHERVVRDGNLLTGGGITAGIDFALTLAAELFDAATAQRVQLQLEYAPAPPFNAGSPDTAPASVVQQARQRAADSLHKRREITLRAAARLAAG

SEQ ID NO: 52769 - protein, 386 aa, Arabidopsis thaliana
MMNPPVDLPYIPDDLLLNCLARVSRLYYPILSLVSKRFRSLVASLELYEIRKLLGHREKCLYLNLRFSSESEPRWFTLCRRPTRSPNPNFNSGWFASCFIPHTMKKEKKSSDNNLMVPVPTSNFITPPSELTRITNGSNIYIVRVFTNGAFSSRFLFMDCRSHTLHEVPRMDKTKKKPFMIRVLDGKIYVIEGCKNPDYSNLIERFDLKTQTWEHVPSPSAEIRGSYITGSLVYDGKLYLFGDKRVVYKPKENKWDVVGLEMPLRWTPSYISCVVDNVIYSYGRSRVLMWYNTEERLWRYLKGLKKLPKLPKDCTCVRLLGYSGKVVVLWEKNVGGGDPQKKMIWCAEIALERRSANKIYGKIEWCDVVLTLPRSCSLLNFAAVTV

SEQ ID NO: 52770 - protein, 221 aa, Arabidopsis thaliana
MDSLATDPAFIDSDVYLRLGLIIEGKRLKKPPTVLSRLSSSLERSLLLNHDDKILLGSPDSVTVFDGRSPPEISIAHYLDRIFKYSCCSPSCFVIAHIYIDHFLHKTRALLKPLNVHRLIITTVMLAAKVFDDRYFNNAYYARVGGVTTRELNRLEMELLFTLDFKLQVDPQTFHTHCCQLEKQNSDGFQIEWPIKEACRANKETWQKRTPDSLCSQTTAR

SEQ ID NO: 52771 - protein, 182 aa, Thiomicrospira crunogena XCL-2
MLCHKYKKLIMKQHPLAQYLEAVPDFPKEGILFQDISPLLRDHFVATIDAMSLLFSAKEWAEVDYLVGVESRGFIFASALALKHDKGFVKVRKPGKLPNVHASMEYGLEYGTDKLEMQKGNGKKVIICDDLIATGGSMQAAAKLCNEVGYEVVGMACLVDLKALNSFSHDGMTVRSVIQFDD

SEQ ID NO: 52772 - protein, 2151 aa, Arabidopsis thaliana
MYYHSLSSYSILFFLFSLFHHLPCASSNQGLGWCESLFQCGNITADFPFWGGNRHKPCGHPLLELHCNNNNITSLYISNQEFYVRQINQTSNTLTLARSDLLGSFCSSYAYNTTTLPPEIFELSPTYKSLTVLYHCDPKLSYRSSYTCPALGTFSMSQSVDYQYSCQNSFTVNVPTSFHPEERGLNLTNLESALRKGFEVKLVIDEIPCQQCSSTRGICSFNGTTQSCCNATSPSGGVSCVPYQHSADEVYRRCSESFSCGSQRDLNYPLWKPGREECGHPNFKLNCSGGFAEINIASVKFRILDSYRSLIRLARSDYIGDLCPANPLTAPFIEKFLPVLELTGETELLTLYYGCRFNSSDIPANIYVGELGCDEGRSYYVTRNLSSPLLDSSRGVLNNLREMCKRNVSVPASGPALFDLQTRPNQDNLKMALDQGFRMLITSDCERCRGSGGACGYNQTSSGFGCYCKDGKCGYEYDALGALTGVVIVFLVLLCPCFRVQIFRKRKTSDEVRLQKLKALIPLKHYTYAEVKKMTKSFTEVVGRGGFGIVYSGTLSDSSMVAVKVLKDSKGTDGEDFINEVASMSQTSHVNIVSLLGFCCEGSRRAIIYEFLGNGSLDKFISDKSSVNLDLKTLYGIALGVARGLEYLHYGCKTRIVHFDIKPQNVLLDDNLCPKVSDFGLAKLCEKKESILSLLDTRGTIGYIAPEMISRLYGSVSHKSDVYSYGMLVLEMIGARKKERFDQNSRSDGSSIYFPEWIYKDLEKANIKDIEKTENGGLIENGISSEEEEIARKMTLVGLWCIQSSPSDRPPMNKVVEMMEGSLDALEVPPRPVLQQISASSVSDSFWNSEESSSASDILVFSTNSKLESSNLYFSPVITLPTLNSTNNILQREETVKTENKSQESIPEVKTPIIVSWNETERLSQRLASFCPKVSEFGLAKLCEEKESILSMLDTRGTVGYIAPEMISRVYGNVSDKSDAYSYGMLVLEIIGARNKEKANQACASNTIQCTFLNGHIEDGINSEENELAKKMTLLFAAQVDAQRSTSPWQTLSGDAPLVIARGGFSGLFPDSSLAAYQFAMVLTKDGHGICFPDLNLANASNSEEVYPNRQKSYPVNGVTTKGWFPIDFSLTELQKVLFSLIRGILSRSGKFDENGYSISTVQNVATQMKPALFWLNVQHDEFYEQHNLSMSSFLLSTSRTVSIDFISSPEVNFFRKIAGGFGNNGPSFVFQFMGKEDFEPTTNRTYGSILSNLSFVKTFASGILVPKSYILPLDDKQYLLPHTSLVQDAHKAGLKLYASGFANDVDIAYNYSWDPVSEYLSFVDNGNFSVDGMLSDFPLTASASVDCFSHIGRNATKQEQKHYHLPMVRASVDFLVISKNGASGEYPGCTKLAYEKAIKDGSDVIDCPVQMSSDGIPFCSSSIDLVNSTTVGQTHLRNRSIIVPEISSVAGIFTFSLTWHEIQSLTPAISNPFRENGMSRNPNERNSGNLISLYEFLNLAKNSTSLSGILISLENVVYLREKKGLDVVKVVLNRLTETGYIVGTLKVMIQSTTRLVLVDFKNQSTYKTVYKIKETIGNITDSAIEDIKKFANAVVINKASVFPNSDSFLTGQTTNVLERLQKFQLPVYVELFQNEFVSQPFDFFADETVEINAYIFGAGINGTITEFPYTAARYKRNRCLGREEVPPYMLPVNPGGVLTLISTSSLPPAQDPNPIFTHDDVTEPPLPPVIAKSPTSTLGTPSTIAKPLSLFITFLLLLDQVWFHSDNFFLLNGCTGNFLKVIRIVSWSVAGVVLFLVLLTLVFCFHRKRETRLRQQKLKALIPLEHYTYAQVKRITKSFAEVVGRGGFGIVYKGTLSDGRVVAVKVLKDTKGNGEDFINEVATMSRTSHLNIVSLLGFCSEGSKRAIIYEFLENGSLDKFILGKTSVNMDWTALYRIALGVAHGLEYLHHSCKTRIVHFDIKPQNVLLDDSFCPKVSDFGLAKLCEKKESILSMLDTRGTIGYIAPEMISRVYGNVSHKSDVYSYGMLVLEIIGARNKEKANQACASNTSSMYFPEWVYRDLESCKSGRHIEDGINSEEDELAKKMTLVGLWCIQPSPVDRPAMNRVVEMMEGSLEALEVPPRPVLQQIPISNLHESSILSEDVSVYTEG

SEQ ID NO: 52773 - protein, 219 aa, Yarrowia lipolytica CLIB122
MDPFVQVCADAQNQLTQTRDLLEQFRSDPSNHNTLQDLTNITEELAETISDLSQSVEAAQGRPQQFGLSSEDIQDRSKQVAQLMSQLGQVQKEVSKIRNTGTPHGIYSDEPDDTEARTAGLTQQMYASQIEEQDNALDGVYNTVNSLREQANVMSRELEDQSYLIDDLDRHADSAGSRLQRGLKKVDWVVRKNQETLGSCCITLLIVALIILLVLLIAL

SEQ ID NO: 52774 - protein, 122 aa, Zea mays
ETNPSPATSFKKKKRYSKKRKAIEVTVDASFHGAAAPVVGYFPTGYDPLAAAEPPRARLFCHEKHHNRVELVVGAPGGGPDFVGRSYAGEAAAPQLCGYALGVLDKATGTLKIVPISSNKIL

SEQ ID NO: 52775 - protein, 502 aa, Frankia sp. EAN1pec
MSTLTPPDAVALPFLDGGPRRLLIGGEWTDAASGRTFPSINPSTGETLTELAEGGAEDVNRAVAAARAAFEGPWRRMLPSERQDLIWAFADAVTAHQEELKLLEALDMGAPIGRRRPGTKPGSSWEAGVLRYFAGWVTKIHGETIPNSIPRQVLSYTLKEPIGVVAAIVPWNRPVSNAIWKIAPVLAAGCTMVLKPAEEASLAALRLGELLTEVGIPPGVVNIVTGPGETAGAALSEHPDVDKVAFTGSTTTGQHIVRAAAGNLKRVSLELGGKSPDVVFADADLDRAVPGAAMAVFTNSGQICCAGTRIFVERSIHDEFVERIATFTANLQVGNSLDPKTRIGPLVSAEQLERVVGYLDLSREEGARAAAGGARIETDDLARGYFVAPTVLTDVHDEMRVVREEIFGPVACVLPFDSVEEVTARSNDTQFGLAGGVWTRDVGKAHRLARDLRAGTVWVNNFNLMDPAVPFGGYKTSGWGREMGHQALDEYLNVKSVWIDMA

SEQ ID NO: 52776 - protein, 484 aa, Synechococcus sp. RS9916
MTKRDHRPAGPWASHRSCLMRASWVSARKGQANVSQMHYARQGLITEEMAHVAKRENLPESLIMEEVARGRMIIPANINHTNLEPMAIGIASKCKVNANIGASPNASDAAEEVKKLQLAVKYGADTVMDLSTGGVNLDEVRTAIINASPVPIGTVPVYQALESVHGSIERLSEDDFLHIIEKHCQQGVDYQTIHAGLLIEHLPKVKGRITGIVSRGGGILAQWMLYHHKQNPLYTRFDDICEIFKRYDCTFSLGDSLRPGCQHDASDAAQLAELHTLGELTRRAWQHDVQVMVEGPGHVPLDQIEFNVKKQMEECSEAPFYVLGPLVTDIAPGYDHITSAIGAAMAGWHGTAMLCYVTPKEHLGLPNADDVREGLIAYKIAAHAADIARHRPGARDRDDELSRARYNFDWNKQFELSLDPERAKEYHDETLPADIYKQAEFCSMCGPKHCPMQTKITDADLEGLEDVLKAQGAAEFTAVKQDKA

SEQ ID NO: 52777 - protein, 579 aa, Glycine max
MCGILAVLGCSDSSQAKRVRVLELSRRLKHRGPDWSGLHQYGDNYLAHQRLAIVDPASGDQPLFNEDKTVVVTVNGEIYNHEELRKQLPNHTFRTGSDCDVIAHLYEEHGENFVDMLDGIFSFALLDTRDNSFIVARDAIGVTSLYIGWGLDGSVWISSELKGLNDDCEHFESFPPGHLYSSKERAFRRWYNPPWFSEAIPSAPYDPLALRHAFEKAVVKRLMTDVPFGVLLSGGLDSSLVAAVTARYLAGTNAAKQWGTKLHSFCVGLEGAPDLKAAKEVADYIGTVHHEFHYTVQDGIDAIEDVIYHIETYDVTTIRASIPMFLMSRKIKSLGVKWVISGEGSDEIFGGYLYFHKAPNKDEFHQETCRKIKALHKYDCLRANKSTFAWGLEARVPFLDKDFIRVAMNIDPEYKMIKKEEGRIEKWVLRRAFDDEEHPYLPKHILYRQKEQFSDGVGYGWIDGLKAHAEKHVTDRMMLNAANIFPFNTPTTKEAYYYRMIFERFFPQNSARLSVPGGPSVACSTAKAVEWDAAWSNNLDPSGRAALGVHASAYGNQVKAVEPEKIIPKMEVSPLGVAI

SEQ ID NO: 52778 - protein, 493 aa, Frankia sp. EAN1pec
MRDRLMYRDAFYINGTWAAPAGSGTLNVVSPSTEEIVGALPEATREDMDRAVRAARDAFENGPWPRMSAAERADILARAAEALRKHEAEIAQVTTDEMGCATSQAKAAQTGLVAPVFEYYSELARSYEFERTVVAGDRGALVTQEPVGVVAAIVPWNAPVTLAAWKAAPALAAGCTVVLKPAPEAPLSNFILADAMDEAGVPPGVVNVVPGGREVGEYLVTHPDVAKVAFTGSTAAGQRIMSLCGEAVRRVSLELGGKSASILVDDADFDTVVPTVVRGGMHLSGQVCGAHTRVLVPRSRYEKVLEIAAAAAAGVSVGDPHDPSVFVGPLVAERQRTRVEGYIEGAVRDGARVVAGGVRPEHLPRGWYVAPTIIGDVDNNMRIAREEIFGPVLCFLPYDDIDDAVRIANDSQYGLSGGVWSADPARGVEVARRIRTGSVAVNGAYPPFPLVPFGGFKQSGLGRELGPEGLAGFLETRSIGLPAALVAASQPTP

SEQ ID NO: 52779 - protein, 669 aa, Synechococcus sp. RS9916
MVAAPASIDTLCVNSIRMLAVDAINKSKSGHPGLPMGCAPMGYALWDKFLKHNPKNPKWFNRDRFVLSAGHGCMLLYALLHLTGYDSVTIDDIKTFRQWGSKAPGHPETFETPGVEVTTGPLGAGISNAVGLAIAEAHLAAKFNKPDANLVDHYTYVVMGDGCNQEGVSSEAASLAGHLKLGKLIALYDDNNITIDGRTDVSFTEDVLKRYEAYGWHVQHVADGNTDVDAIAKAIEAAKAVTDKPSIIKVTTTIGYGSPNKSDTAGVHGAPLGDDETALTRQQLNWNYGPFEVPQEAYDQFRQAIERGASLEAEWNQTLATYRTQYPAEAALFERMLRGELPEGWDKDLPTYTPEDGGLATRKHSQICLGALGPNLPELIGGSADLTHSNYTDIKGETGSFQADSPDKRYLHFGVREHAMAAILNGIAYHNSGLIPYGGTFLVFADYMRGSMRLSALSELGVIYVLTHDSIGVGEDGPTHQPIETIPSLRAMPNMLVFRPGDGNETSGSYKLAIENRKRPSALCLSRQGMVNQANSSIEKVAFGGYILEDCEGTPELILIGTGTELDLCVQAAKQLSAEGKKVRVVSMPCVELFDEQSDAYKEQVLPSAVRKRIVVEAAEAFGWHRFIGLDGDSVTMNRFGASAPGGVCMEKFGFTVDNVVAKSKALLG

SEQ ID NO: 52780 - protein, 436 aa, Clostridium perfringens ATCC 13124
MAQQLISKEQGSIKTLGIFSYFKNGILGLQHLVAMFGATILVPLVTGLDPSVALFTAGIGTLIFHLCTKGKVPVFLGSSFAFIPVIQVIASKYGDLRYAQGGIFFAGLAYVLISFGIKKIGVDKIKRFLPARVVGPMIMVIGLNLIPNALEMAGVKSLIAGETGAMTSVLIACTTLGLALIISKFGKGFFSQLAIITAVCVGYTLSLILGQVDTSLIQQSTMVAVPNFTLPKFDFGAIMITLPVILAVSMEHIGDITTNGQVVGKNFIEDPGLNRTVLGDGLATLVASLLGGPANTTYGENTGVLAITKNYNPSILRLTAVFAIILSFIAKFGAVIRTIPQSVMGGISLMLFSMIALVGVKTIKNEGVKLNKTNLILMGSIIFVGLSGLFMSEPIGIEISEAVSISGLSLAALIGVILNLIITKFESAKSRKEVIA

SEQ ID NO: 52781 - protein, 223 aa, Arabidopsis thaliana
MVSHEENTSIVEWFLGPHPYTYPPYGIEMIHEDDEVAVAHHHHHHQSGEYYREYEDHRSSDVDNDEIIARTLQDDFLQLEIAESNDYSHQNQQQQHQQEGYTNNYSNNNNGYAWNDQSPAVDYSSEWIGNDNDQDGRSDDSVNVFSCSSPSDTDEYVYSWESDQCDADGEFGRRLNQMVPIPYIPKINGEIPPEEEAVSDHERLRNRYLFLLILCFLSYINHS

SEQ ID NO: 52782 - protein, 216 aa, Glycine max
IRLEGEDGPTHQPIETLAHFRALPNMMVWRPADGNETSAAYYVALTSEKTPSILALTRQNLPQLEGSTIENGIKGGYVAVEAEGAQITLVSTGSEVSLCLEAAKYLKDNKGVTARVVSMPCMEVFDAQPKDYKLKVIPDGIPSLSVEVMSTLGWEKYSHEQFGLNRFGASGPYKEVYAKFEFTPEGIAKRAVATIDFYKEVKPLRSPLNRAFQQLI

SEQ ID NO: 52783 - protein, 213 aa, Mycobacterium leprae TN
MFNTNPIAAWKALKEGNERFVAGQPAHPSQSVEHRASLADTQKPLAVIFGCADSRVAAELVFDQGLGDMFVVRTVGHVIDSAVLGSIEYAVTVLDVPLVVVLGHDSCGAVTAALAAINEGNLPSGYVRDVVERVAPSVLLGRRDGLTRVDEFEERHVHETVAQAMARSTAIAQRVAAGTLAIVGVTYHLADGRAVLRTHIGNLGEEVQLSHCS

SEQ ID NO: 52784 - protein, 1080 aa, Xylella fastidiosa Temecula1
MPKRTDLRTILIIGAGPIVIGQACEFDYSGAQACKALRAEGFRVVLVNSNPATIMTDPDMADAVYIEPIHWRTVEKIITKEKPDALLPTMGGQTALNCALDLADHGVLEKYGVELIGAKREAIRMAEDRELFRVAMQEIGLECPKAEVAKSLERALEIQAKVGFPTIIRPSFTLGGTGGGIAYNRQEFEEIIKRGLELSPVHEVLVEESVLGWKEFEMEVVRDASDNCIIVCSIENLDPMGVHTGDSITVAPAQTLSDKEYQRLRDASIAVLRKIGVDTGGSNVQFGIDPQTGRVVVIEMNPRVSRSSALASKATGFPIAKIAAKLAVGYTLDELKNEITGGKTPASFEPSIDYVVTKIPRFAFEKFPQADARLTTQMKSVGEVMAMGRTFAESLQKAVRGLETGKVGLEPTGLDLSSEDDLVVLKRELKAPGAERLFYVADAFRAGFAVADVYALSYIDPWFLDQIEEIVAAEGRLVTDGLGSIDGARLRQLKRIGFSDARIAQLTGTNEVAVRTLRRVLKVKPVYKRVDSCAGEFATGTAYLYSTYEEECEAAPSDRRKIMILGGGPNRIGQGIEFDYCCVHAALALREDGFETIMVNCNPETVSTDYDTSDRLYFEPLTLEDVLEIVEVEHPVGVIVQYGGQTPLKLAKALEANGVPVIGTSPESIDLAEDRERFQRLVQQLGLRQPPNCTARTADEALVLAREIGYPLVVRPSYVLGGRAMEIVYSEADLARYVRDAVKVSNDSPVLLDRFLDNAVEVDVDIIADPEGQVLIGGVMEHIEEAGVHSGDSSCSLPPYSLSAATQDDLRRQVIRLAQALNVIGLMNTQFAIQSNDDGSDIVYLLEVNPRASRTVPFVSKATGVPLAKIAARCMTGKTLAEQSVTCEVVPAYYAVKEAIFPFAKLQGVDPILGPEMRSTGEVMGVGRSFAAAFARAQEAGDIRAPQPGRAFVSVRDPDKKRVLPVVLALVERGFGVVATAGTYAWLQQNGVACEVVNKVAEGRPHIVDLIKNGEIVYIINTTEGRAAIADSFSIRREALQHCVTYSTTIAGAKALVNSLEFRGTGPVWSLQELHKELQV

SEQ ID NO: 52785 - protein, 400 aa, Nostoc sp. PCC 7120
MSKKTVASLSAADISGKRALVRVDFNVPLDDQGNITDDTRIRAALPTIQDLTQKGAKVILASHFGRPKGVDEKLRLTPVAKRLSELLGQEVIKTDDSIGDEVAAKVATLQNGQVLLLENVRFYKEEEKNDPEFAKKLAANADFYVNDAFGTAHRAHASTEGVTKFLSPSVAGYLVEKELQYLQSAIENPQRPLAAIIGGSKVSSKIGVIETLLEKCDKLIIGGGMIFTFYKARGLNVGKSLVEEDKLELAKSLEAKAKERGVSLLLPTDVVLADNFAPDANSQTVSIENIPDGWMGLDIGPDSVKVFQAALADTKTVIWNGPMGVFEFDKFAAGTEAIAHTLAEIGKTGTTTIIGGGDSVAAVEKVGLADQMSHISTGGGASLELLEGKVLPGIAALDEA

SEQ ID NO: 52786 - protein, 298 aa, Arabidopsis thaliana
MIPYATVEEASIALGRNLTRLETLWFDYSATKSDYYLYCHNILFLFLVFSLVPLPLVFIELARSASGLFNRYKIQPKVNYSLSDMFKCYKDVMTMFILVVGPLQLVSYPSIQMIEIRSGLPLPTITEMLSQLVVYFLIEDYTNYWVHRFFHSKWGYDKIHRVHHEYTAPIGYAAPYAHWAEVLLLGIPTFMGPAIAPGHMITFWLWIALRQMEAIETHSGYDFPWSPTKYIPFYGGAEYHDYHHYVGGQSQSNFASVFTYCDYIYGTDKGYRFQKKLLEQIKESSKKSNKHNGGIKSD

SEQ ID NO: 52787 - protein, 334 aa, marine gamma proteobacterium HTCC2143
MTAFGSVFMPEMALTRFDGEQWSNFEMVASDSISLHPGAHVLHYASTCFEGLKAFRHSDGSVKIFRMDCNIDRFDQSTELLALPSIDREQTRTMIMEVVKRFASEVPEVPGSLYIRPTHIGTEPAIGKAAAPSSTSLQYVLVSPVGDYFAGGADTTLRLLLEEDGLRCSPHMGRIKSGGNYASALFPTLAAKRDLQVDQILFCPNGDVQETGAANFLLIDGDTLITKALDDSFLHGITRNSILTLARDLGMTVEERQLSVDELLERSQKPGCEAALSGTAAVLTPVGTLLHQGREYQVGNGKAGATTSKLRTALNDIQWGLAEDKHDWLTSVSS

SEQ ID NO: 52788 - protein, 191 aa, Brassica napus
WNQQRNQIVDAVIIARILGASLVVPVLQVNVIWGDESEFADIFDLEHFKNVLADDVHIVSSLPSTHVMTRPVEEKRTPLHASPQWIRAHYLKRINRERVLLLRGLDSRLSNDLPSDLQKLRCKVAFQALRFSPRILELGNKLASRMLSEGQYLSLHLRMEKDVWVRTGCLPGLTPEYDEISQQRETTPPEL

SEQ ID NO: 52789 - protein, 221 aa, Pseudomonas fluorescens Pf-5
MLNALLFDLDGTLTDTDALHLLALQQLLLEEDGRTFTQEEFEAHVSGQANANMCRYLFPERSVAEHEAFAERKEVRFRQLSPQLMPMPGLLRLLDFAQEHGIGVCVVTNAPRANAEHMLEVLGLRQRFQTVLVAEELPGAKPDPLPYLSGLECLQATADQALAFEDSVPGLTAAVKAGICTFGLATSQRPQTLLDAGAHRVINDFDDPQLWAEIRRRLDLP

SEQ ID NO: 52790 - protein, 319 aa, Arabidopsis thaliana
MEKEADNKFRWVIKNFSSLGSERVFSDIFVVGSCKWRLMAYPIGVRDNRCFSLFLVVTDFKTLPCDWKRHTRLRLNVVNQLSEELSILKETQMWFDQKTPAWGFLAMLPLTELKAENGGFLVNEEVKIVVEVDVVEALGKLEESEEATQPLKKVKLEAFVESKGLLKGTSSVKEEIIDVNGFHVLPSQVEFVSRVFERYPEIASIFQAKKQHLRTACMYVLLSLIETLCKSLEELSNDDLVGGDNALQYLKFSGFKVDWLEKKLEEVKEKKKEEQIGETRMQEMKVFKQKCSDIEALMEREKSKLLVTRGSPLTLDDVL

SEQ ID NO: 52791 - protein, 547 aa, Oryza sativa (indica cultivar-group)
MERMSRVAVAVLLLLCLQLQLGISGGGGGGHGARRDDQLVQECSGFCLADLCVRPAARLIHAKKSSSSSQQQQQRSRHAGSKAGWPSTSSTPSNPFGLPMLLPPPPPLKDWPPWLDMPPVQGPSSSPSPSPSPAPSPASSAAVAEHAAPPRRGEEHARPRSIALPPASSSGDAGETSRPEVTDGSATRRGGGGGKTNYVLVAAAGASVLLAASAAAFAACYRSSKVVRSVRPWATGLSGQLQRAFVTGVPALRRAELEAACEDFSNVIGSLPEYTMYKGTLSSGVEIAVVSTTKTSPKDWSKKCEAHFRKKITSLSRVNHKNFVNLLGYCEEEQPFTRMMVFEYAPNGTLFEHLHARDEGHLDWPTRLRVAVGVAYCLEHMHQLAPPEIVRTLDASTVYLTDDFAAKISDVGFCEEEMAAAAAAPAMADRESVVHGYGMLLLEMMAGRLAASEGGLVQGWAAALLRGERRLRDVMDPALRGAFHAETVDRLDAVVRSCADRDPRRRPSMADVAARLREITAMPPDAATPKVSPLWWAELEIISTEAA

SEQ ID NO: 52792 - protein, 658 aa, Oryza sativa (japonica cultivar-group)
MDFFTRPAMSVLLLLFLPLAAAQPWQVCQDSRGKYTSNSTYQANIQSLSSTLPAKAAAPSTGLFATRVAGNAPDTVYALAFCRGDITNASACAGCVASGFQDAQQLCPFNKAASLYYDLCLLRFADENFLATNNSDVVMLMNSQNFTASVGSVRLLLFTLLNATAESAASSSRRFTTSRLDVSSLPTLYCLMQCTPDLTAGECAACFEDFPRLTLQYLDGARGGRILATRCTMRYEIYPFYSGDTMLRIINLATTVPEMNTTAPTTPVTVYPQPAGPGDHKSKVWIVAIVAPLLAILFCFMLSIVWIRRGRKGEVNMQNNIAAVNRLEEDALVWRLEERSSEFSLFEFSELLEATDNFAAENRLGQGGFGPVYKGQLHDGVEVAVKRLASQSGQGFTEFKNEVELIAKLQHTNLVRLLGCCIQGEEKILVYEYLPNKSLDFFIFGIAQGLLYLHKHSRLRVIHRDLKASNILLDQDMNPKISDFGLAKIFSSNNTEGNTKRVVGTYGYMSPEYASEGIYSIKSDVFSFGVLLLEILSGKRNSGFHQYGDFLNLLGYAWHMWEEGRWLDIIGASIPQTIPTEGLRKYINIALMCVQENADDRPTMSDVVAMLSSESAVLPEPKHPAYYNLRVSKVQGSTNVVQSISVNDVTITSNPEGR

SEQ ID NO: 52793 - protein, 280 aa, Oryza sativa
  misc_feature (113)..(113): Xaa can be any naturally occurring amino acid
MATPAAEKPDGVEIREVWEDNLEAEFAVIREIVDDFPYVAMDTEFPGVVCRPLGTFKSNADFNYATLKANVDMLKLIQLGLTFSNEHGGLPSLGPEGRPCVWQFNFRGFDPRXDVAAADSIDLLRRSGIDFTRHSADGADARRFAELLMSSGVVMNSEVRWVTFHSGYDFGYLLKLLTGTYLPDTITGFFDLIRIYFPVVYDIKHLMRFCNSLHGGLNKLAELLDVERVGICHQAGSDSLLTALSFKKLKEAYFNGLTEKYAGVLYGLGTEGGETSSAAH

SEQ ID NO: 52794 - protein, 193 aa, Solanum ochranthum
FVFAGVGSAIAYGKLTTNAALDPAGLVAIAVCHGFALFVAVSVSANISGGHVNPAVTCGLTFGGHITFITGSFYMLAQLTGAAVACFLLKFVTGGCAIPTHGVGAGVSILEGLAMEIIITFGLVYTVFATAADPKKGSLGTIAPIAIGLIVGANILAAGPFSGGSMNPARSFGPAMVSGNFEGFWIYWIGPLV

SEQ ID NO: 52795 - protein, 85 aa, Glycine max
  misc_feature (37)..(37): Xaa can be any naturally occurring amino acid
  misc_feature (52)..(52): Xaa can be any naturally occurring amino acid
MASSMISSPAVTTVNRAGAGMAAPFTGLKSMAGFPSXKTNDDSTSIATNGGXVQCIHVWPPIGNTKFETPSDLPDLDDAQVAKEI

SEQ ID NO: 52796 - protein, 305 aa, Schizosaccharomyces pombe 972h-
MAYTPGSRGGRGGSRGGRGGFNGGRGGFGGGRGGARGGGRGGARGGRGGRGGARGGRGGSSGGRGGAKGGAKVIIEPHRHAGVFIARGKEDLLVTRNLVPGESVYNEKRISVDSPDGTKVEYRVWNPFRSKLAAGILGGLDNIYIKPGARVLYLGAANGTSVSHVADVVGPEGLVYAVEFSHRSGRDLLNMAKKRTNVIPIVEDARHVQKYRMLVGMVDVVFADVAQPDQARIVALNAAAFLKNEGGVVISVKASCIDSTADAAVVFAREVKKMQEEKIKPQEQLTLEPYERDHCIIVGKYLRHQ

SEQ ID NO: 52797 - protein, 358 aa, Frankia sp. EAN1pec
MRVAVAYEAEKPLVVEDLDQPAVGPRDVLVRIAASGICHTDLHVINGHSPLPLPIVPGHEACGVVEEVGSEVRRVKVGQRVLAAVSPACGTCWWCVNGMSNHCELGGPVKAAPRFTLADGRTAAAVCGCGTFAEAMVVDEASVVPTNTDLADEELALLGCGVTTGLGAALITAGVTPGSSVAVIGCGGVGQSVIQGARISGAATIIGIDLVPARREASLRVGATHVVDPAEADPVEQVRALTEGRGVDFSFEVVGLPNLMVQAFDMARKQGAVTLVGMPTTTATLTLPAISAIFSGKRLAGSVVGGAQILRDMPRFIRLAETGQLDLGGMVSNRIRLDDINEGIALLDRAEGTRTVII

SEQ ID NO: 52798 - protein, 277 aa, Prochlorococcus marinus str. MIT 9515
MGPRLLIKFLQDAAGRGDLDPWDIDVISVIDSFLEQFKQNLKYSSNDQMSYEKDLSETSEAFFAASVLVNLKAQVLESDVFPEEILGFEDEIDMDNQEWINQGFDIPKYPEKYLRRRSVAQPVIKRTSTLGELVSQLESIAEIIETQDLLLMKRKRNKKYSDKILISKVQSLAHREKLPETTKALGKFIDGWEKALQWTDFEYLVNKWQNVVKSDLDKDRLGVFWALLFLSSENKIEIKQKNSLYGPIQIKRILPDGELAQLPIDNLEVAETSSTAA

SEQ ID NO: 52799 - protein, 368 aa, Schizosaccharomyces pombe 972h-
MNLTFKNLQQQKFVISDVSADTKISELKEKIQTQQNYEVERQKLIYSGRILADDKTVGEYNIKEQDFIVCMVSRPKTSTSTPKSAASPAPNPPASVPEKKVEAPSSTVAESTSTTQTVAAAAPSNPDTTATSEAPIDANTLAVGAQRNVAVENMVEMGYERSEVERAMRAAFNNPDRAVEYLLTGIPEDILNRQREESAAALAAQQQQSEALAPTSTGQPANLFEQAALSENENQEQPSNTVGDDPLGFLRSIPQFQQLRQIVQQNPQMLETILQQIGQGDPALAQAITQNPEAFLQLLAEGAEGESALPSGGIQIQITQEESESIDRLCQLGFDRNIVIQAYLACDKNEELAANYLFEHGHESEDEP

SEQ ID NO: 52800 - protein, 392 aa, Prochlorococcus marinus str. MIT 9515
MKAMILAAGKGTRIQPITHIIPKPMIPILQKPVMEFLLELLKEHGFKEIMVNVSHLAEEIENYFRDGQRFGVEIAYSFEGRIEDGEMIGDALGSAGGLKKIQDFQNFFDETFVVLCGDALVDLDLTEAVRNHKQKGALASLITKKVTREQVSSYGVVVSDENGRVKAFQEKPTVDTALSDSINTGIYLFEPEIFDYIPSGEKFDIGADLFPKLVEMDLPFFALPMDFEWVDIGKVPDYWSAIRNVLLGKVRQVEIPGKEIKPGVFTGLNVAANWDQVDIKGPVYIGGMTRIEDGATIIGPSMIGPSCCICEGATIDNSIIFDYSKIGKGVQLVDKLVFGRYCVGKNGDHFDLKDASLDWLITDSRRLDLTEPSPQQKAMAELLGSDLINIPD

SEQ ID NO: 52801 - protein, 1399 aa, Vibrio vulnificus YJ016
MIQIVIDGKYRIVEAGQTVLQAAKVCGVEIPSLCGMNRSGEKIPCDLCVVEVESGGTRRACELEVYNGLTVNTQSEALSAHRKQALNRIMSDHYADCEAPCKTACPAGVDIQSYLYHIAQNDHQKAIEVIKRTLPMPLSIGRVCPAFCESECRRSLVDDAIAIRQLKRHAADADLAAQEAYTPEKKADKNKRIAIVGSGPGGLTAGYYLTNEGYQVDVFEAMPQAGGWLRYGIPEYRLPKSILDKEIALMCRNGMAIHTDKKLGRDISLSQLSQDYDAVCLAVGASKAVAMDYPGSDLDGCYLGVDYLKDFVTEQRFTTGKKVAVIGGGNTAIDCARTAVRTGADTTLIYRRTRDEMPAEDYEIEEAEHEGVKFHFLTNPAQNIADEHGRVCSVKLEKMALGAPDASGRRRPEATGEYFTEAFDTVIAAVSQQADLSFMQGEALTLPLTRWNTADANPETMHSGTGNIFSIGDFRRGPATAVEAVADGRIAAQAIDRFFDGDMENIPLKPFNSRKEQKLKQVDPLHFSHLQKVARTIMPELTSQQREQSFEEVELGFDNAEAMAEAARCLECGCQVNTSCDLRDYATEYGAEQHFHYSVNIKSHDEWQALRQNDPRHKYPIDHSSEFIVFDANRCISCGQCIQACREQSVQGVLSFMNLEKGRPVVRPDCRPNFGGQGVRMGDSRCVQCGACVQACPVGAMTDARDRSQGRETPLKKVDTICTYCGVGCKLTMHVDEAANRIRYVEGAHSPVNEGMLCVKGRYGFDFVASEERLTTPLIRKDGWLQPASWQEAIRLVADKFSTIKQDFGGRALAGFSSAKTTNEDNYAFQKFMRRELGTNNVDHCARLCHASTVTGLEASLGSGAMTNDIPSIKHSDVIFIIGSDTSAAHPVIASHIKQAVRHHGARLIVADPKRIGMADHAELYLAHRPGTDVMLINGVMQQIIKNGWYDMEYIEERVDGFDTMLQEVMSPAYALDKVELVTGVKADDIFAMARMIGTAKRTAVYYSMGITQHTTGHDNVRSIANLQLLCGNIGIEGGGINPLRGQSNVQGACDMGALPNNYPGYQKVYNPLVREKFVIEWDAPNLSAEPGLTLTEIIDGACRRDVRALYVMGENPVLSDPNQAHVIEGLEALDFLVVQDIFLTETAQYADVVLPSCSFAEKSGHFTNTERRVQRIYPAVNPPGEAKEDWRIIQEIANAMGSDWHYRSVVDITNEITRVTPQYAGLKWDNITREGVQWPSNKNNPAGTRIMHQTQFTRGKGQMEAIPFRYAAELPDEEYPLVLTTGRVLEQFHTGTMTRKTQGLNNLAGPRAMISVQDAEALGIGNGDMLKVSTRRGEIEIAAFVTKRMQAGVVFIPFHFVESPVNRLTTTATDPHAKIPEFKVAAVRVEKLHTALVE

SEQ ID NO: 52802 - protein, 278 aa, Yersinia pestis KIM
MIRLIERSQRTCSLKYDGHIPNLIGVNVMAVTKLVLVRHGESQWNNENRFTGWYDVDLSEKGRSEAKAAGKLLKDEGFTFDFAYTSVLKRAIHTLWNILDELDQAWLPTEKTWKLNERHYGALQGLNKSETAEKYGDEQVKQWRRGFAITPPALEKSDERFPGHDPRYAKLTDAELPTTESLALTIERVIPYWNDVIKPRIASGERVIIAAHGNSLRALVKYLDDLGEDEILELNIPTGVPLVYEFDENFKPIKHYYLGNADEIAAKAAAVANQGKAK

SEQ ID NO: 52803 - protein, 873 aa, Clostridium symbiosum
AKWVYKFEEGNASMRNLLGGAGCNLAEMTILGMPIPQGFTVTTEACTEYYNSGKQITQEIQDQIFEAITWLEELNGKKFGDTEDPLLVSVRSGARASMPGMMDTILNLGLNDVAVEGFAKKTGNPRFAYDSYRRFIQMYSDVVMEVPKSHFEKIIDAMKEEKGVHFDTDLTADDLKELAEKFKAVYKEAMNGEEFPQEPKDQLMGAVKAVFRSWDNPRAIVYRRMNDIPGDWGTAVNVQTMVFGNKGETSGTGVAFTRNPSTGEKGIYGEYLINAQGEDVVAGVRTPQPITQLENDMPDCYKQFMDLAMKLEKHFRDMQDMEFTIEEGKLYFLQTRNGKRTAPAALQIACDLVDEGMITEEEAVVRIEAKSLDQLLHPTFNPAALKAGEVIGSALPASPGAAAGKVYFTADEAKAAHEKGERVILVRLETSPEDIEGMHAAEGILTVRGGMTSHAAVVARGMGTCCVSGCGEIKINEEAKTFELGGHTFAEGDYISLDGSTGKIYKGDIETQEASVSGSFERIMVWADKFRTLKVRTNADTPEDTLNAVKLGAEGIGLCRTEHMFFEADRIMKIRKMILSDSVEAREEALNELIPFQKGDFKAMYKALEGRPMTVRYLDPPLHEFVPHTEEEQAELAKNMGLTLAEVKAKVDELHEFNPMMGHRGCRLAVTYPEIAKMQTRAVMEAAIEVKEETGIDIVPEIMIPLVGEKKELKFVKDVVVEVAEQVKKEKGSDMQYHIGTMIEIPRAALTADAIAEEAEFFSFGTNDLTQMTFGFSRDDAGKFLDSYYKAKIYESDPFARLDQTGVGQLVEMAVKKGRQTRPGLKCGICGEHGGDPSSVEFCHKVGLNYVSCSPFRVPIARLAAAQAALNNK

SEQ ID NO: 52804 - protein, 868 aa, Xylella fastidiosa Temecula1
MSASPTAERWIVLKFGGTSVSRRHRWDTIAMVVRKRLEEHGTRVLIVVSALSGVTNELTAIAQGVVDSAKRVTALEQRHRDFLVELGLDAQAVLGTRFAMLSDLLQDARAVTRSLDWQAELLGQGELLSSTLGAAYLGASGIDIGWMDARDWLTALPPQPNQSEWSQRLSVSCQWKSDVEWRTRFDAQRAQVLITQGFISRHQDGGTAILGRGGSDTSAAYFGALLGAACVEIWTDVPGMFSANPKEVPDARLLTRLDYYEAQEIATTGAKVLHPRSIKPCRDTGVPMLILDTERPDVLGTRIDAEVEPVLGVKAISRRDGIVLVSMEGIGMWQQVGFLADVFTLFKKHGLSVDLIGSAETNVTVSLDPSENLVNTDVLTALSTDLSQICKVKIIVPCAAITLVGRGMRSLLHKLSEVWATFGKERVHMISQSSNDLNLTFVIDETDADGLLAVLHFKLIESGAMPVQDRAVFGSPWREIIGHVRTRVMPWWHSARMRLLAMRDEEGIGPCYVYHLPTVRERARQLNAVAAVDQCYYAIKANPHPAILRTLIEEGFGLECVSLGELRHVFEVVPHLVPSRVLFTPSFASRVEYEQAFLLGVNVTLDNVEALRLWPEVFRERTLWLRIDLGYGDGHHEKVTTGGKTSKFGLSVTRIDEFIDVAKTLNITVTGLHAHLGSGVESGNHWSRMYDELAGFASRIGSVSTLDIGGGLPIPYRPDDEPFDVGAWGASLAEVKALHPKFQLVIEPGRFLVAEAGVLLTRVTQVIEKDDILRVGLEAGMHTLIRPALYDAWHGVENLTRLDETPHVLCDVVGPICESSDVFGRRRHLPAATASGDLMLIADAGAYGFSMASTYNLRGLPAEVVLDA

SEQ ID NO: 52805 - protein, 198 aa, Drosera rotundifolia
RYIAVGNEIRPNKYGSEISQYVLPAMQNIQNSLHQLGLSQVKVSTAWDMAVFASTYPPSQGTFDPAIESYTLPIVNFLVSNGSPLLLNCYPYFVFKDTPSLDINYALFTSPGVVVQDGPYGYQNLLFAMVDAAYSALEKAGATEVPIVLSETGWPTEGDVGTSVSNAQTYNNNLIQKVSQGTPKRPGQAIETYIFDMF

SEQ ID NO: 52806 - protein, 798 aa, Buchnera aphidicola str. Sg (Schizaphis graminum)
MKFNENWLREWINPKITSVSLRNQIVESGIEIESIHEFNPIFDGFLVGKIVECINPCKGNNLKILKVDVGYKKLLNIVCGASNCRNNIKVVVATIDSILPNGSKIKIKKIKEKLSEGMICSFFELGLFNFCKDIIELPEDIPIGKKINDLFLLKKDTFIKVAVTPNRPDGLSILGIARNIAAINNLKKIRLKKRILPTTIEDQFPITINTEKQSVNYFGRIIQNVNLNVDTPFWMKKKLFFCDLLSDNIIENILNYILIEIGQPLNILNADKIDDVIEIRMAIKKEFLILKNDTRIVLDKDILVFSDKTKILFIPGNINNSDLEPNKNTKNIFLTSYLVDKKSILNILKKIDSNNILDYYSHGVDASLQKYAIEYATYLIVKICGGKIGPINTKKSNFNSLSCSNKIKLYHQNFNKCIDSFVDSSIISNILLCLEYKVNFHKKYWYVFPPSWRFDILIEEDVIGDILRIYNYNNIPLTPLKQNYYFNSKNKDLKSPLLDEAAVLLINRGYYEIITYSFINPSLQDDIIPNNNQILISNPISKDFSSMRLSLWPGLLKTVSYNKNRQQESMRFFERGLCFSIDESQILGIRQEMFLGGVISGFYSKENWFSVRRKVDFYDLKGDLESLLEVICGLNKFEIRHQNILGLHPEQSAKIYLDNKYIGSLGKIHPKIEKKLNLYNSTFLFELSLNYISKLKFYNTEEISKYPTSRRDIAILVSKDIPFLDIITVCKDFFVNKKVEINLFDVYSCKEFDNRKKSLGISFVFQNFKKNLKENEVNLMLHDCIKILKKKFQVVLRK

SEQ ID NO: 52807 - protein, 516 aa, Zea mays
METAYVVVLSFFFIVAIHRLLNRGESKNMSKQPLPPGPRAIPVLGHLHLLEKPYHLAFMRLAARYGPVFSLQLGSRAAVVVSTADCARECLAEHDATFANRPTYPTLHLMTYGGATIGHSAYGAHWRHVRRVVSLHLLSPQRVLSSMVPTITAEVRAMARRMYRAAAGGAARIELKGRLLELSLSTLMETIAQTKTYRPADDADTDMSPETQEFKQLLDAIISLLGLTNVLEFLPVLQTFDVLGLKKKIAAAAGRRDAFFQRLIDAERRRLDDGVEGQKKSMLAVLLALQKSEPENYTDEKIMALCFSMFIAGTDSTATAMEWAMSLLLNHPEVLKKAREEIDAHVGSSRLLGADDVPSLGYLHCVLNETLRLYPVGPTLIPHESTADCTVGGYRVPSGTMLLVNVYAIHRDPATWPDPDVFRPERFEDGGGSAEGRLLIPFGMGRRKCPGETMALQIMGLALGTMIQCFDWGAVGGGGAPKVDMTQGGGLTLPRAVPLEAMCKPRQVMLDVLQKL

SEQ ID NO: 52808 - protein, 496 aa, Pseudomonas fluorescens Pf-5
MAIAPLLAATTAFIQRAPRMLIGAHWTEAGDGQTMPLRNPATGEQLCLVPRATVDDVDRAVLAARQAFDDSPWTRTRPRERQNLLWKLADLMQRDAELLAQLECLNNGKSAAVAQAMDVQLSIDFLRYMAGWATKIEGSSVEVSLPLMPDDQFHSFIRREAVGVVGAIVAWNFPLLLACWKLGPALATGCTLVLKPADETPLSALKLAELVQEAGYPDGVFNVVTGTGITAGSALTRNPLVDKLTFTGSTAVGKEIGKIAMDSMTRVTLELGGKSPTIVMADADLASAAAGAASAIFFNQGQVCCAGSRLYVQRKHFDNVVADIAGIANAMKLGNGLDASVEMGPLISARQQERVYRYIEMGRESGATIACGGEQFGPGYFVKPTVIVDVDQKHSLVQEEIFGPVLVAIPFDDEADALRMANDSPYGLGASIWSNDLAAVHRMIPRIKSGSVWVNCHSALDPALPFGGYKMSGLGREMGHAAIEHYTELKSVLIKL

SEQ ID NO: 52809 - protein, 384 aa, Glycine max
MEEKQRVIIVGAGPSGISAAACFTKQSIPYIILEREDCSASLWKKYSYERLHLHLRKQYCQLPHKPFPASFPPYVPKKQFLQYLDDYVSHFGITPLYRRTVELAEYDQGCHNWRVMALNGDSGQLEEYRGRFLVVATGETTDPFVPELQGLSGFPGKLIHSTGFRSGKDFKDQHVLVVGSGNSGMEIALDLVNHGAKTSILVRSPVHFLSREMVSLGLFLLKYLSLSTVDSLMVMLSTMIYGDVTKYGVARPNEGPFYMKVKYGKYPVIDVGTYKKIKSGELKVLPSEIESLRGKDVLFKNGESHPFDSIVFCTGFKRSTNKWLKGDDYLLNDEGLPKPSYPIHWKGNNGLYCVGLSRRGFYGAAADAENIANDVSSFTQHPCP

SEQ ID NO: 52810 - protein, 114 aa, Oceanobacillus iheyensis HTE831
MQQIIADITKDQLRTDHPDFRPGDTLKVHVKVVEGNRERIQVFEGVVIKRQNGGISETFTVRKISYGVGVERTLPLHSPRIDKIEVSRRGIVRRAKLYYLRNLRGKAARIKERR

SEQ ID NO: 52811 - protein, 263 aa, Pseudomonas syringae pv. syringae B728a
MNVAQKNTKETDKLFSKQSHHYAAFRFDYPAELYDFIQRNSPDTQQVWDCATGSGQAAINLATTFRHVTATDISAEQISHAPRVPNISFQVLAAENARFAHQQFDAVCVAQAIHWINTSSFYALVDHCLVSEGLLLIVGYAFNEPLTPALDQVINDFQFGVLKDFWPAQTEILFAGLKDLPFPYPRLPTPEMHIQRSWSLQDYVNYTRTWSATQLYIDQHGTDPCIELAERLAEVWPQDKKHLEFRWKLFVLAGNKPACEGRP

SEQ ID NO: 52812 - protein, 208 aa, Prochlorococcus marinus str. MIT 9515
MKDFLQKVNSYIKEAFGAGKYLYDGLSVTFDHLRRRPVTVQYPYEKLIPSERYRGRIHYEFDKCIACEVCVRVCPINLPVVDWVMNKETKKKELRNYSIDFGVCIFCGNCVEYCPTNCLSMTEEYELATFDRHNLNFDNVALGRLPTNVTTDPSVKPLRELAYLPKGVMDPHEVSSSDARVGKLPEEVYDWMKPKTNEMSDPAVKLNK

SEQ ID NO: 52813 - protein, 381 aa, Prochlorococcus marinus str. MIT 9515
MDPNKLILKPGLEGVPVTNSSICDIDGQNGKLLYRGYAIEELAQKSTFLETAFLLIWGELPSAIELRDFEQEVQMHRRLSFRVRDMMKCFPATGHPMDALQSSAASLGLFYSRRAIDDPKYIYNAVIRLIAKIPTMIAAFQLIRKGQDPIQPRDDLSYSSNFLYMLTEKEQDPIAAKVFDRCLILHAEHSLNASTFSARVTASTLTDPYAVIASAVGTLAGPLHGGANEDVIAMLEDIKTPEKAGCFLDDAIKNKKKIMGFGHREYKVKDPRAIILQKLAEELFIRFGKDEMYEVAKNLELEAIPRLGPKGIFPNVDFYSGLVYRKLGIPRDLFTPIFAISRVAGWLAHWREQLGANRIFRPSQIYTGSAPRDWISLENRK

SEQ ID NO: 52814 - protein, 411 aa, Zea mays
MNALAATTRNFRRASKLLGLDSKLEQSLLIPFREIKVECTIPKDDGSLATFVGFRVQHDNARGPMKGGIRYHNEVDPDEVNALAQLMTWKTAVAAVPYGGAKGGIGCSPGELSRSELERLTRVFTQKIHDLIGTHTDVPAPDMGTNAQTMAWMLDEYSKFHGHSPAVVTGKPIDLGGSLGRDAATGRGVMYATEALLAEYGKCISGSTFVIQGFGNVGSWAARLIHEKGGKIIAIGDVTGSIRNTAGIDIPALVKHRNEGHAMKDFDGAEVLGSTELLVHDCDVLVPCALGGVLNKDNAPDVKAKFIIEAANHPTDPEADEILAKKGVVVLPDIYANSGGVVVSYFEWVQNIQGFMWAEEKVNDELEKYMSSAFQHMKAMCKSLDCDLRMGAFTLGVNRVARATLLRGWEA

SEQ ID NO: 52815 - protein, 239 aa, Medicago truncatula
MNFLRDYSNLLNAREACKIAEAEYIKNPRDVDNLTKWGGAMLKMYNNGDQDMTIEDVILKLEEAVFLDPYHHEALYCLGEAFAIRAPEFNDKTSIDYYSKKAIACYQQAFDLDPSNEMYRIMMETYVKGIKKILAEDEQLMTSVSEFYPSFGTKLFEVADELAMAATVTEELRGKLKQMLKNQQRTNLIMANMMSFIQSRFPGEDVYPIIQAARQAYYIFLFCYPFYPFCSYNVVLCFG

SEQ ID NO: 52816 - protein, 626 aa, Rhodobacter sphaeroides 2.4.1
MSALAAFVTLGGDPGEAQSRVLSMLSAMPTRGTELRVRALTAGVALGHGRPAGRGGLGPWRLRPGGPVLTGTVRLDNGPELRRALGLAEASDAETVLAVYDRWGLDLPLHLDGDFALALWDPVAARLIGLRDRFGVRPFLYRATPQAVAVASGIEALVAAFPACEPALDEVWIAEYLSGQPTCARRTVYRGISRLEPAHMLLVEKGRTEVRRYWQLEVAPRRRADPPEALLELLDRSVTARMQGGPVGSMLSGGLDSGTVSMLASRRSEGPLPVISMKFDDHPEIDESEWIAKIHAAGRFRPVWIDGRDAHGGDVAELLAEQGGPFFAPNLATSRWLYRRAAEAGVEILLDGHGGDEVISFGVARLTELASEAQWRTLWQSTAAVSDLFGGSRREFFLNSMAQGAQSRWLRAMARRLNVGAKRDPRAWRQALHPALVARTGLVQRVQEAAGARKRGATDDIRQHVATLTAPRYPTTLEVLDRAATLCGIEPRYPFLERRLIEHCVAQPAAAKFHDGMTRALLRDAVRGLLPDEVRLRTSKTNFTPNVRARMLTSWGDNLNRIAGCNPGRIGDYVDLAVIREGIQRLRAGEPDQPALLQTMRAVVLDEWLRGGSSALAPRLDRRTPA

SEQ ID NO: 52817 - protein, 874 aa, Anaplasma phagocytophilum HZ
MDDRLIYHFGRSRCDGGAHLAHLLGGKGAGLAEMCRIGINVPPGFTIATSVCNLYQESGSVPENVVQQLPEALSLLGQEVDLEFGNPDRPLLVSVRSGSVQSMPGMLDTVLNVGLNDEVAVKLGAMRGGRFAYDSYRRLIQMYAASVLQLEDRIFEERYKEKQKELSLSTGESITNQEALRELVEEFKQLVRTHTGQEFPQDVQVQLRNAIGAVFKSWMNQRAVAYRNMYGIPSDAGTAVNVQAMVFGNINQNSATGVVFTRNPSTGEKEIFGEFLCNAQGEDIVSGQKDPSPIKLMESSMPQVYGELVEVCEKLEKHNKDMQDIEFTVQDGKLWILQTRRGKRSAHAAVNLAVSMVKESLISKEEAILRIDASTLGGLFHPILEENCSNVVVGRGLPASPGAASGYVAFTSSDAEELKRQGKSVILVRQETSPEDIRGMISAAGVLTLRGGMTSHAAVVARGMGKPCICGASSLCIDESGQFFFNEDNVKIGRSDSITINGSTGEVMLGAVQTVTPSLPEAFYELMGWIDEIRTVGVMANADTVEDMGTANLFGADGIGLCRTEHMFFSDNRITIVREMILASNKQERDRALKKIEVVQKDDFLAMFKLMQNKKQITVRLLDPPLHEFLPNSMEALESISLGMGRSLEYIKHRVSALSEKNPMLGHRGCRLAVSYPEIYEMQIRAIFQAVKELRDSDGITVIPEIMIPFVMDEQEIVIIGDLVKCISAQFDNAQYRIGAMIELPRAALLADKLSQHVQFFSFGTNDLTQTTLGISRDDSSKFVEHYISSGVFASDPFELLDVSGVGRLIKIAMELIHKSPNKVKTGLCGEHGGTLAAMQLCSELDIDYVSCSPYKVPVAKLIAAQCAIRNKML

SEQ ID NO: 52818 - protein, 256 aa, Zea mays
MSHFGRSGPPDIRDTFSLLVLNISFRTTADDLFPLFERYGKVVDVFIPRDRRTGDSRGFAFVRYKYADEAQKAIDRLDGRDVDGRNIMVQFAKYGPNAEPIRKGRVKEGVEKSQDRSRSRSPRPRHRDRDHRSQSRSRSRERHVRDRDRGYRRRSRSRSQSLSSSPDNRSHHRARDDDKRKSMSKSRSRSRSTSRSRSYYSASPARHSASPRKSPPPQRSPTPAKHANGKVAPLSRCVSPLPKRATSRSPGSDGKE

SEQ ID NO: 52819 - protein, 266 aa, Streptomyces griseus
MLTPGRSGSPGRVGHGREHAMELRRSALVTGGSRGIGRAVAVRLAQDGYDIGFCSRSADEAALETARLVTSAGARAHHVVCDVTDADAVRTFVAEAEEKLGPAYAVVNSAGVLRDRPMALMAARDWQDVVGTSLDGAFHVCRAVVRGLLTRRAGALVNVSSVIGVYGNAGQTNYAAAKGGLNGLTRALAKEVAPYGVRVNAVAPGFIETEMLDGMTAKAREAALGKIAMARFGSAESVAALVAFLVSDAADYITGQVVQIDGGIAL

SEQ ID NO: 52820 - protein, 503 aa, Mesorhizobium sp. BNC1
MSVLNENIARAVEYLKPFREGGVLNHVGGAQVPAASGETFETVSPVDMSTLAKVARGGAADTDKAVAAASEAFKTWSKTSGAERRKILIKVAEGIEARAEEIAFIECMDTGQALRFMSKAAIRGAENFRFFADQAPGSEDGRALRTPAQMNVTSRRPIGPVGVITPWNTPFMLSTWKIAPALAAGCTVVHKPAEFSPLTANLLVQIAEEAGLPKGVLNVVNGYGEEAGRALTEHKGIKAIAFVGESRTGSMIMKQGADTLKRVHFELGGKNPVIVFDDADLDRAVDAAAFMIYSLNGERCTSSSRLLVQESIYEEFTRRVAEVARGIKIRHPLDPETVIGPLIHPSHEKKVLSYFEKAKEEGAIIATGGEKYGEAGCFVRPTLFTNARNDMAIAQEEIFGPVLTAIPFKDEDEALAIANDVNYGLAAYLWTRDLGRAMRMTDNLEAGMIWVNSENVRHLPTPFGGVKASGIGRDGGDWSFDFYMETVNVSFPRREHKVSKLGG

SEQ ID NO: 52821 - protein, 565 aa, Zea mays
MAELPLAAGLMDLRNCKLSPKPAPPLPLPALRRMHTSATATTAPSPRHAVPELHSTTELADGSIVFRFGHPKSKALEPEPASVKTSPYSRVAPASGAVPGSQMEPEIDSEHGLDGVRIGTTAGVEKPSPNAAAEAWPTPPPPDAGAVTGATSAALEEAPEQEAGSNAAVEEVDTRPSSAESLVPSRSEDGPKGDGVAVEAGMPTSGAAMDTIETALEGRGASEDDSAVDVSGGLDEAATSGLEDSEAASEGSTAQDFYTDVETESSGSSSDEQRAEFGFSLPPPEQVSNKADWKNDTSEVKSSDRMIPIAQRTRVLSSGAAILPHPSKVATGGEDAYFIAANGWFGVADGVGQWSFEGINAGLYARELMDGCKKFVTENQGDPDLRPEQILSKAVDEACSPGSCTVLVAHFDGQALQASNIGDSGFIVIRNGEVFKKSKPTLYGFNFPLQIQKGDDPSKFVQNYAIDLEDGDAIVTATDGLFDNVYEHEIAGIVSKSLQADLEPAEIAEHLAVKAQEVGRSGAGRSPFSDAALSAGYLGYSGGKLDDIAVVVSIVRTEIQEDRLR

SEQ ID NO: 52822 - protein, 599 aa, Oryza sativa (japonica cultivar-group)
LAFGKFAGRAGLIDFLHGLGQRYLSLGYSTPFLSLGQSHMYPSLAAAKAAVIAIGEEIATFGLPSGICPIVFVFTGTGNVSQGAQEIFKLLPHSFVDAGKLPELSAARSLSQHPQSSKRVFQLYGCVVSSRDMVTPKDPTRCFNKADYYAHPEHYKPVFHERIAPYASAIVNCMYWERRFPRLLSIDQLQQLMKNGCPLVGISDITCDIGGSIEFVNKSTSIERPFFRYDPCTNSCHDDMEGNGVICLAVDILPTEFSKEASQHFGDILSKFVARLASAKELLELPSHLRKACIAHAGRLTSLYEYIPRMRKTIIELPPAPTNLLPDKKYNSLVSLSGHLFDKFLINEALDIIETAGGSFHLIRCDVGQSIDDMSYSELEVGADDTATLDKIIDSLTSLANAHGDPNARREIELSLKIGKVNECGTDDSMAKEGSKVLILGAGRVCRPAAEFLASYSNIFSSSAYDHDIDQIHVIVASLYQKDAEETIDGIRNATAAQLDVADIKNLSNLVSQVEVVVSLLPASFHAAIARVCIEMKKHLVTASYVDESMSKLEQSAEGAGVTILCEMGLDPGIDHMMSMKMIDEAHSRKGKIKSFTSF

SEQ ID NO: 52823 - protein, 1077 aa, Buchnera aphidicola str. Sg (Schizaphis graminum)
MPKSTDIKSILILGAGPIVIGQACEFDYSGAQACKALKEEGYKIILVNSNPATIMTDPCMADATYIEPIHWKIVKKIIQKEQPDALLPTMGGQTALNCALELNRRGILKKFNVKIIGATIDAINKAEDRKLFEDSMKKLNLKTAKCGIAHNIQEALLVLKNVGFPCIIRPSFTMGGHGGGIAYNQEEFEDICERGLKLSPTTELLIDESLIGWKEYEMEVVRDKNNNCIIVCSIENLDPMGIHTGDSITIAPAQTLSDKEYQIMRNASMSILREIGVETGGSNVQFAINPKNGRMIVIEMNPRVSRSSALASKATGFPIAKIAAKLAVGYTLDELANDITGINTTASFEPSIDYIVTKIPRFNFEKFLGCNDRLTTQMKSVGEVMAIGRTFQESIQKAICGLEIGSSGFDSKVSFADNKQDIIKIRHELKDAGAERIWYIGDAFRCGMSVNDVFELTSIDPWFLVQIQEIIQLEKKIIQKGFIGLDYNFFYFIKRKGFSDLRIAILTNKKEEEIRQLRYELNLHPVYKRIDTCSAEFSTETAYMYSTWEDECESHPTKNTKKIIVIGGGPNRIGQGIEFDYCCVHAAQALREDGFEAIMINCNPETVSTDYDISDRLYFEPITLENVLEIVRIENPKGVIIQYGGQTPLKLARQFEKEGIPIIGTNPDAIDKAEDRNRFQKIVTKLKLKQPLNATVLTLEEAHKKAIEIGYPIMVRPSYVLGGRAMEIVYEPCDLDNYFKKFLKNNHITPILLDQYLNYAIEVDVDAICDGEKVLIGGIMEHIEQAGVHSGDSACSLPAYTLTNKIQNKIREQVKKLAFALSVKGLMNVQFAIKNNEIYIIEVNPRAARTVPFVSKATGLALAKISVRVMYGKTLSEQGFCKEVIPSYFSVKEAVLPFDKFQGVDPILGPEMRSTGEVMGIGKNFSEAFSKAMLGSHTNMKKSGRVLLSVRDDDKNSIVNLAVKLQKFGFKIDATKGTSIALKKSGIMARLVNKVHEGRPHIQDRLKNGEYSYIVNTTSCHQGMKDSQLICRSALQYKVHYDTTVNGAFATVMALNEEPTENIISLQEIHKKINLIN

SEQ ID NO: 52824 - protein, 622 aa, Zea mays
MLALYSNTMGTTAPVAGAVVVRVKQSMLLVLVIVTSVLVVGPTADRGAFASPPPEPVQCSSGGGTANCTVSSAYGVFPDRSTCRAAAAVFPASEDELVRAVAAAAAASGTKMKVATRYSHSIPKLACPGNGTGEGLVISTRRLDRVVSVDAATGHVTVESGVTLRQLIAEAAKAGLALPYAPYWWGLTVGGMLGTGAHGSSLWGNGSAVHEYVVGMRIVTPAPAAEGYAKVRVLTAGNPDLDAAKVSLGVLGAISQVTLALQPLFKRSVTFTERDDDDLAEQVAKFGYQHEFADISWFPGHGRAVYRIDDRLPLAASGEGAMDFIGFRATPTVVIQASRLAEDLFERAGNGSGKCLTSRVTHAALSVAGYGLQRRSGGLFTGYPVVGPQHRMQASGGCVTGPENALLTACPWDPRVPAGTFFHQTTFSLPLRRAAAFVTEVRRLRDLEPQALCGVELYDGILMRYVKASTAHLGKPAPRGEPSGDMVDFDITYYRSRDPGRARLFEDVLEEIEQMGIFKYGGLPHWGKNRNLAFVGAARKYPGLPHFLRVKDAYDPDGLFSSDWSDTMLGIGGRSPTTDAPGCALEGMCVCSRDEHCAPEQGYVCRPGKVYKDARVCTRVSS

SEQ ID NO: 52825 - protein, 456 aa, Thiomicrospira crunogena XCL-2
MQYDYDLIAIGAGSGGLSVVERAVEYGKKCAVVEAKKMGGTCVNIGCVPKKVMWFGAHIAESLRDAPDFGFHVERKGFDWSELVKRREQYISNITTWYGGYFKELGIDVLEGWGSFVDEHTVSVDGKLVTAETIVIAPGGTPFIPNETENADLGITSDGFFALTEQPNKVAVIGSGYIAVEIAGVLQALGTQTTLISRKDLVLRGFDDMVRETLTDAMIESGIHKEYHFKVKKLMKADDGTLIIESEDGQHLEGFDEVIWAVGRETLTEPLALDKVGITPNGRGYIDVNDYHQTQVPNIYAIGDVTGQAQLTPVAIRAGRYLAERLYNNQPELKMDLSKVPTVVFSHPPVGVIGLAEHDARKEYGHDNVQVYSSVFTPMRYAFTEHQIKTALKLVCVGEEQKVVGIHIVGDGADEMLQGFAVAVQMGATKADLDATIAIHPSSSEELVTMRPMILK

SEQ ID NO: 52826 - protein, 193 aa, Solanum chmielewskii
FVFAGVGSAIAYGKLTTNAALDPAGLVAIAVCHGFALFVAVSISANISGGHVNPAVTCGLTFGGHITFITGSFYMLAQLTGAAVACFLLKFVTGGCAVPTHGVGAGVSILEGLVMEIIITFGLVYTVFATAADPKKGSLGTIAPIAIGFIVGANILAAGPFSGGSMNPARSFGPAMVSGNFEGFWIYWIGPLV

SEQ ID NO: 52827 - protein, 460 aa, Oryza sativa (indica cultivar-group)
MEAACVLAVVVVVLAFLSPAARGGVTSTYRRSLQALPDMPIDADVFRPPPGFNAPEQVHITLGDQTGRAMTVSWVTPKLPDSNVVRYGLRADNLTHTANGTFRRYSFGRKYLSGFIHHATLTGLDYGTKYHYAVGSGDTASARSFSFTTPPKPGPDVPYKFGLIGDLGQTFHSNDTLSHYEACGGDAVLFIGDLSYADNHPGHDNNRWDTWARFVERSVAYQPWIWTTGNHELDFAPELGETTPFKPFTNRYPTPFGASGSTRPLWYSVRMASAHVIVLASYAAYGKYTPQWRWLEGELRRVDRAVTPWLIVCVHSPWYSSNGYHYMEGESMRVEFERWLVDAKADVVLAGHVHSYERTRRVSNVAYDIANGMATPVFNRSAPVYINIGDGGNIEGLADDFRWPQPDYSVFREASFGHATLQIVNRTHAFYEWHRNSDGVKVVADHAWFTNRYWFPTDTN

SEQ ID NO: 52828 - protein, 768 aa, Magnaporthe grisea 70-15
MASSQPFGDAIIGAALDPVSGKAVSAPAHDAINEKLGQDKSDVIAATSSTEKGEIQPARSAEDSDNDKGSESDPDAIIVTGTDVARHLLPLRDDADPSLTFRSMVLATGLSGFQSVMNQIYQFKPTLVTIQGTFIVLIAYFLGQAWAKFLPRGDRLEARWRSKGGEGKVPLWIRIVSFFNYGEWGLKEHAICAITATAASNAAASSTVFSAQLLFYDLPLSATTVVLTVISIGLFGYGLCGILRPVTVWHVDAVYWSTLPTVKTLQGLHWQEIKSSKPIRYFWIAFVGMFFYEFFPAYIWPWLNAVSIPCLASMNATGATGATLTRLFGGSLNNEGLGLFTLSFDWQYAHTAVGYFICFLAMLGIYYTNQWDAKSQPFMSTKLRSEDGGSYPTAKVFAGGILDHAALAKYGIPMLSGTFAYAMFMANAAIGALVTHCFLFWGGDIKKTYRSAREGRFDDPHHVIMAKNYKETPWWWFMVVLVGSFVLGLIVVTTQDVTLPAWAYIVSLLLGSIIAPFSTLLYSRYGNGIATNNLSKMIAGLILPERPIANMYFAAFSHNVINCTLNLSNDLKMGEYRFINYAVMISIVTGNKDLLVNGNGDASWSGATIQSYNTNATSWALASYLYKAGGRYWQVIPMGLFPSDWELVPPSLLPTASSTTIGRFDLLDINMPQLIQYAGYIPYNASQTCVLFSQVISGFFIQFYLRNYRPRIFKDYSYLVTGAFEGGSLLALFILSFAVFGAGGAVVAFPQWWGNNVAGNYDLCPVAE

SEQ ID NO: 52829 - protein, 280 aa, Oryza sativa (japonica cultivar-group)
MATPAAEKPDGVEIREVWEDNLEAEFAVIREIVDDFPYVAMDTEFPGVVCRPLGTFKSNADFNYATLKANVDMLKLIQLGLTFSNEHGGLPSLGPEGRPCVWQFNFRGFDPRTDVAAADSIDLLRRSGIDFTRHSADGADARRFAELLMSSGVVMNSEVRWVTFHSGYDFGYLLKLLTGTYLPDTITGFFDLIRIYFPVVYDIKHLMRFCNSLHGGLNKLAELLDVERVGICHQAGSDSLLTALSFKKLKEAYFNGLTEKYAGVLYGLGTEGGETSSAAH

SEQ ID NO: 52830 - protein, 260 aa, Oryza sativa (indica cultivar-group)
MDAGDAWGRSSSSSSSAAAAARRLQARYDLYMGFDDADAAGVEEVEARGGGEAYNCPFCGEDFDFVAFCCHVDDEHAVEAKSGVVKLIEIAGIFMFYCFRRIVYIIFGFNTCIISVDIGIFVVLCKYWVAAKLDSFWVCPICATRVGVDLIGHLTMQHGSYFKISFFLLYNAGNEHMQFYIFTSYSVEDTWHYCLPVAEPSKDLHSDSSDNNFLLNKFPDDKTAERAEPSLSEKDQKERAQRSKFVRGLVLSTIFEDDNL

SEQ ID NO: 52831 - protein, 549 aa, Medicago truncatula
MSSSKQQQQFRCTQIPSKVLHFRNLPWECSDEELADLCSPFGKVMSTKCNVGVNQNQAFVQFAELNQAISMVSYYASSSEPAQVRGKTVYIQYSNRHHIVNSNSPGDIPGNVLLVTIEGVEAGDVSIDVIHLVFSAFGFVHKLATFEKTAGFQALIQYTDAETAASAKDSLDGRSIPRYLLPEHVGACNLRISYSAHRDLNIKFQSNRSRDYTNPMLPVNQAAIDSALQPAIGPDGKRKEHKSNVLLATIENMQYAVPLDVLHSVFSAFGFVQKVAMFDKNGHTHALIQYPDLTIAAAAKETLEGHCIYDGGYCKLHLTYSRHTDLNVKAFSDKSRDYTVLDPSLHAAQAPAWQTTQAATMYSGSMGQMPSWDPNQQEVTQSYLSAPGTFPSGQAAPPFPGYSPAAVPPAGASPHSHMPPSSFAGAFPVFIQLHQIFKLDLIDSYRVSVSISDALSFEPFVQTTHYFRGHKEIYGSDLPSTGIIKVNACEERQIVEAEYINNPRDANNLTRWGGALLNMYNNDGPDQDYTIYVFLFVIKWVLVAFELVI

SEQ ID NO: 52832 - protein, 482 aa, Zea mays
MASSDHGSTTAPKDVPGSYGLPLVGAVRDRLDFYYFQGQDKYFESRVERYGSTVVRMNVPPGPFMARDPRVVAVLDAKSFPVLFDMDKVEKKDLFTGTYMPSTSLTGGYRVCSYLDPSEPTHTKVKQLLFSLLLSRKDDVIPTFRSNFSSLLATVEAELAKGGKAEFNKLNDVTSFDFIGEAYFGVRPSATELGKGGPSKAAKWLIWQLHPLVTLGLPMVLEEPLLHTFHLPPFLVKGDYRALYKYFSTVAKQALDTAEGLGLSREEACHNLLFATTFNSYGGLKVLFPGLLANVASGGEKLHERLVAEIRGAVADAGGKVTLAAVERMELAKSVVWESLRLDPPVKFQYGHAKKDLLVESHDAVFQVRKGEMLFGYQPCATKDPRVFGDTAGDFVPDRFLGEEGSKLLQYVYWSNGRETENPSVDNKQCPGKNFVVLVGRLLLVELFLRYDTFTAEVGKELLGTSVIFTGVTKATSGPGSE

SEQ ID NO: 52833 - protein, 235 aa, Rickettsia montanensis
MKDIEYWEKNFESCKYSDKLIERLLFLNTQVKQPIDIREVKKGIYYARKYHGEQMRQSGDPYYSHPIAVTIMVAEFVAKEVPKLFTFRMLQAALLHDTIEDTALTEEMISNIFDAEVARHVTGLTRIKPWGKISSEKSLILLIKQKRYDTALIKLFDRIHNLQTLEAKSPEKAHKIIKETLKSFLVLSEILEIPSVSELIYAECHKNNLKFNINSTFNKIINFDSFPFSQNKLLP

SEQ ID NO: 52834 - protein, 486 aa, Pseudomonas stutzeri
MKEIKHFINGAFVDSASGRTFEDINPVNGQVIGRVHEAGRAEVDAAVRAARAALKGPWGKMTVAERAEILHRVADGVTARFDEFLEAECLDTGKPKSLASHIDIPRGAANFKVFADLIKNVPTEAFEMATPDGAGALNYGVRRPKGVIGVISPWNLPLLLMTWKVGPALACGNCVVVKPSEETPLTATLLGEVMQAAGVPAGVYNVVHGFGGDSAGAFLTEHPDVDAYTFTGETGTGETIMRAAAKGVRQVSLELGGKNAGIVFADCDLDKAIEGTLRSAFANCGQVCLGTERVYVERPIFDAFVARLKAGAEALKIGEPNDPEANFGPLISHKHREKVLSYYQQAVDDGATVVTGGGVPEMPAHLAGGAWVQPTIWTGLTDDSAVVTEEIFGPCCHIRPFDSEEEAIELANSLPYGLASAIWTENASRAHRVAGQIEAGIVWVNSWFLRDLRTAFGGSKQSGIGREGGVHSLEFYTELKNICVKL

SEQ ID NO: 52835 - protein, 395 aa, Prochlorococcus marinus str. MIT 9515
MAQLETRTEPMVVNFGPHHPSMHGVLRLVVTLDGENVIDCEPVIGYLHRGMEKIAENRTNVMYVPYVSRMDYAAGMFYEAIVVNAPERLANISVPKRASYIRVLMLELNRIANHLLWLGPFLADVGAQTPFFYIFREREMIYDLWEAATGQRLINNNFFRIGGVACDLPYGWLEKCIDFCDWFAPKIDEYEKLITNNPIFKKRIEGLGTIERDQAINWSLSGPMLRASGVSWDLRKVDNYECYDDFDWKIASEKEGDCYARYRVRVEEMRQSLKIIRQACEMIPGGPTENLEAKRMATDDKKSDIFGIDYQYVAKKVAPTFKIPNGELYTRLESGKGEIGVFIQGNNEVTPWRFKIRAADLNNLQILPHILKGAKIADIMAILGSIDVIMGSVDR

SEQ ID NO: 52836 - protein, 535 aa, Magnaporthe grisea 70-15
MAKPPRMVICREQQCRRAGIFAVMAMQPEHENTAMWDMKTSEANTGTKIPDGNLGTNKTQPSCTNRRSKTMATTAEGDFLWGATMQARARKLLLEYQERYVAANPKSADSFGRASVSLAGGNTRSVLHYDPFPMVLVSGRDCFVSSEDGREYVDFVSEYSACMLGHSHPAVAEAVQAVMSRGINLGGASKEEQVLAALLTERIPSMARVRFCNSGTEANTMALTLARHHTGRRKILAFENGYHGGFIGFDSGVLPTTVPFEFVLARYDDATHVRELVDDSFAAIIVEPMQGVGGMIPASRRFLQTLREVADATSAVLIFDEVVTSRLNYNALQSHHGVFPDLTTIGKFWGGGGGGFSFGAFGGKADIMAAMDPPALGGSTSSAQQQRLSHSGTFNNNAFSMTAGAVACRLITREAIARANALGDRLREGITAAGRNAEASPWMWASGFGSMLNVHFGGFAAAELRDLFFFFMLDRGFYVSRRGLIALNLMHTDHHNSRSSSRHSSLVYKIEVLYLMQFFAITMFRNQKLILVSYS

SEQ ID NO: 52837 - protein, 254 aa, Triticum aestivum
MGREDRFPVWEAALGAGVAAVFAAGLVGVYLSMPDSDYSFLKLPRNLHELQILTGHLENYTSDYTVQVLIGYCAVYIFMQTFMIPGTIFMSLLAGALFGQLRGVALVVFAASAGASSCFFLSKMIGKPLVFVLWPDKLTFFQKQVAKRREKLLNYMLFLRVTPTLPNTFINLASPIVDVPFHTFLLATLIGLIPAAYVTVRAGIALGELTSLSDLYDTQSVALLFLIGVVSVTPALLSKDEAQDTAPEIAAGAS

SEQ ID NO: 52838 - protein, 119 aa, Zea mays
  misc_feature (49)..(49): Xaa can be any naturally occurring amino acid
  misc_feature (60)..(60): Xaa can be any naturally occurring amino acid
  misc_feature (81)..(81): Xaa can be any naturally occurring amino acid
  misc_feature (87)..(87): Xaa can be any naturally occurring amino acid
MSLQPRYCDPNYIPPLPIATTPPQPTGKTTLVSPLDYIFLPRSTNPVTXAYTPLQSDNKXQNEMRHTNPATGLIECRANAXSHDLQXSEETVDYLYHPTKEGMKMKDPPNDKPDDVMNA

SEQ ID NO: 52839 - protein, 154 aa, Arabidopsis thaliana
MALCATTQRTIRIAATLRRVARPFATDAVVESDYKRGEIGKVSGIPEEHLSRKVIIYSPARTATQSGSGKLGKWKINFVSTLKWENPLMGWTSTGDPYANVGDSALAFDSEEAAKSFAERHGWDYKVKKPNTPLLKVKSYSDNFKWKGNPQPEN

SEQ ID NO: 52840 - protein, 315 aa, Polaromonas sp. JS666
MNQLESLKQFTTVVADTGDFRQLGQFKPQDATTNPSLILKAVQKADYQPLLKETVARFKGRALDEVMDRLLVRFGCEILSIIPGRVSTEVDARLSFDANASYTRGERIVELYQAEGIHIDRVLIKVAATWEGIQAAERLERRGIHTNLTLLFSFCQAVACGQARVQLISPFVGRIYDWYKKSAGAAWDEAANAGANDPGVKSVRQIYNHYKHFGIATEVMGASFRNAGQITALAGCDLLTISPELLAQLAASEAPLARSLDAGAARSLDLPAVNYDETGFRYALNEDAMATEKLAEGIRAFAADAIKLEQLMVAA

SEQ ID NO: 52841 - protein, 525 aa, Polaromonas sp. JS666
MSQSMKRLRCDQTPAWAALQASFEAGGKSFDLREAFAGDAERFFRFSQEAPYVFADLSKNLLDVTSEALLLDLAVQCQLEQHRDAMFAGDRINSTEQRAVMHFLLRQPALPALEQAQSAIKNTAHELSQVHATLDAMLAYAEEVRADEAITDVVNIGIGGSDLGPQMAVLALGEFATTGKRFHFVSNVDGQELAGVLAQCQPHSTLFLVASKTFTTNETMSNAHSAKRWFEAGGGRDINRHFAALTTNVVAANAFGIRSTFGFWDWVGGRYSLWSAIGLPVAIAIGAVGFRELLAGAHAMDEHFRTAALARNLPVRLGLLDVWYRNFHGFGSRSIAPYSSALRRLPAYLQQLEMESNGKRVDTDGQPLPFATAPVLWGEPGTNGQHAYFQMLHQGTSVVPIEFVAVRKAAHGLPGHHEQLLANVLAQAQALMQGKNDEGGHRHFPGNRPSTFLLLDQLTPASLGALIALQEHRVFVSGALWGINSFDQWGVELGKVLAKDIEPRLRSGDTSGLDGSTAGLLQRLR

SEQ ID NO: 52842 - protein, 463 aa, Oryza sativa (indica cultivar-group)
MGMLRWGAHLLLLLLAAATWTCAGAGAGVTSEYRRKLEATVDMPLDADVFRVPPGYNAPQQVHITLGDQTGTAMTVSWVTANELGSNTVRYGRSPEKLDRAAEGSHTRYDYFNYTSGFIHHCTLTGLTHATKYYYAMGFDHTVRTFSFTTPPKPAPDAPFKFGLIGDLGQTFDSNSTLAHYEANGGDAVLFVGDLSYADNYPLHDNNRWDTWARFVERSVAYQPWIWTAGNHELDYAPELGETVPFKPFTHRYPTPYRAAGSTEPFWYSVKIASAHVIVLASYSAYGKYTPQWTWLQEELATRVDRKLTPWLIVLMHSPWYNSNNYHYMEGETMRVQFERWLVDAKVDVVLAGHVHSYERSRRFANIDYNIVNGKATPAANVDAPVYITIGDGGNIEGIANNFTVPQPAYSAFREASFGHATLEIKNRTHAHYAWHRNHDGAKAVAEAVWLTNRYWMPTNDDV

SEQ ID NO: 52843 - protein, 480 aa, Oryza sativa (indica cultivar-group)
MAMGARLCSSSVIVVVVVLIVAAAAEAMRCPGTTSVYRRPKKKAADMVDMPLDADVFAEPAGRNAPQQVHITLGDQTGTAMTVSWVTMEEAGNSTVLYGLAMDKLDMAADATVTTYTYYNYTSGFIHHCTLTNLQYGVKYYYAMGFGFTVRSFWFTTPPRPGPDVAFRLGLIGDIGQTFDSNATLTHYEASGGDAVLFMGDLSYADKYPLHDNNRWDTWGRFSERSVAYQPWIWVAGNHEIDYAPELGETKPFKPFTHRYPTPHLASASPEPYWYSVKLASVHIIVLSSYSAFAKYTPQWKWLEAELGRVNRSETPWLIMASHSPWYNSNNFHYMEGESMRAQLEKMAVDARVDLVFAGHVHAYERSFRVSNIRYNITDGLCTPVRDRRAPVYVTIGDGGNIEGLADEMTWPQPPYSAFREDSFGHAVLDIKNRTHAYYAWYRNDDGAKVAADAVWFTNRFHMPNHDDSTPTPTKRHYYG

SEQ ID NO: 52844 - protein, 630 aa, Thiomicrospira crunogena XCL-2
MSTFKNALPASNDILTRDPLPASHKTYISGEIHPEIKVPMRAITLTNGETVTVYDTSGPYTDPNIEIDVAQGIPTVRKDWIANRNDVEAYEGRIIDPKDNGYKNRTQMETAIAGASSLMRQPLRAKAGQNVTQLHYARQGIITPEMEFIAIRENQRRDMTRRYLNDPEREARLKGENFGANLLEDITPEFVRKEVAEGRAVIPANINHPESEPMIIGRNFLVKVNANIGNSATTSSIGEEVEKMVWATRWGADTVMDLSTGQNIHTTRDWILRNAPVPIGTVPIYQALEKVNGVAEDLTWEIFRDTLIEQAEQGVDYFTIHAGVLLRYVPMTAKRVTGIVSRGGSIMAKWCIAHHKENFLYTHFEDICEILKQYDVSFSLGDGLRPGSVADANDEAQISELKTLGELTQIAWKHDVQVIIEGPGHVPMHMIKENMDKQLEYCHEAPFYTLGPLTTDIAPGYDHITSGIGAAMIGWFGTAMLCYVTPKEHLGLPNRDDVKEGLITYKLAAHAADIAKGHPGARSRDDALSQARFEFRWEDQFNLGLDPEKARAFHDETLPRDSAKVAHFCSMCGPKFCSMKISQEVRDYADKQGLSTEDAVNKGMEEMSQTFKNQGSEVYVNVEDITKTGS

SEQ ID NO: 52845 - protein, 597 aa, Buchnera aphidicola str. Sg (Schizaphis graminum)
MIDENKKKNTNLNKNEYEEKSILKDLFHFFGKDFCVVQDTCIDFPVIWINKSLLLKVGKFLSSSPKPYNMLFDLHGVDERFRLNRLNLPEADFSIFYHLISIERNSDILIKVPLLKDDLNVSTFISLFPNANWYERETWEMFGIIFDQHPNLTHIIMPNEWKGFPLRKDYPARATEHESFFLDEQKEDLEMENLRFKPELWGMKRKNDNVDFMFLNLGPNHPSAHGAFRIVLQLDGENIVDCVPDIGYHHRGAEKMAERQSWHSYIPYTDRIEYLGGCVNEMPYVLAVEKLANISVPEKVEVIRVMLSELFRINSHLLYISTFIQDVGCMTPVFLAFTDRQKIYDLIEAITGARMHPAWFRIGGVAHDLPKGWNVLLKEFLEWMPKRLKYYVQLALENPILIRRSKGIAQYNQKEALQWGVTGSGLRSTGLDLDVRKWRPYSGYQNYTFEIPIGQGISDCYSRVIIKVEEIYQSLSILKQCLKNMPEGPFKSDHPLTTPPPKERVLKDIDTMITHFLQVSWGPVIPANESFQMIEATKGINSYYLISDGGTMSYRTRIRTPSFPHLQQIPSVIRGSLISDLIVYLGSIDFVMSDVDR

SEQ ID NO: 52846 - protein, 277 aa, Thiomicrospira crunogena XCL-2
MTDLYAVVGNPIAHSKSPLIHRLFAEQTDQDLVYEALLIDTEDTTFQFAISDLIARGYRGINITVPFKLDAFELADELSPRAEVAHAVNTFSFKDGKIFGDNTDGIGLVTDIEENANRPFKDQKVLILGAGGAVQGILQPLLEKQPGLVHIANRTAKRAEVLGKRFETFSPITSSDWEGIPDQAYDIIINGTSASLEGKLPPINSNVVGQDSLVYDMMYGAEPTIFMQWAQQHQPSCQVRDGLGMLVGQAAEAFYIWRGVRPQTQSVIDEVRRLIQA

SEQ ID NO: 52847 - protein, 346 aa, Arabidopsis thaliana
MAIGPSSVIIIVGIILALTYQSILKPPPPNLCGSPGGPPITAPRIKLRDGRHLAYKEYGLPREKAKHKIVFIHGSDSCRHDAVFATLLSPDLVQERGVYMVSFDKPGYGESDPDPIRTPKSLALDIEELADQLSLGSKFYVIGKSMGGQAAWGCLKYTPHRLAGVTLVAPVVNYYWRNLPLNISTEGFNLQQKRDQWAVRVAHYAPWLIYWWNTQNWFPGSSVVNRDGGVLSQPDKDIILKLGSSRKPHLAEVRQQGIHESINRDMIVGFGNWEFDPLELENPFLNREGSVHLWQGDEDMLVPVTLQRYIADKLPWLHYHEVAGGGHFFPLAKGVVDEIVKTALNH

SEQ ID NO: 52848 - protein, 433 aa, Mycobacterium sp. MCS
MIPAKTGRSANWKWKPVEARADADFVVAPDERLSWPRTIGLGAQHVVAMFGATFLVPVLTGFPPATTLLFSGVGTILFLIITGNRLPSYLGSSFSVIAPVTAAVASEGTGSALGGIVALGLVLIVIGGVVHLVGTRWLDVTLPPVVTGAIVALIGFNLAPAAKTNFEAGPVVATVTLVLLVATLAFFRGMIGRLAIFLAVLIGYLLALAMGDVDTSAIAAAPWVGLPDFEAPSFSLAVLPMFLPAVVALIAENIGHVKSVGQMTRTDMDPLIGRALAADGVATTLAGFGGGSATTTYAENIGVMAATRVYSTAAYWVAAVVAIALSLCPKIGAAISATPAGVLGGATVVLYGLVGVLGVRIWLTNHVDFSLPVNQMTAAIPLIIGIADFTWQAGELTFTGIALGSIAALLVYHGMRLLGLRTSRSAEPSTSTV

SEQ ID NO: 52849 - protein, 415 aa, Mycobacterium sp. MCS
MNPPGGPALSRRLGLVDAIVIGLGAMIGAGIFTALAPAAAAAGGGLLVGLAVAAVVAYCNATSSARLAARYPESGGTYVYGRERLGPFWGYLAGWGFVAGKTASCAAMALTVGVYVWPGGARLIAVAAVVALTAVNYAGIRKSALLTRLIVAVVLAVLAVVVVIVLGFGDPVGDRLDFGADVTVGGALQSAGLLFFAFAGYARIATLGEEVCDPARTIPRAIPIALGLTLAVYAVVAVTVLAQLGPAALAGSTAPLADAVRAAGFPGWVPVVGAGAAVAALGSLLALILGVSRTALAMARDRHLPSGLAAVHARHGTPHRAEVAVGVLVAALAATVDLRDAIGFSSFAVLMYYAIANASAWTLGARVVPAVGLAGCLLLAFALPWTSVLAGVAVLAVGALAYAVRRARSTGNGAR

SEQ ID NO: 52850 - protein, 392 aa, Streptococcus suis 89/1591
MDLLNRFNKNLNRIEVSMIRQFDQSISDVPGILKLTLGEPDFTTPDHVKEAAKAAIDANQSYYTGMAGLLELRQAAAEFVAEKYNLHYNPENEILSTIGATEALSASLVAILEAGDTVLLPAPAYPGYEPIVNMVGADIVEIDTTANDFVLTPEMLEEAIIEQGDKLKAVILNYPANPTGVTYSREQIQAFADVLRNYPVFVLSDEVYAELTYTGQPHTSIAEFLPEQTILIQGLSKSHAMTGWRIGLIMSQAPIIAQIIKSHQYLVTAASTAMQYGAVEALKNGKDDALPMRAEYVKRRDYIIEKMTDLGFKIIKPDGAFYIFAKIPAGYNQDSFSFLQDFARKKAVAFIPGAAFGQYGEGYVRISYAASMEKIQTAMACLKEYLEENGTN

SEQ ID NO: 52851 - protein, 376 aa, Rhodobacter sphaeroides 2.4.1
MRTRAAVAVEAGKPLEIMEVNLEGPKAGEVMVEIKATGICHTDEFTLSGADPEGMFPAILGHEGAGVVVEVGPGVTSVKPGDHVIPLYTPECRQCPSCLSQKTNLCTAIRGTQGQGLMPDGTSRFSMLDGTPILHYMGCSTFSNYTVLPEIAVAKVRPDAPFDKICYIGCGVTTGIGAVINTAKVEIGAKAVVFGLGGIGLNVIQGLKLAGADMIIGVDLNNAKKEWGERFGMTHFVNPSEIDGDVVAHLVNMTKTPFDQIGGADYTFDCTGNVKVMRQALEACHRGWGQSIVIGVAPAGAEIQTRPFQLVTGRVWKGSAFGGARGRTDVPKIVDWYMEGKIQIDPMITHILSLEEINKGFDLMHAGESIRSVVVF

SEQ ID NO: 52852 - protein, 429 aa, Anaplasma phagocytophilum HZ [sequence omitted]

SEQ ID NO: 52853 - protein, 245 aa, Brassica napus
MQSLPTTLYPTSVSPPSLDLYPLRQTVSSVLSPPTAGYNRRGMVSRGESASFKPLAARQTSISGDGDGYCTLVDFAGYGGGGANVGDDLVVLLYHLQHACKRIASLVASPFNSSLGKLSVNSSTGSDRDAPKPLDIVSNDIILSSLRNSGKVAVMASEEDDTPTWIKDDGPYVVVVDPLDGSRNIDASIPTGTIFGIYNRLVELDHLPVEEKAELNSLQRGNRLVASGYVLYSSATILCVTLGSG

SEQ ID NO: 52854 - protein, 509 aa, Mesorhizobium sp. BNC1
MIKEALLQTTMKSLEGSRQELFIGGRFRAPSSGRFIPSFDPTTGEVWYEFAEADAADVDAAVTSATKAFHNPAWRRMTQTDRGKLIRRLAELVLEHADELALMETRDNGKLIKEMMAQMRAMPDSYIYFAGMADKLQGDTIPVNKLDSLNYSQREPLGVVGMITPWNSPLMLLTGTLAPCLAIGNTVVVKPSEHATASTLALAELVVEAGIPEGVVNVVTGTGAVTGEALTRHPGLAKIVFTGSTATGRRIAANAAENLIPCQMELGGKSPHVVFSDVDIERAVNGVVSGIFAAAGQTCVAGSRCFVEANIYDRFLEALVERTRHIRVGHPMEESTDVGPLAMKSQLEKIEGYVASGARDGAKIAVGGRRPKDGDLARGWYFEPTVMADARNDMKFMRDELFAPVVGVMPFRDEAEMITLANDTEYGLASGIWTRDIDRAMRFASQIDAGTVWINTYRSAAYMSANGGFKNSGYGRRGGFDVMREFSRSKNVLIDYSGAMQDPFVIRLK

SEQ ID NO: 52855 - protein, 337 aa, Polaromonas sp. JS666
MSHLPVPPPPSGPVPWDKAFALAVLAGMLRIRRMEEKCAQLYGEQKIRGFLHLYIGEEAVAVGALRALQPQDNVVATYREHGHALLRGLAMNGIMAEMYGKREGCSRGRGGSMHLFDRATRFYGGNAIVGGGLPLAAGLALADKMAGRQALTACFFGEGAIAEGAFHEAANLAALWQLPVLFCCENNLYAMGTALARSEAQTDLCMKAASYGMATVQADGMDVVAVFDAVQRSAQQVRSQGRPVFVELKTYRFRAHSMFDPELYRDKAEVQAWKTRGPIHTFTARLKAQGSLTEDEFLVLDAAAQAEVDAAAAFAEAGTWEPVEDLLRDVHTREGAA

SEQ ID NO: 52856 - protein, 451 aa, Arabidopsis thaliana
LLTREENPNFQLWSKIGRMRRRRCDLQPKRTRMCDLQPKRTSMCDLPPKLVGEKILTRIPITSLRAVRSTCKLWNALTKDRVLGKAAAQFLGFMTMDSKVCSVRFHLRRSKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 52857 - protein, 444 aa, Oryza sativa
MGWKAPTRIQAEVIPFALQGRDVIGVGQTGSGKTAAFALPIIQALLEHEHRPCFFACVLAPTRELAIQIAKQFEALGSAISLQCSVLIGGIPRTSQTISLAKRPHVVVWWRSSRACLPEHLRKGFDSWQLWKERNSRVGTPGRLLDHLTNTKGFSFNKLKYLVLDEADDLLKVDFQKAVDDILNVIPKERRTFLFSATMTEKVKKLRRACLKNPVKVEVASKYSLVDTLRQDLYVVPAKYKDCYLIHVLNKMPGSMIMVFVRTCESTRLLALMLRNLRFKAISISGQMSQDKRLGALNRFRTRDCNILVCTDVASRGLDIQGVDVVINYDFPLNSKDYIHRVGRTARAGQSGYAVSLVNQFEGEFFKLTEQFLGGEEIPARKVDADEIMILHERIYDSKRIALKTMNESGYHKRMRRRMEDDEEEVEEAPVSSRSRSLKKSRRR

SEQ ID NO: 52858 - protein, 330 aa, Polaromonas sp. JS666
MARRTITYREALREALREALYADPRVFLMGEDVGRYGGTYAVSRGLLDEFGPERIRDTPLSELGFVGAGVGAALGGMRPIVEVMTVNFSLLALDPIVNTAAMLHHMSGGQLSVPIVIRMATGAGRQVAAQHSNSFENWYAHVPGLTVLAPATVEDARGMLAAALADPDPVVIFEHAQLYNMEGEVPDGEWPGVDIRSARVRRAGTDVSLITHGGSLPKALRAAEELEQQGISAEVIDLRVLRPLDDATLMASVRKCRRAVVIDEGWRSGSLAAEVMARIMEQAFFDLDAPLARVCSEEVPIPYARHMEEAALPQVPKIVAAARALLGSAP

SEQ ID NO: 52859 - protein, 256 aa, Vibrio sp. Ex25
MRRPVVMGNWKLNGSKAMVTELLTGLNAELEGVEGVDVAVAPPALYIDLAERVIAEGGNKIILGAQNTDLNNSGAFTGDMSPEMLKDFGATHIIIGHSERREYHNESDEFIAKKFNFLKENGLTPVFCIGESEAQNEAGETEAVCARQINAVIDTYGVEALNGAIIAYEPIWAIGTGKAATAEDAQRIHASIRALIAAKDEAVAAQVIIQYGGSVKPENAEAYFSQPDIDGALVGGASLDAKSFAAIAKAAAKAKA

SEQ ID NO: 52860 - protein, 420 aa, Polaromonas sp. JS666
MIEFKLPALGADMDEGTLLKWHVQPGDAVKRGQVVAVVDTSKAAVDVEIWQDGVMTELRVQPGEKVPVGTVLARLLAPGEVAAPAATSLTASTVPTVPVAVPQSVPAAPPQPALPRVPEIEKALPAARHPVSPSARRHAREHGIDPDSVHGTGPQGSVTLADIEAAVAARRPPLPVAAAPDRQTEMRKAIAATMSRSKREIPHYYLSEPIPMARALAWLLQRNEGLPITERILPAVLQLKAVAAALQRVPQLNGLYRDGAFQLSTAVHAGVAISLRGGGLVAPAIHDVGAKPLELLMRELADLVKRARAGSLRSSEMSDPTITITNLGDQGVEAVFGVIYPPQVALVGFGRVADGPWVEEGEVRALPLVTATLAADHRVSDGHQGALFLAELRDLLQQPQALAERVTPAPGQGGQAGGPT

SEQ ID NO: 52861 - protein, 178 aa, Medicago truncatula
MALQLQLQLQLPASIGRVKSITCPPRARKATTFATLSQPRSDTVNWVEATSSFFDQDKRPIMLFDGVCNLCNGGVKFVRDNDRNKSIRYEALQSEAGKMLLRRSGRAPDDISSVVLVENNRSYIKSEAVLKIMEYIDLPFPQLAFLFNFMPLFVRDFVYDNVANNRYTVFGRSESCEI

SEQ ID NO: 52862 - protein, 180 aa, Buchnera aphidicola str. Sg (Schizaphis graminum)
MTVKEIIIGFLLQIRSILMVFKNIFSKSETKMYPEEKLYLSPRYRGRVILTRNIDGGERCVACNLCAVVCPVDCISLQKSEKKNGRWYPKFFRINFSRCIFCGLCEEACPTAAIQLMPDFELSDFNRQNLVYEKEDLLISGPGKYPDYDFYRFSGVVIKDKKVDKLEGQLKPVNVKDLLP

SEQ ID NO: 52863 - protein, 453 aa, Arabidopsis thaliana
  misc_feature (106)..(106): Xaa can be any naturally occurring amino acid
MDTDMISNLPDDVLGKILSLVPTKLAAATSVLSKRWRNLLPLVDSLDFDETMLFYPDNKDGEDEASSYESGQRRRHSFSHFVDKTLALLSNAPLTEKFSLKCYHEXDGARINRWIRTALERGCLELNLEAANYLPIDSQYFTSNTLVKLTISDGLYPGGHLLPFGGVFFPALKTLTLVSVCFTSVEMINFFIHGCPALEELFLCVWMQYMSSPNVKRVTITSDFDDDIQRPSMVLKTPSLVYLDYSSYVAGNYYVVLDSLVEARLDLRLYEPIIYDEDGLWNAEVFGNITNLIEAIRTIKILHLSPSSLEVFYYCCDLPVLEDLVNLSIESDKEKGWEVMPRLLNKSPNLQTLVVKGLVHRVTYCCGDACACIRMKDREIVSCLSRCRVKVLKILGYGGSFRELKQMRHFLGKLKCLETVKVGVKEGSKKSNYLVANVMALPRVSSKCKIQFI

SEQ ID NO: 52864 - protein, 795 aa, Photobacterium sp. SKA34
MKFSESWLREWVNPAVNSEELAHQITMAGLEVDGIEAVAGEFTGVKVGQVVECAQHPDADKLRVTKVDVGAEELLDIVCGASNCRQGIKVAVATVGAVLPGDFKIKKAKLRGQPSHGMLCSFTELGIDVESDGIMELAEDAVLGTDFREFLGLDDVTIDVDLTANRADCLSIAGLAREVGVLNRAEVTEPKFEIVAPTAADTISIDVKAPVACPRYLGRIVRNVNVQAETPLWMQEKLRRCGTRSIDPIVDITNYVLLEMGQPMHAFDLAKIDGGIVVRMAEQGEKLTLLDGNEAELNDNTLVIADNKQALAIAGIFGGEFSGVNTETKDVLLECAFFAPDAIRGRARSYGLHTDSSHRFERGVDATLQMKAMERATALIVEICGGEVAPIVEAESEADLPKAATIELRRTKLDRLLGHSIASEEVIEILTRLGCDVETTDAGWKATAPAWRFDMAIEEDLVEEVGRIFGYNNIPNQSPVAALSMNLHKEANLPLKRVRDLLVDRGYQEAITYSFVEPEQQKLIVPEIEPLILPFPISADMSAMRLSLWTGLLNTVVFNQKRQQPRVRLFEAGLRFVPEQSAENGMRQEMMLAGVIAGNRSDEHWDIATNTVDFFDLKGDLEAVLELTAIVAAFSFKAAKHPALHPGQSAAIVVDGKEVGFIGTVHPELERKFGLNGRTIMFEIEWAAINTRMLPEAVVVSKFPANRRDIAVVVNEDVLAGEVVAACRENGGELLTDVNLFDVYTGKGVEEGNKSLAIALTLQSAERTLEEADIASAVEAIVAALAEKFGASLRD

SEQ ID NO: 52865 - protein, 475 aa, Staphylococcus aureus subsp. aureus MW2
MRDYTKQYINGEWVESNSNETIEVINPATEEVIGKVAKGNKADVDKAVEAADNVYLEFRHTSVKERQALLDKIVKEYENRKDDIVQAITDELGAPLSLSERVHYQMGLNHFVAARDALDNYEFEERRGDDLVVKEAIGVSGLITPWNFPTNQTSLKLAAAFAAGSPVVLKPSEETPFAAVILAEIFDKVGVPKGVFNLVNGDGAGVGNPLSEHPKVRMMSFTGSGPTGSKIMEKAAKDFKKVSLELGGKSPYIVLDDVDIKEAAKATTGKVVNNTGQVCTAGTRVLVPKKIKDAFLAELKEQFSQVRVGNPREDGTQVGPIISKKQFDQVQNYINKGIEEGAELFYGGPGKPEGLEKGYFARPTIFINVDNQMTIAQEEIFGPVMSVITYNDLDEAIQIANDTKYGLAGYVIGKDKETLHKVARSIEAGTVEINEAGRKPDLPFGGYKQSGLGREWGDYGIEEFLEVKSIAGYFK

SEQ ID NO: 52866 - protein, 119 aa, Brassica napus
MAGEQMKPVASLLLVLNFCMYVIVLGIGGWAMNRAIDHGFEIGPDLKLPAHFSPIYFPMGNAATGFFVVFALLAGVVGAASTISGLSHIRSWTAGSLPAAAAAATIAWTLTVLAMGFAW

SEQ ID NO: 52867 - protein, 155 aa, Triticum aestivum
  misc_feature (52)..(52): Xaa can be any naturally occurring amino acid
  misc_feature (66)..(66): Xaa can be any naturally occurring amino acid
  misc_feature (83)..(83): Xaa can be any naturally occurring amino acid
  misc_feature (93)..(93): Xaa can be any naturally occurring amino acid
  misc_feature (97)..(97): Xaa can be any naturally occurring amino acid
  misc_feature (112)..(112): Xaa can be any naturally occurring amino acid
  misc_feature (122)..(122): Xaa can be any naturally occurring amino acid
  misc_feature (129)..(129): Xaa can be any naturally occurring amino acid
  misc_feature (138)..(138): Xaa can be any naturally occurring amino acid
  misc_feature (149)..(150): Xaa can be any naturally occurring amino acid
QAGLLEPKDVDLLNITSMACPALPLCPLAQTEAERGILPILKRIRAVFDKVXGIKDEESVVVRITXGCPNGCARPYMAEVGFXLGDGPNSYQXIWLXRNTKPRHLWQETLMXKVNFQDIEKXWDHCFPXWDNTPPRRXPLGASQTRMGXXQLKEW

SEQ ID NO: 52868 - protein, 447 aa, Escherichia coli K12
MDQTYSLESFLNHVQKRDPNQTEFAQAVREVMTTLWPFLEQNPKYRQMSLLERLVEPERVIQFRVVWVDDRNQIQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSLPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 52869 - protein, 545 aa, Yarrowia lipolytica CLIB122
MLGRTLLVSDHCVDITASIFPGSSHPFTTTNPAMNTFHLLIALATFVVVYILSSSFVYQRRTNALEKQWKCGKPLYYASFPRSLWHFYVFLRESRKHKLLEGFQRSFEAKKPFLTNKVNIFGKDIFNTCDPENLKAMLATQFKDFCLGERHAQLFPVLGDGIFTLDGNGWQHSRAMLRPQFARDQVSDVHMVETHLKFLTSRITGSKPVDMQELFFNLTLDTATEFLFGQSVGCQIAESDPGAYSSDMPLDLRKSFQKDFNKAQEHLGERVRLQMLYWLWNPKELQTAGARVHAFVDHYVSKALVEAEEKVDDDKYVFLRELARETKDPKVLRDQALNILLAGRDTTASLLSWCFYLMARDDRVWQKLRSEVIEHFGDGENLENITFESLKRCDYLRYVLNEVLRLYPSVPANMRFATKDTTLPRGGGPVGQDPIVIRKGNVISYHVFTTHRLTQYWGEDAEEFVPERWAEGKARGWEYLPFNGGPRICLGQQYALTEAGYVLVRLAQMYDTLENADDKPEPPVKLHALTMSHLTGVHVKLYKKN

SEQ ID NO: 52870 - protein, 205 aa, Escherichia coli
MSASALVCLAPGSEETEAVTTIDLLVRGGIKVTTASVASDGNLAITCSRGVKLLADAPLVEVADGEYDVIVLPGGIKGAECFRDSTLLVETVKQFHRSGRIVAAICAAPATVLVPHDIFPIGNMTGFPTLKDKIPAEQWLDKRVVWDARVKLLTSQGPGTAIDFGLKIIDLLVGREKAHEVASQLVMAAGIYNYYEQLEHHHHHH

SEQ ID NO: 52871 - protein, 113 aa, Rickettsia montanensis
MTGRIKHPISILYKLYRKGIKLEELTDIFVISIVVIDEEKCYKALKAVHDLYEYEKDKLKNYILNPKPNGYQSLHTIITTEDNYKIEIQIRDHKMHYHADSGEAAHWKYKNSF

SEQ ID NO: 52872 - protein, 328 aa, Synechococcus sp. RS9916
MSALTRCLQEEAAAIAAAADRLSVDQVEGALALLERCADRKAKLVITGVGKSGIVARKIAATFSSIGLMALYLNPLDALHGDLGVVAPDDVCLLLSNSGETSELLEVLPHLKRRGTARIALVGRAESSLALGSDVVLEASVDREVCPLNLAPTASTAVAMAIGDALAAVWMERRGISPADFAINHPAGSLGKQLTMTVADLMVPAQQLPALRPETPLPDVISQLTQGAIGSGWVEDPEHAGRLVGLITDGDLRRALRDQNPEGWASLQAKDLMTADPITVTAELMAVDAIQRMEHNRRKPISVLPVVNAAGELDGLLRLHDLVQAGLA

SEQ ID NO: 52873 - protein, 366 aa, Schizosaccharomyces pombe 972h-
MIRLQKFGEIVGTSRSWKLLSSTIAKRYSSSSNGVKEMTVRDALNSAMEEEMKRDDRVFLIGEEVAQYNGAYKISRGLLDKFGPKRVIDTPITEMGFTGLATGAAFAGLRPICEFMTFNFSMQAIDHIVNSAARTLYMSGGIQACPIVFRGPNGPAAAVAAQHSQHFAPWYGSIPGLKVVSPYSAEDARGLLKAAIRDPNPVVVLENEILYGKTFPISKEALSEDFVLPFGLAKVERPGKDITIVGESISVVTALEAADKLKADYGVEAEVINLRSIRPLDINTIAASVKKTNRIVTVDQAYSQHGIGSEIAAQIMESDAFDYLDAPVERVSMADVPMPYSHPVEAASVPNADVVVAAAKKCLYIK

SEQ ID NO: 52874 - protein, 332 aa, Gluconobacter oxydans 621H
MHRPSPRPFRTALDSALQTVSIEREGLQALEHALSGPLGEAFCEAVNRIAESEGRLIVTGIGKSGHIARKVQATLASTGTPSLFLHPAEAAHGDLGMVAPGDLILAFSNSGESTELAAILAYAARQNHCVIAITSVGTSALARASEIPLVLPSSTEACPMGLAPTTSTLLQLALGDALALALLEKRGFTARDFGAFHPGGLLGARLRPISDLMHTGDALPLGQGSLPLRSVILEMTRKSFGCMGVTDDNGVLQGLITDADLRRALSGDLDTTTAKDVMNAAPVTATPTTLAQDVLQLMNQRERPITSLFIVDEDRRPTGIVHVHDLLRSGLS

SEQ ID NO: 52875 - protein, 436 aa, Streptococcus pyogenes M1 GAS
MMSLPKEFINTYQAILGKELEDFLASFNQEPVNAFRINPLKNQLKTFEHPIPNTLWGYYGKLSGKSPEHVSGLVYSQEPAAQMVAQVAAPQKGSRVLDLAAAPGGKSTHLLAYLDNTGLLVSNEISKKRSKVLVENIERFGARNVVVTNESADRLAKVFSHYFDTIVFDGPCSGEGMFRKDPDAIQYWHHGYPAECAKLQKSILEDALAMLKPGGELIYSTCTWAPEENEDVVQWLLETYTFLELVDVPKLNGMVSGIGLPETARMYPHRYQGEGQFVAKLKDKRQEGQSTKLKAPKSNLIKDQLRLWKMFEKDHLNLTLSGTLQTFGDYLYLLPDGLPALDGLKIARNGLELGVFKKKRFEPSYALGLALKPDEVRSSIELREEDFRPYVSGNVITLPQSYPTGWYQLLINGNGLGFAKVVDKTIKNNFPKGLRF

SEQ ID NO: 52876 - protein, 402 aa, Prochlorococcus marinus str. MIT 9515
MSKLSLSSLDKSKLEGKKVLVRVDFNVPLNDDGQITDDTRIRAAIPTIKYLINNSAKVILAAHFGRPKGKVNERMRLTPIAARLSEILGKKVNLTESCIGEEALEKSNNLNNGDVLLLENVRFYEEEEKNDLNFAKNLAAHADMYVNDAFGAAHRAHASTQGVTKFLEPSVAGFLLEKELKYLQGAIDAPNRPLAAIVGGSKVSSKIGVLDSLLDKCDKIIIGGGMIFTFYKARGLDVGKSLVEEDKLELARNLEEKAKTKGVELLLPSDVVLANEFSPTAESKVSQIDSISGDWMGLDIGPQSIKVFQNALAECKTIIWNGPMGVFEFDKFAEGTNSIATTLADLSSFSEVCTIIGGGDSVAAVEKAGLAEKMSHISTGGGASLELLEGKNLPGVAALNEN

SEQ ID NO: 52877 - protein, 541 aa, Magnaporthe grisea 70-15
MASVAVGVANATAAFTSPLASYVPSNVALPPQLEYVLGNVIETVSNAGFWTILGTVVLMLAIYDQFSYQRSKGNIVGPRFKEPFIGPFLQSMNPKWEEYYGKWTSGPLSCVSVFHKYAYTFPHSKTVTELLNMPCVVDVAPKLLGHDNWVFLDGKAHVDFRKGLNGLFTRKALECYLPGQEDVYNRYFKKMVQITKDAGGKPVPFMVEFREIITAVSCRTFVGHYMSDETVRRIAVDYFYITEALELVNFPIILPFTKTWYGKKAADMVLAEFSKCAAKSKARMNADGEVTCIMDAWIQQMVLSQRWRDAEAAGTITDDMEKPNPLLRDFTDYEIAQTLFTFLFASQDATSSAATYMFQIMAQHPEVLDRVREENYNVRNGDINARVSLEQLESMKYTRAVVKELLRYRPPVIMVPYVTKKAFPITPEYTAPKGSMLIPTTYMALRDPEVYDRPDEFDPERYYTGDAEEKGQKNFLVFGTGPHYCLGQHYAQLNLALFVGMASLQLDWKHHATPLSEEIQVFATIFPKDHCPLTFDWRKWN

SEQ ID NO: 52878 - protein, 127 aa, marine gamma proteobacterium HTCC2143
MSEKEIIATDKAPHAIGPYSQAVKVGNTVYLSGQIPLIAETMELVIGDIKAQTAQVFNNLSAVASAAGGTMNDAVKVNISLTDLNDFAAVNEVMSSVFQQPFPARACVQVAALPKGADVEIEVILVL

SEQ ID NO: 52879 - protein, 533 aa, Nostoc sp. PCC 7120
MTKAPVAPVVLVILDGWGYCEETRGNAIAAAKTPVMESLWTAYPHTLIHTSGKAVGLPEGQMGNSEVGHLNIGAGRVVPQELVRISDAVEDGSILSNSALVKICQEVRNRNGKLHLVGLCSEGGVHSHITHLFGLLDLAKEQRISEVCIHAITDGRDTAPTDGINAISALEDYINHVGIGRIVTVSGRYYAMDRDRRWDRVQRAYDVMTQDGVGDGRKAVDVLQASYAEGVNDEFIVPVRIAPGTVEPGDGVIFFNFRPDRSRQLTQAFVSPEFTGFARQQIKPLSFVTFTQYDSDLSVSVAFEPQNLTNILGEVIANQGLNQFRTAETEKYAHVTYFFNGGLEEPFAGEDRELVSSPMVATYDKAPAMSATAVTDTAIAAIQKGIYSLIVINYANPDMVGHTGQIEPTIKAIETVDRCLGRLLEGVSKAGGTTIITADHGNAEYMLDEAGNSWTAHTTNPVPLILVEGEKVKIPGYGTNVELRSDGKLADIAPTILDILQLPQPPEMTGRSLLQPAEYEVELSRTPIPVGLN

SEQ ID NO: 52880 - protein, 245 aa, Polaromonas sp. JS666
MTSSSPARPPVAAASTPSDAKVALGWLHTAKFLTTAPELKHLPRLDVPEIAFVGRSNAGKSTCINTLTQQHRLAFASKTPGRTQSINLFSLGKQGVTDAVLADLPGYGYAAVPKEAKYRWQQVMGNYLQTRDNLKAVVLLCDPRLGLTELDEILLDVLRPRVEEGLKFLVLLTKSDKLNKTEAAKALSIVRLQAGGGDVKLFSSLKRKGVEEVAQHLWDWAHPPEKPAKKPKAEPAAEAATGDEG

SEQ ID NO: 52881 - protein, 558 aa, Mesorhizobium sp. BNC1
MDKYDDGLPRCAANYQPMTPISFLERAALTYPDHPAVIHGSTRITYREFWENCRRLASALVRLGIRRGDTVSVLLSNTPPMIEAHYGVPMANGAVLHSLNYRLDAQAIAFQLEHSESKVLIVDREFSSLASDALALLKNSPIVIDYDDPEYPDDAPYPKGPFIGSLEYAAFLRSGNPDFLPPPPRDEWDAISLNYTSGTTGNPKGVVCHHRGAALMALNKTIHGEMGKHPVYLWTLPLFHCNGWSFSWTVAVQAGTHVCLRWVRARVVYDLIADHGVTHLCGAPIVMSTLLNAPDEDKRRFSHEAIFITAAAPPPEAVLAAMRDAGFRVLHLYGLTETYGPAMVNEWKAEWDALPPAEQAAHKARQGVRYLSLSEVAVLDSETMQPVPADGETMGEVMMRGNVVMKGYLKNQKATEEAFSGGWFHTGDLGVMHPDGYVQLKDRSKDIIISGGENISSIEVEDALYRHPKVMQCAVVAMPDEKWGERPVAFVELRPNVHADEAEILSYCKATLARFKCPSRIIFETLPKTSTGKIQKFALRARAKQLAADLAFQRQGEA

SEQ ID NO: 52882 - protein, 390 aa, Oryza sativa (indica cultivar-group)
MADADDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDYLMKILTERGYSFTTTAEREIVRDVKEKLSYIALDFDQEMATAATGSSVEKSYELPDGQVITIGAERFRCPEVLFQPSFVGMEAAGIHETTYNSIMKCDVDIRKDLYGNIVLSGGTTMFPGIADRMSKEITALAPSSMKIKVVAPPERKYSVWIGGSILASLSTFQQARTLPPTPFFPYFLLLFSTLILYTPLHADVDCQG

SEQ ID NO: 52883 - protein, 216 aa, Triticum aestivum
  misc_feature (203)..(203): Xaa can be any naturally occurring amino acid
NKFVQKSRLVPVRNSRDIVDPRVRSKYGKVTEAKVVMDKFSGRSRGFAFVTFDEKKAMEEAIEDMNGLDLEGRAITVDKAQPQGAGRDRNGDRDFDRDRGSRGGRDYGGGRAARGSGGDCFKCGKPGHFARECPDGDGGRGDRYGGRDDRYGGGRSDRDRSDRGGDRSDRDRSDRGGDRSDRDGDRSERGSDRYSSRSRDGGXGGDRYSRDRSGPY

SEQ ID NO: 52884 - protein, 381 aa, Rhodopirellula baltica SH 1
MKVSLAVFLALTLTISIQAEELPDVAVAGEDALVSSQQIFDLADKPTKESHASTIVETPTGLVAAWFAGTRERDPDVGIRVSRHENGQWTESVEVVSGVQSSTLRYPTWNPVLFQPSEGPLMLFYKVGPNPREWWGMLTTSQDGGKTWSWPTKLGEAHTIGHLLGPVKNKPVELADGTILCPSSTEIEYADGSSHWRVHFEVTKDLGKTWEVIGPIQTGETFHAIQPSILTYPDDRLQILCRSKEKRIVESWSKDGGKTWSTLTATDLPNPNSGTDAVTLQDGRQVLIYNHSEGLVRRKDAPDLKPRRILNLAISSDGKTWKPVLTLEHETGPHPKDSDRRRHFGEYSYPAIIQTSDGMLNMVYTYNREGVKHAVVDPSKL

SEQ ID NO: 52885 - protein, 763 aa, Arabidopsis thaliana
MVTSSDQIQNGSEEQSKRSEIYTYEAPWQIYAMNWSIRRDKKYRLAITSLIEQYPNRVEIVQLDESNGEIRSDPNLCFEHPYPPTKTSFIPDKECQRPDLLATSSDFLRLWRISDDESRVELKSCLSSDKNSEFSGPITSFDWNEAEPRRIGTSSIDTTCTIWDIEREVVDTQLIAHDKEVYDIAWGGVGVFASVSEDGSVRVFDLRDKEHSTIIYESGEPSTPLVRLSWNKQDPRYMATVIMGSAKIVVLDIRFPALPVVELQRHQASVNAIAWAPHSSSHICSAGDDSQALIWDISSMGQHVEGGLDPILAYTAGAEVEQLQWSSSQPDWVAIAFSNKLQILRMMYSSLLQYRHIDSLSNLKGIQVSASPILFALLSATNLNLDSFWSPWLRLLSLSPRYLPPSSSSLLQGFTEFSGLRSSSASLPFGKKLSSDEFVSIVSFQTSAMGSSGGYRKGVTEAKLKVAINGFGRIGRNFLRCWHGRKDSPLDIIAINDTGGVKQASHLLKYDSTLGIFDADVKPSGETAISVDGKIIQVVSNRNPSLLPWKELGIDIVIEGTGVFVDREGAGKHIEAGAKKVIITAPGKGDIPTYVVGVNADAYSHDEPIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVSKKTFAEEVNAAFRDSAEKELKGILDVCDEPLVSVDFRCSDFSTTIEFHHLH

SEQ ID NO: 52886 - protein, 427 aa, Polaromonas sp. JS666
MTDHKLPGHPHFAYRGNDLFAEDLMVSELASLHGTPLFVYSKAAMLSALAAYQRGFAGRDVQICYAMKANSSLGVLQVFAGAGCGFDIVSGGELERVLAAGGQANKIIFSGVGKTRAEMRQALAAGIGCFNVESEAELDVLSGVAAAMNLRAPVSIRVNPNVDPKTHPYISTGLKGNKFGVAHEDALRIYQHAAALPGLQVAGIDCHIGSQITETTPYLDAMDRVLDLVASIESAGIELEHIDFGGGLGINYNGDTPPEADVLWRQLLAKLDARGYGSKKLMIEPGRSLVGNAGICLTEVLYLKPGEQKNFCIIDAAMNDLPRPAMYQAFHAIVPAVAGGPAPATTYDVVGPVCESGDWIGRDRPLAVNAGDVLAVLSAGAYCMSMASNYNTRGRAAEVLVDGSQAHLIRRREDAQDQMRHEQLVAE

SEQ ID NO: 52887 - protein, 790 aa, Ustilago maydis 521
MAAPRMSIKFLGTSSMPNSTRNYSSLLFKLDNHTVMVDCGEGTQRQFRSRYIGVDERLANLKTILVTHLHADHVLGLVPLLMSMMGPTGVSSAPESSAPRIEIYGPPGLRALIRTTLSLCYSQLSGKYVVHEFVWPSQDQMPEASPHALRDQPGRTIPNLPLHDGESNAGRDLNMDPRTFSWPNFLTIKSASHGPNVRISAAPISHRCPTLAFVFEEEARAMPLDPSVAEAIKRNATALQEQEGIRHPLSLLSKLTNRRQTVLLPDGTVLHPPHLGMPGRKVTIMGDTSDGTGGFSEMQLRAGYGLPALAYDSDVLVHESTNIALPAHLNKNGKADSLEEVAEKATSRGHSVPQVAGQFAALVNAKCLILNHFSTKYPSPPHYLLDSMGTQAELSPTQSERQQAPQGRQLGDSERKALIMKEFEIQAYQAWKEAASKGSQLETYSAFDGFHFEVPARPEPNALAPTSVRGPFARPWEQDEEADVSDDLEGQHNQQASASNADKQMWDPSPFLLPWSQNDVPRYAMVLLNSPIDTRQIGHFRHLWKSASLRLCADGAANRILDCFGAAAFESQDGRPSVPLPNAILGDLDSIRPDTQHFFTCKGVAVHLRPSQYATDLQKTIQEVEDQEAASGDGDEHTLIIFGGLAGRLDQSVHTLHVLWQLAPGTEQLGSVLDPDGLNERGSRLKKRQRTFAIGDGSVAWLLPKGKHVLKMSRQVMGKTCGILPLGVGNSGANVSTKGLEWNLERDSTTLGGFLSTSNHLADEQGVVEVENDEPVYWTVELRPDDECSF

SEQ ID NO: 52888 - protein, 356 aa, Arabidopsis thaliana
  misc_feature (303)..(303): Xaa can be any naturally occurring amino acid
MPSLAEEICIGNLGSLQTLPESFTWKLTAADSLLRPSSAVSFDAVEESIPVIDLSNPDVTTLIGDASKTWGAFQIANHGISQKLLDDIESLSKTLFDMPSERKLEAASSDKGVSGYGEPRISPFFEKKMWSEGFTIADDSYRNHFNTLWPHDHTKYCGIIQEYVDEMEKLASRLLYCILGSLGVTVEDIEWAHKLEKSGSKVGRGAIRLNHYPVCPEPERAMGLAAHTDSTILTILHQSNTGGLQVFREESGWVTVEPAPGVLVVNIGDLFHILSNGKIPSVVHRAKVNHTRSRISIAYLWGXGPAGDVQIAPISKLTGPAEPSLYRSITWKEYLQIKYEVFDKAMDAIRVVNPTN

SEQ ID NO: 52889 - protein, 347 aa, Escherichia coli K12
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYCLEGKYNICPDVDFMATQPNYRGALTHYLCHPESFTYKLPDNMDTMEGALVEPAAVGMHAAMLADVKPGKKIIILGAGCIGLMTLQACKCLGATEIAVVDVLEKRLAMAEQLGATVVINGAKEDTIARCQQFTEDMGADIVFETAGSAVTVKQAPYLVMRGGKIMIVGTVPGDSAINFLKINREVTIQTVFRYANRYPVTIEAISSGRFDVKSMVTHIYDYRDVQQAFEESVNNKRDIIKGVIKISD

SEQ ID NO: 52890 - protein, 523 aa, Bordetella pertussis Tohama I
MPENAQPHAVIPAADLQLSAQSPQWRVFAAAAAGAPLVARPLRVIEAAGIYVDLSMQRHSSALAQAGLALLQARDVLGARAALFAPGAQDAAHGRYPVLRAGYGAHPEEQCDIEVEIEYARMLEFVRELDRGGAYPAVLYLGGGAGQWALRLALQAFGGPAQRRQLRLVSGGDAAALHEALAGLDPRRTLVVAASRGFEPSETLDNARAAIDWLRRAGIDDVSAHLVAVTGNESAARALGVAAARVFRLPSWLQPRHELWSVGALPVALALGVDMLKALRSGAAAMDQHFLQAASAVNAPMQMALAAVANTSAMHWPTHALAVYSARLAALPACVQQLEMTLAGRAPASLPAYPVVWSPAGAPGPGAFFEWLHRAPAGAPVDFIAGLDEYPASPPAHRALLANCLAQREALLRGLPAGPGQPAAGGGRPSTLVVLRQVDPRAVGALLALYEHKAFVQAALWGAALGGADEAQACQRLAQDIARQLAVPPEAGPVDWGHDSSTAFWIDRYREQGGAGAAAGRTA

SEQ ID NO: 52891 - protein, 545 aa, Yarrowia lipolytica CLIB122
MIGNAQINQVGALQHRFPKLHNPYLTAAVATMGGLLFGFDISSVSAFVDTKPYKEYFGYPTSIQQGGITASMAGGSFLSSLVAGWISDRLGRRFAIHFASFWWVVGAAIQSSAQNKGQLIAGRLISGLGIGLGSSVIPVYISELSPKKIRGRLVGLFQWAVTWGILIMFYISFGLSNIHGVAGFRVAWGLQIIPGLLMSLGCLFLEESPRWLAKQDNWDESVRVLRAIHQGGYGTEEDILLEIEEIREAVRIEHETKNLRFWHLFQKDSINRTMVGIWAQIWQQLTGMNVMMYYIVLIFTMAGYTGNANLVASSIQYVINMIMTIPALLFIDRVGRRPLLLFGSIVMMIWLFAVAGILAVYGTQIPGGLDGDAFTTIVIEPTHKPAQKGVIACSYLFVATFAPTWGPGIWLYCSELFPLKQRAVAAGVTASANWIFNFALALFVPSAFKNINWKTYIIFGVFCIVMTIHVFVLFPETKGKTLEEIDMMWAARVPAWRTANWVPDHVPGALPEDEKHSEEMVEAVESNEEEPKIASANVDAPPSQL

SEQ ID NO: 52892 - protein, 451 aa, Shewanella sp. ANA-3
MAQHFDYICLGAGSGGIASANRAAMRGAKVLLIEAKHVGGTCVNVGCVPKKVMWYGAHIAEAMNLYAKDYGFDVSVNKFDWNTLVNSREAYIGRIHEAYGRGFTNNKVTLLNGYGRFVNGNTIEVNGEHYTADHILIATGGAPTIPNIPGAEYGIDSDGFFALREQPKRVAVVGAGYIAVEVAGVLHALGSETHLFVRKHAPLRNFDPMLIDALVDAMKTEGPTLHTNSVPQSVVKNADDSLTLNLENGESVTVDCLIWAIGRSPATGNIGLENTDVQLDSKGYVITDAQQNTTHKGIYCVGDIMAGGVELTPVAVKAGRLLSERLFNGMSDAKMDYSQIPTVVFSHPPIGTMGLTEPEARAQYGDDNVKVYTSGFTSMYTAVTSHRQACKMKLVCAGKEEKVVGIHGIGFGMDEILQGFGVAMKMGATKADFDAVVAIHPTGAEEFVTMR

SEQ ID NO: 52893 - protein, 639 aa, Photobacterium sp. SKA34
MSNRKQARLEAKQFIESLTAQPYPNSQKVYVQGSRPDVLVPMREITLADSLVGGGKDNPIFEPNEPIRVYDTSGFYTDPEKNIDIYNGLPLVREQWIAERDDTELLEGLSSEYANERLDDKTLDDLRFAERARIRCAKAGRCVTQLHYARQGIITPEMEYIAIRENMGRAKYREEVLNQQHPGVSFGANLPKEITPEFVRKEVAEGRAIIPANINHPETEPMIIGRNFLVKVNANIGNSAVSSSIEEEVEKLVWSTRWGGDTVMDLSTGRNIHETREWIIRNSPVPIGTVPMYQALEKVNGVAENLNWEVFRDTLLEQAEQGVDYFTIHAGVLLRYVPMTAKRVTGIVSRGGSIMAKWCLAHHKESFLYQHFREICEICAQYDISLSLGDGLRPGSVADANDEAQFSELRTLGELTKIAWEYDVQVMIEGPGHVPMHMIKENMEEQLEHCHEAPFYTLGPLTTDIAPGYDHITSGIGAAMIGWYGCAMLCYVTPKEHLGLPNKDDVKVGLITYKLCAHAADLAKGHPGAQVRDNALSKARFEFRWEDQFNLGLDPETARAYHDETLPQESGKVAHFCSMCGPKFCSMKISQEVRDYAKGLEDPEIAIKLLDDPLEGMQQKAQEFRSKGSELYHLAKEES

SEQ ID NO: 52894 - protein, 188 aa, Triticum aestivum
  misc_feature (80)..(80): Xaa can be any naturally occurring amino acid
  misc_feature (86)..(86): Xaa can be any naturally occurring amino acid
  misc_feature (101)..(101): Xaa can be any naturally occurring amino acid
  misc_feature (109)..(109): Xaa can be any naturally occurring amino acid
  misc_feature (132)..(134): Xaa can be any naturally occurring amino acid
  misc_feature (138)..(138): Xaa can be any naturally occurring amino acid
  misc_feature (140)..(140): Xaa can be any naturally occurring amino acid
  misc_feature (144)..(144): Xaa can be any naturally occurring amino acid
  misc_feature (151)..(151): Xaa can be any naturally occurring amino acid
  misc_feature (157)..(157): Xaa can be any naturally occurring amino acid
  misc_feature (161)..(161): Xaa can be any naturally occurring amino acid
  misc_feature (164)..(164): Xaa can be any naturally occurring amino acid
  misc_feature (168)..(168): Xaa can be any naturally occurring amino acid
  misc_feature (172)..(172): Xaa can be any naturally occurring amino acid
  misc_feature (175)..(175): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVDYXIRSKWXVPCLQFNKVGFILRXEHNASPGXYYDGRYWTMWKLLCSGCNDPHKXXXKVEXVXKDYXYPYVRIXRFNNMXQVHXSTXRLKXTGCXDPXKAKHKGILNAFNL

SEQ ID NO: 52895 - protein, 432 aa, Pseudomonas syringae pv. syringae B728a
MTHRIVIVGGGAGGLELATSLGKTLGKKGTASVTLVDANLTHIWKPLLHEVAAGSLNSYEDELNYVAQAKWNNFQFQLGRMTGLDRASRQIHLAETLDENGAELVPARSLGYDSLVIAVGSTTNDFGTKGAAEHCLFLDSRKQAERFHQQLLNHYLRAHAGQADSAQEITVAIVGAGATGVELAAELHNAAHELAAYGLGQIKPENLRITVIEAGPRVLPALPERIGAPVHKTLEKLGVTVLTNAAVSEVTADGLITATGQVIPASLKVWAAGIRAPAFLHELDGLESNRINQLQVLPTLQTTRDENIFAFGDCAACPQKGTDRNVPPRAQAAHQQASLLVKSLRLRIEGKTLPEYTYKDYGSLISLSSFSAVGNLMGNLMGSVMLEGWLARMFYVSLYRMHQMALYGTFRTLMLMLGSKIGKGTEPRMKLH

SEQ ID NO: 52896 - protein, 489 aa, Bordetella pertussis Tohama I
MTQLTQPLSRAELLRDACYIDGKWVGAGNGPSIPVDNPSTGKTIISVPKLGRKEAEQAIDAAEAALPAWSARTGKERAAILLKWAQLMMENQQDLAVIMTSEQGKPVPEAAGEIAYAASFLEWFAEEAKRIDGDILQSPKGGQRLMVLKQPIGVTAAITPWNFPAAMITRKVGPALAAGCTMVVKPAQQTPLTALALAVLAVLAGVPAGVFQVVTGSSREIGAALCESEVVRKLSFTGSTEVGRTLMEQCAPTIKKLSLELGGNAPFIVFDDADLDRAIDGILASKYRNAGQTCVCANRIYVQAGVYEEVAKRLVEKVNAMKVGDGFEQGVTQGPLIDTAAVAKVQEHIADATAHGAKVIAGGEPHALGGSFFQPTVVRDVTQSMRFAVEETFGPVAPLFKFDSEDEVIGMANNTIFGLAAYFYTRDYARIWRVSEALEYGIVGINTGIISNEVGPFGGVKQSGLGREGSKYGIEDYLELKYLCVDLGA

SEQ ID NO: 52897 - protein, 421 aa, Bordetella pertussis Tohama I
MKNRDLNTRRTLATPRGVGVMCDFYAVRAENSTLWDAEGKEYIDFAGGIAVLNTGHRHPKVKAAIAAQLDNFTHTAYQIVPYEGYVSLAERINAVAPIEGLKKTAFFTTGVEAVENAVKIARAYTGRSGVVAFSGAFHGRTMMGMALTGKVAPYKLAFGPMPGDVFHVPFPNATQAISVADSLKALDLLFKVDIDPKRVAAIIIEPVQGEGGFNVTPPELMQALRKVCDEHGILLIADEVQTGFARTGKLFAMQHHSVQADLITMAKSLGGGMPISGVVGRAEVMDGPAAGGLGGTYAGNPLAVAAAHAVLDVIAEEKLCERAVELGKRLMDRLEGLRAKCPAIADVRGLGSMVALELNDPATGKPDAEAVKRIQQQAIERGLILLSCGVYGNVLRFLYPLTIPDDQFARALDILAEIIAA

SEQ ID NO: 52898 - protein, 454 aa, Arabidopsis thaliana
MVIKGMRVGKYELGRTLGEGNSAKVKFAIDTLTGESFAIKIIEKSCITRLNVSFQIKREIRTLKVLKHPNIVRLHEVIILLVLASKTKIYMVLECVTGGDLFDRIVRFLLAPVTVLLVSKRLVSKGKLSETQGRKMFQQLIDGVSYCHNKGVFHRDLKLENVLLDAKGHIKITDFGLSALSQHYREDGLLHTTCGSPNYVAPEVLANEGYDGAASDIWSCGVILYVILTGCLPFDDANLAVICRKIFKGDPPIPRWISLGAKTMIKRMLDPNPVTRVTIAGIKAHDWFKHDYTPSNYDDDDDVYLIQEDVFMMKEYEEEKSPDSPTIINAFQLIGMSSFLDLSGFFETEKLSERQIRFTSNSLAKDLLENIETIFTEMGFCLQKKHAKLKAIKEESTQKRQCGLSVTAEVFEISPSLNVVELRKSHGDSSLYKQLYERLLNELGSSSQVQELLA

SEQ ID NO: 52899 - protein, 114 aa, Bacillus halodurans C-125
MNNIIREITNEQLRTDLPSFRPGDTLRVHVKVIEGSRERIQVFEGVVIKRRGTGVSETFTVRKISYGVGVERTFPLHSPKIDKIEVKRRGKVRRAKLYYLRNLRGKAARIKEIR

SEQ ID NO: 52900 - protein, 487 aa, Acinetobacter sp. ADP1
MSETTQPDQLQRKLGARHLNMIAIGGSIGTGLFLASGSTIANAGPGGALLAYVLIGIMIYFLMTSLGELATHNPTSGAFFTYGNRYVEEGFGFALGWNYWYNWAITVAFELVAVQFIMKFWFPDIPGFYWSAIFLVVIFAINAMTVKGFGESEFWFSMVKVVAIIAFIIIGMAMIIKIMMTPNMATFGNWTYKDAPFVGGLQAMIGVAMIAGFSFQGTEMVGVAAGESKDPKRTIPLAIKQIFWRILLFYVVCIFIIGTLVSYDDPRLLQAAHSSDIALSPFTLLYEKAGFAFAASLMNAVILTAILSAGNSGMYSSTRMLWDMAKEGRAPKWFAKLDRRGVPMNALYATTAIAALCFLTTFIGEQEVFNWLLNMSGMCGFIVWLGIAISHYRFRKGYIAQGYKLEDLAYRAKFFPFAPWFAFILCSIIILGQNYQAILGGKIDWTGLLSTYISIPLFLIIWLGYKWKYKTKLIPYQEMNVKAGKED

SEQ ID NO: 52901 - protein, 457 aa, Acinetobacter sp. ADP1
MSDLPQSPPKRPEQLDLIYGLDDRPAPFVSFLAALQHLLAIIVPIVTPGLLICLALGVSREETNMILSMSLVISGVATFLQCKKVGPLGAGLLIVQGTSFNFIGPIIGIGSTMVAAGTPVNQVMAAIFGVVIAGSFIEMGVSRILPWIKKLITPLVTGIVVLLIGLTLIKEGLISMGGGYQAMQDQTFASSDNLIMSCTVLAIIILLNRIQVIWVKSSAILIALIVGYILAGFMGHLNFSGLHETPLIQIPTPMHFGLSFSWSLFIPMAFIYLVTSLEAIGDITATSKLSNQPVDGPVWMKRIKGGVLVNGANSFLAGLFNTFPSSVFAQNNGVIQLTGVASRYVGIWIAVLLMLLGLFPAVAGIIQAVPQAVLGGAVMVMFGAVAASGINILSGIHLDRRALLIIAISLALGLGVAQVPQILEHLPALFKNIFSSGVATGGIAALILNIILPEHKQ

SEQ ID NO: 52902 - protein, 232 aa, Arabidopsis thaliana
MASSSATKFVDLFPCLFLACLFVFTYSNNLVVAENSNKVKINLYYESLCPYCQNFIVDDLGKIFDSDLLKITDLKLVPFGNAHISNNLTITCQHGEEECKLNALEACGIRTLPDPKLQYKFIRCVEKDTNEWESCVQNSGREKAISDCYNGDLSKKLILGYAKLTSSLKPKHEYVPWVTLNGKPLYDNYHNLVAQVCKAYKGKDLPKLCSSSVLYERKVSKFQVSYVDEAIN

SEQ ID NO: 52903 - protein, 1136 aa, Oryza sativa (japonica cultivar-group)
MEIPKQGQPPRVAGTPPTLPGAITHTTQVGYPAVFYNGNWGAQVPASSYLIVPMSEPPAQVGVPRPNALGLSGSGARPLSRVSLRPPQQVLSVQTALPGMAAMMPSPSMIAGKKMAASPKVQMLKSVPFRSAGSKRPAQELLPKAQPQLFESVRSKFRETLAAALNMDSDQQCAPQSVETVSHVGSASENKQADGAGIDSVTETSALKSGQHNMLSSNSASNMSIKVSDDMQQQSIHVPLENKVLDNNSCTLDELLQGHGLCWSSDVVGASETISQSDPDRVRKSDIDEGVDVSLIEHESKRIKTDDGAAEEKKSVTQKAQILAFEIEGELFTLLGGVNKKYKEKGRSLLFNLKDKSNPVLRGRVLSGDITPKRLCSMTTEELASKELSDWRLAKAEELAKMVVLPSKEVDVRRLVRKTHKGEFQVEVEETDGISVEVGIGGDLLSHVPSRPTEGQTKTDDKSVHTEEKESDNSEQDGVIVTGGNNMPSNLEHTENEKTDLMQELMVDDLKDTENLPPIMSLDEFMETLDSEPPFEDDSTQTVKDDPNSIEKTDISLKSEDSSKNVDSASASDSQLDPQTLSPQDKFESKLQSPKKDAGSILFPVEQIKEDLLVKSSPEKANAENIDTGSQSIPESITDCKSAPDALLTHDSVWEGTIQLSLSSLTNVVAIFKSGEKTSTNEWRHFLDIKGRVRLSAFQEFLEQLPKSRSRAIMVTELRWKEGSLESGRQHLLRTIDSYIADERVGLVKPADGVELYLCPSQGKAAQILAEHLPKEQSSSLTVTGTSAIGVVVWRRPHVSPRIPARNDGSRNQSISRKQHAVIASAVPLSSKPTNERQHHGQDVVTDDVPPGFGPGVVREDDDLPEYDFVTVPNAAANVVPSRQAHRSQQQHSQAASRRPVDHVREMVRKYGSRSAAAAQPWEDDDDDDIPEWDPNQSNLNLQQTRHAIPQPPLPPPGPVHQQMHAYHQQHQQQQQHYQSIQQYHATQESQNTLSQAYYVQSHSQQHSVPVQQLTHLQPGWQTTAQWLAAGAAHSGLPANNVVQQYCTSATPDGSGQGYATGNQGLHALEPTVATLPLCESASIRCFWPPILPLCLPCSSCNYISCELHHPDKNTSVTTSRLGSCWLYANGVAVDM

SEQ ID NO: 52904 - protein, 500 aa, Aspergillus oryzae
MLNLQSFGIVLPLLAGTALAAVSYPPIPEDLTTPYQQRLAIYGPNAISVGWNTYEKLNQSCVQYGTSKDKLDAQACSSTSSTYATSRTYSNAVVLTGLTPATTYYYKIVSTNSTVDQFLSPRSPGDTTPFNLDVVIDLGVFGQDGYTITSNNAKKSSIPSIDPALNHTTIGRLAETVDDYEFIIHPGDFAYADDWYLKPKNLLDGKDAYQAILEQFYDQLAPISGRKPYLVSPGNHEAACGEIPYTTGLCPLGQRNFTAYMHRYDETMPSAFTSSSTNTTAQRLATKAQSLAQPPFWYSFEYGMAHIVMINTETDFPSAPDGQDGSAKLDSGPFGQDGQQLAFLEADLASVDRTVTPWVIVAGHRPWYSTGSSSNICEPCQEAFEALFYKYGVDLGVFGHVHNSQRFLPVYNNTADPNGMNDPAAPMYIVAGGAGNIEGLSSVGSKPSYTEFVYADDYSYSTLRILDAHNLQVDFIHSSTGEVLDSSKLYKSHKEQFVVQ

SEQ ID NO: 52905 - protein, 445 aa, Ralstonia metallidurans CH34
METLLYKVEDRPPILTTVLLAAQHLLAALGGIIAVPLVLGGALKLPPDQIVALVNAALLGSGIVTIIQCKGVGPVGIRLPCVMGTSFTFVGAGISVGLEHGVPGILGASLAGSLVMIVGSFFMPTIRKLFPHTVTGVVVTMIGLSLTPVAIDWAAGGAGSANYAAPGSLAIAGIVLLLVIGFVQWGKGIVSASAVVLGIMIGYLICLALGMVDFSQLHDAPVFALPQPASFGMKFPISGIAAMSLAFLVTIVETTGTFMALGSATRTPMPGKTLARGILCDGVGSAFAALLSSPPVSTFAQNVGVVSLTGVASRHVVALTGGMLVLAGLFPVLGALVVTIPQPVLGGAGLMMFAMIVSAGIRMLGHSAPTKRNSLIIAVSIGCGLAVTIRPDLLAKLPAFVKEVFGSGITVGALVAVVLNLCLPGREVDAIDEEVEGETLVQELA

SEQ ID NO: 52906 - protein, 107 aa, Buchnera aphidicola str. Sg (Schizaphis graminum)
MNVIEKIERQIKDNIILIYMKGTPQSPSCGFSAQAVQALSICGEKFAYVDILENLDIRKELPRYANWPTFPQLWIKGELIGGCSIILEMLENGELKKIISNAVLNSK

SEQ ID NO: 52907 - protein, 481 aa, Helicobacter pylori 26695
MIVRTQNSESKIKEFFEFCKENEVEFVDFRFSDIKGTWNHIAYSFGALTHGMLKEGIPFDASCFKGWQGIEHSDMILTPDLVRYFIDPFSADVSVVVFCDVYDVYKNQPYEKCPRSIAKKALQHLKDSGLGDVAYFGAENEFFIFDSIKIKDASNSQYYEVDSEEGEWNRDRSFENGVNFGHRPGKQGGYMPVPPTDTMMDIRTEIVKVLNQVGLETFVVHHEVAQAQGEVGVKFGDLVEAADNVQKLKYVVKMVAHLNGKTATFMPKPLYGDNGSGMHTHVSVWKNNENLFSGETYKGLSEFALHFLGGVLRHARGLAAFTNASTNSYKRLIPGYEAPSILTYSANNRSASVRIPYGISKNSARFEFRFPDSSSNPYLAFAAILMAGMDGVKNKIDPGEAMDINLFKLTLDEIREKGIKQMPHTLRRSLEEMLADKQYLKESQVFSEEFIQAYQSLKFNAEVFPWESKPHPFEFITTYSC

SEQ ID NO: 52908 - protein, 207 aa, Triticum aestivum
  misc_feature (100)..(100): Xaa can be any naturally occurring amino acid
  misc_feature (108)..(108): Xaa can be any naturally occurring amino acid
  misc_feature (121)..(121): Xaa can be any naturally occurring amino acid
  misc_feature (127)..(127): Xaa can be any naturally occurring amino acid
  misc_feature (177)..(178): Xaa can be any naturally occurring amino acid
  misc_feature (184)..(184): Xaa can be any naturally occurring amino acid
MAMASSTRRLAFVLLGLAFSAALAESRDAYMRSADRYACILTQESFPVASKGSGLTSANGKLCVLCEQYSTEALIYLRQNETQAEILSALHHTCASLGPXLRQQCITXLVDYYIPVFLLGXSGSLTXEEFCEPAHLCPKGGGDPVRPHEGMPVGLCHHVLVEVLMMLKVPNTNWNIXXLSNITXEDTNAMQRCPDPMIGETRKTCSR

SEQ ID NO: 52909 - protein, 247 aa, Saccharomyces cerevisiae
  misc_feature (1)..(1): Xaa can be any naturally occurring amino acid
  misc_feature (167)..(167): Xaa can be any naturally occurring amino acid
XRTFFVGGNFKLNGSKQSIKEIVERLNTASIPENVEVVICPPATYLDYSVSLVKKPQVTVGAQNAYLKASGAFTGENSVDQIKDVGAKYVILGHSERRSYFHEDDKFIADKTKFALGQGVGVILCIGETLEEKKAGKTLDVVERQLNAVLEEVKDFTNVVVAYEPVXAIGTGLAATPEDAQDIHASIRKFLASKLGDKAASELRILYGGSANGSNAVTFKDKADVDGFLVGGASLKPEFVDIINSRN

SEQ ID NO: 52910 - protein, 355 aa, Synechococcus sp. RS9916
MNHSFSGPSNLKNLLLSADAKILDAMRVIDSTPAHISLVIDKANKLIGTLTDGDIRRALLHGESLTSPVENIMNHDFYALVHNQDKSHALDIMKKKKIKQIPIVNSSGEVIDLLFDDQYNTSNVVSNPVVIMAGGKGTRLRPFTENCPKPMLLIDGKPMLEILLENCISSGFRNFYFSVNYLKEQIIDYFGDGKSWDVSINYLIESEPLGTAGSLKLLPKTVKEPILVLNGDVLTSLNLLHLLDFHTHHHAQATVCVRQNQTTIPFGVVQVDGLDLIDFEEKPVYSHLVNAGVYVIDPILLTSIRPDCFTDMPTLLQVSRSNSERVIVYPIHEYWIDVGRPETLEEAHKTWKNLN

SEQ ID NO: 52911 - protein, 247 aa, Saccharomyces cerevisiae
  misc_feature (167)..(167): Xaa can be any naturally occurring amino acid
ARTFFVGGNFKLNGSKQSIKEIVERLNTASIPENVEVVICPPATYLDYSVSLVKKPQVTVGAQNAYLKASGAFTGENSVDQIKDVGAKYVILGHSERRSYFHEDDKFIADKTKFALGQGVGVILCIGETLEEKKAGKTLDVVERQLNAVLEEVKDFTNVVVAYEPVXAIGTGLAATPEDAQDIHASIRKFLASKLGDKAASELRILYGGSANGSNAVTFKDKADVDGFLVGGASLKPEFVDIINSRN

SEQ ID NO: 52912 - protein, 430 aa, Prochlorococcus marinus str. MIT 9515
MKETIDFLIDTIEARQVLDSRGNPTVEAEVFLECGAIGRAIVPSGASTGAHEAHELRDGGTKYMGKGVLDAVNKIHETISPALCGLSALDQTIIDKLMIEIDGTPNKSNLGANSILAVSLANARAASKALDMPLYRYLGDPLSNLLPVPLMNVINGGAHAPNGLDCQEFMLVPHGVKTFSEALRMGTEIFHSLKSLLDKKGLSTAVGDEGGFAPELSSCEAAGDLLLEAIQKAGFIPGKQVSLALDVASTEFYRDGFYKYEGTNLTSSQMISYLSNLVSNYPIVSIEDGLGEDDWEGWAALNKEIGHKVQLVGDDLFVTNTERLRKGILEKSANSILIKVNQIGTLTETLEAMDLAKSAGFTSVISHRSGETEDTTIADLSVATRAGQIKTGSLSRSERIAKYNRLLRIEEELGNQARFAGDLGLGPKNI

SEQ ID NO: 52913 - protein, 445 aa, Glycine max
MSCSSSSGSEEGDEGFDSYRKGGYHAVRVADQFAAGRYIAQRKLGWGPFSTVWLAYDTKTESYVALKIQKSSAQFAQAALHEIELLSSIADHNPTNSKFVIQLIDHFKHTGPNGQHLCMVLEFLGDSLLRLIRYNRYKGLPLNKVREICKCVLTGLDYLHTDRGMIHTDLKPENILLCSTIDPAKDPLRSGLSPILERPEGNTNGGVTSLIEKRLRRRARTAVAKISGRRASMGGIGDAAKTGRNIDGIDVRCKVVDFGNACWADKQFAEEIQTRQYRAPEVILQAGYSFSVDMWSLACIAFELATGDMLFTPKGGQGFSEDEDHLALMMELLGKMPRKIATAGAQSKDFFDRHGDLKRIRRLKFCPLDKLLTDKYKFSVNDAQEFSEFLLPLFDFAPEKRPTARQCLQHPWLNCMESPPNEMRNESAVEKVDVVMSKLKIRVGK

SEQ ID NO: 52914 - protein, 531 aa, Triticum aestivum
  misc_feature (138)..(138): Xaa can be any naturally occurring amino acid
  misc_feature (160)..(160): Xaa can be any naturally occurring amino acid
  misc_feature (238)..(238): Xaa can be any naturally occurring amino acid
  misc_feature (276)..(276): Xaa can be any naturally occurring amino acid
  misc_feature (378)..(378): Xaa can be any naturally occurring amino acid
  misc_feature (396)..(396): Xaa can be any naturally occurring amino acid
MDSGPTKPRYPPRPGAPHPRASSAMAASSAPLAFSASASALSARLRLAAPPAPPSCAATTRRRRPVVVRAKIREIFMPALSSTMTEGKIVSWAAAEGDRVAKGDAVVVVESDKADMDVETFYDGIVAAVLVPAGETAXPVGAPIALLAESEEDVALAVPXAQGCSPRGQPQQQAPAPSDAAAPPPPPAAPVAAAPAPVAGGTKGVATPQAKKLANHHRVDLAQGDPARGQSGRINPGXNFEATRWHPTQKQKVGPHSLLLPPCGLRLPLGKRPVPXAARAFPRVPRGQRVVPVPLEMQGLPVEPKNIGKKTLFKWPEIPGVGFPPIPPPELTPQFPRFIEKGGNPKGRGYDKNLFFAFAKGPAFPMGRLAHKHPLWGXTQHCRDGTRFTFPRSINXAPAVSIDGGLITPVLEQADKLDIYLLSQKWKELVKKARAKQLQPNEYNSGTFTLSNLGMFGVDRFDAILPPGQGAIMAVGASKPTVAADKDGFFSVKSKMMVNVTADHRIVYGADLAAFLQTFAKIIEDPESLTL

SEQ ID NO: 52915 - protein, 174 aa, Schizosaccharomyces pombe 972h-
MPAYHSSFLSLTDVPTTGNIAMLPLKTKFRGPAYPADESQMDIIDECIGLFRANCFFRNFEIKGPADRTLIYGTLFISECLGRVNGLNYRDAERQLNSLALENFSIPGSAGFPLNALYAPPLSPQDAEIMRTYLTQFRQELAYRLLSHVYATEKDHPSKWWTCFSKRRFMNKAL

SEQ ID NO: 52916 - protein, 103 aa, Glycine max
  misc_feature (37)..(37): Xaa can be any naturally occurring amino acid
  misc_feature (57)..(57): Xaa can be any naturally occurring amino acid
MSGRGKGGKGLGKGGAKRHRKVLRDNIQGITKPAIRXLARRGGVKRISGLIYEETRXVLKIFLENVIRDAVTYTEHARRKTVTAMDVVYALKRQGRTLYGFGG

SEQ ID NO: 52917 - protein, 241 aa, Brucella melitensis 16M
MSEQDKKQAAIKAAQAAADAVREAQAALAEEGRLLFKKSWIFIRGVPSMKFLPPEGPVEIAFAGRSNVGKSSLINALVGKKGLARTSNTPGRTQELNYFVPDGYSGENGDLPPLALVDMPGYGFAEAPKAQVDAWTRLVFDYLRGRTTLKRVYVLIDARHGIKKNDAEVLDLLDKAAVSYQIVLTKIDKIKPAGVPRLLEETHKLTYKRAACFPGIIATSSEKGQGLDDLRAAIALLLKEY

SEQ ID NO: 52918 - protein, 353 aa, Arabidopsis thaliana
MANICIATTATNNQVILRDYVSGFPKESDLYIAAATVDLRVPPGSMAVLVKNLYLSCDPHSRTRMGKPDPSSPTSMAHAFTIGKPISGFGVAKAIHSCHPNYKTGDLLWGRVGWEEYCVISPTPSSHFKIHHTDVPLSFYTGILGIPGLTAYVGFYEICSPKKGKTVFVSAASGAVGQLVGQFAKMVGCYVVGSASSKEKVDLPKTKFGYDDAFNYKEEQDLSAALKRCFPKGIDIYFENVGGKMLDAVLQNMRTHGRIAACGMISQYNLKESEVLHNTATIVHKRIRVQGFAAVEFFDRYSKFLDFILPHVREGKITYVEDIAQGLENGPSALIGLFHGKNVGKQLVEVARE

SEQ ID NO: 52919 - protein, 511 aa, Oryza sativa (japonica cultivar-group)
MRTSTDPSGSIESFHGLVHLRTAAPLLAAAVALYMLIEQLSYHRKKGSMPGAPLVVPFLGSAAHLIRDPVGFWDVQAALARKSGAGLAADFLFGRFTVFIRDSELSHRVFANVRADAFHVVSHPFGKKLFGEHNLVYLVGEEHKDLRRRIAPNFTPRALSTYAVIQQRVIISHLRRWLDRSASNGGKAEPIRVPCRDMNLETSQTVFVGPYLTEKARERFDRDYNLFNVGFITLPVDLPGFAFRRARLAGARLMHTLGDCARQSRQRMLGGGEPECLLDYLMQETVREIDEATAAGLPPPPHTSDVEVGALLFGFLFAAQDASTSSLCWAVSALDSHPNVLARVRAEVAALWSPESGEPITAEMMSAMKYTQAVAREVVRYHPPATLVPHIAVEAFQLTAQYTIPKGTMVFPSVYESSFQGFQDADAFDPDRFFSEARREDVVYKRNFLAFGAGPHQCVGQRYALNHLVIFMALFVSLVDFRRERTEGCDVPVYMPTMVPRDGCVVYLKQR

SEQ ID NO: 52920 - protein, 336 aa, Zea mays
MAGVRLVGVRPSPGRLERWVGSLPDAGSRGGRPTLPIRGVRSYFIRSIPPLGRVERGVRKARTSRPAMGGDLYALDFDGVLCDSCGESSLSAIKAAKVRWPSLFEQVDAAMEEWIVEQMYTLRPVVETGYENLLLVRLLVEIQIHSVRKSSVADGLSIQEILENWSKLKPTLMDEWQEDRESLVDLFGRVRDDWIENDFSGWIGANRFYPGTADALKLSSSEAYIVTTKQSRFAEALLKELAGIDFPSERIYGLGTGPKVKVLQQLQQMLQHQGLKLHFIEDRLATLKNVIKEPALDNWNLYLVKWGYNTQKEREETEAIPRIQLIDLPDFSRQLK

SEQ ID NO: 52921 - protein, 228 aa, Pediococcus pentosaceus ATCC 25745
MDQNELKKLVGEEAVKFIEDGMTVGLGTGSTVKFMVDALGERVKNENLNIVGVPTSDRTAEQARSLGINVKSVDEVDHIDLTIDGADEISSDFQGIKGGGAAHLFEKIVATNSKKVMWIVDESKMVDHLGAFPLPLEVIPYGSKQVFKKLEKEGLHPEFRKNDAGEYVLTDSKNYVIDLHLGEIKHPHQLADYLIKQVGIVEQGLFLDMVNTVIVGRQNGPEVLTARP

SEQ ID NO: 52922 - protein, 77 aa, Glycine max
  misc_feature (14)..(14): Xaa can be any naturally occurring amino acid
MASLASLTDVQPSXVKGLALTKISFKTSRQSFRPKNFKNAAVVTNYGDNNAYSHFEDLGSTTGQWDLYGSYAPLPYN

SEQ ID NO: 52923 - protein, 305 aa, Escherichia coli
MSAKVWVLGDAVVDLLPESDGRLLPCPGGAPANVAVGIARLGGTSGFIGRVGDDPFGALMQRTLLTEGVDITYLKQDEWHRTSTVLVDLNDQGERSFTFMVRPSADLFLETTDLPCWRHGEWLHLCSIALSAEPSRTSAFTAMTAIRHAGGFVSFDPNIREDLWQDEHLLRLCLRQALQLADVVKLSEEEWRLISGKTQNDRDICALAKEYEIAMLLVTKGAEGVVVCYRGQVHHFAGMSVNCVDSTGAGDAFVAGLLTGLSSTGLSTDEREMRRIIDLAQRCGALAVTAQRGNDSAAMSTRTGK

SEQ ID NO: 52924 - protein, 226 aa, Pediococcus pentosaceus ATCC 25745
MAKLVLIRHGESTANRDNIYTGWSDVPLTPLGIKQAQRAGKLIAKLGINFDMVHTSMLKRAIVTANIVLDDLNQNWLPINKTWRLNERHYGALRGQNKDETRQIYGKEQVALWRRSFDAVPPLLEHPDDDRRYAVNGILNEPLGESLHMAYNRLLPYWIDQIAPRLMEGQNQLVVAHGSSLRALIKYLENISDQGIDGVEVENGEPIIYELKSDLSIQNKIILKEA

SEQ ID NO: 52925 - protein, 481 aa, Glycine max
MAIEKHEDVESGYLHEPFIQPEDAAAACKENGSDKSVKNGSIGMVLLSTLVAVCGSFTFGTCVGYSAPTQAAIRADLNLSLAEFSMFGSLVTIGAMLGAITSGRITDFIGRKGAMRISTGFCITGWIAVFFSKGSYSLDFGRFFTGYGIGVISYVVPVYIAEIAPKNLRGGLATTNQLLIVTGGSVSFLLGSVINWRELALAGLVPCICLLVGLCFIPESPRWLAKVGREKEFQLALSRLRGKDADISDEAAEILDYIETLQSLPKTKLLDLFQSKYVHSVVIGVGLMACQQSVGINGIGFYTAEIFVAAGLSSGKAGTIAYACIQIPFTLLGAILMDKSGRRPLVMVSAAGTFLGCFVAAFAFFLKDQSLLPEWVPILAFAGVLIYIAAFSIGLGSVPWVIMSEIFPIHLKGTAGSLVVLVAWLGAWVVSYTFNFLMSWSSPGTLFLYAGCSLLTILFVAKLVPETKGKTLEEIQACISS

SEQ ID NO: 52926 - protein, 144 aa, Glycine max
MSHRVSILSSHLSPVMASEKEAALAATPSDSPTIFDKIISKEIPSTVVFEDDKVLAFRDITPQGPVHILLIPKVRDGLTGLSKAEERHIDILGRLLYTAKLVAKQEGLDEGFRIVINDGPQGCQSVYHIHVHLIGGRQMNWPPG

SEQ ID NO: 52927 - protein, 528 aa, Arabidopsis thaliana
  misc_feature (254)..(254): Xaa can be any naturally occurring amino acid
  misc_feature (426)..(426): Xaa can be any naturally occurring amino acid
MAAETASGSNRSISNSPLIENSDSNQILVPEKKSWKNFFSYLGPGFLVSIAYIDPGNFETDLQSGAQYKYELLWIILVASCAALVIQSLAANLGVVTGKHLAEHCRAEYSKVPNFMLWVVAEIAVVACDIPEVIGTAFALNMLFNIPVWIGVLLTGLSTLILLALQQYGIRKLEFLIAFLVFTIALCFFVELHYSKPDPKEVLYGLFVPQLKGNGATGLAISLLGAMVMPHNLFLHSALVLSRKIPRSVTGIKXACRYYLIESGLALMVAFLINVSVISVSGAVCNASDLSPEDRASCQDLDLNKASFLLRNVVGKWSSKLFAIALLASGQSSTITGTYAGQYVMQGFLDLRLEPWLRNFLTRCLAIIPSLIVALIGGSAGAGKLIIIASMILSFELPFALVPLLKFTSSKTKMGSHANSLVISSXVTWIIGGLIMGINIYYLVSSFIKLLLHSHMNLVAIVFLGVLGFSGIATYLAAISYLVLRKNRESSSTHFLDFSNSQTEETLPREDIANMQLPNRVAVIGDLN

SEQ ID NO: 52928 - protein, 505 aa, Arabidopsis thaliana
MASLARRKAYFLTRNLSNSPTDALRFSFSLSRGFASSGSDENDVVIIGGGPGGYVAAIKASQLGLKTTCIEKRGALGGTCLNVGCIPSKALLHSSHMYHEAKHSFANHGIKVSSVEVDLPAMLAQKDNAVKNLTRGIEGLFKKNKVTYVKGYGKFISPNEVSVETIDGGNTIVKGKHIIVATGSDVKSLPGITIDEKKIVSSTGALSLSEVPKKLIVIGAGYIGLEMGSVWGRLGSEVTVVEFAGDIVPSMDGEIRKQFQRSLEKQKMKFMLKTKVVSVDSSSDGVKLTVEPAEGGEQSILEADVVLVSAGRTPFTSGLDLEKIGVETDKAGRILVNDRFLSNVPGVYAIGDVIPGPMLAHKAEEDGVACVEFIAGKHGHVDYDKVPGVVYTHPEVASVGKTEEQLKKEGVSYRVGKFPFMANSRAKAIDNAEGLVKILADKETDKILGVHIMAPNAGELIHEAVLAINYDASSEDIARVCHAHPTMSEALKEAAMATYDKPIHI

SEQ ID NO: 52929 - protein, 298 aa, Prochlorococcus marinus str. MIT 9515
MNSGKILIVSSTHGNEINPVWSVNQYSKQGNIIDKNIEYKFIIGNPLAYEKGCRYIDKDLNRSFNLIKNNHDTSIYEIRRANFLVEKFGVNGSEPCDIAIDLHTTTANMGTSIVMYGRREKDFCLAALLQHKFGLPIYLHEKDEKQTGFLVEAWPCGLVIEIGPVAQNFYDPKIINRFLIIISSLREEINKLKNKQKQLPKLVIVHVHQGSIDYPRGEDGNINALIHPKRMNQDWKPIKKGDPLFMDMEGCTKSYNGKNTLWPVFIGEVAYKEKNIAMSYTKKEVINLPTQICEDFFN

SEQ ID NO: 52930 - protein, 341 aa, Schizosaccharomyces pombe 972h-
MVLQAIGKHALGVVLLLFVVFLWLISSFLTSSLLDDDNFFSPFLITYINTGTFVFYLIPWYFSEKKTRKHRLMSELSMYESVHDSSFNLGTRPNSPLGFRQTAYLSLGFCIIWFAANYFSNSSLGFTNVASFTIISSMSGFFTLGLGTIVNVERFTLSKLLALMASVGGVIIVVTQDAKQADLNDSPPSRPALGNAYALLAALLYGCYSVMVKFHITEESCVSTRLFFGLVGLFDLILLWPFLIILHLYGVERFSLPSTTAGLIVLIINASITFVSDYLWVIAMLMTSPLLVTVGMSLSIPLALFFDILLKGHYLNFSLILGSLLVFAGFIVVNYNQQNII

SEQ ID NO: 52931 - protein, 337 aa, Streptococcus pyogenes M1 GAS
MKRIAVLTSGGDAPGMNAAIRAVVRKAISEGMEVYGINRGYAGMVDGDIFPLGSKEVGDKISRGGTFLYSARYPEFAQLEGQLAGIEQLKKHGIEGVVVIGGDGSYHGAMRLTEHGFPAVGIPGTIDNDIAGTDYTIGFDTAVNTAVEAIDKLRDTSSSHGRTFVVEVMGRNAGDIALWAGIASGADQIIVPEEEFDIEKVASTIQYDFEHKGKNHHIIVLAEGVMSGEAFAQKLKEAGDKSDLRVTNLGHILRGGSPTARDRVIASWMGSHAVELLKDGKGGLAVGIHNEELVESPILGTAEEGALFSLTEEGKIIVNNPHKARLDFAALNRSLSQ

SEQ ID NO: 52932 - protein, 268 aa, Arabidopsis thaliana
MSSDSSREENVYLAKLAEQAERYEEMVEFMEKVAKTVETEELTVEERNLLSVAYKNVIGARRASWRIISSIELKEDSRGNSDHVSIIKDYRGKIETELSKICDGILNLLEAHLIPAASLAESKVFYLKMKGDYHRYLAEFKTGAERKEAAESTLVAYKSAQDIALADLAPTHPIRLGLALNSSVFYYEILNSSDRACSLAKQAFDEAISELDTLGEESYKDSTLIMQLLRDNLTLWTSDLNDEAGDDIKEAPKEVQKVDEQAQPPPSQ

SEQ ID NO: 52933 - protein, 226 aa, Xylella fastidiosa Temecula1
MMVSAPLSFMPEAVIFDMDGLMLDSERVSIECRCRAAFDLEHQIEPDYWLQMVGVSDIACHVQLSARIGAVSATALLARSDALYEAVVMKGVPHRPGIVTLLEWLFARGIPCAVGTSTRRPLALRKLNTAGLLSRFDVVCTASEVAQAKPAPDIYLLAAHTLGIVPRRCLVVEDSPIGVRAALAAGMTPIQVPDLLMPDAQVSALGHRIVASLTEVQSLLEACFDV

SEQ ID NO: 52934 - protein, 204 aa, Triticum aestivum
  misc_feature (59)..(59): Xaa can be any naturally occurring amino acid
MSGGNPAGVDNTFRRKFDKEEYLERARQRERDEKDEARRGKDRGPPVQRQPLKHRDYEXVDLEARLGTTPAVTPIAPLSQQAGYYCSVCECVVKDSANYLDHINGKKHQRALGMSMRVERASLEQVQKRFEALKKRKDPASFSEQDLDERIWKQQQEEDEKKRQRREKKKEKKKEPAGQNEPEDIDPDVAAMMGFGGFGTSSKK

SEQ ID NO: 52935 - protein, 888 aa, Buchnera aphidicola str. Sg (Schizaphis graminum)
MSEKLYNYDVDPVETNDWVQSIESVIREEGLERAKFLIEKILKKSKITRANFFKCFFTSDYINTISSEEEVEYPGDLILEKRIRSAIRWNAIMMVLRASKKDLELGGHLSSFQSSATIYEVCFNHFFRSKNDEDGGDLVYFQGHIAPGIYARSFLEGRLSKKQIDNFRQEVDGKGLSSYPHPKLMPNFWQFPTVSMGLGPLCAIYQAKFLKYLQNRELKNTSKQTVYAFLGDGEMDEPESKGAISIAVREKLDNLIFVINCNLQRLDGPVVGNGKIVNELESFFYGAGWKVIKVIWGGKWDSLLKKDKTGKLIQLMNETIDGEYQTLKSKDGAYVRKYFFGKYQETLELVKNMTDEEIWNLNRGGHDPKKMFNALKKAKEIKDKPTVILAHTVKGYGMGVIAEGKNIAHQIKKININGIIYIRDRFNIPISNEDIKELPYVVFEKNSKEYCYMHQQRKKLGGYIPFRLSKFTNALNIPDLIDFKSLLKEQNKKMSTTIAFVRVLNLILKNHSIKNLIVPIIADEARTFGMEGLFRMIGIYSSIGQKYVPQDREQLAYYKEEKKGQILQEGINELGAASSWLAAATSYSTNDFPMIPFYIYYSIFGFQRIGDLFWAAGDQQARGFLIGGTSGRTTLNGEGLQHEDGHSHIQSLTIPNCVSYDPAFAYEVAVIIQDGLRRMYGPLQENIYYYITTINENYYMPAMPQGVEKGICKGIYKLKTFYATELKVQLMGSGAILRCICKAGEILSNDYCITTDIYSVTSFTELARNGEDCERWNMLHPYEKKRIAYIKTVMNSSPAVAATDYMKLFAEQIRHYIPSNEYHVLGTDGFGRSDSRDKLRDHFEVSAYYIVVAALNLLAKLNNINKKVVEEAIIKFNINADKINPRLA

SEQ ID NO: 52936 - protein, 361 aa, Escherichia coli K12
MMKTMRIAAIPGDGIGKEVLPEGIRVLQAAAERWGFALSFEQMEWASCEYYSHHGKMMPDDWHEQLSRFDAIYFGAVGWPDTVPDHISLWGSLLKFRREFDQYVNLRPVRLFPGVPCPLAGKQPGDIDFYVVRENTEGEYSSLGGRVNEGTEHEVVIQESVFTRRGVDRILRYAFELAQSRPRKTLTSATKSNGLAISMPYWDERVEAMAENYPEIRWDKQHIDILCARFVMQPERFDVVVASNLFGDILSDLGPACTGTIGIAPSANLNPERTFPSLFEPVHGSAPDIYGKNIANPIATIWAGAMMLDFLGNGDERFQQAHNGILAAIEEVIAHGPKTPDMKGNATTPQVADAICKIILR

SEQ ID NO: 52937 - protein, 476 aa, Buchnera aphidicola str. Sg (Schizaphis graminum)
MHQEIQSEVVIIGSGPAGYSAAFRCADLGLETVLIEHQERLGGVCLNVGCIPSKSLLHIAKIIKDASELSESGVFFNKPIIDIKKINNWKEKIIKKLTTGLSNMGEKRKVRIVQGKALFNTDHSVLVKNKKNDFTIFFKHAIIATGSKPIKIPSLPNEDNRIWNSTDALSLKSIPNRFLIIGGGIIGLEMATIYSALGSKVDIVDRFNAFLPSVDKDITDIYIKSIKKRFKLLLNTHVKSVEKSKDNDLIVKIAEENSDENVCCYDNILVAIGRSPNVDFLGLEKIGLKLNESGFIEINQQLKTNISHIYAIGDVTGFPMLAHKAVQQAHIAAEVISGKKHYFEPKVIPSVAYTDPEIAWVGLSEKEAENNDIDYEVSLFPWSASGRAHASNCTLGMTKLIFNKNTNKIIGGSIIGTNASELISEIGLAIEMGSDAEDISLTIHPHPTLSESISLASEVFQGTITDLLNLKKSLLN

SEQ ID NO: 52938 - protein, 136 aa, Zea mays
MARTKQTARKSTGGKAPRKQLATKAARKSAPTTGGVKKPHRYRPGTVALREIRKYQKSTDLLIRKLPFQRLVREIAQDFKTDLRFQSHAVLALQEAAEAYLVGLFEDTNLCAIHAKRVTIMPKDIQLARRIRGERA

SEQ ID NO: 52939 - protein, 286 aa, Buchnera aphidicola str. Sg (Schizaphis graminum)
MINEKIWHEKLHRHVGQYFSIDKILYQKKNKYHDIIIFQNSIMGRIMAIDGVVQTTEKDEFIYHEMLTHVPIFYHGLIKNVLIVGGGDGGILREICRHKSIENITMVEIDLNIIDLCKQFFPKHNNNAYKDPRLKIVIDNGLNFVQKTKEKFDLIISDSTDPIGCGKDLFLSDFYFHCKNCLVKNGIFVGQNGVFFLQKNDINQSYKNLKKNFHDVSFYQATIPSYYGGTMMFSWGTDNIDFRQINIKNLEKRIKDKKLTFNYYNSNIHISSFYLPQYIINTLDKS

SEQ ID NO: 52940 - protein, 524 aa, Oryza sativa (japonica cultivar-group)
  misc_feature (18)..(18): Xaa can be any naturally occurring amino acid
MVGAPLAVAAAAAAPGAXVFLARPLLRRSPRGVACAFRRRPPSTSVDEMAPCERLEIRNKIQNEEVVVEDDIGGGGEDDDDALEALFKQLEEDLKNDDLSVEDDDDGISEEDMARFEQELAEAIGDIADADESGEGSSLGSEAYGNDEKTDEIKRPELKNWQLKRLARALKIGRRKTSIKNLAGELGLDRTLVIELLRNPPPKLLFMSDSLPDEDPSKPEIKEIEPSPVVDNADVTETKPQTELPVHVMCAEWSSQKRLKKVQLETLERVYSRTKRPTNTMISSIVQVTSLPRKTIVKWFEDRREQDGVTFSTLLDQTHALPYFNRNRVAIFNMEKFRSSSEGNYVETGEGGSIWGPARLQHRDSERGVVVLVVQMMAGLQRSATTFRRSGSSGLVWDERFLTEDAEAAKAGDGDGGGGTEEPQPELRHSKSVGSIGMMRRVAADDGDDSEKTTKQQRKKKKKKKKDGQKEDDNRSQQVFRTKDIAPDVDPPSPRVSGCILCSIFSGSGSSSSATSRRAKPRKK

SEQ ID NO: 52941 - protein, 374 aa, Arabidopsis thaliana
MSRILMDLNVRMESLNPFSYIQMVHRVKPTREKFGSTQTRGQRHEKEEDSRLINGFSDARGAWTIPCWGIKYLFSETPNMKMLGLLQVTMLRLVFQYWSISGTTGFPVLVTRICVLVPTFFCTKLFTWENLIHLVGCLTDIFNSFLQGFASGLMLSISFLDLAHNAINSIGFFKANLWKNGDEGGKDMMKKHRKQVLYSGLITAIGISLHNFPEGMAVFLGSIKGMRVGVNLALAIALHNIPEGVAVALPIYFATESKWQAFKLATLSGLAEPLGVIIVAYLFPRSLSPEILEGLLGAVGGIMAFLTLHEMLPLAFDYAGQKQAVKAVFFGMACMSASLYFLELSLPETMSLRPCDLWTKNPFAKNKKILSILF

SEQ ID NO: 52942 - protein, 561 aa, Escherichia coli K12
MKKVWLNRYPADVPTEINPDRYQSLVDMFEQSVARYADQPAFVNMGEVMTFRKLEERSRAFAAYLQQGLGLKKGDRVALMMPNLLQYPVALFGILRAGMIVVNVNPLYTPRELEHQLNDSGASAIVIVSNFAHTLEKVVDKTAVQHVILTRMGDQLSTAKGTVVNFVVKYIKRLVPKYHLPDAISFRSALHNGYRMQYVKPELVPEDLAFLQYTGGTTGVAKGAMLTHRNMLANLEQVNATYGPLLHPGKELVVTALPLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDDNEVPPGQPGELCVKGPQVMLGYWQRPDATDEIIKNGWLHTGDIAVMDEEGFLRIVDRKKDMILVSGFNVYPNEIEDVVMQHPGVQEVAAVGVPSGSSGEAVKIFVVKKDPSLTEESLVTFCRRQLTGYKVPKLVEFRDELPKSNVGKILRRELRDEARGKVDNKA

SEQ ID NO: 52943 - protein, 1735 aa, Neurospora crassa
MPLKKSYSDAYAQPPKRGGWQRTRSNPPNKGPLQSLAPVSESSKNKLQAFRSDDTSSKPPPKSARPVKAAIDELQKENINTTKSIPRKRPLPDSNDDEPSSDAKTPADRHSWKDLFGVPEVITEEEDGEKSPGDRVDWRSGVPLQLPASPMIPKNGRRRAKSSSPASSPATKLTTPHVALKRFAGASKTPHADPASDLWSRFSSNGNDTSPSNHKNPLFAQLMASSSPRPQSSDRSLRKSVSCGSAWPKRRRTLCPEEQNRIVSQDTPRKKKSSLLSELLQSVDGEIDSSKTPSNAPAQQKKSPSPMKKSPSKRKITPQTVPDQNSSPSRKKAERQTTETDASKQPEKASSDYGDDDFDFDESTLLELDASILGQGDGSTLIASDAVSPAPRESSKTLVDNDEFGDLDDDIFDGVEDLVAQVESATQKPAQRLSPRKRPSPKKRLSPRKRQSPKKLPQQVAGDEDDEFGDDFGNDFDFDAVEMAATQRASHAQDVSSHPSQKPRAIQRYLVTNVLESSYTDDRGRESPEKVESPFRQYILIVQADRTNSVRTIHLRGDWFDTPASVSAYVHIIGQFEDQGKCVLDNNQNMLILHPDQLISSTVVADSFSCMRRAVLQDRVKATSDLTPALVYGTILHEIFQEALVANKWDPAFLTNVINKTLEKHLEDLYILKVSMDDAKSHVQSKMPELRSWAQLFVTSQPKPDAIVQGRNGDKATMCVSKLLDVEEHVWSPMYGLKGNIDATVQVTMRDPPARGSSSKAPTTKTLTVPFEVKTGKNVNSNHQAQTALYNLLLSDRYDIEIVYGILYYMETSQTLRIPAVRHEIRHMIMQRNQLACYIRERSVQLPPMKKNKNACGRCYAQTTCFIYHKLADDGDGETSAMNEKFDEVVHHLSPTHKAFFLKWEELLTKEEKESQKLRRELWTMISTEREKVGRCFANVIIEEGSAYENHQQMGKTNRFAYTFIKEKPAPGFSFLDSQLTVGEPIVISDEQGHFALALGYVTSVRKTRIAVAVDRRLHNARVRQPGFDEADNQTFASIMQVPGSGGNAPEDREAGPVRYRLDKDEFSNGMATVRNNLVQIMADGVLGSRQIRSLVVDLEAPRFKAVPTQYILPSTASGQGLNVDQKAAVEKVMSAQDYALVLGMPGTGKTTTIAHIIRALVAQKKTVLLTSYTHTAVDNILLKLKDDGIPILRLGPPVKVHPEVPSFATLAGVPKTSFSEIHEAWNDTPIVATTCLGINHPVFAERIFDYCIVDEASQITLPICLGPIRMARKFVLVGDHNQLPPLVQNEEARLGGLDVSLFKLLSEKHPQSVVNLEHQYRMCEDIMTLSNTLIYNGRLKCGTEALRTTSLEIPDMDALATKHFDADSFLAHSQQHPLKEGDKLSFCPSPTPTTCWLRDLLDPSARVRFINTDSLLPHSREEKSTRGQRIVNPLESRIVCQLVDSLLTVGVPASEIGVMTHYRSQLALLKHNMKNTLGGSAGAIRAGVKVAAEEIEMHTADRFQGRDKSVVVLSLVRSNEGCSIGELLKDWRRINVAFTRAKTKLLVVGSRETLRGASSSVAGSPTAIASPELGETGDDQGEGQGEPEGGEMLARFVRMMEDRNWVYELRPGALEGHRFADANAASTAADALSPRKPNPIFKPVSPRKGSALSPSKRANAKLAGKGYKVQSKLQFGTPSQGKENVGSQSLKSPKKGIVGRGKHNPKRIGISERAIMKGRPIMRDIMNEITDGRF

SEQ ID NO: 52944 - protein, 416 aa, Photobacterium sp. SKA34
MDYFNYQQNNQLWAENVPLAQLAEQYGTPLYVYSRATLERHWKAFDEAVATHPHLICYAVKANSNLGVLNVLARLGSGFDIVSQGELERVIAAGGDPAKVVFSGVGKTAAEMKRALELGIKCFNVESEPELERLNAVAEELGVTAPISLRINPDVDAKTHPYISTGLRDNKFGIVFDRAVEVYRLAHSLPHLQVVGMDCHIGSQLTDITPFIDATDRLLALVDELKAEGIHIQHLDLGGGLGVTYNDEQPPQPSDYASALLARLENYPDLELIFEPGRAIAANAGVLLTKVEFLKHTEHKNFAIVDAAMNDLIRPTLYSAWQDIVPVSPRQGEAHVYDLVGPICETGDFIGKDRSLCLAQGDLLAVRSAGAYGFVMASNYNTRARAAEIMVDGEQAHVVRERETLTQLWQLEQIIQ

SEQ ID NO: 52945 - protein, 328 aa, Ammopiptanthus mongolicus
MAPDITTAAANATVEQPKAGGGRGRAFVTFLAGNGDYVKGVVGLAKGLRKVKSVHPLVVAVLPDVPEEHRKILNSQGCIVREIEPVYPPENQTQYAMAYYVINYSKLRIWEFVEYSKMIYLDGDIQVFENIDHLFDLPDNYFYAVMDCFCEKSWTHTPQYQIGYCQQCPDKVEWPSNFGPKPPLYFNAGMFVYEPNLVTYRDLLEALQVTKPTSFAEQDFLNIFFREKYKPIPNVYNLVLAMLWRHPENVELDKVQVVHYCAAGSKPWRYTGKEENMEREDIKMLVKKWWDIYEDETLDYDNPLNVERFTAALLKAGGVKFVPAPSAA

SEQ ID NO: 52946 - protein, 431 aa, Escherichia coli O157:H7 EDL933
MVSLEKNDHLMLARQLPLKSVALILAGGRGTRLKDLTNKRAKPAVHFGGKFRIIDFALSNCINSGIRRMGVITQYQSHTLVQHIQRGWSFFNEEMNEFVDLLPAQQRMKGENWYRGTADAVTQNLDIIRRYKAEYVVILAGDHIYKQDYSRMLIDHVEKGARCTVACMPVPIEEASAFGVMAVDENDKIIEFVEKPANPPSMPNDPSKSLASMGIYVFDADYLYELLEEDDRDENSSHDFGKDLIPKITEAGLAYAHPFPLSCVQSDPDAEPYWRDVGTLEAYWKANLDLASVVPELDMYDRNWPIRTYNESLPPAKFVQDRSGSHGMTLNSLVSGGCVISGSVVVQSVLFSRVRVNSFCNIDSAVLLPEVWVGRSCRLRRCVIDRACVIPEGMVIGENAEEDARRFYRSEEGIVLVTREMLRKLGHKQER

SEQ ID NO: 52947 - protein, 392 aa, Glycine max
RLREDNSRGHSLFKTVVFSLRQNQPNPSPILKPTMSSFKSKYQDELIANAAYIGTPGKGILAADESTGTIGKRLASINVENVEANRRALRELLFTTPGAFECLSGVILFEETLYQKTASGKPFVELMKEGGVLPGIKVDKGTVELAGTNGETTTQGLDGLGARCQKYYEAGARFAKWRAVLKIGPNEPSELAIHENAYGLARYAVICQENGLVPIVEPEILVDGPHDINKCAEVTERVLAACYKALNDHHVLLEGTLLKPNMVTPGSESKKVTPEVIAQYTVTALQRTVPAAVPAIVFLSGGQSEEEATLNLNAMNKSQGKKPWSLSFSFGRALQQSTLKAWGGKDENIKKAQDALFARCNANSHATLGTYKGDATLAEGASESLHVKDYKY

SEQ ID NO: 52948 - protein, 264 aa, Prochlorococcus marinus str. MIT 9515
MRIRSLLAFVISLCLTFAFVPDKTYAFSERGNAQFTDVVNTGKANDCPSLDSSLIGSISLGNGDSLKGICMHPTEVYVKVPGSKRKEAEFVATKIISPRNNTTVTEVYGDIDSGTFTEKGGIDFQLITVLTPGGLEVPFAFSAKDLTADIPSSIEPGTEVSGATFTPNYRTGDFLDPKARAKNTGVEYAQGLVALGGDDEELAKENIKVDVNGTGVVTLSIENVDSDTDEFAGTFVAIQPSDTDMGSKEPLDVKIIGELYGRKA

SEQ ID NO: 52949 - protein, 109 aa, Brassica napus
HNEGGEEGTKKYRSRTFVPTGQEMDAMRKNKPVYANKIDGVSVSSLSSNASSPKSSSVTSDPVRSEAVKSSLLVDASDSLDTMYDMTLIDIDISSFPSNVPSANESGPR

SEQ ID NO: 52950 - protein, 119 aa, Rhodobacter sphaeroides 2.4.1
MAFDPASLTFDANGLIPAVAQDHATGEVLMMAWMNAEAVARTVETGCVTYWSRSRQAFWVKGETSGHVQRLIELRIDCDRDCLLLLIEQEGPACHTNRRSCFYTALREGEERIILDPMV

SEQ ID NO: 52951 - protein, 399 aa, Triticum aestivum
  misc_feature (254)..(254): Xaa can be any naturally occurring amino acid
  misc_feature (265)..(265): Xaa can be any naturally occurring amino acid
  misc_feature (274)..(274): Xaa can be any naturally occurring amino acid
  misc_feature (361)..(361): Xaa can be any naturally occurring amino acid
MAGSEQRVVAVIMVGGPTKGTRFRPLSLNVPKPLFPLAGQPMVHHHISACRRIPNLAQIYLIGFYEEREFALYVSSISNELRIPVRYLREDKPRGSAGGLYSFRDYIMEDTPAHIVLLNCDVCSSFPLPDMLEAHKKYGGMGTLLVNKVSAESANQFGELVADPETNELLHYTEKPETFVSDLINCGVYIFTPKILLAIEDVLKQKKDRANLRRVSSFEALQSATKAIPADYVRLDQDILSPLAGKKELYTYQXTLDFWEQIKTXPGMSLRCSXGLYLSQFRHTSPHLLASGDGKKGATIVGDVYIHPSAKVHLTAKIGPNVSISANARIGAGARLISCIILDDVEIMENAGEGDHIAKLXGSPILGEAVDVEDEVVVTNSIVLPNKTLNASVQDEIIL

SEQ ID NO: 52952 - protein, 178 aa, Glycine max
MASSMISSPAVTTVNRAGAGMVAPFTGLKSMAGFPTRKTNNDITSIASNGGRVQCMQVWPPIGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 52953 - protein, 393 aa, Nicotiana tabacum
MTAPTTRKDLMIVNMGPQHPSMHGVLRLIVTLDGEDVVDCEPILGYLHRGMEKIAENRTIIQYLPYVTRWDYLATMFTEAITINGPEQLGNIQVPKRASYIRVIMLELSRIASHLLWLGPFMADIGAQTPFFYIFRERELIYDLFEAATGMRMMHNYFRIGGVAADLPYGWIDKCLDFCDYFLTGVAEYQKLITRNPIFLERVEGVGIIGGDEALNWGLSGPMLRASGIEWDLRKVDHYESYDEFDWQVQWQREGDSLARYLVRIGEMTESIKIIQQALEGIPGGPYENLEIRRFDRLKDPEWNDFEYRFISKKPSPTFELSKQELYVRVEAPKGELGIFLIGDQSVFPWRWKIRPPGFINLQILPQLVKRMKLADIMTILGSIDIIMGEVDR

SEQ ID NO: 52954 - protein, 595 aa, Acinetobacter sp. ADP1
MAETDIAMPESTPVDSRPAFAIVEELKTKFGENFYVQTTCEEFPTVWVERSRVQEVLMFLRKVDRPYVMLFDLSAMDERLRVHRDGLPASDFTVFYHLLSLERNSDIRIKVALNESDLNIPTATNIWPNANWYEREAYDMFGINFEGHPMLRRILLPTYWEGHPLRKEYSARATEYTPYMQNQAKQDFEQEHLRFVPEDWGLKRGNADEDFMFLNLGPNHPSAHGAFRVVLQLDGEEVKDCVPDIGYHHRGVEKMAERQTWHSFIPYTDRVDYLGGCAQNMPYVMAVEQLAGIKVPERAQVIRVMLNELFRINNHLLFCGTAIQDAGGMTPVFYMFADRQKVYDIVEAITGYRMHPAWFRIGGTAHDLPNNWHKLVKELLEWMPKRLNEYHTAALKNSVFIGRTRNVAQYDAKSALAWGVTGTGLRATGIDFDVRKYRPYSGYENFDFDVPLEYEGDAYARVMVHFREITESLKIIQQCLDNMPSGPYKADHPLAVPPPKDKTLQDIETLITHFLSVSWGPVMPAGEASFMTEVVKGASTYYLTSDKSTMSYRTRIRTPTFTHLQQMPSVINGSLVSDLIIYLATIDVVMADVDR

SEQ ID NO: 52955 - protein, 180 aa, Acinetobacter sp. ADP1
MYKVLAGVGSIVRTLWMVFTHITRKRDTILYPEVPAEEIVPPRYRGRIVLTRDPDGEERCVACNLCAVACPVGCISLQKAEKEDGRWYPEFFRINFSRCIFCGMCEEACPTTAIQMTPDFELGEYVRQDLVYEKENLLISGPGKYPDYNFYRVAGMAIDGKEKGQAQKESAPIDVRSLLP

SEQ ID NO: 52956 - protein, 549 aa, Zea mays
LGCAAPAAVHAVHGAGGALRPPSPAPRRPQPAAVGLLLVARHAAPGCATARWPSVPRGEVAAPGIRWAPAATQQQQQHGGRGDDVLRRSLGLQRHRSVLHQPPPGSGLSLDSAGGAEAAAAAAAAAESHLWNQVLMGAGGEVGRSMQAVHDAHDDSENFLDLLNSRALAPELFAEPPACDYLKKMEYGGGSGGWPDHHQFTTSALEKHLGSGYGAPERLTANLSDLVSNWSIAPPSPCLGDARHHRVAVAGAGACDNNNAAVAALGLGGKAAAGLFLDSGGVGVCNSKHEIGGHGAMLEEAAAASGGSGQELLRPAGYSSMLGLSSSSRMYMDVPWGNNASRSLSDLISFGGTPLGKPEQPTPAATSTKAQAAEYKKQGREISSPPKTSSEGGSKGSSDGKKKKRSDGRQGSEANAKKSKNEASSPTSSSLKASQLPKVKLGDKITALQQIVSPFGKTDTASVLYEAINYIKWLHEQVQLLSDPYMKTSSSSKDYNAWGGLDWKDKSETEMDLQSRGLCLVPVSCTPQVYRDNNGPDYWTPPYRSCLYR

SEQ ID NO: 52957 - protein, 657 aa, Escherichia coli O157:H7 EDL933
  misc_feature (330)..(330): Xaa can be any naturally occurring amino acid
MTQLAIGKPAPLGAHYDGQGVNFTLFSAHAERVELCVFDANGQEHRYDLPGHSGDIWHGYLPDARPGLRYGYRVHGPWQPAEGHRFNPAKLLIDPCARQIDGEFKDNPLLHAGHNEPDYRDNAAIAPKCVVVVDHYDWEDDAPPRTPWGSTIIYEAHVKGLTYLHPEIPVEIRGTYKALGHPVMINYLKQLGITALELLPVAQFASEPRLQRMGLSNYWGYNPVAMFALHPAYACSPETALHEFRDAIKALHKAGIEVILDIVLNHSAELDLDGPLFSLRGIDNRSYYWIREDGDYHNWTGCGNTLNLSHPAVVDYASACLRYWVETCHXDGFRFDLAAVMGRTPEFRQDAPLFTAIQNCPVLSQVKLIAEPWDIAPGGYQVGNFPPLFAEWNDHFRDAARRFWLHYDLPLGAFAGRFAASSDVFKRNGRLPSAAINLVTAHDGFTLRDCVCFNHKHNEANGEENRDGTNNNYSNNHGKEGVGGTLDLVERRRDSIHALLTTLLLSQGTPMLLAGDEHGHSQHGNNNAYCQDNQLTWLDWSQASSGLTAFTAALIHLRKRIPALVENRWWEEGDGNVRWLNRYAQPLSTDEWQNGPKQLQILLSDRFLIAINATLEVTEIVLPAGEWHAIPPFAGEDNPVITAVWQGPAHGLCVFQR

SEQ ID NO: 52958 - protein, 359 aa, Arabidopsis thaliana
MTMMSDISQDLLEEILSRVPITSLRAVKSTCKRWKDLLNDPSFSKKYGGKRDNEFLAIMTSGSRASLMSVNLHGPRDNKDLEDPFIKQIGELNQDQIFKVFHCDGLLLCITNEDNTRLVVWNPYLAQTRCIQPIDKFYIYDWYCLGYDKDKNHKILVVYSPMFGRIEYEIYSFLSKSWIVLSFPTDWQISRDECLSLKGNTYFIAYKKMEVEEVGFQEFLLCFDFTNERFGPLLPLPFQCYNQTSLVLSTVQEEQLAVLCKRCDAYETKIWITTKIEPNAVSWSYFLKFDFKVDISGGSFFVDVEEKVAVLFCINREKEKGINNKTYMIGEDGYYKEVDLGESNWCPSMCSYVPSCVQV

SEQ ID NO: 52959 - protein, 359 aa, Pisum sativum
MSHFKSKYHDELIANAAYIGTPGKGILAADESTGTIGKRLSSINVENVESNRQALRELLFTASWLFLQYLSGVILFEETLYQKTAAGKPFVDVLNEAGVLPGIKVDKGTVELAGTDGETTTQGLDGLGARCRKYYEAGARFAKWRAVLKIGANEPSEHSIHENAYGLARYAVICQENGLVPIVEPEILVDGSHDILKCAAITERVLAATYKALSDHHVILEGTLLKPNMVTPGSDAPKVAPEVIAEHTVRALQRTVPAAVPAVVFLSGGQSEEEASVNLNAINQIKGKKPWTLSFSFGRALQQSTLKAWGGKTENVKAAQDALLTRAKANSEATLGTYKGASNLGAGASESLHVKDYKY

SEQ ID NO: 52960 - protein, 323 aa, Oryza sativa (japonica cultivar-group)
MEVESRYVAVRHHVEGLPSEDDFEVKAARVRWWPESGEVLVRNLYLSVDPYQLNRMKRRSASHLAVDGIVPGERIDAYGAGEVVASACEEYKEGDVVAGVLGWEDYTLFRPSPACSWTSGMTAYAGLYEVGRPEAGEKVFVSAASGSVGSLVGQFAKLAGCYVVGCAGTNAKVDLLKNKLGFDDAFNYKDEPDMKSALKRYFPDGIDIYFDNVGGETLEAALANMNTYGRVALCGVISEYTDAGHRAVPDLLEVIYKRITIRGFFAWDFLTRFAEFTGVISDWIRQGKVQVIEDISDGLESVPSAFAALFSGDNIGKKMVKLA

SEQ ID NO: 52961 - protein, 543 aa, Rhodopirellula baltica SH 1
MVLTFMTATRRRPVVLIVRDGWGQNPDPKWNESNAVHLANTPVDDKLTQEYPSVLIHTSGEDVGLPAGVMGNSEVGHQNIGAGRIVDQEVMRITRAIRDDSFFSNPVVTGAIDHVKKSGGRLHLLGLMSDGRVHSDLQHGIAVIDLAKRNGLTGDQLAIHAITDGRDTSPRGGLKFVSQLTDHCEASGVGVVASVIGRFYAMDRDLRWERVEAAYNLMTQGTGQTFPSASAAIESYYANPTESSRDGDEFITASSIVPEGGSPITVQPGDAVLFMNYRGDRTREITKAFTFDDAAWKDIPGGGFDRGKKIDNLYFATMTGYETGLPVKVIFEKPAKMPNILGEYVASKGLHQFRCAETEKYPHVTFFFNDYRDNPFEEEEWGMAPSPRDVSTYDQKPEMSAEDITEKVLKQIKSGKCDMIIVNYANGDMVGHTGVLEAAIKAVEKVDACVGRVVDATLAAGGSLVVTADHGNCEQMIDPETGGPHTAHTTYQVPLIVVDPEFVGKPLREGGRLADIAPTVLALMGLEVPPEMTGRPLMETQTA

SEQ ID NO: 52962 - protein, 331 aa, Cucumis sativus
MSPAAAPESAIESTDAPKRAYVTFLAGNGDYWKGVVGLAKGLRKVKAAYPLIVAVLPDVPEDHRQILEYQGCIVREIEPVYPPANQTQFAMAYYVINYSKLRIWEFVEYEKLIYLDGDIQVFENIDHLFEMPSGYFYAVMDCFCEKTWSNSPQYKIGYCQQCPDKVKWPVEEMGNPPPLYFNAGFFVYEPDLFTYKDLLETCKATTPTLFAEQDFLNMYFNDIYKPIPPIYNLVMAMLWRHPENIDVDKVKVVHYCAAGSKPWRYTGKEENMEREDIKMLVKKWWEVYEDESLDYQNVLKSETKQETNLTPLISVLSEAEVVNHITAPSAA

SEQ ID NO: 52963 - protein, 524 aa, Rhizobium leguminosarum bv. viciae 3841
MSTFGAYFRLWRVGWVLVREGVVSALPSEGLPPPVALAKSFVTIFERSKARHQKRSDRLAQAVERLGPSYVKIGQFLATRPDVVGVEFANDLSQLQDRMAFFPSAAAKANIEGSLGRPISELYASFGDPIAAASIAQVHPAEVESAEGRKKVAVKIVRPGVRQRFAHDIEAMYLVAHMQERFLPSSRRLRPVEVTKTLEQTTKVEMDLRLEAAALSEIAENTERDPGFRVPKVDWERTGRDVITMEWIDGTRMSDVEGLRAAGHDLNLLADTLIQSFLRHTLRDGFFHADMHPGNLFVDADGMIVAVDMGIVGRLGKKERRFLAEILYGFITRDYIRVAEVHFEAGYVPGHHNVESFAQAIRAIGEPIHGQPAETISMGKLLTLLFEVTELFDMETRPELVMLQKTMVVVEGVSRMLNPRFNMWKASEPVVGDWIRTNLGPKRIATDLKDGLKAAVKLAEAVPEIAAKTEKFHHQLLHMSEHGLRFDAETAEAIGKAEARHNRSAKIALWIIALTLVYIAWVLS

SEQ ID NO: 52964 - protein, 554 aa, Pseudomonas syringae pv. syringae B728a
MAYYRTPSDVTALPAWQALNKHRQAMQNFSMREAFNTDPQRFSQFTLSSAGLFLDYSKNLITTETRDLLVSLAGEVGLKDAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSSKSFNTLETLKNAQAARAWYLAQGGSEVELHRHFIAVSSNNAAAVAFGIREENIFPMWDWVGGRYSLWSAIGLPIALAIGMSNFKELLSGAYTMDQHFQSAPFEQNMPVLLGLLGVWYGNFWNAQSHAILPYDHYLRNITKHLQQLDMESNGKSVRQDGTPTSTDTGPVIWGGVGANGQHAYHQLLHQGTQMIPADFIVPIVSFNPVADHHQWLYANCLSQSQALMMGKTRAEAEAELREKGMDEQEVQKLAPHKVIPGNRPSNTLVVERISPRRLGALVAMYEHKVFVQSVIWGTNAFDQWGVELGKEMGKAVYQRLTGGTEEQADDASTQGLINYFRGRHRG

SEQ ID NO: 52965 - protein, 421 aa, Zea mays
MPVTDHQSSSPSPFSFGRSLLSLRRDPTAMPSGEEADLEAFQRHVASTLAELLPAAEAGVGGSDATAGAGEEFLSAAWIRRLLEAFVLCQEEFRVFVAQARRRAGALPAAAEKTVAEFHERAVKALDVCNAARDGVDQVRRWERLADIAASALRAPGEVHEGQLRRARKALTDVAALLVDDDAAAAAAASGAGGVASFLSSHRNRSFGRARASPSRTAGAGAGTLASASASHFRSLSWSVSRTWSASRQLLAIGAGLAAPRAHEAGLAAPVYAMGCVLHLTAWALVAAVPCPDRGNALQAHHLPAAPPRAAFPWAPPLLALQERLAEEGKRKDRRHSCGLLKEIHSLEKSTQKLAEAIDAAPIPLFGDREADVRDAAAELAAVCEAMRDGLEPLERMVREVFHRIVRSRVDGLDSSMHNAD

SEQ ID NO: 52966 - protein, 162 aa, Escherichia coli O157:H7 EDL933
MGVSGSGKSAVASEVAHQLHAAFLDGDFLHPRRNIEKMASGEPLNDDDRKPWLQALNDAAFAMQRTNKVSLIVCSALKKHYRDLLREGNPNLSFIYLKGDFDVIESRLKARKGHFFKTQMLVTQFETLQEPGADETDVLVVDIDQPLEGVVASTIEVIKKGK

SEQ ID NO: 52967 - protein, 304 aa, Streptomyces avermitilis MA-4680
MSSTLSVPAQAPETGTARVKRGMAEQLKGGVIMDVVTPEQAKIAEDAGAVAVMALERVPADIRKDGGVARMSDPDMIEGIISAVSIPVMAKSRIGHFVEAQVLQSLGVDYIDESEVLTPADEVNHSDKWAFTTPFVCGATNLGEALRRIAEGAAMIRSKGEAGTGNVVEAVRHLRQIKNEIARLRGYDNNELYAAAKELRAPYEIVKEVAELGKLPVVLFSAGGVATPADAALMRQLGAEGVFVGSGIFKSGDPAKRAAAIVKATTFYDDPKIIADASRNLGEAMVGINCDTLPEAERYANRGW

SEQ ID NO: 52968 - protein, 382 aa, Arabidopsis thaliana
MKLKSVFDASEIKSEFESAGINPKFAIQIWKYVIQNPDCVWDEIPSLPSAAYSLLHSKFKTLTSSLHSLFHSSDGTTSKLLIKLQNGAFVEAVVMRYDTRLGMLGGKPRPGGIRSTLCISSQVGCKMGCTFCATGTMGFKSNLTSGEIVEQLVHASRIADIRNIVFMLLPWFDDCDQGMGEPLNNYNAVVEAVRVMLNQPFQLSPKRITISTVGIVHAINKLHNDLPGVSLAVSLHAPVQEIRCQIMPAARAFPLQKLMDALQTFQKNSQQKIFIEYIMLDGVNDQEQHAHLLGELLKTFQVVINLIPFNPIGSTSQFETSSIQGVSRFQKILRETYKIRTTIRKEMGQDISGACGQLVVNQPDIKKTPGTVELRDIEDLLL

SEQ ID NO: 52969 - protein, 393 aa, Mesorhizobium loti MAFF303099
MPRPSSRISGIVPSGKDGWEVHFAAWTRKEAGEDIIMLSVGDHDFDTPSQTIEACVTAVRGSNHHYTPLPGLPRLRQAMAAASSACTGIETTPDQVIATPGGQAALYAAVQAVLDQGDHAIVVAPYYATYPNTFSAAGASFTVVETPAEDGFQPRADMIRAALRPNTRAILINTPNNPTGAVYSRERLEQLAQICREHDLWLLSDEVYWTLGGGEHVSPRSLPGMAERTLVINSMSKSHGMTGWRMGWLTGPQDMITLLINLNLVTTYGLPAFISIACAEALENRYGVKEIAERYAARRTVLLDAVRGMNNVSVRGSEGGMYVMLDISDVEPDDEKFAWALLDQEKVGVMPGSSFGEAAAGHIRISLCQPEPVLQEAAARLRRFASTYRREAA

SEQ ID NO: 52970 - protein, 400 aa, Carboxydothermus hydrogenoformans Z-2901
MHIETFLVKRAIEGPSLQTAYFYKEPEKLEQIFGGKSPGFFYSRVANPTVAALEEKVARLEGGVMATATSSGMAAIALTFMAFAQPGAEFLVCAGLFGGTLNLLKNLTKTCGITYKLLPAPDPELVKKHLTSSTRLVFVESIGNPTLKIPDFAGLVSLLKAHKIPLVVDNTVAPLLVKPLSLGANIVIHSLSKYISGQGTVIGGCIVDGGNFEWDERFQNLYPLVREAGPLAFSAYVKKELATDMGMCLSPFAAWQVLIGSETLALRMERMVQNARELSEFLQSFQEIRVNYPGLGDSVEWQNCVNYLGGKGGNLIVLSFKDKETAFNFIKNLNIARLATNIGDVRTLVCHLDSTIYQKIPPDEKKILNITDNQVRVSVGIENIEDLKEDFAKALQKLLS

SEQ ID NO: 52971 - protein, 271 aa, Triticum aestivum
  misc_feature (194)..(194): Xaa can be any naturally occurring amino acid
  misc_feature (205)..(205): Xaa can be any naturally occurring amino acid
TPFPPPVPTLLCLNTPVASSALLLTSGAAILPHPSKAATGGEDAYFIEDYGWFGVADGVGQWSFEGINAGLYARELMDGCKKVIAESEGGSELAPEQVLSKAAAEASSPGSSTVLVAHFDGQLLHVSNIGDSGFLVIRNGEVCAKSKPMVYGFNFPHQIEKGVDPLTLVENYTIDIEEGDIIIAATVGLFDNVXNKFVQKSRLVXSGTLQAYLDPRVLAEHLAARAHEVGRSGAGRSPFSDSAVAAGYLGFSGGKLADTAVVVSIVRRSEA

SEQ ID NO: 52972 - protein, 162 aa, Chromobacterium violaceum ATCC 12472
MNSIRNFFKTFLLVELVKGLMVTGRYFFARKITVQFPEEKTPISPRFRGLHAQRRYANGEERCIACKLCEAVCPAMAISIESEQREDGTRRTSRYDIDLTKCIFCGFCEEACPVDAIVETHIFEYHGEKRGDLYYTKPMLLAIGDKYEAEIAANKAADAKYR

SEQ ID NO: 52973 - protein, 332 aa, Ralstonia metallidurans CH34
MNSSSTPTARFVSTGTLPGPEEIRSLVEAAYENFREEAGGKLADYIPALAEADPSAFGICVANTRGHAFMVGEAAETFSIQSVSKPFVFALVCEALGAAEAATRLGVDATGLPFNSIMAMELRTDGTSNPLVNAGAIAATSLIPGFGADDRWHHVRQGLSRFAGRELACDEHVYESEAANNQRNAGLAHLLRGHGRLYCDPDEAVEVYTRQCALLVSARDLALMGATLAGGGVHPLTGEQVVSAATCQRVLAVMATAGLYERSGSWLYDVGLPGKSGVSGGILTIAPGKGAVATFSPPLDAAGNSVRGQLVMRFLSERLGLNLFISAPAAHL

SEQ ID NO: 52974 - protein, 156 aa, Brassica napus
  misc_feature (4)..(4): Xaa can be any naturally occurring amino acid
  misc_feature (6)..(6): Xaa can be any naturally occurring amino acid
  misc_feature (13)..(13): Xaa can be any naturally occurring amino acid
  misc_feature (18)..(18): Xaa can be any naturally occurring amino acid
  misc_feature (22)..(22): Xaa can be any naturally occurring amino acid
  misc_feature (26)..(26): Xaa can be any naturally occurring amino acid
  misc_feature (28)..(30): Xaa can be any naturally occurring amino acid
  misc_feature (38)..(38): Xaa can be any naturally occurring amino acid
  misc_feature (45)..(45): Xaa can be any naturally occurring amino acid
  misc_feature (57)..(57): Xaa can be any naturally occurring amino acid
  misc_feature (74)..(75): Xaa can be any naturally occurring amino acid
  misc_feature (80)..(80): Xaa can be any naturally occurring amino acid
  misc_feature (85)..(85): Xaa can be any naturally occurring amino acid
  misc_feature (91)..(91): Xaa can be any naturally occurring amino acid
  misc_feature (93)..(94): Xaa can be any naturally occurring amino acid
  misc_feature (99)..(99): Xaa can be any naturally occurring amino acid
  misc_feature (102)..(102): Xaa can be any naturally occurring amino acid
  misc_feature (106)..(106): Xaa can be any naturally occurring amino acid
  misc_feature (109)..(110): Xaa can be any naturally occurring amino acid
  misc_feature (113)..(114): Xaa can be any naturally occurring amino acid
  misc_feature (116)..(119): Xaa can be any naturally occurring amino acid
  misc_feature (121)..(123): Xaa can be any naturally occurring amino acid
  misc_feature (126)..(126): Xaa can be any naturally occurring amino acid
  misc_feature (128)..(129): Xaa can be any naturally occurring amino acid
  misc_feature (131)..(131): Xaa can be any naturally occurring amino acid
  misc_feature (136)..(136): Xaa can be any naturally occurring amino acid
  misc_feature (138)..(139): Xaa can be any naturally occurring amino acid
  misc_feature (141)..(143): Xaa can be any naturally occurring amino acid
  misc_feature (145)..(147): Xaa can be any naturally occurring amino acid
WPQXAXSSEPSPXPADRXPGIXSPEXPXXXVRNHEIEXLMACVTXLEAALLPCLPAXELPAIDRSPHPSHQIDXXRHAQXFPWKXLKKLQXLXXLGLQXRKXPPPXPLXXLRXXIXXXXKXXXTQXEXXKXTLPGXSXXPXXXGXXXNGRFLLPRC

SEQ ID NO: 52975 - protein, 224 aa, Photobacterium sp. SKA34
MNQPLNYRNTSFITSAPDIRHLPQDAGVEIAFAGRSNAGKSSALNRLTDQKGLARTSKTPGRTQLINMFEVVQGCNLIDLPGYGFAQVPLEMKLKWQKSLGEYLQRRECLQGLVVLMDIRHPMKDLDQQMINWALESRLPVMVLLTKADKLKSGARKAQVLKIRQMTKELEGDVQVEAFSSLKGIGVDQVRRKLDEWYAPELERQRVLAGGDDAFPEQVEEDNE

SEQ ID NO: 52976 - protein, 68 aa, Glycine max
  misc_feature (43)..(43): Xaa can be any naturally occurring amino acid
IKNCNADGIWAWDLVVGNCAICRHHVMDLCVDCLANQASSTSXECTVARGVGNHALHLHCICRWVKTR

SEQ ID NO: 52977 - protein, 390 aa, Pseudomonas syringae pv. syringae B728a
MSQPYSARSRAIEPFHVMALLARANELQAAGHDVIHLEIGEPDFTTAEPIIKAGQAALADGKTRYTAARGLPQLREAISGFYAQRYGVDIDPQRILVTPGGSGALLLTSSLLVDPGRHWLLADPGYPCNRHFLRLIEGEAQLVPVGPQQRYQLTPELVATHWNHNSVGALVASPANPTGTLLSRDELAALSQALKVRNGHLVVDEIYHGLTYGVDASSVLEVDNDAFVLNSFSKYFGMTGWRLGWLVAPQDAVADLEKLAQNLYISAPSMAQHAALACFEPQTLAILEQRRAEFGRRRDFLLPALRELGFGIAVEPEGAFYLYADISAFGGDAFAFCRHFLETEHVAFTPGLDFGRFQAGHHVRFAYTQSLPRLEQAVERIARGLRSWGV

SEQ ID NO: 52978 - protein, 118 aa, Arabidopsis thaliana
MSATGIKRSNLNTRPVQRDASAKQTAIKGPYGKSPGCTTSCGLRLPRKTEVTAAKLIKHLGCKFAKARNIKAQAQVYNTSDTATGNLPASIIAMDSGSLKPKRLKIFSSHTSFRSQLI

SEQ ID NO: 52979 - protein, 182 aa, Streptomyces avermitilis MA-4680
MTELVNITELLLSRIRDVRDYPEPGVVFKDITPLLADPAAFTALTGALAELTVRHGATKIVGLEARGFILGAPAAVQAGVGFIPVRKAGKLPGATLSQSYDLEYGSAEIEVHAEDLVAGDRVMVVDDVLATGGTAEASLQLIRRAGAEVAGVSVLMELGFLGGRARLEPALAGAPLEALLQI

SEQ ID NO: 52980 - protein, 824 aa, Solibacter usitatus Ellin6076
MFSTPDTLCVERCAANARIRSVLRVLMLVLSLVALGAPLMAQETGGGEANLKLPRLDSVTFLGGISGSSLLMGGLVVSALGLIFGLYIFTRLRAMPVHDSMREVSELIYETCKTYLATQGKFLCILEALIAVIIVFYFGFLLGFEFYKVLIILAFSVVGISGSFMVAAFGMRVNTFANSRTSFAALRGKPFPCYAIPLQAGMSIGMLLVSVELLIMLCILLFVPGDLAGSCFIGFAIGESLGAAALRVAGGIFTKIADIGSDLMKIVFKIKEDDARNPGVIADCTGDNAGDSVGPSADGFETYGVTGVALITFILLAVASPTVQVQLLVWIFTMRIMMVISSGVGYFINDAIAKAKYLNADKFDFEAPLTTLVWLTSILSIVLTYVLSNMMIPDLAGDTTLWWKLATIISCGTLAGALIPEFVKVFTSTNSRHVREIVTSSREGGASLNILSGFVAGNFSAYWLGMAMLALMSIGFFVSTMFPVTLMLAPAVFAFGLVAFGFLGMGPVTIAVDSYGPVTDNAQSVYELSTIETIPNIEALIQKQYGFKPEFEKAKENLEENDGAGNTFKATSKPVLIGTAVVGATTMIFSTIVALTHGLKDNMDKLSMMHAPFLLGLIAGGAVIYWFTGASAQAVTTGAYQAVEFIKKNIKLETTEKASVADSKKVVEICTKYAQKGMFNIFLVVFFSTLAFAFLEPFFFIGYLVSIALFGLFQAIFMANAGGAWDNAKKVVETELRAKGTPLHDACVVGDTVGDPFKDTSSVALNPIIKFTTLFGLLAVQLAVSVSAKQGNTLTTILSAVFFLASTYFVYRSFYGMRIETTKE

SEQ ID NO: 52981 - protein, 470 aa, Arabidopsis thaliana
MDRISNLPNEIICHIVSFLSAKEAAFASVLSKRWQNLFTIVQKLEFDDSVKNQGSLMDFVNGVLALPVTTRISKFSLRFDSFLKRKLETGLVIGPHVVNRCLCNVLKRGVLDLKLEIYGEDGYLLPSEVFTCKTIVDLKLTSCIFAESYVIDVIPENAFLPGLESLFLKSIWFSDLRGCAFQTLLSACPVLKTLTIYDVQWEKWKWSRTVSSATLERLIIQRTEFTYFNGSDFKSITFDTPSLTYLKYIDFVPEEYPVVNLDSIVEAKLHLILTGNQDYPVRYLGREDDPITSNPTNLIKGLRNVEILHLSTATAQMLCFFPRETLPEFVNLHHLTIGPTYYECFNWRLLPILLKKTPNLKTLMIKGPLHLYYRDFNDDEEEEEPEYYCECSSGCNCLLSCHMEVLEISHYRGTTKELEKLKHFLGKLSCLEHVKLGVWASSDKEKLSITTDLLMLPRASVNCKIQINFS

SEQ ID NO: 52982 - protein, 613 aa, Debaryomyces hansenii CBS767
PGRQPKSIDLIQDYEEITTFPKPTAECRAALYSSNGEYFAYTQPNEVVVVRTTKEAPLQTRIDLPEVFDIYFSPNGTYLCLWCKPILQDKESGVWNKNVKIFNINSNSIISEWSNKHQAGWKPQFTQDEKLFAKNVNNKELHFFDVTNSSNEEININQPTYKYKLSDPKATFQSFQMSPGLNPSIAIFIPEKNGKPASVVIYNVPNFNQPICLKNFFKAERCQLKWNSIGTALLALASTDHDTTNKSYYGETNLYLLGIAGSYDSRIDLKRTGPIHDITWSPSAREFAVVYGYMPADTTFFDARGNAIFSLPTAPRNTILYSPHARYVLVAGFGNLQGTVDVYDRQNKFSKVVTFEAANTSVCEWSPCGRYILTATTSPRLRVDNGCKIWHASGKLVYLKEYQELYSITWKPQSLDKFPPLRNLEDAPVAHESTKEYLAKKQANDLSAAQKPSGAYRPPHARNSGSSARTSLYQKELQSSSSLSGSNGNGARTRVVPGAAPVDNTPKESKSAAKNRKKREAKKQQQDEGQQTGSPSNSVESVQKDNETSESGVIGGVSSLEEKKIRSLLKKLRAIETLKMKQANGEILEDTQVSKIKKEDDIRKELHLLGWSD

SEQ ID NO: 52983 - protein, 93 aa, Capsicum annuum
MERVKSVQLKDGRVLDADIVVVGVGARPLTTLFKGQVDEDKGGIKTDAFFKTSVPDVYAVGDVATFPMKMYNDIRRVEHVDHSRKSAEQAVKA

SEQ ID NO: 52984 - protein, 258 aa, Clusia minor
CEEIGRGRFGVVYKCTKLSTNETYALKSIVKNSLNDDLLDARCLVTEPKILRHVSPHPHVTQLHDSHEDDCYLHLIIDLCPNGDLYTLLLSTGPIPEAQSKAQFVQLMKAVSHCHKSGVVHRDIKPDNILFDSRESLKLADFGSAECGKGSDLNGVVGTPYYVAPEILEGREYGEKVDVWSAGVVLYVMLAGFPPFYGETVVEIFEAVLRGNLRFPTRAFCTVSSSVKDLLRRILCRDVSRRFTADQVLRHPWVTSGG

SEQ ID NO: 52985 - protein, 260 aa, Clusia minor
CEEIGRGRFGVVYKCTKLSTNETYALKSIVKNSLNDDLLDARCLVTEPKILRQVSPHPHVTQLHDSHEDDCYLHLIIDLCPNGDLYTLLLSTGPIPEAQSKAQFVQLMKAVSHCHKSGVVHRDIKPDNILFDSRESLKLADFGSAEVICGKGSDLNGVVGTPYYVAPEILEGREYGKKVDVWSAGVVLYVMLAGFPPFYGETVVEIFEAVLRGNLRFPSRAFCTVSSSVKDLLRRILCRDVSRRFTADQVLRHPWVTSGG

SEQ ID NO: 52986 - protein, 495 aa, Sulfitobacter sp. EE-36
MKDWNALASALYDGSFRPMFINGKWCPAQSGAEMDARNPANGSLLATVPQGGAADIDAAVKSARAAFEGPWAKFTPFERQALLLRIADKFEAEWERLCLSDTLDMGMPIQRTLANSRRVLGMLRFYAGQAVMIHGQTIPNSFPGEIYSSTVREPVGVVGAIIPWNAPIAGSVWKIAPALATGCTVVLKPSEEASLTVLMIARLMQEAGLPDGVLNVVTGLGADAGAALAAHPDVDKIVFTGSTATGQAIARAATGTLKRVSLELGGKSPVIVCKDADIDKAVPVAAMSVFANSGQICIAGSRLFVAREIHDEFTRRVAEFAAGLKIGQGIDEGTDIGPIISARQAERIAGFLSDGPAEGATVLTGGQRAEGAALEGGHFIQPTVFGGVTDDMRIAREEIFGPVISALPFDDLDEVVTRANDTPYGLAAGVFSTNLGTAHKLAHRLKAGSVWVNMYHAIDPAVPFGGVKMSGYGREGGTEHLEEYLDTKAIWINAD

SEQ ID NO: 52987 - protein, 146 aa, Glycine max
  misc_feature (87)..(87): Xaa can be any naturally occurring amino acid
MEEEQNGGRFDLIILGASGFTGKYVLREALKFLNTPSSPLKSIAIAGRSPQKLTQALQWASRPNPPPSLPILTADTADPSSLRSLCXAAPNRVEAYVALESEKRIVGNFATYESAVLGVANAHQLQQLRRSRPRKPRPQIPGPPTS

SEQ ID NO: 52988 - protein, 306 aa, Clostridium tetani E88
MMQSKIESIIEECRKYTREGEVASYIPELKKADKDALGIYIDKLDGNEFCAGDYDTKFTIQSISKIIALIIAIMDNGMEKVLSKVGVEPSAYSFNSIVTLEVKNANKPLNPMINAGAIATVSLIKGNSPEEIIERILEFTRKVTGNKNIKVNEEVYQSEKKTGDRNRSLAYFMKGTGIIEKDVEKVLDAYFQQCSIEVTCKDIAKIASFLANDGVLPSTGERIIPAEVAKIVKAVMVTCGMYDASGSFAVKVGIPSKSGVGGGILATVPGVMGIGVFGPALDKKGNSIAGVKILERLSEELNLSIF

SEQ ID NO: 52989 - protein, 1062 aa, Bacillus halodurans C-125
MGKREDIKKILVIGSGPIVIGQAAEFDYAGTQACQALKEEGYEVILVNSNPATIMTDTTMADRVYIEPLTLEFVSRIIRMERPDGILPTLGGQTGLNMAVELDQAGILKEYNVELLGTKLDSIQQAEDRDLFRALMKELNEPVPDSEIIHTLEEAYTFVERVGYPIIVRPAYTLGGTGGGLVYNEEDLVEIVTSGLKYSPVTQCLVEKSIAGFKEIEYEVMRDGKDHAIVVCNMENIDPVGVHTGDSIVVAPSQTLSDREYQMLRNSSLKIIRALGIEGGCNVQFALDPDSFQYYIIEVNPRVSRSSALASKATGYPIAKIAAKIAVGYTLDELLNPITQTTYASFEPALDYVVSKIPRWPFDKFEAANRSLGTQMKATGEVMAIGRNLEESLLKAVRSLEAGVYHLDQPDVNDLDKESLEKKLTKPDDERLFALGEAIRRGYTIEELWALTKIDRFFLRSFARIIQLETQLKENVGDLELLKEAKERGFSDMIIADLWGTSEQEVYELRMNHGLSPVYKMVDTCAAEFASATPYFYGTYEEENESERTDKKSILVLGSGPIRIGQGIEFDYATVHTVWAIKEAGYEAIIVNNNPETVSTDFSTSDKLYFEPLTVEDVMHIVNLEQPEGVIVQFGGQTAINLASELAARGVKIIGTALEDMDRAEDRDKFEQTLVELNIPQPLGDTATSIEEARQIAERIGYPVLVRPSYVLGGRAMEIVYKEEELLNYMAHAVKVNPKHPVLIDRYLTGKELEVDAISDGENVYIPGIMEHIERAGVHSGDSIAVYPPQTVPESLKQKLIERTIELARGLRIVGLLNIQFVWHKDDVYVLEVNPRSSRTVPFLSKVTGVPMANVATKVMLGKTLPQLGYETGYHPEAKEVSVKVPVFSFAKLRRVDITLGPEMKSTGEVMGRDKTLEKALYKGLIASGMSIPTHGSVLFTIADKDKQEAISLAKRFYQIGFSILATEGTAHILHEEGIPVTTVNKISDEKPHLLDVIRAGDAQFVINTLTRGKQPARDGFRIRRESVENGVVCLTSLDTAEALLRVLESITFSAESMPVMQ

SEQ ID NO: 52990 - protein, 796 aa, Crocosphaera watsonii WH 8501
MEIVKQLKQIVIILLVFAVVNLCLLSFQSYQMTKYGRVVNFSGIVRGASQKLVKNELSNYPKDQEIEKINAIIQGLIKGDKTLDLPLVKNKIFQVKISIVQEKWTDLKAEIIAFREGKSTKQQLLQISEDFWIVTNDATFASENTASSHIQSLRKLYLVLFLINLTVLTFVWKINKKISLNIKDRIRAEISLKSSEEKFQQLANNINEVFWMTDINFREIIYVSPAYEKIWGKTCESLYLDINQWKNSIYPQDVSFFDRVLENFLINQEGTFYLEYRILSSDNQIYWIHHRGFLIKNIENQAYRIAGIAEDITQKKNIEICLREELKQTILLQTITKKIRASLEIETILNNTAHILAIKMKIDSCLIYTYIGDDQFQLNLIGTNINKNIRHYDFLNQLDKDDSYLKRIIDEDKAVVINKIEEEPLLISNQHLLQAENIKSLLTIRTSYKQNINGVIELHQYDKIHNWQPKDIKLIEAVASQLGIAIAQANLLAENKKQLEKLNQQNIQLQEKSKQAEAANKAKTNFLANMSHEIRTPLNAILGFSDLLSQKIIDPENVNHLQSIIFSSNNLLALINDIFELIRLESGIVKVESETVNLTEIIRQIYYKFSEKANQKNIKLIVNLNKNIPDILEFDKLKLYQIINNLLSNAIKFTKLGSVKVDVWANYFQSDLKTRQENCSIVIRIKDTGIGISQEKQKIIFDRFTQVSQETNREYEGIGLGLTLTQKMIQLLEGNLKLESELEKGTTITVTLPHLNIIQLSNQKALNLITETQLTTQEQKNIGQQKKLVLSNYQNS

SEQ ID NO: 52991 - protein, 196 aa, Crocosphaera watsonii WH 8501
MAHATDIKALARWMCADFSNQEQAFENPPFYAHIRVCIRPLPITNFPEPSLFLEQAYDYALDQPYRVRVLRLKIVEGRMELENYKLKEKEGFLGAARDREKLKKITPDDLELMQGCDMFIDWTGNSFKGVVKPGKNCLVFRKGKETYLDNSFEIDDQKLISLDRGYDPVTDELVWGSVAGAFNFKRRQSFADEVEF

SEQ ID NO: 52992 - protein, 473 aa, Acinetobacter sp. ADP1
MRGIYVAIFLENLSRIEVSAMNTKATSPEHEHLGLTKNLTYGFQHVLTMYGGLIAAPLVVGLGIGLSQADIGLLITASILVAGLATLLQTLGFKWFGSRLPIVQGTSFAAVASMIAIGANGGSFQSILGAIIVSSIFGIIVAPFFSKIVRFFPPIVTGSIIAIIGISLLPVAIRWIMGGNPKAPNWGSLENLGLAGITLVFLLLLTKFGSTSIKRLAVLLSIIFGAIVAFAFGLADFSKVSQGAWMALPNILGFGMPVFEWPAILSMCIVTLVILTETTASLLAIGEIVETKVDNHRIADGLRADMLSSALAPFFGAFMQCAFVQNVGLVAITGVKSRFVVATAGGILVVLGLLPVFGRLVASIPMPVLGGAGLVLFGSVAVSGIRTLSKVDYQLQSNMIIVAVSLGAGLIPLISPEFFHSMPGAVQTLFHSGISITCIMALLLNLFFNHLNFGKKTVSEGLTKPSATAQNHL

SEQ ID NO: 52993 - protein, 92 aa, Glycine max
  misc_feature (52)..(52): Xaa can be any naturally occurring amino acid
  misc_feature (55)..(55): Xaa can be any naturally occurring amino acid
  misc_feature (65)..(65): Xaa can be any naturally occurring amino acid
VGFPTSKTYNDITSIVSNGGRLQCMHVWPPLGKKKSETLFYLPYLYDAQSAXKYXYLLKKGWIPXWEFQLDHSLVYHDHYRLPRYYDGRYWT

SEQ ID NO: 52994 - protein, 469 aa, Photobacterium sp. SKA34
MSVENVLALIQENEVKFIDLRFTDTKGKEQHISIPSHQIDADFFEEGKMFDGSSVAGWKGINESDMVMMPDASSAVLDPFTEDATLNIRCDILEPATMQGYDRDPRSIAKRAEEFMRSTGIADTVLIGPEPEFFLFDDVKFNTDMSGSFFKIDDVEAAWNTGSDFEGGNKGHRPGVKGGYFPVAPVDSSQDIRSAMCLIMEEMGLVVEAHHHEVATAGQNEIATRFNTLTTKADEIQIYKYVVHNVAHAFGKTATFMPKPLVGDNGSGMHVHQSLAKDGVNLFSGDKYGGLSEMALYYIGGIIKHARAINAFANPATNSYKRLVPGFEAPVMLAYSARNRSASIRIPVVPSPKARRIEVRFGDPAANPYLAFAAMLMAGLDGIQNKIHPGEAMDKDLYDLPAEEAAEIPTVAESLQGALQALSDDREFLTSGGVFSDDFIDSYIALKSQDVEKVNMTTHPLEFELYYSV

SEQ ID NO: 52995 - protein, 221 aa, Microcystis aeruginosa
HKTQREALEFLQDFKSHLDETPDDREVVLCAPFTALAVLSKTLHGGRIRLGAQNVHWEKSGAYTGEISADMLTEIGVHYVVIGHSERRQYFGETDETVNLRVISAQKQGLIPIICVGESKAQRDAGETEKVIIKQIQGGLVNVDQKNLVIAYEPIWAIGTGETCESEEANRVIGLIRQQLDNPEVTIQYGGSVKPDNIDEIMAQSQINGALVGGASLDPAV

SEQ ID NO: 52996 - protein, 500 aa, Oryza sativa
  misc_feature (321)..(321): Xaa can be any naturally occurring amino acid
MENSQMWLLWGALSVALFFYFSTLRRRYAGGKPLPPGPTPLPLIGNLHLVGGGTFHHKLRDLARVHGPVMTLKLGLATNVVISSREAAIEAYTKYDRHLAARATPDTFRACGFADRSMVFIPSSDPQWKALRGIHASHVFTPRVLAAVRPIRERKVGDLIAYLRAHAGEEVLVGHAMYTGILNMVSFSYFSVDIVDMGSQMARELREVVDDIILVVGKPNVSDFYPFLRPLDLQGLRRWTTKRFNRVFSIMGDIIDRRLAHIRDNKPRHDDFLDSILELMAAGKIDRVNVLNMLFEAFVAGADTMALTLEWVMAELLKNPXVMAKARAELRDVLGDKEIVEEADAARLPYLQAVLKEAMRLHPVGALLLPHFAMEDGVEVGGYAVPKGSTVLFNAWAIMRDPAAWERPDEFVPERFVERTPQLDFRGKDVEFMPFGSGRRLCPGLPLAERVVPFILASMLHTFEWELPGGMTAEELDVSEKFKTANVLAVPLKAVPVLIK

SEQ ID NO: 52997 - protein, 221 aa, Microcystis wesenbergii
HKTQREALEFLQDFKSHLEETPDDREVVLCAPFTALAVLSKTLHGGRIRLGAQNVHWEKSGAYTGEISADMLTEIGVHYVVIGHSERRQYFGETDETVNLRVISAQKQGLIPIICVGESKAQRDAGETEKVIIKQIQGGLVNVDQKNLVIAYEPIWAIGTGETCESEEANRVIGLIRQQLDNPEVTIQYGGSVKPDNIDEIMAQSQINGALVGGASLDPAV

SEQ ID NO: 52998 - protein, 416 aa, Pseudomonas putida KT2440
MNQESISQSIAIVHPITLSHGRNAEVWDTDGKRYIDFVGGIGVLNLGHCNPAVVEAIQAQATRLTHYAFNAAPHGPYLALMEQLSQFVPVSYPLAGMLTNSGAEAAENALKVARGATGKRAIIAFDGGFHGRTLATLNLNGKVAPYKQRVGELPGPVYHLPYPSADTGVTCEQALKAMDRLFSVELAVEDVAAFIFEPVQGEGGFLALDPAFAQALRRFCDERGILIIIDEIQSGFGRTGQRFAFPRLGIEPDLLLLAKSIAGGMPLGAVVGRKELMAALPKGGLGGTYSGNPISCAAALASLAQMTDENLATWGERQEQAIVSRYERWKASGLSPYIGRLTGVGAMRGIEFANADGSPAPAQLAKVMEAARARGLLLMPSGKARHIIRLLAPLTIEAEVLEEGLDILEQCLAELN

SEQ ID NO: 52999 - protein, 212 aa, Brassica napus
  misc_feature (19)..(19): Xaa can be any naturally occurring amino acid
  misc_feature (168)..(168): Xaa can be any naturally occurring amino acid
STHASDLQHDVMIEAVENXMPETIIIDEIGTELESLAASTIAQRGVQLVATAHGMTIDNIIKNPSLQILIGGIESVTLGDEEARKRKVQKTILERKGPPTFTCAVEMISRTECRVHQRLDVTVDAILAGKSAPCEIRQIRGEDDSPHKLVTPIPLESLEVEPAPLLTXDFASEVLSDDEEEDFLPTRYKKASRNISVSQRSSPVHVYTYNVA

SEQ ID NO: 53000 - protein, 278 aa, Streptomyces avermitilis MA-4680
MTGTDSKRRAAVLGSPIAHSLSPVLHRAAYAELRLSDWSYDRFDVDEEALPAFFGKLGPEWAGLSLTMPLKRAVIPLLDEITETAASVEAVNTVVCTRDGRRVGDNTDIPGMVAALRERGIEQVDSAAILGAGATASSALAALARICTGEVVAYVRSEARAAEMRQWGERLDVEVRTEDWAQAAEALRAPLVVATTPAGATDALAAAVPERPATLFDVLYDPWPTDLAARWSAYGGAVVSGLDLLVHQAVLQVEQMTGRSPAPLDAMRRAGEHALAAR

SEQ ID NO: 53001 - protein, 122 aa, Leptospira interrogans serovar Lai str. 56601
MYGEFRMTDPNCIFCKIIRKEIPSKVVFENDEILAFYDISPQAPVHIVFIPKKHIPSLSEIENEDSHLLGNILLQIRDTAKNLGFAENGYRVVNNTGKNGGQTVFHIHFHLLAERRLHWPPG

SEQ ID NO: 53002 - protein, 261 aa, Arabidopsis thaliana; identical to SEQ ID NO: 976

SEQ ID NO: 53003 - protein, 493 aa, Nocardioides sp. JS614
MAVETGRITTDIPARLDRLPWARWHWLVVIGLGTVWILDGLEVTIVGSMSDALKPDGTGLGMNNFDIGLAGSMYVAGACLGAPFFGQLTDRLGRKKLFIVTLAVYTVATVLTAFSMNPMWYFACRFLTGCGIGGEYAAINSAIDELIPAKYRGRVDIAINGSFWVGAAGGALLTIPLLDPTMIDQSWGWRLAFGLGAILAVGILVVRRNVPESPRWLFIHGREDEAEQIVRDIERTVSEESHHQLHDVHDTITVRQRTSIGIGLIARTVFTLYPKRTILCFSLFVGQAFLYNAFFFTYGDTLTTFLGVEQTGYYIAVFAASNFAGALLLSPLFDTLGRVKMITATYIGSGVLLAVTGFYLGSFDATTLTLMGAIIFFMASAGASAAYLTASEVFPMETRALCIAFFYAIGTAAGGISGPLFFGWLIEQASADKDITQIAVGYFLGAALMIIGGIVEAFLGVKAEGKSLESIAQPLTAEDTDTGSTGSTQPQHA

SEQ ID NO: 53004 - protein, 136 aa, Triticum aestivum
  misc_feature (2)..(2): Xaa can be any naturally occurring amino acid
  misc_feature (5)..(6): Xaa can be any naturally occurring amino acid
  misc_feature (9)..(10): Xaa can be any naturally occurring amino acid
  misc_feature (12)..(15): Xaa can be any naturally occurring amino acid
  misc_feature (19)..(19): Xaa can be any naturally occurring amino acid
  misc_feature (22)..(22): Xaa can be any naturally occurring amino acid
  misc_feature (24)..(24): Xaa can be any naturally occurring amino acid
  misc_feature (27)..(30): Xaa can be any naturally occurring amino acid
  misc_feature (32)..(32): Xaa can be any naturally occurring amino acid
  misc_feature (34)..(34): Xaa can be any naturally occurring amino acid
  misc_feature (37)..(38): Xaa can be any naturally occurring amino acid
  misc_feature (40)..(40): Xaa can be any naturally occurring amino acid
  misc_feature (42)..(43): Xaa can be any naturally occurring amino acid
  misc_feature (45)..(45): Xaa can be any naturally occurring amino acid
  misc_feature (47)..(48): Xaa can be any naturally occurring amino acid
  misc_feature (50)..(50): Xaa can be any naturally occurring amino acid
  misc_feature (52)..(54): Xaa can be any naturally occurring amino acid
  misc_feature (56)..(56): Xaa can be any naturally occurring amino acid
  misc_feature (58)..(58): Xaa can be any naturally occurring amino acid
  misc_feature (63)..(64): Xaa can be any naturally occurring amino acid
  misc_feature (72)..(72): Xaa can be any naturally occurring amino acid
  misc_feature (74)..(77): Xaa can be any naturally occurring amino acid
  misc_feature (79)..(79): Xaa can be any naturally occurring amino acid
  misc_feature (84)..(84): Xaa can be any naturally occurring amino acid
  misc_feature (86)..(87): Xaa can be any naturally occurring amino acid
  misc_feature (90)..(90): Xaa can be any naturally occurring amino acid
  misc_feature (93)..(93): Xaa can be any naturally occurring amino acid
  misc_feature (96)..(97): Xaa can be any naturally occurring amino acid
  misc_feature (100)..(101): Xaa can be any naturally occurring amino acid
  misc_feature (110)..(110): Xaa can be any naturally occurring amino acid
  misc_feature (112)..(113): Xaa can be any naturally occurring amino acid
  misc_feature (117)..(117): Xaa can be any naturally occurring amino acid
  misc_feature (135)..(135): Xaa can be any naturally occurring amino acid
GXIGXXRFXXGXXXXLKLXSFXLXIVXXXXSXFXGAXXKXLXXVXFXXEXIXXXGXGXKVKVXXQLQEMPQXQXXXXHXVKARXAXXKNXIKXPAXXKWXXYLVKWGSTXQXXREEXGAISRIQFIVFPDFSKQXK

SEQ ID NO: 53005 - protein, 85 aa, Glycine max
MADTSGGDAVRPVVICDNKCGCTVPCTGGSTCRCTSVGMTTGGGDHVTCSCGEYCGCNPCSCPKTAASGTGCRCGTDCSCASCRT

SEQ ID NO: 53006 - protein, 172 aa, Solanum commersonii
MANPRVFFDLTIGGAPAGRVVMELFADTTPKTAENFRALCTGEKGVGKMGKPLHYKGSTFHRVIPGFMCQGGDFTAGNGTGEEKSIYGAKFKDENFVKKHTGAGILSMANAGPGTNGSQFLICSAKTEWLDGKHVVFGQVVEGLDVIKKAEAVGSSSGRCSKPVVVADCGQL

SEQ ID NO: 53007 - protein, 316 aa, Acinetobacter sp. ADP1
MTQHIPIISISGLFSPLLEDRLQVAMQMKQACEDNGFFYIADHGVSKNLQQKVFEQSRQFFDLPTNEKEKIHKKNSIANRGYEPLKNQTLEAGTPADLKEGFYAGREYALDSQAVLNKRFNHGPNQWPEQFPEFESTMQHYQAELEVLAKHLMRGLALSLNLDENYFDDFCQDSLVTLRLLHYPPQPANPEPNEKGCGAHTDFGALTLLLQDQQGGLQVWDKHTESWIDAPPIEGTYVINLGDLIARWTNNHYKSTVHRVINKSGKQRYSVPFFFGGNPDYLVKCLPDCMSESEPSLFVPTTVEQHHIEMYRRTYG

SEQ ID NO: 53008 - protein, 1280 aa, Streptococcus pneumoniae TIGR4
MRKTPSHTEKKMVYSIRSLKNGTGSVLIGASLVLLAMATPTISSDESTPTTNEPNNRNTTTLAQPLTDTAAGSGKNESDISSPGNANASLEKTEEKPAASPADPAPQTGQDRSSEPTTSTSPVTTETKAEEPIEDNYFRIHVKKLPEENKDAQGLWTWDDVEKPSENWPNGALSFKDAKKDDYGYYLDVKLKGEQAKKISFLINNTAGKNLTGDKSVEKLVPKMNEAWLDQDYKVFSYEPQPAGTVRVNYYRTDGNYDKKSLWYWGDVKNPSSAQWPDGTDFTATGKYGRYIDIPLNEAAREFGFLLLDESKQGDDVKIRKENYKFTDLKNHSQIFLKDDDESIYTNPYYVHDIRMTGAQHVGTSSIESSFSTLVGAKKEDILKHSNITNHLGNKVTITDVAIDEAGKKVTYSGDFSDTKHPYTVSYNSDQFTTKTSWRLKDETYSYDGKLGADLKEEGKQVDLTLWSPSADKVSVVVYDKNDPDKVVGTVALEKGERGTWKQTLDSTNKLGITDFTGYYYQYQIERQGKTVLALDPYAKSLAAWNSDDSKIDDAHKVAKAAFVDPAKLGPQDLTYGKIHNFKTREDAVIYEAHVRDFTSDPAIAKDLTKPFGTFEAFIEKLDYLKDLGVTHIQLLPVLSYYFVNELKNHERLSDYASSNSNYNWGYDPQNYFSLTGMYSSDPKNPEKRIAEFKNLINEIHKRGMGAILDVVYNHTAKVDLFEDLEPNYYHFMDADGTPRTSFGGGRLGTTHHMTKRLLIDSIKYLVDTYKVDGFRFDMMGDHDAASIEEAYKAARALNPNLIMLGEGWRTYAGDENMPTKAADQDWMKHTDTVAVFSDDIRNNLKSGYPNEGQPAFITGGKRDVNTIFKNLIAQPTNFEADSPGDVIQYIAAHDNLTLFDIIAQSIKKDPSKAENYAEIHRRLRLGNLMVLTAQGTPFIHSGQEYGRTKQFRDPAYKTPVAEDKVPNKSHLLRDKDGNPFDYPYFIHDSYDSSDAVNKFDWTKATDGKAYPENVKSRDYMKGLIALRQSTDAFRLKSLQDIKDRVHLITVPGQNGVEKEDVVIGYQITAPNGDIYAVFVNADEKAREFNLGTAFAHLRNAEVLADENQAGPVGIANPKGLEWTEKGLKLNALTATVLRVSQNGTSHESTAEEKPDSTPSKPEHQNEASHPAHQDPAPEARPDSTKPDAKVADAENKPSQATADSQAEQPAQEAQASSVKEAVRNESVENSSKENIPATPDKQAELPNTGIKNENKLLFAGISLLALLGLGFLLKNKKEN

SEQ ID NO: 53009 - protein, 542 aa, Rhodopseudomonas palustris CGA009
MLGLMQDWPLLCHRIIEHAARIHGNQEVVTRSVEGPIVRTTYAQIHQRALKVSQMLDRAGIKLGDRVATIAWNTARHLECWYGIMGIGAICHTVNPRLFPDQIAWIVNHAQDRVMITDLTFIPVLEKIADQIPSVERFVVLTDAEHMPQTTLKNAIAYEEWLKEADGDFEWKTFDENTAAAMCYTSGTTGDPKGVLYSHRSNVLHALMANNPDALGTRAADTMLPVVPLFHANSWGIAFSAPSMGTKLVMPGAKLDGASVYELLSTEKVTHTAGVPTVWLMLLQYMQKEKLTLPHLKMVVCGGSAMPRSMIKAFVDMGAEARHAWGMTEMSPLGTLATLKPPFDQTTGDARLDVLATQGYPPFGVQMKITDDAGKDVDWDGKTFGRLKVSGPAIAKAYYRVDKEILDDAGFFDTGDVATIDQDGYMRITDRSKDVIKSGGEWISSIDLENLAVGHPKVAEAAVIGVYHPKWDERPLLICQLKPDVTCTRDEILQYMDGKIAKWWMPDDIVFVEAIPHTATGKILKTALRDQFKTYTLPGAAA

SEQ ID NO: 53010 - protein, 972 aa, Zea mays
  misc_feature (66)..(66): Xaa can be any naturally occurring amino acid
  misc_feature (81)..(81): Xaa can be any naturally occurring amino acid
MIVQPIELRAWTAFPGSAQEGIGRMAASVSRAICVQKPGSKCTRDREATSFARRSVAAPRPPHAKXRRRHPLRLRRGTGPXHCSPLRAVVDAAPIQTTKKRVFHFGKGKSEGNKTMKELLGGKGANLAEMASIGLSVPPGFTVSTEACQQYQDAGCALPAGLWAEIVDGLQWVEEYMGATLGDPQRPLLLSVRSGAAVSMPGMMDTVLNLGLNDEVAAGLAAKSGERFAYDSFRRFLDMFGNVVMDIPRSLFEEKLEHMKESKGLKNDTDLTASDLKELVGQYKEVYLSAKGEPFPSDPKKQLELAVLAVFNSWESPRAKKYRSINQITGLRGTAVNVQCMVFGNMGNTSGTGVLFTRNPNTGQKKLYGEFLVNAQGEDVVAGIRTPEDLDAMKNLMPQAYDELVENCNILESHYKEMQDIEFTVQENRLWMLQCRTGKRTGKSAVKIAVDMVNEGLVEPRSAIKMVEPGHLDQLLHPQFENPSAYKDQVIATGLPASPGAAVGQVVFTAEDAEAWHSQGKAAILVRAETSPEDVGGMHAAVGILTERGGMTSHAAVVARGWGKCCVSGCSGIRVNDAEKLVTIGGHVLREGEWLSLNGSTGEVILGKQPLSPPALSGDLGTFMAWVDDVRKLKVLANADTPDDALTARNNGAQGIGLCRTEHMFFASDERIKAVRQMIMAPTLELRQQALDRLLPYQRSDFEGIFRAMDGLPVTIRLLDPPLHEFLPEGNIEDIVSELCAETGANQEDALARIEKLSEVNPMLGFRGCRLGISYPELTEMQARAIFEAAIAMTNQGVQVFPEIMVPLVGTPQELGHQVTLIRQVAEKVFANVGKTIGYKVGTMIEIPRAALVADEIAEQAEFFSFGTNDLTQMTFGYSRDDVGKFIPVYLAQGILQHDPFEVLDQRGVGELVKLATERGRKARPNLKVGICGEHGGEPSSVAFFAKAGLDYVSCSPFRVPIARLAAAQVLV

SEQ ID NO: 53011 - protein, 1206 aa, Arabidopsis thaliana
MESTVMPGFDRISELPESLISQILLHLPTKASVKTSVLSTRWKNLWLNVPGLDLNCRDFPFQNNNEKLLIDFIDRFLQFNNESRLQKFKVDYSRDKIIKFSDRIGDAISRGIRVLDVESNTYYRDADDCIDYPCIEFMPLNLYSCKTLVSLKLSYSGLEDPGFVYLPCLKFMHLREVRWDSSGTMNLEKLVSGCPVLEELIYLHDDKLVVTRVRSRSLKRFSIPFRHKLSLFRRVTQTFEIDAPGLEYMSLKADHFDRIVVKNLTSLFMIDLDIKFIVGFGWMFDPEDLPKRNEIRDFLTGISSVRHMVISHNTVKALDLYSKVGLIPKFNNLSRVEAAFPSSLLQFLPAFLESFPNLKHLILETECPVEVMEKFELVNVPRCFVSTLEHVEIKGLFDWGEQDMKIASYFLENSAVLKKLILSFMGCPQHYSESDIYEELNKLTKRSPRFSYDLLDSLKKVILLHWTLVAMYSRRELEDLEYRYYSEMKDGTRKVKISESLFRCPFCYIDRKRDYQFDDLLRHASGIGGSSRTKDGRDKARHLALERYMRKYLRPRERPRPSPTSDVSSLPKEEFTGKWKSTLSTTEEGEFITTENSSSPHIVKAEPKFVSGDDSGRSGEERLKFSDKPDPFFSNEDKSYPAKRPCLVSGAKEGDEPVQRIGLSHGASFAPTYPQKLVSLGAGNGDQMYVHPWKGILANMKRTFNEKTRKYAGESGSKIREDLIKKGFNPHKVTPLWNGRLGFTGFAIVDFGKEWEGFRNATMFDKHFEVSQCGKRDHDLTRDPGDKLYGWVAKQDDYYSRTAIGDHLRKQGDLKSVSGKEAEDQRKTFTLVSNLENTLVTKSDNLQQMESIYKQTSSVLEKRMKEKDEMINTHNEKMSIMQQTARDYLASIYEEHEKASQHLEAQRKEYEDRENYLDKCQAKNKTERRKLQWQKHKNLMATQEQNKADEDMMRLAEQQQREKDELRKQVRELEEKIDAEQALELEIERMRGDLQVMGHMQEGEGEDSKIKEMIEKTKEELKEKEEDWEYQESLYQTLVVKHGYTNDELQDARKALIRSMRELTTRAYIGVKRMGALDETPFKKVAKEKYPAVEADKKAEELCSLWEEHLGDSAWHPIKVVEKDGIAKEELNEEDEKLQELRKELGEEVYAAVTQALKERNEYNGSGRYIVPELWNFKQNRKASIKEGVVYLVNSWKQKKPKPKRR

SEQ ID NO: 53012 - protein, 378 aa, Oryza sativa (japonica cultivar-group)
MNHLRNQILLLRVRSSSTSLSPLSPLHRLFSSSTAAASIAAEPFAVEDYLVTTCGLTGDQARKAAKTLSRLRSPSKPDAAVAFLSGLGLSRSGIAAAVAADPRLLCADVEKNLAKRVAELGELGISRSQIARLIPLARQSFRSSSLATNLGFWLPVLGSFENVLMALKANGAILGSDVEKVVKPNLALLQQCGIHVCDFPHTRLPTVLCRPPNHVQEAVARIGEFGVPQYSPVFRNALVPFAYQNKEKLAAKIGVLEMFGWSEDDLSMTMRKGPVVMNMSVERLRKNVEFLTRDVKLETRYIARRPIMISYSLERRLLPRHRLLRFLSAKGLLDGELDFYSAVALTEKKFLDKFVHSCKCSIADPANAYASSFVGDVL

SEQ ID NO: 53013 - protein, 347 aa, Clostridium perfringens str. 13
MKNILDFTLEELKEWMKENGESAFRAKQIFDWIYKKEVFNFEEMKNISKALIGKLSENFYIGIPEVIDYLSSSEDGTRKILLGLGDGNIIECVIMRYKYGNSICVSTQIGCRMGCKFCASTLEGMVRNLTAGEILSEVLIGQKLLGERISNIVLMGSGEPLDNYDNVMKFLELVNADYGLNIGQRHITLSTCGLVPKIREMADKEMQVTLAISLHAVSDEKRKTIMPIANKYSISEILDACNYYIEKTGRRITFEYSLVSGVNDTKEDAKSLGRLLKGMLCHVNLIPVNEIKENEFKKSTKKDIETFLNTLKTYGVEATVRREMGSDINAACGQLRRSYIKSKGLKL

SEQ ID NO: 53014 - protein, 179 aa, Helicobacter pylori 26695
MNETLKEELLQSIREVKDYPKKGILFKDITTLLNYPKLFNKLIDTLKKRYLALNIDFIVGIEARGFILGSALAYALGVGFVPVRKKGKLPAHTLSQSYSLEYGSDSIEIHSDAFRGIKGVRVVLIDDLLATGGTALASLELIKALQAECIEACFLIGLKELPGIQLLEERVKTFCLLEC

SEQ ID NO: 53015 - protein, 149 aa, Triticum aestivum
  misc_feature (67)..(67): Xaa can be any naturally occurring amino acid
  misc_feature (82)..(82): Xaa can be any naturally occurring amino acid
  misc_feature (97)..(97): Xaa can be any naturally occurring amino acid
  misc_feature (131)..(131): Xaa can be any naturally occurring amino acid
MAGRMALAVVLLTAAAAAAAAQSASNVRATYNYYSPEKINWDLNAASAYCATWDAGMSYAWRSKYGXWTAFCGPAGPTGPGXPCGKCLLVTNTATGXAQITARIVDQCSNGGLDLDFDTVFSKIDTDGQGXVAQGHLTVNYQFVDCGDN

SEQ ID NO: 53016 - protein, 392 aa, Oryza sativa (japonica cultivar-group)
MGVSASCLWGGSESRGNQNGSAAVTSPRSGQVISRAGSNVRVFSLKELKLATRNFHMMNCVGRGGFGAVYKGNLKDGTQIAIKKLSAESKQGANEFLTEINVISNVRHPNLVKLIGCCVEGTNRLLVYEYAENNSLAHALLGPRSRCIPLNWQKRAAICIGTASGLAFLHEEAQPRIVHRDIKASNILLDKKLLPKIGDFGLAKLFPDTITHISTRVAGTMGYLAPEYALLGQLTKKADIYSFGVLVLEVISGESSSKSTWGQDMNVLVEWTWKLREQGRLLEIVDPELEEYPEEEMLRFIKVALVCTQATSQQRPSMKQVVDMLSNPTEISLENLVAPGVLKEPRHHSSSSGLTPDTTSNRSTKANPADSYSTQTRDMNSYQLSTIEVSPR

SEQ ID NO: 53017 - protein, 371 aa, Pseudomonas putida
HAAAALCYTSGTTGNPKGVLYSHRATLLHALSSALPDSLSLSAREVVAPIVPMFHVNAWGLPYSAALVGAKLVLPGAGLDGQSVFKLFEQEGVTFSAGVPTVWLSLQQYMQQTGKRLPSLQRLVVGGAACPPALMRSFEQEFGIRIQHAWGMTEMSPTGTVNTLKASHLPLDEEARFAISIKQGRPLFGIELKTVDDDGNEVVRDGKTSGALVVRGHWVVDRYYRSDETPLVNGWFPTGDVASLDQDGFMQITDRAKDVIKSGGEWISSIELENIAMGHPAVAEAAALGIAHPKWDERPLLVVVAKPGEAPTREAILALYTGKVARFCIPDDVVFVEALPHTATGKVSKIQLRQALRDYQWPGSPAREVAS

SEQ ID NO: 53018 - protein, 593 aa, Pseudomonas putida KT2440
MTADNAIFIPPYKADDQDVVVELNNRFGADAFVAQETRTGMPVLWVKRAQLKEVLSFLRGVAKPYSMLYDLHGVDERLRTQRRGLPAADFSVFYHLLSIERNSDVMIKVSLSEGDLNLPTVTGIWPNANWYEREVWDMFGIDFAGHPHLSRIMMPPTWEGHPLRKDYPARATEFDPYSLTLAKQQLEEESARFNPEAWGMKRQGANEDYMFLNLGPNHPSAHGAFRIVLQLDGEEIVDCVPDIGYHHRGAEKMAERQSWHSFIPYTDRIDYLGGVMNNLPYVLAVEKLAGIKVPQKVDVIRIMLAEFFRITSHLLFLGTYIQDVGAMTPVFFTFTDRQRAYTVIEAITGFRLHPAWYRIGGVAHDLPRGWDKLVKDFVEWLPKRLDEYTKAALQNSILKGRTIGVAAYNTKEALEWGTTGAGLRATGCNFDLRKARPYSGYENFEFEVPLAHNGDAYDRCMVRVEEMRQSIRIIDQCLRNMPEGPYKADHPLTTPPPKERTLQHIETLITHFLQVSWGPVMPANESFQMIEATKGINSYYLTSDGGTMSYRTRIRTPSYPHLQQIPSVIKGSMVADLIAYLGSIDFVMADVDR

SEQ ID NO: 53019 - protein, 322 aa, Photorhabdus luminescens subsp. laumondii TTO1
MPKIDFQQAGKKVLHIERDGLTELEQHINGDFDRTCELMFNCEGKVIVMGMGKSGHIGCKIAATFASTGTPSFFVHPGEASHGDLGMITPKDIVLAISNSGESSEILSLIPALKRQKIPLICMTNNCNSSMGKAADIHLCIKVPQEACPLGLAPTTSTTATLVMGDALAVALLQARGFTAEDFALSHPGGTLGRKLLLLVSDLMSTGDDIPKVNRNATLREALLEITRQKLGMTVICDENRYIDGIFTDGDLRRVFDMGVDLYNVKISDVMTTGGIRIKPHALAVDALNLMQSHHITSLLVAEDNKLLGVLHMHDLLQAGVV

SEQ ID NO: 53020 - protein, 438 aa, Lactobacillus johnsonii NCC 533
MSNARTVALETLIKVFNQKSYSNIALNNELIKHDLKPADKALATRIVYGTIQYKIFLEYQLKPLIKTKLRDSFLKPLLLMSAYQYFFLEKVPANAIFDEANKLAKKYSKRNSGSYKLINGILRALERQGEILPPTNDLVEYLSIKESFPKWLVEYLLDHFGENKTKEILVRSNQPAANSIRMTTKESDFEEIKEELKKDNFSFEESSLTPHNLNLNKGGVAQTALFKNGKITIQDAAASLAVDAFYFKGSEQVLDACSAPGGKTVQIAENLTTGSVIALDIHENKLRLVRNAAERLHVSDKVRTKALDARKAKEYFNQGQFDKILVDAPCSGLGLIRRKPEIRYEKSLNDIKNLAKIQLAILESVSGLLANGGELVYSTCTISYEEDEGVVKQFLKLHPDFELIPVQVGKLPKQEMVRIFPSSDGSDGFFIAKLKKRG

SEQ ID NO: 53021 - protein, 458 aa, Erwinia carotovora subsp. atroseptica SCRI1043
MEQPSSKLKRGLSTRHIRFIALGSAIGTGLFYGSASAIQMAGPSVLLAYLIGGIVAYIIMRALGEMSVHNPQSSSFSRYAQDYLGPLAGYVTGWTYCFEMLIVAIADVTAFGIYMGVWFPAVPHWVWVLSVVLIIGAINLMNVKAFGELEFWLSFFKVATIIIMIAAGIGIIVWGIGNGGEPTGIHNLWSNGGFFSNGVMGTILSLQLVMFAYGGVEIIGITAGEAKDPHKSIPRAINSVPWRILVFYVGTLFVIMSIYPWNQVGTNGSPFVLTFQHMGITAAAGILNFVVITASLSAINSDVFGVGRMLHGMAEQGHAPKVFSRVSKRGIPWVTVVVMMMALLVAVYLNYIMPGKVFLVIASLATFATVWVWIMILFSQIAFRRRLSVDEVKALAFPLRGGIATSVFGIVFLFFIIGLIGYFPDTRISLYVGIIWILVLLVGYVWKKKHQNAVAAQN

SEQ ID NO: 53022 - protein, 319 aa, Oryza sativa
MSMGHYTNLTDPRTELEVVRDWNGVDQVVLRSPRGAYARVSLHGGQVLSWRNDRGEELLFTSSKAIFKPPKAMRGGIPICFPQFGNSGTLEQHGFARNRIWALDEEHPPLNQNDNNSKASVDLILKPSEDDLKCWPHGFEFRLRVSLTKDGNLSLVSRIRNVNGKPFSFSFGYHTYLSVSDISEVRIEGLETLDYLDNLSQRERFTEQGDAITFESEVDRVYVSSPNVIAVLDHEKKRTFVIRKEGLPDVVVWNPWEKKSKNIVDFGDEEYKQMLCVDAAAAERQITLKPGEEWTGKLELSEVPSTNCSGHLDQPGIII

SEQ ID NO: 53023 - protein, 837 aa, Chromobacterium violaceum ATCC 12472
MGTIAPRLDVLAPLSGWLVPLDSVPDPVFAGKMVGDGISLDPTSGSLLAPVSGVVSNLHSAHHALTITTSEGVEVMVHIGIDTVMLKGEGFFPLVEQGQQVSAGQPVIDFDLDLVGRKAASLLTQIIVTNGDETVSKMKLSDGLVAAGKDIVLSLQLANGKAVLQVEASEPQLSADIVIGNPAGLHARPAAVFASKAKSFASDIQLILGDKEANAKSVVAIMGLATKLGDAVRVRAAGADAAAAIAELTQLLNDRCGEKADEAPIAPAAPVFAQQQDSDTQLAGVGASPGIAIGRIVHHRLQEFDVPEQGKGANVEQQAFARATEEASAQLDLVKAQLTDPAKQAILSMHQELLQDPDLLAQTYTGLADGKSAAWSWRAAFSAYSARLEAQDNALLRERANDIRDVGRRVLALLAGVKQAALELPAGSILIAEDLAPSDTASLDPSKVMGFCTRTGGATSHVAILARSLGIPAICGISQSALKLPEGLQVILNGNEGTLAIAPTTEDLAAAEQEIARLAERRAAEAKSSMQPAATSDGARIDVVANIRNAADAREAVAKGAEGVGLLRSEFLFDNRDTAPTEAEQAAEYCAVAEALGKDRPLVVRTLDVGGDKPLSYLPLPKEDNPFLGLRGIRVSLDRPDLLRTQLRAILRAAPLTQLHIMFPMVASLEELRAAKAVLAEEQAAAGASNVKVGIMVEVPSAAVLAARFAPEVDFFSIGTNDLTQYVLAMDRGHPQLAKQADALHPGVLAMIALTCEGARAHGKWVGVCGGLASDERAAPLLVGMGVTELSVSTPAVASVKATLARWSMDECRQLAKDVLALSTVTDVRHHLNQHAR

SEQ ID NO: 53024 - protein, 273 aa, Nostoc sp. 36
MTIATSTKPQINWVNTLFFIGLHIGALFAFVPGNFSWTAVGVGFLLYWVTGGLGVTLGFHRLVTHRSFQTPKWLEYLLVFFGTLSCQGGPIEWIGTHRIHHLHSDTDADPHDSTKGFWWSHMDWLIHYCPAHADVPRFTKDIAEDPVYQFLEKYFILIQVALGVLLLLLGGWPFVIWGIFVRIVWVYHCTWLVNSATHKFGYRSYDSGDQSTNCWWVAVLVFGEGWHNNHHAFQYSARHGLEWWEIDLTWMTVQLLQAVGLATNVKLAPTKSS

SEQ ID NO: 53025 - protein, 201 aa, Actinobacillus pleuropneumoniae
MNHFNYKNQQLFAEDVSVSDIINQYGTPAYIYSRATLERHWHAFDKAFGAHPHLICFAVKSNSNIALLNVMARLGSGFDIVSQGELERVLAAGGKPSKVVFSGVAKSHSEIQRALEVGIRCFNIESIAELHRINEVAGQLGKIAPISLRVNPDVDAHTHPYISTGLKENKFGVSVTNEGNKYWEKRYEKKHRRKTYCVKVR

SEQ ID NO: 53026 - protein, 117 aa, Glycine max
  misc_feature (37)..(37): Xaa can be any naturally occurring amino acid
  misc_feature (80)..(80): Xaa can be any naturally occurring amino acid
MASSMIFSPADTTVNRAGAGMAGPFTGLKYMAGFPTXRKTNNDLTWIARHGGKRPCMHVWPTIGKKKFETLSYLPDLDDXPLAKEGQYPLKKGWDPLLGITLEHRFAYPEHKKAPGY

SEQ ID NO: 53027 - protein, 285 aa, Nostoc sp. 36
MTANFGAIAPERGNSPQLRWINVVFFGVFHALALLSPWFFSWSALGLLVFLHWLFGSIGICLGYHRLLSHKSFQVPKWLEYAIALIGALALQGGPIFWVGGHRQHHAHTEDIDLDPYSAQKGFWWSHILWIFYPRPEFFDYDTYKKYAPDLARQPFYCWLDRYFLLLQIPFALLLYVLGGWPFVFYGVFLRCVLLWHSTWFVNSASHLWGYRTFDADDGARNLWWVSIVTYGEGWHNNHHTYPHMAKSGLFWWEIDVTWWSIQLLQTLGLAKKVVSSPPQGATHG

SEQ ID NO: 53028 - protein, 959 aa, Sinorhizobium meliloti
MSLIHEIDYGTPASKSEKLVTLTIDGREITVPEGTSIMRAAMEAGIEVPKLCASDMMDAFGSCRLCLVEIDGRAGMPASCTTPVAAGISVSTQTQRLKDVRRGVMELYISDHPLDCLTCAANGDCELQDLAGAVGLRDVRYGYDGENHVTARNNGEINAKWAPKDESNPYFTYDSAKCIVCSRCVRACEEVQGTFALTISGRGFDSRVSAGMNEDFVSSECVSCGACVQACPTATLTEKSVIEIGQPEHSVVTTCAYCGVGCSFKAEMRGEELVRMVPWKDGQANRGHSCVKGRFAYGYSNHRDRILNPMVREKVTDPWREVTWEEAFAHVASEFRRIQYQYGRDSVGGITSSRCTNEETFLVQKLVRAGFGNNNVDTCARVCHSPTGYGLNQTFGTSAGTQDFDSVEHTDVAVIIGANPTDGHPVFASRLKKRLRQGAKLIVIDPRRIDLVRSAHVEASYHLPLKPGTNVAILTAIAHVIVTEGLANEAFIRERCDWSEFEDWAAFVAEPHHSPEATEAYTGVPPELVRGAARLYATGGNGAIYYGLGVTEHSQGSTTVMAIANLAMLTGNIGRPGVGVNPLRGQNNVQGSCDMGSFPHELPGYRHISDDATREIFEKLWGVTLNHEPGLRIPNMLDAAVEGTFKGLYVQGEDILQSDPDTKHVAAGLAAMECVVVHDLFLNETANYAHVFLPGSTFLEKDGTFTNAERRINRVRRVMRPKNGYADWEVTQKMAQAMGLAWNYRHPSDIMDEIAATTPSFAMVSYDYLDKMGSVQWPCNEKAPLGSPIMHVDGFVRGKGKFIRTEYVATDERTGPRFPLLLTTGRILSQYNVGAQTRRTENVVWHAEDRLEIHPHDAEQRGIRDGDWVRLASRSGDTTLRALITDRVAPGVVYTTFHHPSTQANVITTDFTDWATNCPEYKVTAVQVSPSNGPSDWQRDYDEQARQSRRIAGKLEAAE

SEQ ID NO: 53029 - protein, 339 aa, Streptococcus pneumoniae TIGR4
MKAVVVNPESTGVAIEEKVLRPLETGEALVEVEYCGVCHTDLHVAHGDFGQVPGRVLGHEGIGIVKEIAPDVKSLKVGDRVSVAWFFEGCGTCEYCTTGRETLCRTVKNAGYSVDGGMAEQCIVTADYAVKVPDGLDPAQASSITCAGVTTYKAIKEAKVEPGQWVVLYGAGGLGNLAVQYAKKVFNAHVIAVDINNDKLALAKEVGADIVINGLEVEDVAGLIKEKTDGGAHSAVVTAVSKVAFNQAVDSIRAGGRVVAVGLPSEMMELSIVKTVLDGIQVIGSLVGTRKDLEEAFQFGAEGLVVPVVQKRPVEDAVAIFDEMEKGQIQGRMVLDFTH

SEQ ID NO: 53030 - protein, 377 aa, Triticum aestivum
MMAAQPTANPGVRLGWKAPGALASPPRLALSRSAAAPLASHRVGRGKFSAAAITTDDYLPMRSTEVKNRTSVDGIKSLRLITAVKTPYLPDGRFDLEAYDSLINTQINGGAEGVIVGGTTGEGHLMSWDEHIMLIGHTVNCFGTNIKVIGNTGSNSTREAIHASEQGFAVGMHAALHVNPYYGKTSTAGLISHFDEVLPMGPTIIYNVPSRTGQDIPPAVIEALSTYPNMAGVKECVGHERVKCYTDKGITIWSGNDDECHDSRWKYGATGVISVTSNLVPGLMRSLMFEGENAALNEKLLPLMKWLFSEPNPIGLNTALAQLGVVRPVFRRPYAPLSLEKRTEFVRIVEAIGRENFVGQKEVRVLDDDDFVLISRY

SEQ ID NO: 53031 - protein, 207 aa, Rhodopirellula baltica SH 1
MTVRAFVLSLVGIATFGLTAGPASSTSAADPAKGEVTHKVYFDVSIGSEPAGRIVLGLFGKDVPKTAENFRALSTGEKGEGKLGVPLDFEGSAFHRVIPGFMLQGGDFTAGNGTGGESIYGMKFADENFKFQHTTPGLLSMANSGRNTNGSQFFITVAPTPWLDGKHVVFGRVIEGMDVVKKIEAQGSGSGQTRKLIKITEAGEVKE

SEQ ID NO: 53032 - protein, 761 aa, Rhizobium leguminosarum bv. viciae 3841
MPDIDKKDRPVTSVTDQEALDFHAMGRPGKLEINPTKPMATQRDLSLAYSPGVAVPVKAIAADPQTAYDYTARGNMVAVISNGTAILGLGNLGALASKPVMEGKAVLFKRFADVDSIDLEIDTENVDEFINCVRFLGPSFGGINLEDIKAPDCFVIESRLRELMDIPVFHDDQHGTAIIAAAGLINALELTGRDLKTTKLVCNGAGAAAIACVELIKAMGFAPENVILCDTKGVIYQGRTEGMNQWKSAHAAKTDTRTLEEAMKGADVVFGLSQKGAFSAKMIRSMAERPIIFAMANPDPEITPEEVARIRDDAIMATGRSDYPNQVNNVLGFPYIFRGALDVRASTINDAMKIAAVNALANLAREDVPDDVVAAYQGNRPRFGSQYIIPVPFDPRLISAIPVAVAQAAIESGVARKVITDMAGYARELSARRDPIASTLASLYERVRRRPKRIVFAEAEEEQVLRAAMSYANQQLGTAILLGREDLIRATAERAGIDLNRPGLEIVNARLSTRVEAYIDYLYARLQRHGYLHRDAQRLIHNDRNHFAATMVALGDADGMVTGITRNYSTALEDVRRCIDEKPGHRVIGVSLALCRGRTVFVADTAVHDMPTAEELADIAEEAAGLARRMGYPPRVAMLAYSTFGHPSGERSERVREAVKILDKRRVDFEYDGEMAADVALNRKVMEQYPFCRLSGPANVLVMPAFHSASISTKMLQELGGSTVIGPILVGLDKPVQITSMGAKDSDIVNMAAIAAYGAGS

SEQ ID NO: 53033 - protein, 379 aa, Triticum aestivum
  misc_feature (74)..(74): Xaa can be any naturally occurring amino acid
  misc_feature (176)..(176): Xaa can be any naturally occurring amino acid
  misc_feature (322)..(322): Xaa can be any naturally occurring amino acid
MADGEDIQPLVCDNGTGMVKAGFAGDDAPRAVFPSIVGRPRHTGVMVGMGQKDAYVGDEAQSKRGILTLKYPIXEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPXAILRLDLAGRDLTDSLMKILTERGYSFTTSAEREIVRDIKEKLAYVALDYEQELETAKNSSSVEKSYELPDGQVITIGAERFRCPEVLFQPSMIGMESSGIHETTYNSIMKCDVDIRKDLYGNIVLSGGTTMFPGIADRMSKEITXALAPSSMKIKVVAPPERKYSVWIGGSILASLSTFQQMWISKDEYDESGPAIVHRKCF

SEQ ID NO: 53034 - protein, 256 aa, Myxococcus xanthus DK 1622
MATARRRKIVAGNWKMNKSVPEALALVRDLRGQVASLGDTVEVVVAPPFVALQPLHVALEGAPLALAAQNCHWESSGAFTGEISAPMLAELGCAYVIVGHSERRQLFGDTDEQVNKRAKAVRAAGMTPIICVGETLAEREANQTLAVVERQVRGALEGFGAKEVAGFVLAYEPVWAIGTGRNATAAQAQEVHAAIRGLVERLYDGETAGRVRIQYGGSVKPDNAAELLGQPDVDGALVGGASLKAGDFAAIVKAAT

SEQ ID NO: 53035 - protein, 499 aa, Ralstonia eutropha JMP134
MDTRTELLSAATRAFLQRPKRMLIDGQWCAATDGAVFTTEDPASETTLAEVPAAGPADVDAAVQAARAAFEQGPWNAMRPSDRERLLLRLADLVEANAEELAQIEALDNGKPATMARAIDVAGAAGFLRYMAGWATKLHGESLDVSVPLVREREFVAFTRQEAVGVVGAIIPWNFPLLMAAWKLGPALACGCTVVLKPAEETPLSALRLGELVMEAGYPAGVVNIVTGDGARCGAALAGHPQVDKIAFTGSTEVGKLVGGAAMERLARVTLELGGKSPVIMLDDMSPEAAATGAAQAIFFNQGQVCTAGSRLYLPRSKFDATVQALADIANSLRLGPGLEPDTGMGPLVSRRQHKRVAGYVQAGVDAGAQLICGGNADLPRGHFFKPTVLARAPETSSVVQEEIFGPVVVALPYDDIDEVVGRANGTPFGLAASVWSNDLSRVHRLVPRIKAGTVWVNCHNLLDNAMPFGGFKQSGLGREMGRAVFDHYTETKSVMIAV

SEQ ID NO: 53036 - protein, 182 aa, Pseudomonas putida KT2440
MFKYIGDIVKGTGTQLRSLAMVFSHGFRKRDTLQYPEEPVYLPPRYRGRIVLTRDPDGEERCVACNLCAVACPVGCISLQKAETEDGRWYPEFFRINFSRCIFCGLCEEACPTTAIQLTPDFEMAEFKRQDLVYEKEDLLISGPGKNPDYNFYRVAGMAIAGKPKGSAQNEAEPINVKSLLP

SEQ ID NO: 53037 - protein, 802 aa, Rhodobacter sphaeroides
QPVTGGAEALRIRWSKAPCRFCGTGCGVMVGTRDGQVVATHGDTQAEVNRGLNCVKGYFLSKIMYGEDRLTTPLLRMKDGVYHKEGEFAPVSWDEAFDVMAAQAKLVLKEKAPEAVGMFGSGQWTIWEGYAASKLMRAGFRSNNLDPNARHCMASAATAFMRTFGMDEPMGCYDDFEAADAFVLWGSNMAEMHPILWSRLTDRRLSHEHVRVAVLSTFTHRSSDLSDTPIIFRPGTDRAILNYIAHHIISTGRVNRDFVDRHTNFALGATDIGYGLRPEHQLQLAAKGAADAGAMTPTDFETFAALVSEYTLEKAAEISGVEPALLEELAELYADPDRKWMSLWTMGFNQHVRGVWANHMVYNLHLLTGKISEPGNSPFSLTGQPFACGTAREVGTFAHRLPADMVVTNPEHRAHAEEIWKLPAGLLPDWVGAHAVEQDRKLHDGEINFYWVQVNNNMQAAPNIDQETYPGYRNPENFIVVSDAYPTVTGRAADLVLPAAMWVEKEGAYGNAERRTHFWHQLVEAPGEARSDLWQLMEFSKRFTTDEVWPEEILSAAPAYRGKTLFEVLFANGSVDRFPASDVNPDHANHEAALFGFYPQKGLFEEYAAFGRGHGHDLAPFDTYHEVRGLHWPVVEGEETRWRYREGFDPYVKPGEGLRFYGKPDGRAVILGVPYEPPAESPDEEFGFWLVTGRVLEHWHSGSMTLRWPELYKAFPGAVCFMHPEDARSRGLNRGSEVRVISRRGEIRTRLETRGRNRMPRGVVFVPWFDASQLINKVTLDANDPISRQTDFKKCAVKIEAV

SEQ ID NO: 53038 - protein, 146 aa, Triticum aestivum
  misc_feature (2)..(2): Xaa can be any naturally occurring amino acid
  misc_feature (33)..(33): Xaa can be any naturally occurring amino acid
  misc_feature (41)..(42): Xaa can be any naturally occurring amino acid
  misc_feature (70)..(70): Xaa can be any naturally occurring amino acid
  misc_feature (95)..(95): Xaa can be any naturally occurring amino acid
MXPTVMASSVTSVAPFQGLKSTAGLPVSRRSNXASLGSVSXXVGRIRCMQVWPIEGIKKFETLSYLPPLXTEALLKQVDYLIRLQSGCPCLEVQXGWGSSSREHNAIPPGVLRIGPGTWTVKPGNCGIATRTAQRQRLITEGLGRE

SEQ ID NO: 53039 - protein, 77 aa, Zea mays
MGCDDKCGCAVPCPGGKDCRCTSGSGGQREHTTCGCGEHCECSPCTCGRATMPSGRENRRANCSCGASCNCASCASA

SEQ ID NO: 53040 - protein, 424 aa, Glycine max
  misc_feature (223)..(223): Xaa can be any naturally occurring amino acid
MASAMVEDANFEDDQLANMTTDDVVRASRLLDNEIRILKEELQRTNLELESYKDKIKENQEKIKLNKQLPYLVGNIVEILEMNPEDEAEEDGANIDLDSQRKGKCVVLKTSTRQTIFLPVVGLVDPDKLKPGDLVGVNKDSYLILDTLPSEYDSRVKAMEVDEKPTEDYNDIGGLEKQIQELVEAIVLPMTHKERFQKLGVRPPKGVLLYGPPGTGKTLMARXACAAQTNATFLKLAGPQLVQMFIGDGAKLVRDAFQLAKEKSPCIIFIDEIDAIGTKRFDSEVSGDREVQRTMLELLNQLDGFSSDDRIKVIAATNRADILDPALMRSGRLDRKIEFPHPSEEARARILQIHSRKMNVHPDVNFEELARSTDDFNGAQLKAVCVEAGMLALRRDATEVNHEDFNEGIIQVQAKKKASLNYYA

SEQ ID NO: 53041 - protein, 792 aa, Streptococcus pyogenes M1 GAS
MKTKKVIILVGLLLSSQLTLIACQSRGNGTYPIKTKQSRKGMTSNKIKPIKKSKKTNKTHKGVAGVDFPTDDGFILTKDSKILSKTDQGIVVDHDGHSHFIFYADLKGSPFEYLIPKGASLAKPAVAQRAASQGTSKVADPHHHYEFNPADIVAEDALGYTVRHDDHFHYILKSSLSGQTQAQAKQVATRLPQTSSLVSTATANGIPGLHFPTSDGFQFNGQGIVGVTKDSILVDHDGHLHPISFADLRQGGWAHVADQYDPAKKAEKPAETHQTPELSEREKEYQEKLAYLAEKLGIDPSTIKRVETQDGKLGLEYPHHDHAHVLMLSDIEIGKDIPDPHAIEHARELEKHKVGMDTLRALGFDEEVILDIVRTHDAPTPFPSNEKDPNMMKEWLATVIKLDLGSRKDPLQRKGLSLLPNLETLGIGFTPIKDISPVLQFKKLKQLLMTKTGVTDYRFLDNMPQLEGIDISQNNLKDISFLSKYKNLTLVAAADNGIEDIRPLGQLPNLKFLVLSNNKISDLSPLASLHQLQELHIDNNQITDLSPVSHKESLTVVDLSRNADVDLATLQAPKLETLMVNDTKVSHLDFLKNNPNLSSLSINRAQLQSLEGIEASSVIVRVEAEGNQIKSLVLKDKQGSLTFLDVTGNQLTSLEGVNNFTALDILSVSKNQLTNVNLSKPNKTVTNIDISHNNISLADLKLNEQHIPEAIAKNFPAVYEGSMVGNGTAEEKAAMATKAKESAQEASESHDYNHNHTYEDEEGHAHEHRDKDDHDHEHEDENEAKDEQNHAD

SEQ ID NO: 53042 - protein, 546 aa, Carboxydothermus hydrogenoformans Z-2901
MSSVYQAKPWLKHYSEGVRASLNYPEKTLHELFWETTEKYPGLIATVFLGQEMTYKELGEKIKRFTNALSKLGIKKGDRVAVMLPNCPEFVISYFAILTLGGIVVQTNPMYVERELEYQLNDSGAETIILLDVLYPRANAVKGNTALKNLIVVNIPLIGTYPGEFGPGVYKFNDLISDSEPNPPEVTVTPDDVAVLQYTGGTTGISKGAMLTHKNLVANVYQVREFSNGIFFDGQERILTALPLFHVYGMTCCMNLATCFGGTMILIPKFDATLLLQHIQRYRPTSFPGAPTMYVALLNHPDLTKYDLRSINVCVSGSAPLPVEVQTKFEEVTGAVVVEGYGLSEASPVTHCNPIRGTRKIGSIGVPYSDTIAKIVDIETGEELPPGQIGELVVKGPQVMKGYWNRPEETANALKDGWLYTGDLAKMDEDGFFYIVDRKKDMIIAGGYNIYPREVEEVLYQHPKVKEAIVVGVPDPYRGETVKAFIVVKEGETLTEQEVIEFCNAHLARYKVPRLVEFRSELPKTAVGKVLRRQLREEELKKQQKN

SEQ ID NO: 53043 - protein, 684 aa, Arabidopsis thaliana
MRALNSRLVLIDINSSWQASRRLISATATAFSSDSSSSFRRTRGARQRIASSKSPASSPSPVRRPSDGFSFDVRSPSSDSSISSRKSPTTAPPTVELDAFLEILPPATRKELVKHEAIEELIEVVMDLGRKPLARFPSGDWVISEQPVTHQDLELAVSKVGDFSDDNRSGIDRSLHRISAIRNRKLQVIGLTCRVGRVVSGSAEIIRDLIEGGGSILVIGSPGVGKTTLIREIARMLADEHRKRVVIVDTSNEIGGDGDVPHSGIGRARRMQVPNVNLQHDVMIEAVENHMPETIIIDEIGTELEALAASTIAQRGVQLVATAHGMTIDNIIKNPSLQILIGGIESVTLGDEEARKRKVQKTILERKGPPTFTCAVEMISRTECRVHQRLDVTVDAILAGKSAPFEIRQIRGEDDVPHKLVTPIPLENLEEEPAPLLNRDFVSELLSDDEDEDFLLIRSNKARSNTYTSPRSSPVHVYTYNVLEADLLQVAEVMGLDDEIEVTDDVGEADVILASSSELKQNSSIRRVAKLHKLPIFVIKSTTMAQMVKAVRMILGRESFGSAPKAIEKSSVDDIEIKDDAPESKPSLEELDALEEVRLAIEYIVIPGGEPVELLPRRSDIIVRQLELVESYQLAVENLGTHLNPRLQILPRRSTKKTLTSSSPQKSADGSMGTTGTRLPFLKD

SEQ ID NO: 53044 - protein, 397 aa, Rhizobium leguminosarum bv. viciae 3841
MTMNQSINPHDLGAHAAADDLFTPVDPAAFNAVSPPIFQTSLFTYDSYEAMEDVFAGRTRNYIYSRGDNPTVREFELLVARLEGAEDGRAFSSGTAAITSTILSLVEAGDRVVAVRHLYNDVYRLLVKLLARLGVAVDFVDPADHDEVRKALSGAKLLYLENPTSFVFELQDIAALSAMAKEAGVTSIIDNSWATPLFQKPIQHGVDIVIHAASKYLGGHSDTVAGVVVGSKEAIARINATSYPYVGAKLSPFEAWLLLRGMRTLRVRLKEHERSGLLLAGRLKEHSAIGCVRHPAFQEHPGRATLTGYAGLFAFDLNPDIDVARFVNSLRDIRLGVSWGGPETLVVPAKVALQIPDRMTSFIRFGVSEQTVRFAVGLEEPELLWSDLQQALHAAKR

SEQ ID NO: 53045 - protein, 380 aa, Zea mays
MISPTNLLPARKITPVSNGGAATASPSSPSVAARPRRLPSGLQSVTGRGKVSLAAITLDDYLPMRSTEVKNRTSTDDITRLRLITAVKTPYLPDGRFDLEAYDSLINMQIEGGAEGVIVGGTTGEGHLMSWDEHIMLIGHTVNCFGSRIKVIGNTGSNSTREAVHATEQGFAVGMHAALHINPYYGKTSAEGMISHFEAVLPMGPTIIYNVPSRSAQDIPPEVILAISGYTNMAGVKECVGHERVKHYADKGITIWSGNDDECHDSKWKHGATGVISVTSNLVPGLMHSLMYKGENATLNEKLSPLMKWLFCQPNPIALNTALAQLGVARPVFRLPYVPLPLEKRAEFVRIVESIGRENFVGQKEARVLDDDDFVLISRY

SEQ ID NO: 53046 - protein, 762 aa, Vibrio vulnificus CMCP6
MSFRIKTIIGIACIEIIMLMLLVFSAMNFMRQSNQEQFIQKANATSQMFARASKDALLSLDLATLDDLTQEILSLPDILYVDIRNNDQQLAFAGALPKVSADWQADDHVSLGDLVFDVSEKITVDGLTYGEIRMGFNTTAIQTALDEASKAIVLIAVLEIILVALFSYFLGSYLSQNLYQLTRAAERVANDGPGFQLQLKAKDEIGKVAAAFDSMSHNLATSYQELEQARTQAELANESKSRFLASMSHEIRTPMNGVLGLLGILGETKLDNHQQNLVHTAKESGELLLSIINDILDFSRMEANTLILYPRPFELKSCVEEIVNSFEPLAKTKGLYLSLTFNDECDYVVVGDSNRYRQVLLNLLGNAVKFTQKGSVSLHVTTQNEGDKLYIRCEINDTGIGIAPDAMAILFEEFTMVDQGYSRTREGSGLGLAICKRLAQLMEGEINVESEVGKGSCFVFSVEMPLAEHDTVTQQAQPDNDSVCTLLQGKRILVAEDNTANQMVIKAMFERLGVAIDLANDGYEAVSMASNHHYDIIFMDISMPGKDGMQACKEIRQLPDAKQAATPIIALTAHALYGDKEKFLRSGMNGYLSKPLRSRHLIEELNNILSASNHHDTAHKPLETEKTNHMQITLTSEKNTTAPLVDELIIQQMIRDTSAEVMPMLIEHYIEESERRLVKIDQAIAHSDFQQLEFELHTLGSSSLALGNRRLSNLARKLERLCVAKEYDAVMEDASGIAQLAHDSLSALNERKQLGFVEPNSI

SEQ ID NO: 53047 - protein, 356 aa, Glycine max
MEVTAAPVPYVQEIAKEALTIVPERYVRPVHERPILSNSTPLPEIPVIDLSKLLSQDHKEHELDRLHYACKEWGFFQLINHGVDSSLVEKVKRGAQGLFDLPMEEKKKFGQREGEAEGYGQLFVVSEEQKLEWADLFFMFTLPPNKRKPHLFPNLPLPFRGDLDAYCEELRKLAIQILDQMANSLAIDPMEIRELFGEAEQSMRMNYYPPCPQPELVMGLNPHSDGGGLTILLQANEVEGLQIRKDGLWIPVKPLPNAFIINLGDMLEVMSNGIYQSIEHRATVNSEKERLSIATFYSTAIDAIICPAPSLVTPKTPAMFKPISAGDYFKGYLAQELRGKSFLDTIRIHAENENSS

SEQ ID NO: 53048 - protein, 102 aa, Glycine max
  misc_feature (80)..(80): Xaa can be any naturally occurring amino acid
SNISSTVHLQPAVLYDAGCTNLKSMAVFPTRKTNNYITSIASNCGRVQCMQVWPPIVKKNFETLSYLPDLYDAQFAYEVXYLLMKVCIPFLEFVLEHIFLFP

SEQ ID NO: 53049 - protein, 224 aa, Francisella tularensis subsp. tularensis SCHU S4
MISYTMIKNIFFDLDGTLVNTVGDLTVATNTMRKHFGLNPVSEDVLANIIGKGYPTTVRKVLALDFDDKDYIESIADEGVKIVSQTYKTLNSANSKVYPNIFKTLDFLKQQNIKMAVVTNKHEEDAIQSLTHLGLVDYFEVIVGGDSTASYKPYPEPLLFAMNKLNAKPEESLMVGDSINDFLCAQGANIKIVIVSYGYHNGIDLKSLESFAYIDDFSTIKNLI

SEQ ID NO: 53050 - protein, 154 aa, Zea mays
MTASVSRAICVQKPGSKCTRDREATSFARRSVAAPRPPHAKAAGVIRSDSGAGRGQHCSPLRAVVDAAPIQTTKKRVFHFGKGKSEGNKTMKELLGGKGANLAEMASIGLSVPPGFTVSTEACQQYQDAGCALPAGLWAEIVDGLQWVEEYMGA

SEQ ID NO: 53051 - protein, 89 aa, Zea mays
MAPVQCARSQRVFHFGKGKSEGNKTMKELLGGKGANLAEMASIGLSVPPGFTVSTEACQQYQDAGCALPAGLWAEIVDGLQWVEEYMGA

SEQ ID NO: 53052 - protein, 347 aa, Bifidobacterium longum NCC2705
MSEPVVLGIESTCDETAAAIVRGRELLSNVVASSMEEHARYGGVIPEIASRAHAEAFVPCVSKALVDANMTLADVDAIAVSAGPGLAGCLAVGVSGAKALAWAANKPIYGINHVIGHIAVTQLQFGPFPKDTLALIVSGGHTSLLHVEDMPRKIDVVGTTLDDAAGECFDKVARLLGFPYPGGPHIDRHGQNGDPHAIKVPMGLTQGKAGAAHPYDFSFSGVKTAVARWVESEQAAGHEIPVDDVCASLADSVATVLARKAMRGCRQYDSNTLIVGGGFSANSQLRAKLLEFGENYGVDVRIPQIKLCTDNGAMVAMLGVNLVEAGVAPSAPDFPIDSAMPLTKVSM

SEQ ID NO: 53053 - protein, 353 aa, Arabidopsis thaliana
MATCWPEPIVSVQSLSQTGVPTVPNRYVKPAHQRPVFNTTQSDAGIEIPVLDMNDVWGKPEGLRLVRSACEEWGFFQMVNHGVTHSLMERVRGAWREFFELPLEEKRKYANSPDTYEGYGSRLGVVRDAKLDWSDYFFLNYLPSSIRNPSKWPSQPPKIRELIEKYGEEVRKLCERLTETLSESLGLKPNKLMQALGGGDKVGASLRTNFYPKCPQPQLTLGLSSHSDPGGITILLPDEKVAGLQVRRGDGWVTIKSVPNALIVNIGDQLQILSNGIYKSVEHQVIVNSGMERVSLAFFYNPRSDIPVGPIEELVTANRPALYKPIRFDEYRSLIRQKGPCGKNQVDSLLLTR

SEQ ID NO: 53054 - protein, 220 aa, Oryza sativa (japonica cultivar-group)
MATASDGSGSGGEQRRLLSIPKEGERIIAPTRRPDGTLRKAIRIRAGYVPQEEVAIYQSKGAQMRKSGPDVPPGYDPALDAKPKTKAAKRNERRKEKRQQASTTNDKGKGLHIEDDAGETDNPKDAVDSVTKQISGIAISESLVVATSSTDATDNSKSESSAPDIDKKIRALKKKIRLAEAQVQGDPENLKPEQLEKMKKIEGWKEELKLLENKSSPAAS

SEQ ID NO: 53055 - protein, 456 aa, Xanthomonas campestris pv. campestris str. ATCC 33913
MSARYDYDVVVLGGGSGGLAAAFRAAKHGARVAIMEPGELGGTCVNLGCVPKKAMWLAADLASKIELAGALGFDVVRPTLTWQELVTHRQGYIGNIHASYRRRLDDDGVVLIPQRGVLQDRHTLMGADGVPVTAEHIVIATGAHPLRPHVEGAEHGHVSDDFFNLCHAPDHVAIVGGGYIAVEIAGLLQALGSRVHLFVQGERLLERFDAELTLQLADNLRHLGVRLHFGFRTTGVQRDDTGKLRMRGHSAHPGELGNDVFDQVFFAIGRRANTAGLGLEALGVELGKKGEIVVDDGQTTNVPNIHAVGDVDGKVGLTPVAIAAGRKLMDRLFGGQPDARMDYDNVPSVVFSHPPLGAVGLTEEQARERYDGAVRVYRSNFRPMLHALADAPQRSVFKLVCVGEEERVVGVHLLGESADEMLQGFAVAVKMGATKRDFDETVAIHPTSSEEIVLMH

SEQ ID NO: 53056 - protein, 265 aa, Arabidopsis thaliana
MNYSNNYIEHQNKKKTIIIFFRQFKKQKPMLRMGVHLVVINKNTFNFFNRQNNYFNSGKTKKIFVIDRFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEEQLLACARKMVAFHHKAGTGKLTGSTTHLSSFMLQEVNQLGFCFKGGKNYNKNLI

SEQ ID NO: 53057 - protein, 268 aa, Haemophilus influenzae R2846
MDLYAVWGNPIVQSKSPLIQNKLAAQTHQAIEYIAKLGDLDAFEHQLLAFFEEGAKGCNITSPFKERAYQLADEYSQRAKLAEACNTLKKLDDGKLYADNTDGIGLVTDLQRLNWLHPNQRILILGAGGATKGVLLPLLQAQQNIVLANRTFSKAKELAERFQPYGNIQAASMDSIPLQTYDVVINATSAGLSGGTAPVDAEILKLGSAFYDMQYAKGTDTPFIALCKSLGLTNVSDGFGMLVAQAAHSFHLWRGVMPDFVAVYEQLK

SEQ ID NO: 53058 - protein, 332 aa, Triticum aestivum
  misc_feature (11)..(11): Xaa can be any naturally occurring amino acid
  misc_feature (164)..(164): Xaa can be any naturally occurring amino acid
  misc_feature (167)..(167): Xaa can be any naturally occurring amino acid
  misc_feature (170)..(170): Xaa can be any naturally occurring amino acid
ITGELPAGWAXALPQYTTESPADATRNLSQQCLNALAKVVPGLIGGSADLASSNMTLLKMFGDFQKDTPEERNVRFGVREHGMGAICNGIALHTPGLIPYCATFFVFTDYMRGAMRISALSEAGVIYVMTHDSIGLGEDGPTHQPIEHLVSFRAMPNMLMFRPXWGXRLXGAYKVAVLNRTRPSILALSRQKLPHLPGTSIEGVAKGGYTISDNSTDNKPDFIIMSTGSEVEIAVKAAEELTKEGKTVRVVSFVCWELFDEQSDEYKESVLPEAVTARISIEAGSTLGWQKYVGSKGKTIGIDKFGASAPAPKIYKEYGITAESVIAAAKSL

SEQ ID NO: 53059 - protein, 718 aa, Nocardioides sp. JS614
MTPGLWRDRGERAPVWPGRSWPLGSTWSAEATNFAVHAPRATAAWVCLFDEEGRERRHPLTEQELGIWHGAIPGVAPGTRYGYRVDGPWDPAQGLRFNADKLLLDPFARAVSGDLTLDPAIFGYVEGAPDRRSDTDSAPYVPRSVVLGDDDFDWDDDAPPRHPWQDSAIYEMHVKGMTALHDRVPEELRGTYAGLATPAVVDYLKDLGITAVELLPIHQFVSETSLLERGLVNYWGYNTIGFFAPHNAYSSSGDRGQQVTEFKAMVKAFHAAGLEVILDVVYNHTAEAGTTGPTLSFRGLDDRGFYYRTGGDGHAEPFEDTYWDVTGCGNTVDASNPFALRLILDSLRYWVTEMHVDGFRFDLMSALTRVHRQIDMRSHLLTAIGQDPVLRHVKLIAEPWDASMDGYRVGEFPPPWVEWNDQYRDEIRDFWRNHTSGIRGVATRLAGSSDLYLDDGRSPYASVNFVTAHDGFTMRDLVTYERKRNEANGEDNRDGTDNNRSWNHGVEGESHDPALVAIRRRQVANMMATLCLSNGVPMITAGDERGRTQGGNNNAYAQDNETSWIDWRPDDAWLDVYEVTKTALRLRREHPALRQRHWFEGRPTLIGGPKDLAWLHPSGREMSGDDWHDPTLRAVGMFVSGAPLRAPGPRGEQQADKSFVLWFNSDWLPQRVTLPENDWVRAGEVVLSTDFRLPVGTPVKAGDQVHIGRRTVVVFRET

SEQ ID NO: 53060 - protein, 288 aa, Escherichia coli
  misc_feature (1)..(1): Xaa can be any naturally occurring amino acid
  misc_feature (13)..(13): Xaa can be any naturally occurring amino acid
  misc_feature (25)..(25): Xaa can be any naturally occurring amino acid
  misc_feature (40)..(40): Xaa can be any naturally occurring amino acid
  misc_feature (61)..(61): Xaa can be any naturally occurring amino acid
  misc_feature (68)..(68): Xaa can be any naturally occurring amino acid
  misc_feature (127)..(127): Xaa can be any naturally occurring amino acid
  misc_feature (208)..(208): Xaa can be any naturally occurring amino acid
  misc_feature (238)..(238): Xaa can be any naturally occurring amino acid
  misc_feature (258)..(258): Xaa can be any naturally occurring amino acid
  misc_feature (284)..(284): Xaa can be any naturally occurring amino acid
XDVTAKYELIGLXAYPIRHSLSPEXQNKALEKAGLPFTYXAFEVDNDSFPGAIEGLKALKXRGTGVSXPNKQLACEYVDELTPAAKLVGAINTIVNDDGYLRGYNTDGTGHIRAIKESGFDIKGKTXVLLGAGGASTAIGAQGAIEGLKEIKLFNRRDEFFDKALAFAQRVNENTDCVVTVTDLADQQAFAEALASADILTNGTKVGXKPLENESLVNDISLLHPGLLVTECVYNPHXTKLLQQAQQAGCKTIDGYGXLLWQGAEQFTLWTGKDFPLEYVKQVXGFGA

SEQ ID NO: 53061 - protein, 148 aa, Thermosynechococcus elongatus BP-1
MLQSCSRWPSRLLVLGTLGVGLAMAPLFWRPADSQEPPSQALTIIADVQQANAITGVITARGNVQLRYPARQIQATAAQAQYFSREGRIVLSGNVYVLQQGNSLRADTITYLIREAKFVALPAPSRQVESILMIPDDPNQQILTPVQP

SEQ ID NO: 53062 - protein, 350 aa, Arabidopsis thaliana
  misc_feature (266)..(266): Xaa can be any naturally occurring amino acid
MGSLPPPSLDFSSIDHNSLKNGGSSHQEISHDNLLNLFKSQQDLLNHFFKHLDLSQTLDFSRILLSTTGTVFFTGVGKSAFVANKVSQTLVSLSFRSSFLSPLDALHGDIGALSPRDVLVFFSKSGATEELLRLVPCARAKGAFLVSLTSVSGNPLAGVCDMNVHLPLQRELCPFNLAPVTSTAIQMVFGDTIAVALMAARNLSKEEYAANHPAGRIGKSLIFKVKDVMKKQEELPVCKEGDLIMDQLVELTSKGCGCLLVVDEHXRLIGTFTDGDLRRTLKASGEAIFKLSVGEMCNRKPRTIGPETMAVEAMKKMESPPSPVQFLPVVNEDNTLIGIVTLHGLVSAGL

SEQ ID NO: 53063 - protein, 104 aa, Zea mays
  misc_feature (24)..(24): Xaa can be any naturally occurring amino acid
MVRKAKVEFDEQPPDNFDPKNPYXDPVAMLEYREHLVREKWIQIETAKIIRERLRWCYRIEGINHHQKCRHLVDQYLEATRGVGWGKDARPPELHEPKKIIEAE

SEQ ID NO: 53064 - protein, 196 aa, Erwinia carotovora subsp. atroseptica SCRI1043
MTASALVCLAPGSEEIEAVTTIDLLVRAGITVTLASVASDGNLEIVCSRGVRLLADAPLAMVADRSFDVLVLPGGLKGAECFRDSPILVECVRQTHLEGKIVAAMCATPALVLEYHQLFPVGNMTGYPTFKDSIAPEKWMEKRVVYDPRVNLLTTQGPGTSMDFALKIIDLLLGKEKAAEVAAQIILPPGIYNYHD

SEQ ID NO: 53065 - protein, 441 aa, Chromobacterium violaceum ATCC 12472
MLFSELGLSPEILRAIDEQGYSQPTPIQEKAIPLVLSGRDLLAAAQTGTGKTAAFMLPILERLKKFANTSVSPAMHPIRALVLSPTRELADQIGVNVQTYTKYLPLRATTVFGGVNMDPQTQELRRGVEILIATPGRLLDHIQQKTVQLNKVEVLVLDEGDRMLDMGFIQDIRKIMGMLPKERQTLLFSATFAPEIKRLAADFMHAPQTVEVARQNATNDQVEQLVFQVDNFKKRQLLAHLIRSREMSQVIVFCKTKISADQLARDLKRDGLDAEAIHGDKTQGARLETLAGFKEGKLRVLVATDVAARGLDISELPYVVNFELPTSPEDYVHRIGRTGRAGAKGIAISLMCPDESRQHEAIEKLTKQTLTPQSVDGFWPSWLPRPKPAREPSSASPSMPALSAGKSEGLKQARPGRRSRKAKREIPALLLPPRYKVEIIR

SEQ ID NO: 53066 - protein, 933 aa, Arabidopsis thaliana
MVRISLLLLCLLVSTCLFTSSSAQAPGFVSLDCGGAEPFTDELGLKWSPDNHLIYGETANISSVNETRTQYTTLRHFPADSRKYCYTLNVTSRNRYLIRATFLYGNFDNSNNVYPKFDISLGATHWATIVISETYIIETAELVFLASSPTVSVCLSNATTGQPFISTLELWQLSGSMYGSMLSEDRFYLSVAARINFGAESEASVRYPDDPYDRIWESDLQKKPNYLVDVAAGTVRVSTTLPIESRVDDRPPQKVMQTAVVGTNGSLTYRMNLDGFPGFGWAFTYFAEIEDLAEDESRKFRLVLPEQPEYSKSVVNIKENTQRPYRVYAPGYPNITLPFVLNFRFAKTADSSRGPILNAMEISKYLRKSDGSVDATVMANVASLYSSTEWAQEGGDPCSPSPWSWVQCNSDPQPRVVAIKLSSMNLTGNIPSDLVKLTGLVELWLDGNSFTGPIPDFSRCPNLEIIHLENNRLTGKIPSSLTKLPNLKELYLQNNVLTGTIPSDLAKDVISNFSGNLNLEKSGDKGKKLGVIIGASVGAFVLLIATIISCIVMCKSKKNNKLGKTSELTNRPLPIQRVSSTLSEAHGDAAHCFTLYEIEEATKKFEKRIGSGGFGIVYYGKTREGKEIAVKVLANNSYQGKREFANEVTLLSRIHHRNLVQFLGYCQEEGKNMLVYEFMHNGTLKEHLYGVVPRDRRISWIKRLEIAEDAARGIEYLHTGCVPAIIHRDLKTSNILLDKHMRAKVSDFGLSKFAVDGTSHVSSIVRGTVGYLDPEYYISQQLTEKSDVYSFGVILLELMSGQEAISNESFGVNCRNIVQWAKMHIDNGDIRGIIDPALAEDDYSLQSMWKIAEKALLCVKPHGNMRPSMSEVQKDIQDAIRIEKEALAARGGISDEFSRSSAHSSSLNMGMLDLAGSQSYVSIDESVLQPTAR

SEQ ID NO: 53067 - protein, 353 aa, Haloferax volcanii
MVSVTDLQTMYEQMVTARHYEERLVDEYLVGKQPAFDISAGPIPGELHLAAGHEASGAGVCMHLRDDDTVTAPHRPHHIAIAKGVDLKRMTAEIFGRKTGLCRGKGGHMHLFDPDVNFACAGIIAQGCPPAVGAAMAAKKRNTDSVAVAFLGEGAIDQGGFLESLNLAAVHDLPVVFVVEDNDWAISMPKDRVTDVQNGAQRAAGFDLPGVRIDSDDATAVYEAAGEAVMRARDGNGPTLIEVQVHRRMGHFMGDAEAYRPEADIDRAKQRDSIERLAADLRSHGVTDDDIDEMRERAHGRVEAAISWAKEQPEPEPAEAYENVFTNPPAQAATDGGSAADAPGDAGETGGDN

SEQ ID NO: 53068 - protein, 108 aa, Oryza sativa (japonica cultivar-group)
MEGGRGVTRVLLVDDSPVDRRVVQLLLSSSACAGSFHVIAVDSAKKALGFLGLKEKGKEQAIDMVLTDYCMPEMTGYELLKAIKALSPLKPIPVIVMSSENEPQRISR

SEQ ID NO: 53069 - protein, 346 aa, Haloferax volcanii
MATESRDYTEATETDRELTMSRAMVEAIAWEMRENEEVFYMGEDVADYGGIFSSTTGLLDEFGRDRVMDVPISETAYLGAAVGAAQAGMRPIAELMFVDFFGVAMDQIYNNMAKNTYMSGGSFSVPMVLTTAVGGTYNDAGQHSQTLYGTFAHLPGMKVVVPSTAYDAKGLMHTAIRDDDPVVYMFHKRLMGLGWMPSPSGPKTGVSEEDYAIPFGEADVKRPGDDVTVVTLGLHVHRAMEAAERLDDDGIDAEVIDLRTLVPLDTETVLDSVRKTGKLLVVDEDYRSFGVTGEIIARAAEGALDDLSAVKRLAIHDVPIPYARPLEDEVNPGTDDIAAAVRELHE

SEQ ID NO: 53070 - protein, 544 aa, Coccidioides immitis RS
MSLYFDVVSILTAPLEVGGSLKSRIYNSRLKSSPPQIYALITEVTKWNAVLKEVVDSSDILAHEPKLTPLLSLLLTHDLLLSKRGIASPSNHPLRLAVERHKTRLNAEFTRIRIRRGCASVEQLRSAIETATNRDAGDKALPSPRWVRINNARTTLEQELNTTFAGYTPVTSLHGLSTSTTRAYYADKHIPDLIAVASTSQLLSTPAYKQGKIILQDKASCFPAYLLLGDQAASWSGDLIDGCAAPGNKTTHLASLLSAAGRKGAKIYSLDASPTRSKILQKMVGIAGVDDRVTVLAGQDFLALDPEDPRFKNVTGLLLDPSCSGSGIVKREDVPRLDLPEPKSQNSRGFVNSGPNSRKRKRKPGPPEASTSESPAPDTFENEAVGGEVDISRLTKLSNLQAQIIEHAFKFPCATRITYSTCSIHAQENENVVYRALQSSVARERQWKILPRSEQAEGLKNWPHRGWLKREHKPVDGEETWELTDMESEACLRCSARDVEGTGGFFVAGFVREQNSTSNSSKGEVTEDGDSDGSDETWHGFDSD

SEQ ID NO: 53071 - protein, 299 aa, Rhizobium leguminosarum bv. viciae 3841
MITVFGSINMDLIATTERLPKPGETVAGNGFATAAGGKGANQALAARRAGRYVHMAGAVGKDAFAAEALALLDDAGTDLSLIKHVDGPTGTALILVGGDGENMIAVVPGANGQVTPADAETAIGRMNEGDILMLQLEVPVAAVERALSAARAKGVTSILNLAPLIPDAPRLGRLADIVIANETEFERLAGQEGMDAQAREAALVRLHAETGQTLIVTLGADGVIAIRDGAISRAQGLKIEPVDTVGAGDTFCGYFAASLDDGLDFVSALRRAAVAGSLACLEAGAQPSIPLSEEVADRI

SEQ ID NO: 53072 - protein, 544 aa, marine gamma proteobacterium HTCC2080
MYKYNPIDQAIVDARVSQFSEQMTRYLAGELPEEQFMPLRLQNGLYIQRHAPMLRVAIPYGTLAGYQLRHLAQIARKYDRGYGHFTTRQNIQFNWLALEQVPEVLGELATVQMHAIQTSGACVRNTTTDPLAGTVADEAIDPRVVCELIRQWSTFHPEFAYLPRKFKIAVVATEEDRAAIEVHDVGIRIKKHVIHGLAFDLWVGGGLGRTPLLGHRLLADLPLDELRNWLTAVLRVYNLAGRRDNKYKARIKILVNAMGVEAFREAVTHRYLTDHDSDLKISAETLEDLGDSFSCKLEPQPIEGHQGSLDFQRWYRQNTKPHRIMGYRSVFLSLKRPGTAPGDVTALQMDVIADLADRFSQSEIRTTHDQNLILPHVAESDLKELLQCLSAHDLAHPNLGLISDSIACPGLDFCSLANAPSLSLAEALHETFDDLDEQVDIGPLEVKISGCMNACGHHHIAHIGILGVEKKGQPWYQITLGGRDQQGAALGKRLGPAVPHDDVLPLIKRLVDTYLEERQPGEYFVGFVDRLGVDYLKEISYATH

SEQ ID NO: 53073 - protein, 384 aa, Arabidopsis thaliana
  misc_feature (363)..(363): Xaa can be any naturally occurring amino acid
MASIVLRSRLLPRLAKLRSRNLRCFSAEASSTNSTSRYSGVTSTQSMFSDFPPPNQPPPPPPPQVEAAAAAATGKERKGLKYLGYALLWALTGATAATGYASFAYTIDEVNEKTKAFRESATKTPVIKSSGIDVIDKYQTKLYSAAMTGSARAIDKYLELREIVEEQVKGFTEPLSEKLLPDLHPAEQHVFTLVLDLNETLLYTDWKRERGWRTFKRPGVDAFLEHLGKFYEIVVYSDQMEMYVLPVCEKLDPNGYIRYKLARGATKYENGKHYRDLSKLNRDPKKILFVSANAFESTLQPENSVPIKPYKLEADDTALVDLIPFLEYVARNSPADIRPVLASFERKDIAKEFIDRSIEYQKXESKDNWDKVDSGGVKGSKIYV

SEQ ID NO: 53074 - protein, 225 aa, Zea mays
MASGGGGGYGDPSQKIDYVFKVVLIGDSAVGKSQILARYARDEFSLDSKATIGVEFQTRTLVIDHKSVKAQIWDTAGQERYRAVTSAYYRGAVGAMLVYDITRRQTFDHIPRWLEELRAHADKNIVIILIGNKSDLEDQRAIPTEDAKEFAEKEGLFFLETSAFNATNVESAFSTVLNEIFNIVNKKSLAVSEEEQHGSLAGKKIDIVPGPGQVIPAKSNMCCNS

SEQ ID NO: 53075 - protein, 353 aa, Actinoplanes sp. A40644
MSDTTLTASVPLRWVGPLRITGNVGDIETEVPLATYESPLWPSVGRGAKISRLVGPGIVTTLVDERMTRSVLVRAEDAQTAYMAALEVDARLDELREIVRTCGRFVELIGFHHEITAHLLYLRFDFTTGDASGHNMATLAADALLAHILKTIPGISYGSISGNYCTDKKATAVNGILGRGKNVITELTIPRDIVRDNLHTTAAAIAELNVQKNLIGTLLAGGIRSANAHYANMLLGIYLATGQDAANIIEGSQGVTVAEDRDGDLYFSCTLPNLILGTVGNGKGLDFVEENLARLGCREAREPGENARRLAVITAATVLCGELSLLAAQTNPGELMQAHVRLERDNTTAKIGE

SEQ ID NO: 53076 - protein, 175 aa, Debaryomyces hansenii CBS767
KYLDESYTKHKIIPDVVDKFDTQGLLTIEYNEQDHVALGNTLKVENTQHHPVIQFTLNSPGQENDFEISNNDKFTLVLTDPDAPSHKDHKWSEYAHWIVTDLPLNANSNDVESAESLTTVLDYSKGKELLSYQGPAPPPKTGKHRYVFLLFREDPSVSKFETPKDRPNWGIGIES

SEQ ID NO: 53077 - protein, 164 aa, Mesorhizobium loti MAFF303099
MMSALSQAAKSLLLQDFVSAFFLSMRQFFAPKETINYPHEKGPVSPRFRGEHALRRYPNGEERCIACKLCEAICPAQAITIEAGPRRNDGTRRTVRYDIDMVKCIYCGFCQEACPVDAIVEGPNFEFATETREELYYDKDKLLANGDRWERELARNISLDAPYR

SEQ ID NO: 53078 - protein, 269 aa, Triticum aestivum
GTIWTNFYQKTGWYRSRISRNLFTPRVREWGPRTLTWTEGLEKARVPPPSRLYTYIVQAWPPTVMASSATSVGPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGNPSPPHSRQAIYKVPLQFVNSDIALGFPSPFIFLICS

SEQ ID NO: 53079 - protein, 979 aa, Oryza sativa
MSPASIAALRHLAAVLSILAHCLLLSSADVDFIYNGFRNAANLSLDGSATVLRGGALQLTNDSNNIMGHAFFDSPVQMVSDAAVVSFSTAFVFDIVTNGSVGGHGLAFVVAASKVLPGATAEQYLGLLGKSNMGDPSNHVFAVEFDTVQANGLLNETNGNHVGVDLNSLVSNVSEPAAYFTDGGGGKRNLTLESAQPIQAWVDYDGSAKILNVTIAPVASTVPTRPRRPLISHAVDLLPIFKQEMYVGFSSSTGKLASSHYVLAWSFRTGGGAARPIDLSRLPSVPKKPAPPPSASVVVKIVALTCAATVTVIVAAIGVALWLRRRAALADTLEEWELDHPHRLPYRELYMATKGFKNSELLGAGGFGEVYRGVLRRSGDVVAVKRISSNGRQGMREFVAEVASLGRMRHRNLVELRGWCKRGHDLLLVYEFMPNGSLDALLFGGAPATATATALTWEQRVRILRGVASGLVYLHEEWEQVVVHRDVKASNVLLGADASAARLGDFGLARLYEHGGDPATTRVVGTLGYMAPELTVTGKATTATDVFAYGALLLEAACGRRPIDPATGVNLLRWVREHGARGELVHAVDERLDGRYDKEEARLVLWLGLACSQARPEARPSMRQVCQYLDGEEDVPEEAVLVFSDVDSIDFGSLTSLTWSSCATMSVGSLNGGRGEGARCAVDEMKEVVLHVYDVTNSDSEKTNNTILQINRIFKDRIGLGGIFHSAVQVRLRAASQIPPSEGRICFCFAFAFLPPPDLADFGWFSLALFCSDPGGAQVYGEEEWSFGFCENGSGVFSCPIGKNPMYTYRECIVLGETECSIATVNRILRELSREWPGHSYDLLSRNCNHFCDVLCERLAVPKLPGWVNRFANAGDTAVVVAENTAVKFRQAKTEIVNASRVAYRFMAGLASKNQNPQPESPSNQSRNGPTFQGTWFKNIISNGAKPSSSESTSSHDTGTGGDESSLQNQKPSEQSTRL

SEQ ID NO: 53080 - protein, 701 aa, Oryza sativa
MLRRRRSSVVHAVLFFAAVALLESLAAQPWPKCGNGGTFTAGSTYETNLKNLALILRTNASSGSSPTLFASGALGSAPDTVYGLLLCRGDLSSSDCAGCGTNVSRDAVAGPTCNRTKDAILVYNECYAQFSDKGDFLAATDNSGEYSALQSGTNISSTDVAGYDRAVTELLNATVQYAVENSTRLFATGQRVGTDPGFRNIYSMAQCSPDLSPGQCRSCLDGLVDQWWKGFLFPRNGEGARVSGPRCSLRSELGPGPFYTGRPMVLLPVKADGLTPAPDVVPAITGVIIFHCKNAGKNNSASKILVITLPTVTVAIVAAISLCIWNVRKKRRLAKADSRREADRTEDFESVKSALLSLTSLQVATDNFHKSKKIGEGGFGEVYKGVLSGQEVAVKRMAKDSHQGLQELKNELILVAKLHHKNLVRLIGFCLEKGERLLVYEYMPNKSLDTHLFDTEQRKQLDWATRFKIIEGTARGLQYLHEDSQKKIIHRDMKASNILLDADMNPKIGDFGLAKLFAQDQTREVTSRIAGTFGYISPEYVMCGQYSTKSDVFSFGILVIEIVTGQRRNSGPYFSEQNGVDILSIVWRHWEEGTTAEMIDHSLGRNYNEAEVVKCINIGLLCAQQNPVDRPTMVDVMVLLNSGTEGFRCGDATSCSGEASNGDDGASRASASRTKQVAAALAAEQAAAGHRGLRQWRRTTS

SEQ ID NO: 53081 - protein, 329 aa, Arabidopsis thaliana
  misc_feature (70)..(70): Xaa can be any naturally occurring amino acid
  misc_feature (132)..(132): Xaa can be any naturally occurring amino acid
MQSQTNPNPSLPDDLILSCVARVSRLYYPALSLVSKSFRSLIASPELYKTRSLLDRTESCLYVCLKLNPXDEKPRWFTLFRKHTGTLKSSGYVLATVPFPHTPLESSSSSIVSVCSSIYNIGGYELPSSSVXILYCTSNTWHEGPRLRVKLMSCTACVLDEKIYVSGRCKDGDSMTFQVFDTNTQTWDPLSVPCSETKHDFHYKIVRFDGKLHLVSYKGNVWYTIVKGDISTSVWWYHSEEREWRDLKGMVGLPKFPIDACLRMVDYGGKMAVLWDDYLPGRRKKMIWCAEIALERRGSLEIWGKVEWFAHVLTVPRQYEFVKVLAATL

SEQ ID NO: 53082 - protein, 492 aa, Arabidopsis thaliana
MWKQILSKLPKKSSSKNHSSSSSSTSKSSDNGAGKSGNSQTKNAPPVKPSADSGFKEGNLKGNGNGFTPYEALPGFKDVPNAEKQNLFVRKLSLCCVVFDFSDPTKNVKEKDIKRQTLLELVDYVASPNGKFSETVIQEVVRMVSVNIFRTLNPQPRENKVIDALDLEEEEPSMDPTWPHLQLVYEILLRLIASPETDTKLAKKYIDQSFVSRLLDLFDSEDPRERDCLKTVLHRIYGKFMVHRPFIRKSINNIFYRFVFETEKHNGIAEFLEILGSIINGFALPLKDEHKVFLVRALVPLHKPKSLQMYHQQLSYCITQFVEKDCKLADTVIRGLLKSWPVTNSSKEVMFLNELEEVLEATQPPEFQRCMVPLFRQVARCLNSLHFQVAERALFLWNNDHIENLIMQNRKVILPIIFPALERNTQKHWNQAVHSLTLNVQKIFNDIDAELFKDCLAKFREDESKEAEIGAKREATWKRLEEIGNQKKKSSL

SEQ ID NO: 53083 - protein, 199 aa, Helicobacter bizzozeronii
MVKIGVCGPVGSGKTALIEALTRAMSQQYSIGVITNDIYTKEDAEFLCRNSVMPRERIIGVETGGCPHTAIREDASMNLEAVEELHAKFPDIELMFIESGGDNLSTTFNPELADFTIFVIDVAEGDKIPRKGGPGITRSDLLIINKIDLAPYVGADLGVMDRDSKKMRGDKPFLFTNIRSKEGLDHVIGWIKKYALLED

SEQ ID NO: 53084 - protein, 447 aa, Rhodococcus sp. RHA1
MSTRDQVAEIYEQVRLRNAGEPEFHQAAAEVFESLQVVLDHHPHYADSGLIERLCEPERQIIFRVPWVDDSGNVHVNRGFRVQYNSVLGPYKGGLRFHPSVNLGIVKFLGFEQIFKNALTGLPIGGGKGGSDFDPKGRSEAEIMRFCQSFMTELHRHIGEYTDVPAGDIGVGGREIGYLFGQYKRLTNSYESGVLTGKGLTWGGSQVRREATGYGVAYFVAEMLKAANSSLDGKTVVVSGSGNVAIYAIEKVHQLGGIAIASSDSSGYLVDEKGIDLELLKEIKEVRRGRISEYADTVPHARFVPNGSIWDVPCDVALPCATQNELDEAAAKTLVANGVQAVAEGANMPTTPQGVQVFRDAAVAFAPGKAANAGGVATSALEMQQNASRDSWGFEYTDERLAGIMRGIHERTVATAAEYGMPGDYVHGANIAGFVKVADAMISLGVI

SEQ ID NO: 53085 - protein, 496 aa, Acidovorax sp. JS42
MEMKTSPLSLLKDPSLLKTDALLGGQWFAGGARFAVHDPATGLKLADVANLGAKEAELAIAAANEAWPAWKAKTAKERSTILRQWFDLLMQHQDDLGRLMTAEQGKPLPEAKGEVAYGASFVEWFAEEAKRVNGETLPQFDNNRRLLVLKQPIGVCAAITPWNFPLAMITRKVAPALAAGCPVVIKPAELTPLTALAAAELALRAGIPAGVLSVLTADAENSIAIGKVLCASDVVRHLSFTGSTEVGRILMAQCAPTVKKLSLELGGNAPFIVFDDADLDSAVEGAFASKYRNAGQTCVCTNRFYVQAGVYDAFVAKFAARVKTAKVGNGFEDGVNQGPLIEPAAVDKVQRHLDDAIAKGASVVTGGKHLAELGAGQFFEPTVLANATAGMLCAREETFGPLAPVFRFETEQEAIAAANATEFGLASYFYSRDVGRIFRVGEALEYGMVGVNVGILATEHVPFGGVKQSGLGREGSHYGMDDYVEIKYLCVGDIQK

SEQ ID NO: 53086 - protein, 397 aa, Wolbachia endosymbiont strain TRS of Brugia malayi
MSDLAKRMLLIKPSPTIAVTDKANRLKDEGKKICILAAGEPDFDTPDHIKKVAIQAIDEGKTKYTAVDGTRELKEAIISKLKRDNNLEYALSQVCVGAGAKQVLFNLFMATVNPGDEAIIPAPYWVSYVDMVSLFGGLPVVIECGQGLKLTPELLKNKVTKKTKWLILNSPNNPAGVVYTYGELEGIAQVLLEYPHVNIITDDIYEHIIYDEKFFTIAQVEPKLYNRVFVVNGVSKAYAMTGWRIGYIAGRSDVVKAISTLQSQSTSNPNSIAQAAAVEALNGDHSFLKERMGIFKSRRDFVIEKLNSAPGLLASIPQGAFYLFVSCKDLLGKSTKSGKVINNDLDFAEYLLEDHLVAVIPGIAFGLKNFIRISYATSQEQLEIGCNSIIKACKMLS

SEQ ID NO: 53087 - protein, 133 aa, Paraboea crassifolia
MEPYGNHQIGDQLRKTDEYGNPVHHTPGGEYGGPHVGAEHHHGAPISIPPTTDVPHHRRSGSSSSSSSEDDGQGGRRKKGIKDKVKEKLPGGHKDNQPHHEAGYGGGYGAQPEPEKKGMMDKIKEKLPGGHRN

SEQ ID NO: 53088 - protein, 139 aa, Pinus sylvestris
SSSSSSSDEEGEGGKKKEGGRKKKGSKDKSKEKLPGAGQHSSDQCGGKEEKKTGLLDKIKEKIPGHQEKLSGGGTHSSDECGGKEEKKTGLLDKIKEKIPGHQEKLPGDGKHSSDEHGGEEEKKLGVLGKIKEKLPGHK

SEQ ID NO: 53089 - protein, 139 aa, Pinus sylvestris
SSSSSSSDEEGEGGKKKEGGRKKKGSKDKTKEKLPGAGQHSSDQCGGKEEKKTGLLDKIKEKIPGHQEKLSGGGTHSSDECGGKEEKKTGLLDKIKEKIPGHQEKLPGDGKHSSDEHGGEEEKKLGVLGKIKEKLPGHK

SEQ ID NO: 53090 - protein, 287 aa, Francisella tularensis subsp. tularensis SCHU S4
MSDINIKIGLAEMLKGGVIMDVVNAEQAEIAQQAGAVAVMALERVPADIRKDGGIARMSDPKLIKEIMSVVSIPVMAKARIGHFVEAQILESLGVDFIDESEVLTPADELNHIDKDSFKVPFVCGCTNLGEALRRIGEGAALIRTKGEAGTGNIVEAVRQLRQVNKDINYIKNADKSELMAIAKNLQAPYDLVTYVHKNGKLPVPNFSAGGVATPADAALMMQLGAESVFVGSGIFKSADPLKRARAIVSAVTYYNDAKILAEVSEDLGEPMTGINCDFEKFSQRGW

SEQ ID NO: 53091 - protein, 1725 aa, Burkholderia mallei ATCC 23344
MQTVVLGWFGFSAVWFIPLFWRLVKAALPGGGGLAGPGSIRLWLGFVGVLTASCTLATALTGDATTNALGHALARGFEHVFGHVGTPFAMIALFVVGLPWLVGVRWRQVNAWLDASFGIRFARERGDEEPRGVADLPRAALHRDDDRRVRRAADVQPTTAHTVNSMAPRQNGRYARPTLWKPNDAQRGERRSASAGGAARAAAEPTAPAGWLKPGAQPRGAQPAAAMATGAAAAGASTAGFAKAAGAAAAVTSPAAFAPAAIGIAKPIGSTAAVAALGKRAQARPTAPDPRFAPRRPATQAAVSAARNRPMTFTPSRQTTGATPPQPAPPAQTAAPTAETARKRAPANPARAPLYAWHEKPAERIAPAASVHETLRSIEASAAQWTALAGATSTAATPVTARESIAAPAAPSGGAAASAARDGRAPTSAETAAPDGHAPTSAETVAPDGHVPTSAETAAPDGHVPTSAETAAPNDHASTSAETVAPDSHAPTSAETAAPDGHASTITEATAPNGHVSATVETSAVAAPAGITQAAPPIAADICPAGEHVIAAVEPACTSDSAAIGAGAIAHAEAGAAASTAETASPIGADTHIAPSREADRTAQTAPTAPSPAEATPHVDAPHALDVAARALVGNTAATAHGAAAVNGSAQRADTASPAASTSGPPAPVAASAASSDRAAPQPVATAAPASIATSGALGTMKASGTAGPQPSTIAAQRASAIDDTGQPPSTGHSTHAAVSNELGRRPHAAPDAVTPVLPPAAAAVPTNASAVQRQALASESAEAAQGVARAAAAGDSRETTQVSPAGARPDGAAPSAAVANPIAPLPDASAITAHEDAPTSAAPDAATPVIAAMDSAMPNAVAPASAIASNAGMSPASASAAAPRMASAPASAAVPDAHPPLPRAAAAVPGVASIGMAAPGVIVTNAATALPAAPGRIASPAGASAVAPGAITPNAASTDVAPAAAPASDVSPNVVPAPAVGANASVPPAGASSAARHVNAPMVASTGAAAPAPSIPSSLPPSTVTSNAERRATTTAPTAAPAGLAPNPVAASSFVAPTTSAAPGQFAPAATAPADNAPAAAEAPPGRVPNPPAGAGFVTPTSPTPGPLPPAAETPAATATPTAPPPGLAPNPPAGAGFAATPEAVAHPFGNPSAPAPGAIPESPATAPSVALTANGTEAPGAPQAFAPSPVPAMPAAPAAADPASAAPAAEPVRPSRPPAPNAFEFHAPAASNVELPTLDLLEPASDTIEAISDEHLAQTGQIIEQRLQEFKVPVTVVGASAGPVITRFEIEPALGVRGSQIVGLMKDLSRGLGLTSIRVVETIPGKTCMGLELPNAKRQMIRLSEILASRQYQHSASQLTIAMGKDITGNPVVTDLAKAPHMLVAGTTGSGKSVAINAMILSLLYKATPEDVRLIMIDPKMLELSVYEGIPHLLAPVVTDMKLAANALNWCVGEMEKRYRLMSALGVRNLASFNQKIRDAAAKEKKLGNPFSLTPEDPEPLSTLPLIVVVIDELADLMMVAGKKIEELIARLAQKARAAGIHLILATQRPSVDVITGLIKANIPTRVAFQVSSKIDSRTILDQMGAESLLGQGDMLFLPPGTGYPQRVHGAFVADEEVHRIVEYLKQFGEPQYEEGILDGPSAEGGTQDLFGEAPDAEADPLYDEAVAFVVRTRRASISSVQRQLRIGYNRAARLVEQMEAAGLVSPMGINGSREVLAPPLPE

SEQ ID NO: 53092 - protein, 198 aa, Cynodon dactylon
MAAAVASLYRRVLPSPPAVDFASPEGKRLFAEALSAGTMEGFFSLISCFQTQSEPAFCGLASLAVVLNALAIDPGRRWKGPWRWFDESMLDCCELLDKVKAQGITFGKVACLAHCSGAKVQSFRANRATINDFRSHLVRCVSSQDCHLIASYHRKPLQQTGTGHFSPIGGYHAGQDMALIFDGARFKYPPHWVPLPLP

SEQ ID NO: 53093 - protein, 282 aa, Atriplex canescens
MSKEVISEEGQVHQHGKDYVDPPPAPFFDMGELKLWSFWRAAIAEFIATLLFLYITVATVIGYKKETDPCASVGLLGIAWSFGGMIFVLVYCTAGISGGHINPAVTFGLFLARKVSLLRALVYMIAQCAGAICGVGLVKAFMKGPYNQFGGGANSVALGYNKGTAFGAELIGTFVLVYTVFSATDPKRSARDSHVPILAPLPIGFAVFMVHLATIPITGTGINPARSFGAAVIYNKKRVWDDHWIFWVGPFVGALAAAAYHQYVLRAAAIKALGSFRSNPTN

SEQ ID NO: 53094 - protein, 472 aa, Klebsiella oxytoca
MTTLSHDSTTMPRTQRDTRRMNQFVSIAAAVAGLLFGLDIGVIAGALPFITDHFVLSSRLQEWVVSSMMLGAAIGALFNGWLSFRLGRKYSLMVGAVLFVAGSVGSAFATSVEMLLVARIVLGVAVGIASYTAPLYLSEMASENVRGKMISMYQLMVTLGIVMAFLSDTAFSYSGNWRAMLGVLALPAVVLIILVIFLPNSPRWLAEKGRHVEAEEVLRMLRDTSEKARDELNEIRESLKLKQGGWALFKVNRNVRRAVFLGMLLQAMQQFTGMNIIMYYAPRIFKMAGFTTTEQQMVATLVVGLTFMFATFIAVFTVDKAGRKPALKIGFSVMAIGTLVLGYCLMQFDNGTASSGLSWLSVGMTMMCIAGYAMSAAPVVWILCSEIQPLKCRDFGITCSTTTNWVSNMIIGATFLTLLDAIGAAGTFWLYTALNVAFIGVTFWLIPETKNVTLEHIERRLMSGEKLRNIGN

SEQ ID NO: 53095 - protein, 474 aa, marine gamma proteobacterium HTCC2080
MDNLQKFYIDGAWVSPDSTNTMPVINPATEQIVATVALGNAADVDRAVAAANQAFKTFSMTSKQERLALLERIKTVTEARFEDLAQAMREEMGAPITFAREAQADAAIGHLQGFADALEQLEEEIDLGNGELLVREPIGVCGLITPWNWPINQIALKVLPALAAGCTCVLKPSEHTPLSAIIYAEILHDAGCPPGVFNLVNGEGPEVGTAMSKHPDIQMMSFTGSTRAGTAVTHDSAESVKRVTLELGGKSANLVFADSDLEERVQNAVAECMANTGQSCDAPTRLLVERSCYDEVVEIARQATIATQVGDPTEEGNHIGPLFDRIQFDRVQTLIGVGIDEGAHLIAGGLGKPEGLETGWYVKPTLFSDVHNQMRIAREEVFGPVLVIIPFETEDEAIAIANDSPYGLAAYLQTGDPIRARRVARQLRAGAVHINGGVYEYGSPFGGYKQSGNGREGGMMGLEDYLETKILHGL

SEQ ID NO: 53096 - protein, 353 aa, Coccidioides immitis RS
MANPSRYSPLTKLPIQLPIIDISNTRPETGKAMIDAATKYGFLYVDSVTSDFSDEDVESAFAMARKFFASPHEEKVQVKIGSNNRGWTGMHVETLDPNHQKRGDFKEAFNFGEFKNDKAQQPLPSSLVPHEAEISRFMNLCRKTCDRILTLLALGLGIPSDWFTTRHDSSKGPSGVTFRFLYYPSIQSPSTSTFQQNIDVRAGAHSDYGSITLLFQRDGQPGLEIQTPTGGWAPVPIRPQQESTTTSFPPILVNIGDLLSYWTNGLLKSTVHRVVFPVEQQSGSSHGDDRYSMAYFCHPLDDTELVPVPSKLVEQHRDAIAGYGPNADKIMTARDHLASRLAATYGGNPNEYK

SEQ ID NO: 53097 - protein, 342 aa, Zea mays
  misc_feature (285)..(285): Xaa can be any naturally occurring amino acid
MDSRCPHLLLLLPLLLLAALLPPPSSGVPEVIWLPTSGGAGPLSCAPPDPAVYDRPVIGIVSHPGDGAGGRISNTTATSYIGASYVKFVEAAGSRVIPLVYNEPEDRLLEKLSLLNGVLFTGGSEKEGVYFDTIKRVFQYVLDKNDAGEPFPLFAQCLGFELVSMIVSKDNNILEAFDAQDQASTLQFPSYALEGSVFQRFDTDLIKKVSTNCLVMQNHRYGISPRRYRENDALSSFFKILTTSPDENGKVYVSTVQANNYPITCTQWHPEKAIFEWRKPMIPHXEDAVQVTQHFANHFISQARKSPNRPPADKVLDNLIYNYSPTFTGKKSKSFEEVYIFS

SEQ ID NO: 53098 - protein, 133 aa, Debaryomyces hansenii CBS767
RTTLQFGVDYVPPDNQNAYILTIAGFIYVSGQIPYTPDNKPLSENPSIPEQAEQVIQNVSNILEASNSSLKHIVKANIFLTDMPTQFPQFNLVYGKYFSEHKPARSCVAVKALPLGVDLEMEVIAIEKEDPKL

SEQ ID NO: 53099 - protein, 516 aa, marine gamma proteobacterium HTCC2080
MASPMPHIEAFKLTLPDVVTGHVAGLSVLANSSATILPVHFPGTGESIASLQEDDATQVIAAVNVARERFRSGDWSKCTTTEKQSVFRAAAQAIRNNAHELALQESLCAGLPFAHLASRQIPRAAENFDFFADYIGQLAGETYDQLHDYRTVVTRQPAGVAAIFTPWNACLALSSMQIASCIAFGNSCVLKPSEFAPLAVLQLVRLLESVGLPTGVVNVVNGRGSVTGAALATAAGVDRISLTGRGDTARKVMAAAAAQLTPVHFELEGNSANIIFDDADIDRAIDGALVSAFGNSGQICIAGSRILVQQNIADRFIDAFVARTKNLQVGDPLDNRTEVGPMAFAQHQQKVLNYFALAENTDATLLTGGRAMPELGGGYFVAPTVFKVLDNNSPLCQEEIFGPVVTIQIFNEDEEAWTIANDSPFGLIGYCWTESLHRAQLFQQRLEAGTLWLNTPIARDLRAPFGGFKASGIGRDGPRHAADFFTEEKATIAALGKPPIRRMGVSRQHEDNDDGA

SEQ ID NO: 53100 - protein, 429 aa, Bacillus cereus E33L
MKKFDKSIAAFEEAQDLMPGGVNSPVRAFKSVGMNPLFMERGKGSKVYDIDGNEYIDYVLSWGPLIHGHANDRVVEALKAVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLQFFAAYYREMVEQGVFLPPSQFEGLFLSTAHSDADIEATIAAAEIAMSKLKA

SEQ ID NO: 53101 - protein, 179 aa, Candida albicans
MGLTISKLFASLLGRREMRILMVGLDAAGKTTILYKLKLGEIVTTIPTIGFNVETVEYKNISFTVWDVGGQDKIRPLWRYYFQNTQGIIFVVDSNDRDRINEAREELQSMLNEDELKDAVLLVLANKQDLPNAMNAAEITEKMGLHSIMNRPWFIQATCATTGDGLYEGLEWLSNQVGK

SEQ ID NO: 53102 - protein, 603 aa, Triticum aestivum
  misc_feature (40)..(40): Xaa can be any naturally occurring amino acid
MAAEVEMGAGGALLEGGAGGRRGGRRRQPLGWRCMPFIIXTETFEKVGSVGVRANLTVYLVKRYNIGRLAAANITNIFYGTLNFAPLLGAFISDAYLGRFRTLAYGSFFSLLGMLGLTLSASVPALKPPGCSQTAQLGGHCDSPSTLQLSVLYISLAFLTIGGGAIRPCSLPFGVDQFDMTDEKSRKGLNSYYNWYYGTTTAALVFSMTILIYIQNSISWPIGFGIPTFFMLMSIIILFMGTRLYVHVPPEGSIFTGIAQVLVASFKKRRLKLPHPDNINQQELLLFSPPIGGHRIFRLPLTSQFRCLNKGAIVRDGDINDDGSARNSWELCSIQQIEEVKCLLRIVPICIVRIICFVALAQQFTYIILQTLTMDCHLGTHFEIPAGSVISISLIALTAFLPIYGRILVPIARRFTGVESGITLLQRQGIGLVISPISMVVAGLVEHKRRNSALSNGGKSPMSVMWLAPQLILMGIAEAFNAVGQIEFYNKQFPEQMLTLAGSLFFVTLAGANYLSTALANITRKVTTRDGHTSWLTDDINLGKLDYYFYFIALIGVLNLFYFLICSHYYQYKSMSLHAEESIKVHTKEEAEAEADANTAPKK

SEQ ID NO: 53103 - protein, 471 aa, Thermosynechococcus elongatus BP-1
MATPQEILNLIDSKYELIDLKFTDMPGTWQHLTVHKSQISESSFTEGVPFDGSSIRGWKAINESDMVMVPDPNTAWEDPFMKEPTLSLICTIKDPRTGELYDRCPRSIATRAIEYLKATGIGDTAYFGPEAEFFVFDDVRYDQNQKSGYYYIDSIEGVWNSGREEEGGNLGYKIRGKEGYFPVAPTDTLQDLRTEMLLTMAKCGVPIEKHHHEVATAGQCELGFRFGTLVQAADWLMTYKYCVKNVARKHGKVATFMPKPVFNDNGSGMHTHQSIWKDGQPLFWGDGYANLSQIALWYIGGILKHAPALLAFTNPTTNSYKRLVPGFEAPVNLAYSQGNRSASVRIPLTGPNPKAKRLEFRCPDATSNPYLAFAAMLCAGIDGIKNQIDPGSPLDVDIYDLSPEELAKIPSTPGSLMAALENLQKDHSFLTAGGVFSEDFILNWIQYKLDTEVIPMSLRPHPYEFALYFDA

SEQ ID NO: 53104 - protein, 269 aa, Oryza sativa (japonica cultivar-group)
MALPLVRLPPLPAARHPPLLRLPKHSVPPHGGRVSFACSSGSRAAFAACCASASVAPAAEAEAVVEEPEGPRTRLIAQNIPWDCTADDMRALFGKHGSVVDVELSMYNSTRNRGLAFVTMGSEEEALSALNHLNSTTLNDRTIKVDFTRSRKKQYVVPSAPMPKHSVFVGNLTWRVRSRHLRELFASTPGVQSVEVVFHTTSPRRSAGYGFVSFSSKEAAEAAISTFNGTKLMGRSINVMFKDDNAKKNKSAAPTEEDLKAESSEQIVS

SEQ ID NO: 53105 - protein, 551 aa, Agaricus bisporus
MTGSLASNYASWKQLQEIYDKDRAKIVLRDLFAADPQRFSKLSATYNSQSGPGVQILLDYSKHLVTEPILQKLFNLLREAKVEDARDKMFSGEHINTSEDRAVLHVALRNFNDFSIKEEGVDEVSKVLQHMKEFSESVRSGQWKGYTGKTINTIVNIGIGGSDLGPVMVTEALKPFSKRDLNAHFVSNIDGTHIAETLRLCDPERTLFIVASKTFTTQETITNAESARDWFLGFAKDKAHVAKHFVALSTNTSAVTAFGISEANMFQFWDWVGGRYSLWSAIGLSIALVIGFDNFEKLLRGAHAMDQHFKTTPLEKNLPAIMAALGIWCNDFYGAQTLALLPYDQYLHKFADYFQQGDMESNGKFITKNGDRVNYQTGPIIWGASGTNGQHSFYQLIHQGTKIIPADFMAPATSHNPIANSKHHRILLSNFFAQPEALAFGKTEEEVRKELGQNASEALVKSKVFEGNRPSSSLMFDKLDPATLGALIALYEHKIFVQGVVWGINSFDQMGVELGKVLAKQILAQLDKSDDVKGHDSSVRHLPFILQVDHC

SEQ ID NO: 53106 - protein, 373 aa, Listeria monocytogenes EGD-e
MTLSKGLENVYVAETSISSIIDDMLTYVGYGIDDLMENNASFEEVIYLLWHLRLPNKDEFKKFKREIQENMAVSETIITSLRMQNHQKLHPMSVLRTTVSMLGVFDTEAELDDGEAVYRKGLRLQAKMPTIVAAFSRIRRGLDPIPPREDLNMAANFLYMITGEEADELSVEAMNKALVLHADHEFNASTFTARVCVATLSDVYSGVTAAIGALKGPLHGGANERVFDMLEEIDQAGDVRNYIQEKIDTKQKIMGFGHRVYRGGDPRAQHLREMSRKLTAEKGEEKWFDISLQVEESVWELKHLKPNVDFYSASVYHALGIDRDLFTLVFSVSRVSGWLAHIFEQYRDNRLIRPRAIYVGPENRSYLPVEERI

SEQ ID NO: 53107 - protein, 152 aa, Brassica napus
  misc_feature (2)..(3): Xaa can be any naturally occurring amino acid
  misc_feature (12)..(13): Xaa can be any naturally occurring amino acid
  misc_feature (16)..(16): Xaa can be any naturally occurring amino acid
  misc_feature (19)..(19): Xaa can be any naturally occurring amino acid
  misc_feature (26)..(26): Xaa can be any naturally occurring amino acid
  misc_feature (29)..(29): Xaa can be any naturally occurring amino acid
  misc_feature (35)..(35): Xaa can be any naturally occurring amino acid
  misc_feature (40)..(41): Xaa can be any naturally occurring amino acid
  misc_feature (47)..(47): Xaa can be any naturally occurring amino acid
  misc_feature (49)..(49): Xaa can be any naturally occurring amino acid
  misc_feature (51)..(53): Xaa can be any naturally occurring amino acid
  misc_feature (63)..(63): Xaa can be any naturally occurring amino acid
  misc_feature (65)..(65): Xaa can be any naturally occurring amino acid
  misc_feature (82)..(82): Xaa can be any naturally occurring amino acid
  misc_feature (85)..(85): Xaa can be any naturally occurring amino acid
  misc_feature (91)..(91): Xaa can be any naturally occurring amino acid
  misc_feature (100)..(101): Xaa can be any naturally occurring amino acid
  misc_feature (106)..(106): Xaa can be any naturally occurring amino acid
  misc_feature (108)..(108): Xaa can be any naturally occurring amino acid
  misc_feature (111)..(111): Xaa can be any naturally occurring amino acid
  misc_feature (125)..(125): Xaa can be any naturally occurring amino acid
MXXSMLSSAAVXXSPXQAXMVAPFTXLKXSAAFPXTRKAXXDITSIXSXGXXXTCMKVWPPDXKXKFETLSYLPDLTEVELXKEXDYLLRXKWIPCVEFXXEHGFXYXEHXSTPGYYDGRYWTMXKLPLVGCTDSAQVLKEVQECKTEYPNA

SEQ ID NO: 53108 - protein, 377 aa, Gossypium hirsutum
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNAPAMYVAIQAVLSLYASGRTTGIVLDSGDGVSHTVPIYEGYALPHAILRLDLAGRDLTDALMKILTERGYSFTTTAEREIVRDVKEKLAYIALDYEQELETSKTSSSIEKSYELPDGQVITIGAERFRCPEVLFQPSMIGMEAAGIHETTYNSIMKCDVDIRKDLYGNIVLSGGTTMFPGIADRMSKEITALAPSSMKIKVVAPPERKYSVWIGGSILASLSTFQQMWIAKAEYDESGPSIVHRKCF

SEQ ID NO: 53109 - protein, 299 aa, Mycobacterium sp. JLS
MHAMVYHGPGRRSWEQVPDPEVQRATDAIVRVDAVTICGTDLHILKGDVPEVQPGRILGHEAVGTVIEIGSAVEKLAVGDRVLVSCISACGSCRYCRDGQYGQCLGGGGWILGHLIDGTQAEYVRVPFADNSTHKVPAGVSDEQMVMLADILPTSYEVGVLSAAVRPGDTVAIVGAGPIGLAAVLTAKLFSPSHIVVIDIAESRLEAAKNMGADVVVNSTSQDARSVLDELTDGLGADVAMEAVGMPETFEQAVRLVRAGGHVANIGVHGKPATLHLEDIWIKNLTITTGLVDTHSTPP

SEQ ID NO: 53110 - protein, 433 aa, Arabidopsis thaliana
MRRRRCDLQPKRTRMCDLQPKRTSMCDLPPKLVGEKILTRIPITSLRAVRSTCKLWNALTKDRVLGKAAAQFLGFMTMDSKVCSVRFHLRRSKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRRERHV

SEQ ID NO: 53111 - protein, 181 aa, Rhodopseudomonas palustris CGA009
MTPEFANDLKASVRAIPDYPKPGIIFRDITTLLGEPRAFRRAIDELVQPWAGSKIDKVAGIEARGFIIGGAIAHQVSSGFVPIRKKGKLPHTCVSMEYALEYGTDKIEVHVDAITPGERVILVDDLIATGGTAEGAIKLLRQIGAEVVAACFVIDLPELGGAAKIRAMGVPVRTLVAFEGH

SEQ ID NO: 53112 - protein, 271 aa, Streptococcus pneumoniae TIGR4
MTNTSFSIEQFSLKGKIALITGASYGIGFAIAKSYAEAGATIVFNDINQDLVNKGIEAYREVGIQAHGYVCDVTDEDGIQAMVKQIEQEVGVIDILVNNAGIIRRVPMCEMSAADFRKVIDIDLNAPFIVSKAVIPSMIKKGHGKIINICSMMSELGRETVSAYAAAKGGLKMLTRNIASEYGGANIQCNGIGPGYIATPQTAPLRELQEDGSRHPFDQFIIAKTPAARWGNTEDLMGPAVFLASDASNFVNGHILYVDGGILAYIGKQPE

SEQ ID NO: 53113 - protein, 215 aa, Zea mays
MTGLGSPCGACKFLRRKCVKGCVFAPYFCHEHGAAHFAAIHKVFGASNASKLLMHLPISDRCEAAVTMSYEAQARLQDPIYGCVAHIFSLQQQVVRLQAELESFKALAIQGCGDGSLTSNPQKENCERLAPYIQDGQLFYQPTMANNSSVKSERQLYFANDCFTSTSTQHSEGYEPDICMPDYYNNSNPSWTTQGSGYHDIDELQSVAFAYLDNA

SEQ ID NO: 53114 - protein, 1204 aa, Oryza sativa (indica cultivar-group)
MDLLPPATEPPAGGGGGGGGAPAPGRRLRRGVGFRSLKMVSVSMDEPLPAEPVGVAYGRLANGLAYYVRSNPKPRMRAALSLAVKVGSVVEEEDERGVAHIVEHLAFSATSRYTNHDIVKFLESIGAEFGACQNALTSSDETIYELLVPVDKPGLLSQAISVLAEFSSEVRVSAEDLEKERGAVLEEYRGGRNATGRMQDSHWALLFEGSKYAERLPIGTEKVIRTVPHETVRHFYHKWYHLSNMAVFAVGDFPDTQAVVEMIKEHFGQKAPPSCPPPVIPDFPVPSHVEPRFSCFVESEAAGSAVVVSCKMPADRIKTVTDYRDSLAESMFHCALNQRLFKISRRNDPPYFSCSSAADALVRPVKAYIMTSSCRERGTVEALESMLLEVARVRLHGFSEREISIARALMMSDIESAYLERDQMQSTTLRDEFLQHFLHEDPVVGIEYEAQLQKTLLPHISSAEVVKFAANFSTISSCVIKVVEPHAHASLEDLKAVVLKVNTLEQDNAIPPWDEEQIPEEIVSQSPEPGSILDKVEHPGIGATEMILSNGMRICYKCTDFLDDQVVFTGFAYGGLSELSEDEYTSCSMGSTIAGEIGIFGYRPSVLMDMLAGKRAEVGTKVGAYMRSFSGDCSPSDLETALQLVYQLFTTKVEPREEEVKIVMQMAEEAIYAQERDPYTAFANRAREINYGNSYFFKPIRISDLKKVDPIRACEYFNNCFKDPSAFTVVIVGNIDPSISVPLILQYLGGIPNVGNAVLPLTRDDLKGLPFKFPETIIREVVRSPMVEAQCFVQLGFPVVLKSTTMTEDIHYVGFLSKLLETKIMQVLRFKYGQVYSVNVGVFLGGNKPSRSGDIRGDISVNFSCDPDMSSKLVDFVLEEISFLQNEGPSEEDVLTILEIEQRAHENGLQIQDEGRLKVREALTPQSMQMALQRVVPFPCRKQFTVVILMPKSSCWNSFKALLTWSPGGFSRDAKVVALNESVAGSVKSVFKPWEQRLDTSGGFLESNEGDPELLVFIPSHYKKVHVQIHLVLLIHLFLLSIACCVDLCMRFTSDVKIKSISVVGGADGTSPSRMRALVSELYLFCYLTHLFVPLNRMFINREGIDFNDAQNMQPVQEWELAENLQGVLEYQTRYSRFQGVANLTLHFPENFGGDTTKIYYIGLRGEATQNKRDVVATIVYEIMPNPSDHKTKSETGGGFSHVE

SEQ ID NO: 53115 - protein, 257 aa, Neisseria gonorrhoeae FA 1090
MYRQIGMWDQKWVIGNWKMNGRLQNNNALMHRFRILPTAERVLIGLAAPTVYLLQLHNAMQIVLNNRILTCAQDVSRFPDNGAYTGEVSAEMLADTGTDIVLIGHSERSLYFGEKNEIQRRKMENVLNVGLIPLLCVGESLEERETGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 53116 - protein, 387 aa, Ralstonia eutropha JMP134
MIRARFTGILDRVQTTRHTRPERDTAMTKPSPASFRIAAIAGDGIGNEVLPEGLRVVEAAARKFDLLIEVRHFEWANCDYYLRHGKMMPDDWKQQLDGFDAIYFGAVGWPDKVPDHISLWGSLLKFRREFDQYVNLRPVRLLPGVPCPLAGKKPGDIDFYVVRENTEGEYSSVGGRMYEGTERELVMQQSIFSRHGTDRILKYAFELAQSRPRKKLTSATKSNGIAVSMPWWDERTAAMGAQYPEIEWDSQHIDILCARFVLQPERFDVVVASNLFGDLLSDLGPACTGTIGLAGSANLNPERKFPSLFEPVHGSAPDIFGKQIANPIGMIWSGAMMLDFLGGEAGRQAHDAILAAIETVLREGPLTPDAGGKAGTSDVGKAIAEAV

SEQ ID NO: 53117 - protein, 407 aa, Clostridium perfringens str. 13
MRYIVVGASAAGISGAKTLRELDKDAEIILVSKDENVYSRCILHHYISGHRDIEALDFTDRDFFEKYNIEWKKGLEVKSIDDREHIIGLSNGESLKYDKILLATGASAFIPPVENLREAKNVVGLRNLEDAIKIKEEAEKVKNVVVLGAGLVGIDAIAGLVGKNLNVTLVEMGDRVLPIQLDKYASSKYEKRFEDAGVKLKLGVRAEKVLIDENKNPKALLINTGEEIPCELIIVATGVRSNVAFLKDSSIETDRFGLIINEKGETNARDVYGAGDITGRNPIWPTAVKEGIIAANNMVGNEIFMEDFFGSKNTMNFLGLTTMSLGVVNVPDDSYTEEIDISGENYKKIIHKDGKIYGAIIQGDLSYAGVLTQLIKEKIHVSKVKKPLFEIDYADFFNIKENLEYTY

SEQ ID NO: 53118 - protein, 319 aa, Listeria monocytogenes EGD-e
MKRIAILTSGGDAPGMNAATRAVVRKAIYEGLEVYGINYGFLGLVNGDIRKLELGSVGDLLHRGGTFLYSARYPEFATEEGQLKGIEQLKKHQIDGLVVIGGDGSYHGAEALTKRGFPTIGIPGTIDNDISGTDFTIGFDTALNTVLDALDKIRDTATSHERTFIIEVMGRDAGDIALWSGLAGGAEAIIVPEESFNMDDVVDRLNKGRERGKKHSIIVVAEGVMSGNEFAKQLAEYGDYHARVTVLGHVQRGGSPTAFDRVLASRLGARSVELLLENRGGLAVGIRENRIVENDISEILKEKHTLDQKLFDLASILSI

SEQ ID NO: 53119 - protein, 692 aa, Clostridium perfringens str. 13
MKRIQSTCNYCALACNLDFYTEDGKIKRVVPTPHYPVNKGFSCIKGLNLDKQCTKFNGSKKPLLKMKDGERKAIEWKEAFDLFASKMTAIQEKYGKESVAYISTGQLPTEEMALLGHVGRSYMGINGDGNTRLCMASAVVAYKQSFGFDAPPYTLKDLELSDTIFFIGANPVIAHPIAWGRVRKNKDAKIITIDPRKSETAMNSDMWIDIKTKGDLALFYTLANVLIEKGWIDQDYINNYTEGFEDFKAHVKKYTLEDVEERTGISKMRVLELAKIIHEGKRVSFWWTMGVNQSYEAVRTAQAIINLALITGNMGREGTGANSLTGQCNAMGSRMFSNTTALYGGGEYNNKERRKVVADILGMDENMLPSKPTLDYEQIIKGINKEEIKGLWVICTNPRHSFSNNEEFKKAMKNLDFFVVQDIYEDTDSSKECDLYLPSVPAIKKEGFLINTERRLSAMVPVLEKEEDELSDYEIFLGIGEALGMGSLLDKWRTPKDAFNLLRECSKGMPCDITGVTYERLRGSKGIQWPCREGEELEADERRLFEDGKYYTPSGKAKFIFEDVTENPNATNEEFPFNLNTGRGTVGQWHTHTRTREIQAVTNIVSQKAYVDINRKDAERLDIKENDEVLIHSSNGHTSKFIARLTDNLKEKDLYAPIHYIETNLLTPSVFDPYSKEPSYKTVQVNIEKVRK

SEQ ID NO: 53120 - protein, 539 aa, Arabidopsis thaliana
MAYASRIINHSKKLKDVSTLLRRENAATIRYYSNTNRAPLNREDIFNSRLGYPPLERISICSTSTLPVSIIFSTTRSNLSSAMGRPIFGKEFSCLMQSARGFSSGSDLPPHQEIGMPSLSPTMTEGNIARWLKKEGDKVAPGEVLCEVETDKATVEMECMEEGYLAKIVKAEGSKEIQVGEVIAITVEDEEDIGKFKDYTPSSTADAAPTKAEPTPAPPKEEKVKQPSSPPEPKASKPSTPPTGDRVFASPLARKLAEDNNVPLSDTEGTGPEGRIVKADIDEYLASSGKGATAKPSKSTDSKAPALDYVDIPHSQIRKVTASRLAFSKQTIPHYYLTVDTCVDKLMALRSQLNSFKEASGGKRISVNDLVVKAAALALRKVPQCNSSWTDDYIRQFKNVNINVAVQTENGLYVPVVKDADRKGLSTIGEEVRLLAQKAKENSLKPEDYEGGTFTVSNLGGPFGIKQFCAVVNPPQAAILAVGSAEKRVVPGNGPDQFNFASYMPVTLSCDHRVVDGAIGAEWLKAFKGYIENPKSMLL

SEQ ID NO: 53121 - protein, 430 aa, Oryza sativa (indica cultivar-group)
MEDEGAGGGGIGGDASPVHVGSATEAGVGRDIVPSPTSSRSVMQTVNGSHMFVIQGYSLAKGMGIGKYIASETFTVGGCQWAIYFYPDGKNPEDNSAYISVFIALISDGIDVRVLFELKLLDQSGKAKHKGHSQFDRSLESSPYTLKNRGSMWGYKRFFRRTALETSDFLKDDCLKINCTVGVVVSTMDYSKPHSIHVPESDIGYHFGTLLDNQEGVDVICNVAGEKFHAHQLVLAARSSFFRSELFEHESDEEKNEVDTSNEIKEIVIDDMEPKVFKAVLHFMYRDNLVGDDELSASSSDCSIFDTLAGKLLAAADRYELPRLRLLCESYLCKHISVNSVATTLALADRHHAMELKSVCLKFAAENLSAVIRTDGFDYLKDNCPALQSEILRTVAGCEEECSSGGKSQSVWGQLSDGGDTSGRRVRPRV

SEQ ID NO: 53122 - protein, 361 aa, Thermosynechococcus elongatus BP-1
MATTYRIAVLAGDGIGPEITAVALDVLRAIAPRFGLDFDFVPALVGGCAIDAVGEPLPAATLATCRQSDAVLLAAIGGTQWDSLPRHLRPETGLLALRSGLGLFANLRPAKIFPQLLHASSLKPEVIAGVDLMVVRELTGGIYFGQPRGIFTTETGEQRGVNTMAYTATEIDRIGRVAFETARKRQGKLCSVDKANVLEVSQLWRDRLTALSAEYPDVELTHLYVDNAAMQLVRAPKQFDTIVTSNLFGDILSDIAAMLTGSIGMLPSASLGESGPALFEPVHGSAPDIAGQDKANPLAMVLSAAMMLRYGLNQPAAAQAIEEAITAVLDQGYRTGDLMSEGCTLVGCREMGNLLIKELSR

SEQ ID NO: 53123 - protein, 371 aa, Nicotiana tabacum
MANEENKASPTNTSRASNNRAFDDTLAAASSNGNDPLLKRVVLGELTNLEYVVGSTKTNTHNSKRKIKLKKTAPTKRKKVAKQSFKSDAATNFSPNDDLQKCAYAPLIYQHLHSLEVEERRRPLSNYMEKIQNDVTPTMRMILVDWLVEVADEYKLVSDTLYLTVTFIDRFLSSHVLARNSLQLLGVSCMLAASKYEEISPPHVEDFCYITDNTYTGEEVVNMERELLNFLDFEISNPTTKTFLRIFTKAAQDNVDFLTLHFEFLGCYLTELSLLDYSCVQFLPSVVAASAIFLSRFTILPKVHPWNLALQQCTGYKPSELKDCVLVIHELQSGRRAASVQAVRKKYMDHKYKCVAALHPPDIPACFFDDA

SEQ ID NO: 53124 - protein, 115 aa, Nocardioides sp. JS614
MSLPLRPAVAAGDFVAISGQVGVADGALVEGGISAEARQGLANLVAVLEANGLTTADVVKTNVFLTSMDDFAAMNEEYAKVFTEDFPARSAVAVHQLPIGAVFEIEAWAYRGNQR

SEQ ID NO: 53125 - protein, 483 aa, Nicotiana tabacum
MATTQNRRSSVSSATAKRQAMTANSSLENNNHGKLVAKKRPALTNISNHTTASARNSLSHSSKLAPCTSKAVSIKKSNSNAASSVLPTSSFVKPISKTVSIPRSDAAIPKITAIPLPATCSMDISPSHSDGSLVSMDETMSTSDSLRSPDVEYIDDNQTAAFDSIEKKAFSTLYISEDVKAADICKRDVLVDIESGDKIANIDNNFVDPQLCATMACDIYKHLRATEVKKRPSTDFMEKVQKDINASMRAILIDWLVEVAEEYRLVPDTLYLTVNYIDRYLSGNLMDRQRLQLLGVACMMIASKYEEICAPQVEEFCYITDNTYFKEEVLQMESTVLNYLKFEMTAPTAKCFLRRFVRAAQGLNEVLSLQLEHLASYIAELSLLEYNMLCYAPSVIAASAIFLAKYILLPSKKPWNSTLRHYTLYQPSDLRDCVVALHSLCCNNNNSSLPAIREKYSQHKYKFVAKKYCPPTIPVEFFQNISC

SEQ ID NO: 53126 - protein, 1112 aa, Arabidopsis thaliana
MGFESSSSAASNMKPQPQKSNTAQYSVDAALFADFAQSIYTGKSFNYSKSVISPPNHVPDEHITAYLSNIQRGGLVQPFGCLIAVEEPSFRILGLSDNSSDFLGLLSLPSTSHSGEFDKVKGLIGIDARTLFTPSSGASLSKAASFTEISLLNPVLVHSRTTQKPFYAILHRIDAGIVMDLEPAKSGDPALTLAGAVQSQKLAVRAISRLQSLPGGDIGALCDTVVEDVQRLTGYDRVMVYQFHEDDHGEVVSEIRRSDLEPYLGLHYPATDIPQAARFLFKQNRVRMICDCNATPVKVVQSEELKRPLCLVNSTLRAPHGCHTQYMANMGSVASLALAIVVKGKDSSKLWGLVVGHHCSPRYVPFPLRYACEFLMQAFGLQLQMELQLASQLAEKKAMRTQTLLCDMLLRDTVSAIVTQSPGIMDLVKCDGAALYYKGKCWLVGVTPNESQVKDLVNWLVENHGDDSTGLTTDSLVDAGYPGAISLGDAVCGVAAAEFSSKDYLLWFRSNTASAIKWGGAKHHPKDKDDAGRMHPRSSFTAFLEVAKSRSLPWEISEIDAIHSLRLIMRESFTSSRPVLSGNGVARDANELTSFVCEMVRVIETATAPIFGVDSSGCINGWNKKTAEMTGLLASEAMGKSLADEIVQEESRAALESLLCKALQGEEEKSVMLKLRKFGQNNHPDYSSDVCVLVNSCTSRDYTENIIGVCFVGQDITSEKAITDRFIRLQGDYKTIVQSLNPLIPPIFASDENACCSEWNAAMEKLTGWSKHEVIGKMLPGEVFGVFCKVKCQDSLTKFLISLYQGIAGDNVPESSLVEFFNKEGKYIEASLTANKSTNIEGKVIRCFFFLQIINKESGLSCPELKESAQSLNELTYVRQEIKNPLNGIRFAHKLLESSEISASQRQFLETSDACEKQITTIIESTDLKSIEEGKLQLETEEFRLENILDTIISQVMIILRERNSQLRVEVAEEIKTLPLNGDRVKLQLILADLLRNIVNHAPFPNSWVGISISPGQELSRDNGRYIHLQFRMIHPGKGLPSEMLSDMFETRDGWVTPDGLGLKLSRKLLEQMNGRVSYVREDERCFFQVDLQVKTMLGVESRGTEGSSSIK

SEQ ID NO: 53127 - protein, 482 aa, Nicotiana tabacum
MATTQNRRNSVSSAVAKRQAMAENNHGKLPAGGAKKRPALTNISNHTTASARNSLSHSSKLAPCTSKVVSIKKNNSNAASSVLPTSSSFVKPISKTVSLPRSDAAVPKITAIPPLPSTCSMDISPSHSDGSLVSMDETMSTSNSLRSPDVEYIDDNQTAAFDSIEKKAFSTLYISEDVKAADICKRDVLVDMESGDKIANIDNNLVDPQLCATMACDIYKHLRATEVKKRPSTDFMEKVQKDINASMRAILIDWLVEVAEEYRLVPDTLYLTVNYIDRYLSGNLMDRQRLQLLGVACMMIASKYEEICAPQVEEFCYITDNTYFKEEVLQMESTVLNYLKFEMTAPTAKCFLRRFVRAAQGLNEVLSLQLEHLASYIAELSLLEYNMLCYAPSVIAASAIFLAKYILLPSKKPWNSTLRHYTLYQPSDLRDCVMALHSLCCNNNNSSLPAIREKYSQHKYKFVAKKYCPPTIPVEFFQNISC

SEQ ID NO: 53128 - protein, 472 aa, Glycine max
MSMASLPNSPALSFSSSLSTTANLLPCRRFTAFPRRRASSFSVQAKIREIFMPALSSTMTEGKIVSWIKSEGDMLSKGDSVVVVESDKADMDVETFYDGILAAIVVADGETAPVGAPIGLLADSPEEVAEAKAKAAKSVPSGSPAPASPSDPSPATPPPPPPPAKSVSEGPAKIVATPQAKKLAKQHKVDIATVAGTGPFGRITPADVEAAAGIAPSKRNVAPAAIPAPATPAPPSKAASGSAAPAPIPGSSVVPFTTMQSAVAKNMMESLSVPTFRVGYPVTTDALDALYEKVKPKGVTMTAILAKAAAMALVQHPVVNATCKDGKNFVYNGNINVAVAVAINGGLITPVLQDADKLDLYLLSQKWKELVEKARAKQLQPHEYNSGTFTLSNLGMFGVDRFDAILPPGQGAIMAVGASKPTVLADKDGFFSVKNKMLVNVTADHRIIYGADLAAFLQTFSKIIENPESLTL

SEQ ID NO: 53129 - protein, 389 aa, Nostoc punctiforme PCC 73102
MKAVCWNGANDVRVQSVPDPTILNPRDAIIKITSTAICGSDLHIYGGYIPTVQQGDIIGHEFMGEVVEVGRGVNNLKIGDRVVVPSTIGCGNCHYCQHDMWSLCDNSNPKGWIEEKLFGNITSAIYGYSHMLGGYAGAQAEYIRVPFADVGVVKVPPDLPDEMLLFISDAIPTGYMGAELCDIQPGDTVAVWGCGAVGQFAMISAYMMGAEKVIAIDRFPERLEMAKKFAKAEVINYEEVNAGEALKEMTGGRGPDACIDAVGLEAHGVGLEDFYDQTKQKLRLETDRPHVLREMMVACRKGGTLSIMGVYGGFVDKIPFGAAFNKGLTFRMGQMHGQKYMHLLLQMILDGKLDPSFVVTHQLPLEQAPHAYHIFQQKKDNCIKVVLKP

SEQ ID NO: 53130 - protein, 539 aa, Pseudomonas syringae pv. tomato str. DC3000
MKLLAVRRLFRIQRVVIRYRLDDLLFALPLPWWMLAVRFVLPWRWLPRRKSELSRGVRFRLALQDLGPIFIKFGQLLSTRRDLLPEDIADELMLLQDRVPPFDQQVAIKLIEEQLGARICDVFSRFDETPLASASVAQVHAACLKTGEEVVVKVVRPGLKPIIGQDLAWLFILARMAERVSADARLLHPVQVVMDYEKTIYDELDLLREAANSSQLRRNFEGSDLLYVPQVYWDWCRPKVLVMERIYGLQVTDMAGLADQRTDMKMLAERGVEIFFTQIFRDSFFHADMHPGNIFVSTVNPWAPKYIAIDCGIVGSLTPEDQDYLARNLFAFFKRDYRRVAQLHIDSGWVPAETKLNEFEAAIRTVCEPIFEKPLKDISFGQVLMRLFQTARRFNMEVQPQLVLLQKTLLNIEGLGRQLYPELDLWSTAQPYLERWMRERVSPKTLLGNLQSQVEQLPHIAGMTRDLLERMSRPHASDPPRPWHDRKDEPVLRLIGAALLVGGAIQGWVMSEAATQLLTLTAWPAAIMLIAGLYLIVRR

SEQ ID NO: 53131 - protein, 130 aa, Pseudomonas syringae pv. tomato str. DC3000
MKDWLDEIHWNSDGLVPAIAQDRKTGRVLMMAWMNREALSLTASENRAIYWSRSRGKLWRKGEESGHVQKLHELRLDCDADVIILMVEQIGGIACHTGRESCFYRVYEQSGWKTVDPVLKDPDAIYPAGH

SEQ ID NO: 53132 - protein, 819 aa, Pyrococcus abyssi GE5
MAYRFIKWFEELRKEDVPLVGGKGANLGEMTNAGIPVPPGFCVTAEAYKYFVENVKISKEDVKRILGEKANKGTIAEVLAQAPDEPRPLQEWIMDIINRTNVDDSKQLQENTAVIRELIKSLDMPAEIADEIKQAYKELSQRFGKDEIYVAVRSSATAEDLPEASFAGQQETYLDVLGADDVIDKVKRCWASLWTARATFYRAKQGFDHSKVYLSAVVQKMVNSEKSGVMFTANPVTNNRNEIMINASWGLGEAVVSGAVTPDEYIVEKGTWKIKEKVIAKKEVMVIRNPETGKGTVTVKVAEYLGPEWVEKQVLTDEQIIEVAKMGQKIEEHYGWPQDIEWAYDKDDGKLYIVQSRPVTTLKETTTEEVEEVEEAEVILKGLGASPGIGAGRVVVIFDASEIDKVKEGDVLVTTMTNPDMVPAMKRAAAIITDEGGRTSHAAIVSRELGIPAVVGTKEATKKLKTGDYVTVDGTRGLVYKGIVKSLVEKKKKEEAAAAPGAAVAAAPLVTGTLVKVNVSMPEVAERAAATGADGVGLLRAEHMILSIGQHPVKFIKEGKEEELVEKLAEGIEKVAAAFYPRPVWYRTLDAPTNEFREMPGGEDEPEERNPMLGWRGIRRGLDQPELLRAEFKAIKKVVEKGYNNIGVMLPLVSHPEQIRKAKEIARSVGLEPHKDVAWGIMIEVPAAAIIIEDLIKEGIDFVSFGTNDLTQYTLAIDRDNERVAKLYDETHPAVLKLIKHVIKVCKRYGVETSICGQAGSDPKMARILVRLGIDSISANPDAVQLIRQVVAQEERKLMLEAARKRLFEEEEEEEEFLF

SEQ ID NO: 53133 - protein, 213 aa, Gibberella zeae PH-1
MLARRQLASSSLSTRATSIVGLVQQRGYATPHGPPPANFRTSKPVRWTWDNESTLDRMGKFFLMTEMARGMYVLLEQYFRPPYTIYYPFEKGPISPRFRGEHALRRYPSGEERCIACKLCEAICPAQAITIEAEERADGSRRTTKYDIDMTKCIYCGFCQESCPVDAIVESPNAEYATETREELLYNKEKLLSNGDKWEPELAAAIRADSPYR

SEQ ID NO: 53134 - protein, 384 aa, Nicotiana tabacum
MKKQEKEAIMADLENCGRVTRLAKKRAAEAMASHQQQHPSKKRVVLGEIQNFSNLGVSQIKGLNTEPKKQPKSKQQQSKRKLKRAVTSKIDKEELNVDNVDANYDDPQMCSAYVSDIYDYLRKMEIEEKRRPLPDYLEKVQKDLSPNMRGVLVDWLVEVAEEYKLLSDTLYLAVSYIDRFLSTNVITRQKLQLLGVSSMLISAKYEEISPPHVEDFCYITDNTYTKEEVVKMEADVLKTLNFEMGNPTVKTFLRRFTGVAQEDYKTPNLQLEFLGYYLAELSILDYSCVKYVPSLLAAAVVFLSRFTLQPNTHPWSLALQQYSGYKAADLKECILILHDLQLSRRGGSLAAVRDKYKQHKFKCVSSLTSPVEIPASFFEDMRQL

SEQ ID NO: 53135 - protein, 461 aa, Thermosynechococcus elongatus BP-1
MTYDYDLFVIGAGSGGLAASKRAASYGARVAIAEGDKVGGTCVIRGCVPKKLMVYGSKFSHLFEDAVGYGWHPVKAKLNWERLIRAVDQEVNRLSQLHISYLEKAGVELLPFFARFADPHTLELVDRQGQVQGRVTAAKILIAVGGEAIKPNVPGIEHSITSREMFLLPKQPKRLAILGGGYISVEFAGIMQGLGTEVIHFLRGDRPLRGFDQDIQDGVYGGMIRHGIDVRPQCHITGLKLTKKGNIRIRYEQQGQTRETKVDTVLCAVGRAPNLQGLGLDRAGVHLRTNRQGIVAIAVDEYYRTNQEHIFAVGDCTNRVNLTPVAIAEGRAFADTQFGNLPRTLSYENIPSAVFSQPEAASVGLSEAQAKAKLGEENVKIYRAAFRPMYHSLTGRPEQVIVKLVVENNTERVLGAHMVGDNAAEVIQGIAIALKMGATKKDFDATLGIHPSTAEEFVTLR

SEQ ID NO: 53136 - protein, 386 aa, Listeria monocytogenes EGD-e
MKHVFPTYKRFPIDLVNGTGTVVTDKNGKTYLDFTSGIAVCNLGHCPTNVAEAVQQQLGNIWHTSNLYECALQDSVAELIADGKERLVFFCNSGTESNEAALKLARKYTGKEKIITFEKSFHGRTFGSMSATGQAKIHQGFGELVPGFTYVPYNDIEAFRAEIDENTAAVMLEVIQAEGGVIPANAAFLLEVQLLCKKMGALLIIDEVQTGLGRTGTLYGFEQIGLDPDIFTLAKGLGNGLPIGAMVGKSDLISAFGPGSHGSTFGGNKLALAAAKEILLTMKQTGFLEEVNAKADYFRNLLEANLEVLDNVSDIRGGGFLIGIELENAAEPVITELRDKGLLILTAGTNVLRILPPLTVSYAEIDQAIYLLKSVLENQLIGSEEG

SEQ ID NO: 53137 - protein, 237 aa, Lolium perenne
MDMTGSEQWSSPSLSSSSQEQGAAVWVTPPKRPAGRTKFKETRHPVYRGVRRRGNAGRWVCEVRVPGQRGERLWLGTYLTAESAARAHDAAMLGLLGRSASACLNFADSACVLIVPPALSDLAAVRRAALAAVAGFLRREAASGAATVPTEEAILSASADNADGSSATLQPYADGMFEVPTALGSDMFELDMSGEMDLGTYYADLAEGLLLDPPPPEHSSACWDTGDGGADPALWSY

SEQ ID NO: 53138 - protein, 478 aa, Pseudomonas putida KT2440
MTQKFDVVVIGAGPGGYVAAIKAAQLGLKTACIEKYTDAEGKLALGGTCLNVGCIPSKALLDSSWKYKEAKESFNVHGISTGEVKMDVAAMVGRKAGIVKNLTGGVATLFKANGVTSIQGHGKLLAGKKVEVTKADGTTEVIEAENVILASGSRPIDIPPAPVDQNVIVDSTGALEFQAVPKRLGVIGAGVIGLELGSVWARLGAEVTVLEALDTFLMAADTAVSKEAQKTLTKQGLDIKLGARVTGSKVNGNEVEVTYTNAEGEQKITFDKLIVAVGRRPVTTDLLASDSGVTIDERGYIFVDDYCATSVPGVYAIGDVVRGMMLAHKASEEGIMVVERIKGHKAQMNYDLIPSVIYTHPEIAWVGKTEQALKAEGVEVNVGTFPFAASGRAMAANDTGGFVKVIADAKTDRVLGVHVIGPSAAELVQQGAIAMEFGTSAEDLGMMVFSHPTLSEALHEAALAVNGGAIHVANRKKR

SEQ ID NO: 53139 - protein, 240 aa, Gloeobacter violaceus PCC 7421
MRRKVLAGNWKMYKTRGEARAFLEAFVPLISPGAENREVILCGPFTCLDLLSAQAGPYAVGAQNVHWADHGAYTGEIAPQMLVELGVHYVIVGHSERREYFNETDSTVNRRLNNAQDHDLVPILCVGETESVRKDGITEAHIRSQLDRDLELVDMRRLIIAYEPIWAIGTGKTCEANEANRVCAMIRKHVNFEGVPILYGGSVKPENIDELMAQSDIDGVLVGGASLEAKSFARIVNFEV

SEQ ID NO: 53140 - protein, 683 aa, Medicago truncatula
MASSCYNHKPHLLAFFHVTLTFLLLVTSRAAPLSFNYEQLGGDKTNTFNISGDVSQDNQVLQLTKYKEHSLGRVTYSKLFHLWDIKTSEVTDFNTRFSFTINTPNKTHHADGMTFYLAHPNFPMSQIYGGGIGLASLVQLSNPDYTKENPFVAVEFDTFVNEWDPNYDHVGIDVNSISTNHATQWFTSMDERGYDAEVSYDSSSNNLTVTFTGYQHNNTIQQHLFYVVNLRDVLPDWVEFGFTSATGTFWEYHTLSSWSFNSSLDFEAKEDGTKTGLVIGLGVGGAVALICVIGLVCLVKWKLKKKGMKDALHFDLAMDSDFERISLPKKFIYEELARSTNNFANEHKIGAGGFGAVYKGFIRDLKHHVAIKKVSKESNQGVKEYASEVKVISQLRHKNLVQLYGWCHKQNDLLLVYEFVENGSLDSYIFKGKGLLIWTVRYNIARGLASALLYLHEECEHCVLHRDIKSSNVMLDSNFNTKLGDFGLARLMNHETESKTTVLAGTYGYLSPEAATRGKASRESDVYSFGVVALEIACGRKAIEPSLSEEHIYLVDWVCELYGNGDLLKAADSRLYGEFNEKEVERLMIVGLWCTHTDHLQRPMIRQVVQVLNFDAPLPNLPLQMNASTYNTSFNSVYSKSKISGFENNQTGTSTSSDSTITGSSQSSTAFEVVSPSAALLHK

SEQ ID NO: 53141 - protein, 242 aa, Lolium perenne
MDMTGSEQWSSPSLSSSSQEQGVPVWVTPPKRPAGRTKFKETRHPVYRGVRRRGNAGRWVCEVRVPGQRGERLWLGTYLTAESAARAHDAAMLGLLGHSASSTCLNFADSAWLLDLPPTLSDLAHVRRAALAAVAGFLRQEADSGAATVRADEAAYSASVPSSVDNAGGLSATSQPYADGMFELPSALNSDMFELDMSGEMDLGTYYAGLAEGLLLDPPPPEHTSACWDTGDGGADSALWSY

SEQ ID NO: 53142 - protein, 683 aa, Medicago truncatula
MAPSCYHHKPHLLAFFHVTLTFLLLVTSRAAPLSFNYEQLGGDKTNTFNISGDVSQDNQVLQLTNYEKDSLGRVTYSKLFHLWNINTSEVTDFTTRFSFSINTPNKSYHGDGITFYLARPNFPMSQIDGSGIGLASRVQLSNPNYTKENPFVAVEFDTFVNDWDPKYDHVGIDVNSISTNHTTQWFTSMDERGYDAEVSYDSSSNNLTVTFTGYQDNKTIQQHLFYVVNLRDVLPDWVEFGFTSATGFFWEYHTLNSWSFNSSLDFEAKKDGTKTGLVIGLGVGGAVALICVIGLVCLLKWKLRNKGMKDESHFDLAMDSDFERSSLPKKFTYEELARSTNNFANEHKIGAGGFGAVYKGFIRDLKHHVAIKKVSKESNQGVKEYASEVKVISQLRHKNLVQLYGWCHKQNDLLLVYEFVENGSLDSYIFKGKGLLIWTVRYNIARGLASALLYLHEECEHCVLHRDIKSSNVMLDSNFNTKLGDFGLARLMNHETESKTTVLAGTYGYLSPEAATRGKASRESDVYSFGVVALEIACGRKAIEPSLSEEHIYLVDWVCELYGNGDLLKAADSRLYGEFNEKEVERLMIVGLWCTHTDHLQRPMIRQVVQVLNFDAPLPNLPLQMNASTYNTSFNSVYSKSKISGFENNQTGTSTSSDSTITGSSQSSTAFEVISPSAALLHK

SEQ ID NO: 53143 - protein, 791 aa, Medicago truncatula
MHVQFPNYLFLTIFLILNLNLFIPNASSLTFNFTSFDPNDKSIIYEGSANPASSAIQLTINYGSIGRATYYQPIHLWNKITNNLTDFTSHFTFTIDSQNRQMYGDGIAFFLAPYGSKKPNATKGGSMGLTLDNQRLNSTDNPFVAVEFDIYRNHWDPPLEHAGIDINSMLSVANVTWLADIKQGRLNEAWINYNASSLNLSVLFTGFNNVTSSIVNQHLSSIVDLRLYLPEFVTIGFSAATGNRTAVHSISSWDFSSTLEGQQDNNKTNTQDPVTKSPSSNKKAKTGLAVGLGTGGFVLIGVFGFIWVFLWRKRREQEDGEFQEYMGEDFGRGTGPKKYTYAELANAANNFKDEHKLGQGGFGGVYRGFLKDTKSYVAIKSVSEDSHQGIKEFASEVTIISKLRHRNLVQLIGWCHQRKKLLLVYEYMPNGSLDIHLFKKQSLLKWGVRYTIAKGLASALLYLHEEWEQCVVHRDIKASNIMLDSEFNAKLGDFGLARFVDHAKGGQTTALAGTMGYMAPECATTGRASKETDVYSFGIVALEIACGRKPIINAQENEINIVEWVWGLYGRGRIVEAVDPRLDGDYEEEQIKCMMIVGLWCAHPDPNNRPSIRQAIQVLNFEVPLPNLPSSMPVPTYLDGPLNSFTAPFNTNGSEEGPNMNIESFSSNTNSSEFCICEHTCGLEETPGAHVFNADFPGMKKEEAKVEIEDDRVLQISGKRSVEKEDKNDQWHPVERSSGKFMRRLRLPENAKMDQMKAAMENGILTVTVPKKEIKNHEVKTIDISGKVWCN

SEQ ID NO: 53144 - protein, 236 aa, Lolium perenne
MDTGIDGWTSCSLSPSTPEHGAAHAHPKRPAGRTKFKETRHPVYRGVRRRGSAGRWVCEVRVPGKRGERLWLGTYVAAESAARAHDAAMLALRGCSASVSALASLNFPDSAWLLAVPPWLSDLAAVRRAAVEAVAVFLRRELADGAVAVVPVYEATSTESISSSVQNADGLFEVPTFSALDLGSDLFELDMSGEIDLDTYYAGLAEGMLLEPPPTPYWESRECGNGGGGDAALWSY

SEQ ID NO: 53145 - protein, 389 aa, Nostoc punctiforme PCC 73102
MKAVCWHGANDVRVETVPDPKILNPRDAIVKITSTAICGSDLHIYDGYIPTMQKGDILGHEFMGEVVELGSAVKNVNVGDRVVVPFTISCGSCFFCNRDLWSLCDNSNPNAWLVKKQMGHSPAGLFGYSHLFGGYAGGQAEYARVPFADVGLFKIPDGLTDEQVLFLTDIFPTGYMAAENCNIKPGDIVAVWGCGPVGQFAIKSAYMLGAERVIAFDRIPERLQMAKEYGKAEVLNYEEVNIGEALKEMTGGRGPDACIDAVGMEAHGTDFMAFYDQVKQAVRLETDRPTALRQVIVSAAKGGHVSLVGVYGGFLDKIPMGAAMNKGLTFKMGQTNVHKYLKPLLEHIQNGEIDPTFIITHTLPLEQAPHGYEIFKHKKDNCIKVVLKP

SEQ ID NO: 53146 - protein, 665 aa, Medicago truncatula
MASSCNYMKPHLLAFFHVTLSLSLLVTSHAAPLTFNYDNLSSDKTHALNFSGDVYHDNQVLQLTRYEKDSLGRVTYSKLFHLWNINTSEVTDFTTRFSFTINTLNKTDHSDGITFYLAHPNFPLPVPRDGSGIGLMSSVQLATPNYTKENPFVAVEFDTFVNTWDPTYDHVGIDVNSISTSYTTQWFTSLDERGYDVDISYNSSSNNLSVTFTGYGDNNTIQQNLFQIVNLREVLPDWVEFGFTSATGLFWGEEHTLRSWSFNSSLDFEAHKDEGKTGLVMGLAVGLGIGGFVLIGVLGLFSIVLWKKWKKESEEEDGEFEEYMGEDFGRGAGPRKYTYAELAHAANDFKDEYKLGQGGFGGVYRGFLKDTKSYVAVKRVSEDSHQGIKEFASEVTIISKLRHRNLVQLIGWCHERKKLLLVYEYMPNGSLDIHLFKNQSFLKWGVRYTIARGLASALLYLHEEWEQCVVHRDIKASNIMLDSEFNAKLGDFGLARFVDHAKGAQTTALAGTLGYMAPECATTGRASKETDVYSFGIVALEIACGRKPIINLKAQENEIHIVEWVWGLYGRGKILEAVDPKLDGDFEQEQIKCMMIVGLWCAHPDPNNRPSIRQAIQVLNFEVPLPNLSSSMPVPTYLEGPLNSFSAPFSTNNSEESQNQEYKKL

SEQ ID NO: 53147 - protein, 313 aa, Karenia brevis
ELDAFAALLLASDAQAGFQAPNAANARAQNAQKLANVGAKVLAGSLAGLLALTAGTDGALAGPFTRDDLASLTYDQVKGSGLANTCPKVNKAGAGGIKIGGLKQLSDFCLEPTSFAILEEQMTQQKGTQTVPVPSKVTTRQTYVLDGIEGTLSVSEGKLKFVETDGIDYAPTTIQLPGGERVPFLFTVKNLVATAGTTADEIAPGFTMSGPFMVPSYRTGLFLDPKGRGTTTGYDQAVALPAMQAGGDEEMFKENDKKFDVGKGSIELKVTQVNTELKEIGGVFVHKQPGDTDLGSKEPKEILLKGNWFATVE

SEQ ID NO: 53148 - protein, 242 aa, Lolium perenne
MDAGHDNWITTPSSSTSSRENAMAPKRPAGRTKFKETRHPVYRGVRRRGSAGSWVCEVRVPGRRGERLWLGTHVTAESAARTHDAAMLAMRGSSAASSCLNFADSASLLAVPSPLFEFADVRQAALAAVADFQRRNAANGPPAASAGAVVEATSSSSAPSPGDNTGSSTASSEATADGLFEVPAALGSYMFELEMSGEMDLGTYYADLAEGLLLDPPSPAGTEACWENGDHGGADAALWSYH

SEQ ID NO: 53149 - protein, 273 aa, Nostoc punctiforme PCC 73102
MTIATSTKPQINWVNTLFFIGLHIGALFAFVPGNFSWTAVGVGFLLYWVTGGLGVTLGFHRLVTHRSFQTPKWLEYLLVFFGTLSCQGGPIEWIGTHRIHHLNSDTDTDPHDSNKGFWWSHMGWLTHYCPAHADVPRFTKDIAEDPVYQFLEKYFILIQVALGVLLLLLGGWPFVIWGIFVRIVWVYHCTWLVNSATHKFGYQSYDSGDKSTNCWWVAVLVFGEGWHNNHHAFQYSARHGLEWWEIDLTWMTVQLLQAVGLATNVKLAPAKSS

SEQ ID NO: 53150 - protein, 655 aa, Medicago truncatula
MAPPIFCYARGTIMLFLIIPLAHAHLVSFDYPMFNHNCKELPELDGDATIEDSDNIIQLTGYTDDPDKASSVGRVTSPKLIKLYNRSTNEVYDFRTKFSFTIFSNHSSYGDGLAFFLASSNLTKANRIGGGGGFGLVPANEVALNSTEYSIVLVEFDTHKNIWDPGFPHVGVNINSVVSDTNIEWFSNVSERMVYNCSIEYISRNNVLNVSFTGYRLNAWQEPQNFSHIINLREHLPEYVRVGISASTGKVDEEHMLLSWSFSTSQPSYFVVDPRKTKLWEGLAVGGVCLSWSLVAILIIFLWKKNKGKEDEPTSETTSDQDMDDEFQMGAGPKKISYYELLNATNNFEETQKLGQGGFGGVYKGYFKDSNSVAAIKRISADSRQGVKQYSAEVKIISQLRHRNLVKLTGWCHKKNELILIYEYMPNGSLDFHLFRGGSILPWNLRYNIALGLASALLYLQEEWEKCVIHRDIKSSNIMLDSDFNTKLGDFGLARLMDHEKGSETTVVAGTRGYLAPEYIDTSKARKESDIFSFGVVLLEIACGKKAIHHQELEGEVSLVEWVWELYGLRNLIVAADPKLCGIFDVKQLECLLVVGLWCANPDITSRPSIKKVIKVLNFEAPLPILPLNMPFLASLSPTTNEQFFSVPSFFRSTG

SEQ ID NO: 53151 - protein, 332 aa, Heterocapsa triquetra
MARAATRPLVGAALFGCSSAFVQNSAVHPTAPSLRSRDASLRLNALPSEDAPPAADQAEGRSWVAPVLGLSAMLGLVFGVLAPQPAKAITAEQFSQLTYAQVRGSGLANRCPTVESQGTQVPVTSSSRMQNFCLEPKSFAIEFETEPGKKEFVTTKLTTRQTYTLAFIEGALKPNPITFTEQDGMDFAATTVKMPDGEYVPFLFSCKQLIAKGDGSSFKPGFTWGGEFNVPSYRTGGFLDPKGRGMYTGYDQAVALPALQADGKGGQEELFKETNKVFDIGKGAIEMEVNKVNQELGEIGGVFVSKQPSDTDMGAKAPKTVLLKGIFYGKIV

SEQ ID NO: 53152 - protein, 442 aa, Oryza sativa (indica cultivar-group)
MDELGIIEQGVDWRTRLGQDIRDCMINDILFSLQTKLQSTSTTLIDLQKVAARIEERIHTIASDYRQQASIRSSILLHQENKQGDQIVQAKRNTMGTSSSSVLSNQVALNDHKEHSHPYEKDMISKLPNDLVQHIMSFLSMREAVRTSVLSHWWVNQWTFLKSIQLNIYWFHMDREKFSSFLDKLLLSRVQADAPMDTFELKSFAIDRANCWINHAIKHNAKVLKFAEYGKWEPFYLDPNLVELSSRYLETLELTNVALDATIFSQLANSCPALQNMLLTDCLLEVEEISSSSLKNLDIIDCYILKDLSICTPSLVSLCIKNERTDNSSFRNSYLIFATVIIIDASSVSSMELLAMDRQFTFVEKDGGEPMFNNLRNLSLGLWCINNMFSPLRRFVRHSPMLRMVTLRISPLDWKSHLTKEHQEMLISIRDRRGLILYIDWY

SEQ ID NO: 53153 - protein, 668 aa, Medicago truncatula
MAPLYVSLHTQTLVLCYTIGIISTLQIIHIANSLSFEYPYFKNGDVNWEGDASPYKGAIQITSNTLDQNNNYSVGRVTSFKQMRLWDLNSGNLSDFTTKFSFVVYSNKRDYGDGMVFFLADPALPLLKNISEGGGLGLVDGNQVLKSTQHSFVAVEFDTFNNPWDPPGEGTHVGLNFNSMRSNITKPWLTNIQERRVYNCSIEYKSSTLNLSVSFTMYDDDDDKPFEEYISHKVDLRDVLPERVIVGFSAATGILYEVHTLRSWSFSSSLLSDETKNQVVAPIPSPIISEKENKMGLKVGLGIGTGLAVSLSGLVCTLLWKMSRGRKEEFGFDLNMDDEFQKGSGPKRFSYNELVSATNKFSESGKVGQGGFGGVYKGYLKDLNSYVAVKRISRESRQGILEYATEVKVISQLRHRNLVQLLGWCHRKNDFLLIYEFMSNGSLDSHLYSKKSLLTWTMRYNIALGLASALLYLQEEWEQCVLHRDIKSSNIMLDSCFNARLGDFGLARLVDHETGSQTTIIAGTRGYIAPEYFTSGKPTKESDIFSFGVVLLEIASGRKAIEREEKEGQISVVEWVWELYGLGKFLEAVDPKLCGAFDEQQLERLVIVGLWCVHPDYSFRPSIRQVIQVLKFESPSPILPEKMPVPTYLPPTIKALFSSVSSIYWTNS

SEQ ID NO: 53154 - protein, 311 aa, Isochrysis galbana
MLSAVSTGLALIAPAPGRVAPMQRSGAVSMVQKDNLAAQIAGVAAAVLAVGVQSASAGPFTREDIASLTYLQIKGTGLANTCPIVQPSESGKTTISVGPGAKIEEFCLEPTSFQVLEEKMTKKGLVTEAVDTKVTTRQTYVLTGIDGDLVQKDGKLTFLEKDGIDYAATTVQLPGGERVPFLFTVKNLVAQSDVATSSISPGLKMAGSFTVPSYRTGLFLDPKGRGTTTGYDQAVALPALQAGGDESLFKENDKKFDVGTGTIEMKVTAVNAELGEFGGVFVQKQPSDTDLGSKQPKEVLLKGQFFGTVNN

SEQ ID NO: 53155 - protein, 297 aa, Myxococcus xanthus DK 1622
MSALLRGIVAYPITPFTSTGRVDEVLLGKIVDDMVKAGVHAIAPLGSTGVLPYLSDDEREQVAEIVIKRVAGRVPTLVGVSSLTTERTVHHAKHAEKLGASAVMIIPMSYWKLSDAEIITHYETVAKRIAIPIAVYNNPATGGLDLSPDVISRLLKIPNVTMVKGSTGDVNRMHRLVQLCGEDVAFYNGSNPLALAAFVAGARGWCTAAPHIIPKLNIELYDAIQRGDVAAARQSFYRQLPFLQFIVAHGLPRAISAALELQGTSVGPLRAPLQALPAERVEELRRILVGLEVIPGE

SEQ ID NO: 53156 - protein, 585 aa, Triticum aestivum
  misc_feature (92)..(92): Xaa can be any naturally occurring amino acid
  misc_feature (426)..(426): Xaa can be any naturally occurring amino acid
  misc_feature (456)..(456): Xaa can be any naturally occurring amino acid
MAMVDEPLYPIAVLIDELKNEDIQLRLNSIRRLSTIARALGEERTRKELIPFLSENNDDEDEVLLAMAEELGVFIPYVGGVEHAHVLLPPLXETLSTVEETCVRDKAVESLCRIGAQMKENDIVDYFIAVVKRLAAGEWFTARVSSCGLFHIAYPSATDPLKTELRTIYGQLCQDDMPMVRRAAASNLGKFAATVEQSHLKTEIMSIFDDLTQDDQDSVRLLAVEGCAALGKLLEPQDCVAHILPVIVNFSQDKSWRVRYMVANQLYELCEAVGPEPTRADLVPAYVRLLRDNEAEVRIAAAGKVTKFCRILSPQLAIQHILPCVKELSSDSSQHVRSALASVIMGMAPVLGKDATIEQLLPIFLSLLKDEFPDVRLNIISKLDQVNQVIGIDLLSQSLLPAIVELAEDRHWRVRLAIIEYIPLLXASQLGVGFFDDKLGALCMQWLEDKVFSIRXAAANNLKRLAEEFGPEWAMQHIIPQVLEKINNPHYLYRMTILQAISLLAPVMGAEITCQKLLPVVINSSKDRVPNIKFNVAKVLQSLVPILDQSTVKPCLVELSEDPDVDVRYYANQALQACDQIMMSS

SEQ ID NO: 53157 - protein, 498 aa, Francisella tularensis subsp. tularensis SCHU S4
MSILKELDLGLQAYITNDTNNVIETLNPATGELLAKVRNQSVTTMQEAIAKATEVAKQWRQVPAPKRGELVRLIDEELRRNKDHLGSLVSLEMGKSKQEGDGEVQEMIDMADFAVGQSRMLYGMMMNSERHNHRMYEQWHPLGVVGVISAFNFPVAVWSWNAFIAVICGNTVVWKPSEKIPLCSIAVHNICQKVIKEHNYPEIFYTVISKDVEVSKTLVNDERVNLVSFTGSTKVGQDVGQQVAKRFGKSILELGGNNATIIDESANLKLAIPAAVFGAVGTAGQRCTSLRRLFIHESIYDLVKEKMVNAYKQVKVGDPLDQANLMGPLIDQAAVDNFTRTVEQAINQGGKVLTGGKSIAKPGFFVEPTIIEANHNMPIVAEENFCPILYIMPFKDIDEAIALNNSVIYGLSSSIFTDNLQNAEKFLSSLGSDCGIANVNIGTSGAEIGGAFGGEKHTGGGREAGSDAWKAYMRRQTSTINYGKDLPLAQGIKFNLGE

SEQ ID NO: 53158 - protein, 320 aa, Geobacter sulfurreducens PCA
MPQLNMVQAINLALREEMARDNRLVVLGEDVGRDGGVFRVTEGLFEQFGGDRVMDTPLSESAIAGAAIGMAVCGMRPVAEIQFMGFIYAAFDQLVAHAARIRTRSRGRFTCPLVIRTPYGGGIKAPELHEESTEALFCHVPGLKVVVPSGPYSAKGLLLAAIRDPDPVLFLEPTRLYRLVKEEVPEGDYTLPLGTARIVRQGGAVTVVAWGSMLQRTIQAVEGYDAEVIDPMTLAPFDGETLLASVRKTGRLVIVHEAPLTCGLGAEIAATVAEEAILHLRGPVVRVAAPDVPVPLARLMDRYLPSVERIQAAVKEVLTY

SEQ ID NO: 53159 - protein, 461 aa, Oryza sativa (japonica cultivar-group)
MGRKIKVKKKKASSKVWQPGVDTLEEGEELQFDPQAYNYLRGFNIGWPCLSFDVVRDQLGLVRSEFPHTLYGVAGTQAERATWNYIGIFKICNINGKKREPIPASAIDGDSDMDSESSSDEEDEAVNEDTMPILHLKKVAHAGCVNRIRSMNQEPHICATWGDTGHVQVLIFDSRGTESKLYQRLEWTCEVWDFSSFLNSLAESGAVAHNEDDRIHNHVPVKIFGSHKDEGYAIDWSPLVTGRLVSGDCNKCIHLWEPTSNSWNVDTNPFWSPTEADIFASCSADRTISIWDIRTGKKPCISVRAHNADVNVISWNRLASCMIASGCDDGSFSIRDLRLIKDDSLVAHFEYHKHPITSVEWSPHEPSTLAVSSADHQLTIWDLSLEKDAEEEAEFRARMREQADAPEDLPPQLLFVHQGQKDLKELHWHPQIPSMIISTAADGFNMLMPSNIDTTIREADA

SEQ ID NO: 53160 - protein, 421 aa, Ehrlichia ruminantium str. Welgevonden
MANVKINNISARQILDSRGYPTIEVQITLSNNVFAKASIPSGASVGKFEAVELRDHDTNYYHGYGVTKAVNLINSEIGQKIIKLETLDQEKIDNALIEIDGTNNKSRVGANSILAISLAVAKAAASTLNIPLYQYLGGITAKILPTPLINIINGGMHADNNLDFQEFMIIPHGANSFEDAIRMSSEVFHTLKKILKQKQYNTNVGDEGGFAPNIKDNTEVFDIIIDAIEKSGYKVYKDFSLGLDVAASTFYKNEKYKFSDYQFSTHELVEYYKNIVTQYPIISLEDPIAEEDTLGWKMITKELGDKIQIVGDDLFVTNCKLIKNGIDNNMANAVLIKPNQIGTLTETLNAIRLAQKNNYNVILSHRSGETNDTTISHIAVAVNCGQIKTGSLSRSERLAKYNELLYIEKLLNTSAIYQGML

SEQ ID NO: 53161 - protein, 485 aa, Brassica juncea
MAMASLYRRSLPSPPAIDFSSAEGKKIFNEALQKGTMEGFFRLISYFQTQSEPAYCGLASLSVVLNALSIDPGRKWKGPWRWFDESMLDCCEPLEAVKEKGISFGKVVCLAHCSGAKVEAFRTNQTTIDDFRKFVMKCSTSENCHMISTYHRGVFKQTGSGHFSPIGGYNAERDMALILDVARFKYPPHWVPLKLLWEAMDSIDDSTGKRRGFMLISRPHREPGLLYTLSCKDESWISIAKYLKEDVPRLVSSQHVDSVDKILSVVFKSLPSNFNTFIRWVAEVRIAEDTKQNLSAEEKSRLNLKQVVLKEVHETELFKHISKFLSTVGYEDSLTYAAAKACCQGAEILSGCSSKEYCCRETCVTCVKGPGEAEGTVVTGVVVRDGSEQNVDLLVPSTQTDCECGPEANFPAGNDVFTVLLLALPPQTWSGIKDQALMQEMKQLISMASLPTMLQEEVLHLRRQLQLLKRCQENKEEEDFAAPAF

SEQ ID NO: 53162 - protein, 336 aa, marine gamma proteobacterium HTCC2080
MTINRQWLLAERPSGMVGLHNFEYAETPIPEPKNNEVLVKNLFLSFDPAQRNWMVDRKAYLPPVAIGAPMRAASVGEVVDSRHADYQVGDLVQTTGYWQDYVVAAPGEGPMGLVKLPPGVSPEMMLSVLGITGLTAYFGLLDVGQPKAGDTVLVSGAAGSTGSFVGQIAKIKGCRVVGIAGGPDKCRWLEETAGFDAVIDYKNEDVSEQIAHHCPDKWDVFFDNVGGPILEAAIDHINLRSRIVLCGSISGYNATAPIPGPSNLSNLTINRARMEGFVILDYMPRAMEAIQDLMAWVASGDLVYQVDLQEGFDNIPATLQRLYTGQNLGKQLLKIS

SEQ ID NO: 53163 - protein, 407 aa, Pseudomonas putida KT2440
MAIEIKAPTFPESVADGTVATWHKKPGEAVKRDELIVDIETDKVVLEVLATADGVLGDIVKGEGDTVLSDELLGSIVEGGAAAAPAAAAAPAAAPAAAAADAGEDDPIAAPAARKLAEENGIDLATVAGTGKGGRVTKEDVVAAVAKKKSAPAAAPAAKPAAAAAAPVVVAAGDRTEKRVPMTRLRAKIAERLVEAQSNMAMLTTFNEVDMTEVMALRSKYKDLFEKTHNGVRLGFMSFFVKAATEALKRFPAVNASIDGNDIVYHGFADVGVAVSSDRGLVVPVLRNAESMSLAEIENGIATFGKKARDGKLSIEEMTGGTFTITNGGTFGSMMSTPIVNPPQAAILGMHNIIQRPMAINGQVVIRPMMYLALSYDHRLIDGKEAVTFLVTIKNLLEDPSRLLLDI

SEQ ID NO: 53164 - protein, 368 aa, Glycine max
MDLDDFRSILDTAGVDVWMFIDAAIAVASSDSAGDLKRRRDGIVERLYAATAAPPWCRNCDEGGHRLNGHRIKKQSRHSPSPERQPHRSTATASPATPQSLDNGEDEDNDEDLDPYGGLLDDEQKKILEIKEQLEEPDQSEDSLVELLQSLADMDITFQGLKETDIGRHVNRLRKHPSNDLRRLVKLLVRKWKEIVDEWVKLNPRGGSNTLMADGDSSPVQKTTQNGHHQQIPDFAYSPNPHNGSSGSDRNNSEAERKPKVVPRSEPRPKHAPSPSVSTPASATQNRQRESSFDAERLASARRRLQENYKEAEIAKRQRTIQVMDIHDLPKAKGTGDGDDDDACFSIVGAILRVKKPCGRGSDKSVPN

SEQ ID NO: 53165 - protein, 429 aa, Pseudomonas putida KT2440
MADKKAQLVIEGAAPVELPILTGTVGPDVIDVRGLGATGHFTFDPGFMATASCESKITYIDGDKGILLHRGYPIEQLAEQSDYLETCYLLLNGELPNAEQKAQFVSTVKNHTMVHEQLKSFFNGFRRDAHPMAVMCGVVGALSAFYHDSLDINNPQHREISAVRLVAKMPTLAAMVYKYSMGQPMMYPRNDLSYAENFLHMMFNTPCEIKPISPVLAKAMDRIFILHADHEQNASTSTVRLAGSSGANPFACIAAGIAALWGPAHGGANEAVLTMLDEIGDVSNIDKFIAKAKDKNDPFKLMGFGHRVYKNRDPRATVMKQTCDEVLRELGIKNDPQLELAMRLEEIALTDPYFIERSLYPNVDFYSGIILKAIGIPTSMFTVIFALARTVGWISHWKEMLSSPYKIGRPRQLYTGEQKRDIVALKDRK

SEQ ID NO: 53166 - protein, 252 aa, Lolium perenne
MDAGHDNWISTPSSSTSSHEHATAPWSPSPKRPAGRTKFKETRHPVYRGVRRRGSAGRWVCEVRVPGRRGERLWLGTHVTAESAARAHDAAMLAMRGSSAASCLNFADSASLLAVSSAVFEFADVRRAALAAVADFQRRNAANGAATASAGAVVEATSSASAPSPGDNAGSSATSSEATADGMFEVPAALGSDMFELDMSGEMDLGTYYADLAEGLLLDPPSPAAGTEACWDWENGDYGDHGGADAALWSYY

SEQ ID NO: 53167 - protein, 1001 aa, Oryza sativa (indica cultivar-group)
MHQGAARQAGPSGGGGGGGADRLSALPDAALFRIVSHLTARQAVRTSVLSKRWRHVWASAPRVDIRHPCACDERADQERFGDFVTTMLLNRRPFAPIKALRLWWSHDGDAETWIAHAVRRGAEEIDFSARHHQDDPKPELEYTSFISPKIKILKLTTFGMDIKAITHICSRCTSLEELELKDFRRLDGQIRSASLKRLSIINCFISVAFLVDAPNLISLCFIRPLSFERTKESICSSDNRRWPAPVWKDDNDGFDHDDIFAIASGEHFDDKRENESDQDYGFGDGSDDNIASESDHDDDGPPSPYSVSYDGDNECESYEPRDKEESDRTVAYGEIADEYSSNGDPSDEYRGNYVSHDSANYGRANKFGNLKFPVKSIVDASAHEGELLLRRLLENFPMFNNLDTLSLGEWCMVPDFSALSTILTKSPNAKRLYLHLDVLAVEFFTGCVYASILVQANCSTECTRGAAGPRPSGGGGDRLSALPDAVLLRIVSHLKAREAVRTSGISRRWRHVWASAPRVDVRYPCACDGRAVDQKRFRDFVTILLLRRRPLAPFKALRLSWSHDEDDVSAWIAHAVRRGAEEIDLSARRHQGYPVPDYKHFISPKIKILKLTHLRTTRFTADNTLDLLCSGCTSLEELELKDIKSLWGGIQSDSLKRLSIINCHVTSDGFLVEAPNLISLCCIRPVRAVPWFSHMVSLVEATVVLDDSRLSDDYQQPVLDDDDDGSDYDDCFFAPKAEGSDDKRDNEADNDSGDKKNRDGSESDLDDHDGEYDHEDGDKEVDDLEGGVDRTVTYGEIADESSSYGIPTPTPSNEYGGNYGNHDYTILGGDHMLDNLSDVRTLGLLGHQGEMLLRRQLENCPIFNNLNTLTLGEWCMAPDFSALSTILENSPHVERLYLNLDMDIHRSRGGINPTGGSFACNNLKKVKITCRKDDVMVHMLAKFLQRNGISLQKIFVRRTSSTHNGEEGTGKDSSAKRKAQDEAARRAVKQLRRARNSRSPE

SEQ ID NO: 53168 - protein, 247 aa, Lolium perenne
MDAGHDNWISTPSSSTSSHEHATAPWSPPPKRPAGRTKFKETRHPVYRGVRRRGSAGRWVCEVRVPGRRGERLWLGTHVTAESAARAHDAAMLAMRGSSAASCLNFADSASLLAVPSAVFEFADVRRAALAAVADFQRRNAANGTPTASAGTVVEDTSSASAPSSAGNAGSSTTSSGATADGMFQVPAALGSDMFELDMSGEMGLGTYYADLAEGLLLAPPSPAGTEAFWENGDYDYGGPEGALWSY

SEQ ID NO: 53169 - protein, 289 aa, Oryza sativa (japonica cultivar-group)
MNIKGGGRVPVPPAGAGTLVKLVVLGGTAVYAAVNSLYNVEGGHRAIVFNRIQGIKDKVYPEGTHFMIPWFERPIIYDVRARPNLVESTSGSRDLQMVKIGLRVLTRPMPEKLPTIYRTLGENFNERVLPSIIHETLKAVVAQYNASQLITQRETVSREIRKILTERARNFNIALDDVSITSLSFGKEFTHAIEAKQVAAQEAERAKFIVEKAEQDKRSAIIRAQGEAKSAELIGQAIANNPAFLALRQIEAAREISHTMSSSANKVFLDSNDLLLNLQQLTVANKSKK

SEQ ID NO: 53170 - protein, 223 aa, Lolium perenne
MDAASSSDQEKGPHRTVWSEPPKRPAGRTKFKETRHPVYRGVRRRGRAGRWVCEVRVQGTRSSRLWLGTFTTAEMAARAHDAAALALSGRDACLNFADSAWRMLPVLAVGSFGFGSEREIKDAVALAVLAFQRQQQQQQPAASLTPSSSPVQAVDGEKELHGSPAPSTLSMSSSDLLDEHWFGGTDAGSYYDNLTQGMLVEPPTSRTWQEDGVQTPLWSYLFE

SEQ ID NO: 53171 - protein, 665 aa, Haemophilus influenzae R2846
MATRKQLANAIRVLAMDSVQKAKSGHPGAPMGMADIAEVLWRDFLKHNPTNPKWADRDRFVLSNGHGSMLIYSLLHLTGYDLSIEDLKQFRQLHSKTPGHPEYGYAPGVETTTGPLGQGITNAVGMAIAEKTLAGQFNREGHEIVDHHTYVFLGDGCLMEGISHEACSLAGTLGLGKLIAFYDDNNISIDGHVDGWFSDDTAARFEAYGWQVIRNVDGHDAEQIRAATILAQAEKEKPTLIICKTIIGFGSPNKSGSHDSHGAPLGDEEIALTRKALGWEYAPFEIPAEYYAEWSAKEKGSAAEKSWEEKFAAYAKAYPELAAEFKRRVSGELPANWAAESKAFIEKLQANPASIASRKASQNAIEAYAHVLPEFLGGSADLASSNLTLWSGSKPIRAHENVGGNYINYGVREFGMSAIMNGIALHGGFIPYGATFLMFYEYAHNAVRMAALMKQRALFVYTHDSIGLGEDGPTHQPVEQTASLRLIPNLETWRPCDQVESAIAWQQAVERQDGPSALIFTRQNLAQMNRTSAQLDAVKRGAYVLKDCDGTPELIFIATGSEVELAVKAADVLSAEGKKVRVVSMPSTNRFDKQDAAYRESVLPAAVTKRVAIEAGIADFWYKYVGFNGRVVGMNSFGESAPADQLFKLFGFTVENVVAKAKEIL

SEQ ID NO: 53172 - protein, 550 aa, Oryza sativa (indica cultivar-group)
MRRGKAALWRPRHGEGETSRRGGDGDGEAADRLSALPDGVLHHVMSFPKAWEVVRTCVLSRRWRNLWASAPCVDLRIRYFRLDSEPPEEPRDFVNRLFRRREASAPVDTLRLQLSDPDNLFDNDDANAWIRTAIKRNARFIHLTGHRKEIGVLKHRALVSTHLKILKLSYVLIDDKILKQLSSGCKSLEELDLKDCVMTGHQISSASLKTLKMDRCKINVDLSITAPNLVFLNIVTPYIRVPSFKNLESLVTCSIILDDLFLGDDYQHISDEDDIDETTDDDDFGYQKNDKAGYRINYAKKGFVFGGNEDGYGYGSDIESDDNTYEYSEIANECGELQYGNNGDGHNSSKDGEYDNAETFGGQNVIHSLSNVRSLELLAGAGEVVLSRELKSCPIFINLKTLSLGEWCMDAEFDALVFLLQRSPNLERLFLEPQLISLFCKKNFNTRKALESGVKPTGRSFTCKDLQMVKIRCSKDDARVHMLAHLFRANGIPFDKIYVHRSGSSRLRSEKVMRDLAKQELEFWGSDEFWGSDYEYCGPDPEFGDSDLEF

SEQ ID NO: 53173 - protein, 224 aa, Lolium perenne
MDAASSSDQEQGPQTHRTVWSEPPKRPAGRTKFKETRHPVYRGVRRRGRAGRWVCEVRVLGTRSSRLWLGTFTTAEMAARAHDAAALALSGHDACLNFADSSWRMLPVLAAGSFGFGSAREIKDAVALAVLAFQRRQQQPAASLVPSSLPAQAAADEKDFHGSPAPSTLSMSSSDLLDEHWFGGTDAGGSCYDHLTQGMLVEPPTSRTSQEDGLQTPLWSHLFE

SEQ ID NO: 53174 - protein, 162 aa, Lolium perenne
MRVQGGRGYRLWLGTFATAEMAARAHDAAALALSGSAACLNFADSAWRMLPVLAAGSSGFGSAREIKEAVALAVVAFQLCPVAESSLAAETDVDGPPTPTALFYMSSGDLLELDEEHWFDGMVAGPYYESLAQGMLVEPPDAGAWREDGGVAETPLWSYMFQ

SEQ ID NO: 53175 - protein, 445 aa, Lactobacillus johnsonii NCC 533
MSKTITAEDIKKSVKDNDVRFLRLAFTDINGTSKAVEVPTSQLDKVLTNDIRFDGSSIDGFVRLEESDMVLYPDFSTWAVLPWGDEKGGKIGRLVCSVHKTNGEPFEGDPRNNLKRVLKEMKEKGFTDFDIGFEAEFHLFKLGEDGNWTTEVPDHASYFDMTSDDAGARCRRDIVETLESIGFEVEAAHHEVGDGQQEIDFRFDDALTTADRVQTFKMVVREVARKHGLYATFMAKPVEGQAGNGMHTNMSLFKDGKNVFYDKDGEFHLSDTALYFLNGILEHARAITAIGNPTVNSYKRLIPGFEAPVYISWASKNRSPLVRIPDAEEINTRLEMRSADPTANPYLLLAACLTAGLNGIKEAKKPMAPITSNVFEMSEEERAKRGIKPLPSTLHNAVKAFKADPLIQEALGEHLTQSFIDSKNLEWSKYTQSVSDWERDRYMGY

SEQ ID NO: 53176 - protein, 336 aa, Pseudomonas syringae pv. tomato str. DC3000
MSRVTLSRYLIEQTRSNNTPADLRFLIEVVARACKEISHAVSKGALGGVLGSMGTENVQGEVQKKLDVISNEILLEANEWGGHLAGMASEEMDNAYQIPGKYPKGAYLLVFDPLDGSSNIDINAPVGTIFSVLRCPNEYLSQNEALNEKAFLQPGTEQVAAGYAIYGPQTMLVLTLGDGVKGFTLDREMGSFVLTHEDITIPETTQEFAVNMSNQRHWEAPVQRYVSELLAGEDGPLKKNYNMRWVAAMVADVHRILTRGGLFMYPRDSREPSKPGKLRLMYEANPMSFLVEQAGGASTDGHQRILDIQPEGLHQRVAVYLGSKEEVERATAYHKE

SEQ ID NO: 53177 - protein, 546 aa, Arabidopsis thaliana
MASRIINHSKKLKHVSALLRRDHAVAVRCFSNSTHPSLVGREDIFKARLNYSSVERISKCGTGNVTMLSGISTTSTKLSSPMAGPKLFKEFIRYLPDAISERIFIQFRYLVLYYLPPHQEIGMPSLSPTMTEGNIARWLKKEGDKVAPGEVLCEVETDKATVEMECMEEGFLAKIVKEEGAKEIQVGEVIAITVEDEDDIQKFKDYTPSSDTGPAAPEAKPAPSLPKEEKVEKPASAPEAKISKPSSAPSEDRIFASPLARKLAEDNNVPLSSIKGTGPEGRIVKADVEDFLASGSKETTAKPSKQVDSKVPALDYVDIPHTQIRKVTASRLAFSKQTIPHYYLTVDTCVDKMMGLRSQLNSFQEASGGKRISVNDLVIKAAALALRKVPQCNSSWTDEYIRQFKNVNINVAVQTENGLYVPVVKDADKKGLSTIGEEVRFLAQKAKENSLKPEDYEGGTFTVSNLGGPFGIKQFCAVINPPQAAILAIGSAEKRVVPGTGPDQYNVASYMSVTLSCDHRVIDGAIGAEWLKAFKGYIETPESMLL

SEQ ID NO: 53178 - protein, 594 aa, Oryza sativa (japonica cultivar-group)
MSPRVRMSVARWLPSSPAHGKTKSRRSSSAVRPTLLVIAVTVIAVLLVAVVFGGAGRWTLSGGGDTSWVSAGARVVINAEQLVVAYTAYEECPGQQRDGDDPVAAAVEPRNDRLLGGLLSPDFDDSSCLSRYRAGLYRRQSPHAVSPHLVASLRRYESIHRRCGPGTSAYERAVERLRSPPPSNTSDAECRYLVWTPLEGLGNRMLTLTSAFLYALLTDRVLLFHHPAGEGLRDLFCEPFPGSTWTLPEGDFPFSGMQGFNARTRESLGNALRRGEGAAKDHPPPPPPWMYVHLRHDYNRNANDPRFFCDDGQDALRRVGWVVLLSDNYFVPGLFLVPRFERALSRMLPRRDAAFHHLGRYLLHPSNTVWGMVARYHASYMACANERVGIQVRSFYWARISTDELYGQIMSCAHGENILPRVTQQGPNFTAAGDQPQPAARPGRRKAVLVVSLHGAYSERIKDLYYEHGAAGGESVSVFQPTHLDRQRSGEQLHNQKALAEMMLLSFSDVVVTSAASTFGYVGHGLAGLRPWVLMSPLDKKVPDPPCRLAATIEPCFHNPPNYDCRTRAKGDTGKIVRHIRHCEDFENGVQLVD

SEQ ID NO: 53179 - protein, 546 aa, Methylococcus capsulatus str. Bath
MLKKHPTFPGISGPVVTVVMDGFGYSPKTTGNAIAQAYTPTLDRLLATCPHTLLKAHGKAVGMPSDDDMGNSEVGHNALGSGQIYHQGAALVAEAIASGALFEGTAWREIMDNARQHGSTLHFIGLLSDGNVHSHIDHLKAMIVRAKAEGQRRVRIHILLDGRDVPETSALEYVGPFEAFLAELRDETFDARIASGGGRMNITMDRYEADWGMVERGWHTHVLGEARHFESATQAIETLRAEHTGIIDQDLPPFVVAHDGEPVGQIFDKDSVIFFNFRGDRAIEISRAFEEEEFAPFDRVRHPGVTYAGMLQYDGDLGIPRRYLVAPPAIHGTVGEYLAAEGITQLAISETQKYGHVTYFWNGNRSGKFNESLETYVEIPSDRVPFEQRPWMKSAEITDELIRQIKTGRHRTVRVNYANGDMVGHTGHYQATIIAVEAVDLALSRLLPVIDALGGVALITADHGNADEMYELDKKTGEPQRTPSGAPKAKTSHTLNSVPFIYYDRLNRAVIQNPGDAGLSAVAATTVNLLGYEAPDLWDRGLLAFG

SEQ ID NO: 53180 - protein, 115 aa, Bordetella bronchiseptica RB50
MTPPTAGDDILSRIADTLATRRPEAGGDPQSSYVAKLLSKAPDAFLKKIGEEATELVMAAKDGQPDRIISETADLWFHCLVALTHYNLRPEDVLAELARREGLSGLEEKARRPRD

SEQ ID NO: 53181 - protein, 116 aa, Myxococcus xanthus DK 1622
MSDCLFCKIRDGLIPAKVVYRDDVCVAFEDINPQAPTHVLFIPHKHIPTVNDITTEDRELVGHLFIAAAKVAQERGHADPSDGYRVVMNTHAHAGQTVFHIHLHLLAGRPLGWPPG

SEQ ID NO: 53182 - protein, 334 aa, Phaeodactylum tricornutum
MPVSLGINGFGRIGRLVMRAALEHPDATVVAVNDPFLTPEYAAYQFKYDSVHGTYSEDVSFEEGYLVVGDKKIRFFSERNPEEIGWGSVGAEIVCESTGVFTTIDKAQAHINGGAEKVVISAPSADAPMYVMGVNHTTYSGATVFSNASCTTNCLAPLAKVLHEEFGIVEGLMTTIHAGTATQLVVDGPAKRGKDWRAGRSSLANLIPASTGAAKAVGKVIPELNGKLTGMAVRVPTADVSMVDLTIRTEKAVSAAELKAALKKASEGPMKGILGYTEDAVVSQDFVHDPRSSIVDASAGIALNDNFHKVIAWYDNEWGYSNRLVDLAIYTSGK

SEQ ID NO: 53183 - protein, 415 aa, Haemophilus influenzae R2846
MNFFQYKHNKLYAEDIPVQQLAEQFGTPLYVYSRATLERHWHAFDSAFGKRPHLICFAVKSCSNIGVLNIMAKLGSGFDIVSQGELERVLAAGGDASKVVFSGVAKSREEIMRALEVGIRCFNVESVSELKHINQIAGEMGKIAPISLRVNPDVDAHTHPYISTGLKENKFGVSVNEAREVYKLASTLPNIKITGMDCHIGSQLTELQPFLDAADRLIVLMEQLKEDGITLKHLDLGGGLGVTYTDETPPHPSDYANALLEKLKNYPELEIILEPGRAISANAGILVAKVQYLKSNESRNFAITDTGMNDMIRPALYEAYMNIIEIDRTLAREKAIYDVVGPVCETSDFLGKQRELSIAEGDYIAQCSAGAYGASMSSNYNSRPRTAEVLVDGDQSYLIRRRETLQELWVLESTI

SEQ ID NO: 53184 - protein, 199 aa, Arabidopsis thaliana
MSFLAVHQIVRKKLQLVGVTALLLACKYEEVSVPVVDDLILISDKAYSRREVLDMEKLMANTLQFNFSLPTPYVFMKRFLKAAQSDKKLEILSFFMIELCLVEYEMLEYLPSKLAASAIYTAQCTLKGFEEWSKTCEFHTGYNEEQLLACARKMVAFHHKAGTGKLTGSTTHLSSFMLQEVNQLGFCFKGGKNYNKNLI

SEQ ID NO: 53185 - protein, 225 aa, Glycine max
MGSDSNLGGSPSASSPSAKRTRDPEEEVYLDNLRSHKRYLSEIMASSLNGLTVGDSLPDNLMESPARSESMFSFRDDMSLQYSPMSKNSNDLRFCETPGHSCSSQPDSLPSSPVSPHRYQRPQNALPSAPFSSSNASYGSTIACPQPRQRGSDSEGRFPSSPSDICHSADLRRAALLRSVQMKTQPPSPASLDLPFVSNPESAPNIDPEERSCPYMKSLVDEREY

SEQ ID NO: 53186 - protein, 472 aa, Gloeobacter violaceus PCC 7421
MAKTPDDVLKMIQDEDVKIVDLKFIDLPGTWQHCSFATNQIDADAFAEGIPFDGSSIRGWKAINESDMLMVPDPSTAFIDPFFKETTLSLTCSIREPRTGEPYGRDPRTIAAKALEYLKGTGIADTAYFGPEAEFFIFDDVRFDQTQNAGYYYLDSVEGNWNTGRNEGPNLGYKPRNKEGYFPVAPTDSMQDIRTEMLLTMGSLGVPIEKHHHEVASGGQAELGVRFLSMVEAADALQIYKYVIKNVARKHGKVATFMPKPIFNDNGTGMHTHQSLWKDGQPLFAGDKYADLSEMALYYIGGLLKHAPAILAFSNPTTNSYKRLVPGFEAPVNLAYSQGNRSASIRIPLSGKSPKAKRLEFRCPDASSNAYIAFAAMLMAGLDGIKNKIDPGEPLDVDIYELSAEELAKVPSTPGSLSEALKALEEDHAFLTEGGVFSEELINVWIEYKLEKEVIPMSLRPHPYEFSLYFDV

SEQ ID NO: 53187 - protein, 339 aa, Odontella sinensis
MTVSLGINGFGRIGRLVMRAALENPDTTVVAVNDPFMNIDYAAYQIKHDSVHGMYPGSVEVDGDSLVFDGTTKVKFFAERDPASIPWGASGAEYVCESTGVFTTIEKASLHLKGGAKKVIISAPSANAPMFVMGVNHKSYDGSADVVSNASCTTNCLAPLAKVLHENFGIEEGLMTTIHAATATQLVVDGPSKGGKDWRGGRSAMANMIPASTGAAKAVGKVLPELNGKLTGMAVRVPTPDVSMVDLTVRTTKACTGAEIDAALKAASESEDLKGILGYTDLPVVSQDFVHDKRSSIVDSTACIHLSDTFHKVISWYDNEWGYSNRLVDLCLFMKTVDN

SEQ ID NO: 53188 - protein, 429 aa, Arabidopsis thaliana; identical to SEQ ID NO: 1352

SEQ ID NO: 53189 - protein, 615 aa, Odontella sinensis
MISGTARALASSASNASKRAFHASARSDARKFFVGGNWKCNGSVQQVNDLVSMLNQSTLSTDTEVVVCPSQVYVQGVSEKLRKDIGVGAQDCWVQGNGAFTGETSADMLADMGVGWVVIGHSERRGKGEADEEVARKAKYALDKGLKVIACCGEPLESREAGTTNDFVFPQIKAYADVFSKEDWANVVIAYEPIWAIGTGLTATPEQAQDTHADIRQYLGEVAGADVAESTRILYGGSATGATAPGLSAKPDIDGFLVGGASLKPEFADIVNCQGGETSLKPVNIGINGFGRIGRLVMRAAQNDPMVNIVSVNDPFIPVNYMEYMLQYDTVHGEYPGTVKQTGDDTLSIDGKDVKVFGEMDPSKIQWGSVGADYVIESTGVFTSTEKASMHMKGGAKKVVISAPSGDAPMFVMGVNQEKYESSMDVVSNASCTTNCLAPLAKVINDEFGLKEGLMTTVHAVTATQQTVDGPSQKDWRGGRAACYNIIPSSTGAAKAVGKVIPELNGKLTGMSFRVPTANVSVVDLTARLDKGASYETICAAIKEASEGKMKGILGYQDKDIVSSDFISDRHSSIFDEKAGIALTDDFVKLVSWYDNECGYSNRVLDLIKHMDVSK

SEQ ID NO: 53190 - protein, 130 aa, Haemophilus influenzae R2846
MMTQIIHTEKAPVAIGPYVQAVDLGNLVLTSGQIPVNPATGEVPADIVAQARQSLENVKAIIEKAGLTAADIVKTTVFVKDLNDFAAVNAEYERFFKENNHPNFPARSCVEVARLPKDVGLEIEAIAVRK

SEQ ID NO: 53191 - protein, 379 aa, Phaeodactylum tricornutum
MKFSAATFAALVGSAAAYSSSSFTGSALKSSASNDASMSMATGMGVNGFGRIGRLVTRIMMEDDECDLVGINAGSATPDYMAYQYKYDTIHGKAKQTVEIDGDFLVLDGKKIITSRCRDPKEVGWGALGADYVCESTGVFLTKESAQSIIDGGAKKVIYSAPAKDDSLTIVMGVNQEAYDGSEDFISCASCTTNGLAPMVKAIHDEFVIEEALMTTVHAMTATQAVVDSSSRKDWRGGRAASGNIIPSSTGAAKAVTKVIPSLVGKITGMAFRVPTIDVSVVDLTAKLEKSTTYEEICAVIKAKSEGEMKGFLGYSDEPLVSTDFEGDLRSSIFDADAGIMLNPNFVKLIAWYDNEYGYSGRVVDLMKHVAAVDAKIKA

SEQ ID NO: 53192 - protein, 210 aa, Lolium perenne
MDAASTSSQEQPHSHRTVCSEPPKRPAGRTKFHETRHPVYRGVRRRGRVGQWVCEMRVHGARGSRLWLGTFATAEMAARAHDAAALALSGPDACLNFADSAWRMLPVLAAGSFGFGSTREVKAAVALAVVAFTVRATPVAEKVVISSPAPSAALFYMSSGDLLELDDEHWFGGMVAGPYYESLAQGMLVEPPDAGAWREDGGAVQTPLWS

SEQ ID NO: 53193 - protein, 334 aa, Actinobacillus pleuropneumoniae serovar 1 str. 4074
MKTLGEFIIEKQAEYPEAKGELSGILSSIRLAAKIIHREINRAGLSQDILGVAGSENIQGEAQMKLDVFANETMKKALLAREEVAGFASEEDDNFVAFENDRAKNAKYILMTDPLDGSSNIDVNVSVGTIFSIYKRVSPIGSPVTMEDFLQEGRKQVASGYVTYGSSTMLVYTTGNGVNGFTYDPSLGLFILSHPDMKIPTEGKYYSINEGQYVTFPMGVKKFIKYCQESDEATKRPYSSRYIGSLVSDFHRNLLKGGIYIYPTSTVYPKGKLRLLYEGNPMAFLAEQAGGMATDGFNPILDIKPSELHQRVPFFVGSTSMVKQADKFMQECAE

SEQ ID NO: 53194 - protein, 136 aa, Capsicum annuum
  misc_feature (27)..(27): Xaa can be any naturally occurring amino acid
  misc_feature (134)..(134): Xaa can be any naturally occurring amino acid
MLLEKIVDVISGKNDDGKKMKGTVVLXKKNALDFNDVNASFLDGVLEFLGKRVSLQLISSVHGDPANGLQGKRSKPAYLENWLTTRTPLVAGESAFDVTFDWDEDIGVPGAFIINNLHFNEFFLKSLTLEDVPXYE

SEQ ID NO: 53195 - protein, 646 aa, Xanthomonas oryzae pv. oryzae
MFNINRLLRSRPQTDNADQAPAQDRPSRQPSPAQGLLSPLLARPRRRESRSAADTSTPRNAAQGRFSRSPLHPSSQPEALAGASSAPPRSIEHDIDDWLAQSLPMAERIPTGYNLHDGSRDTSRDVLQSAAEAIRRAATRRSTELLVDGLPATRLPDAIGRLDALQKLMLLYTGVQSLPDSLGQLSQLHHLQISGAQELKTLPPSLTRLSNLRTLQLMMVPLDELPADLGRMQGLRSLALGGGHYARLPASIVELSRLTGLRVSHSSHFRELPENIGLMQGLRSLELASNSKLEQLPGSLTQLHRLKKLDLSSNRRLAHLPEDIGQLRGLTELSLKSCAALRQLPGSVGDLAQLQLLDLRGTGLQTLPPWLARLPDRCDIKVSDHLADQLQQIRDPERAQRAAQRLADRRRHASVPAAQQAGASWNRVPEFTRVLRSVDADLGERFEKWTQGLTQNARIFGASITSADMPLLDQVVAEAIRSPEFRSTFGQFLNDHTVKTLNMDGMTQVGDGGPRVRGDVKTAFAEMLKHNIMHTQDQETALGLLQQALQNSGLGLARERLLRSTNQLTGRAEMWPPLKAYISMHDVEGKAAQDAAITWAMAQLDEAHEGVIGEAEAKQESEQAQANANRFIERRARVLLREWGIH

SEQ ID NO: 53196 - protein, 160 aa, Prunus persica
NCFEELEPPAVLKAIAGGLCVPDAPTPPVFYIGPLIAEEKQSGDAAEAEVCLSWLDKQPSRSVVFLCFGSRGSFAGAQLKEMADGLEKSGQRFLWVVKKPPLDEKTKQVHGVHDFDLEGLLPEGFLERTKDRGLVVKSWAPQVAVLKKESVGGFVTHCGW

SEQ ID NO: 53197 - protein, 377 aa, Physcomitrella patens
MADGEEVQPLVCDNGTGMVKAGFAGDDAPRAVFPSIVGRPRHTGVMVGMGQKDAYVGDEAQSKRGILTLKYPIEHGVVTNWDDMEKIWHHTFYNELRVAPEEHPVLLTEAPLNPKANREKMTQIMFETFNVPAMYVAIQAVLSLYASGRTTGIVLDSGDGVTHTVPIYEGYALPHAILRLDLAGRDLTDALTKILTERGYSFTTTAEREIVRDMKEKLAYVAIDFEQELDTARSSSSLEKSYELPDGQVITIGAERFRCPEVLFNPSLIGMEAAGIHETTYNSIMKCDVDIRKDLYGNIVLSGGSTMFPGIADRMSKEITALAPSSMKIKVVAPPERKYSVWIGGSILASLSTFQQMWIAKSEYDESGPSIVHRKCF

SEQ ID NO: 53198 - protein, 216 aa, Bifidobacterium longum NCC2705
MSVYDIDLFLRNKEDREYSWRWQKESPVWNAQPGTAHKALVKLEQAGMLTLLATQNFDALHEKAGNSDNVIVNLHGTIGTSHCMKCHQEYATADIMARLDEEPDPHCHRKLKYRGDMPCNGIIKTDVVYFGEALPDGAMEKSYSLATKADELWVIGSTLEVYPAASIVPVAAQAGVPITIMNMGHTQYDHLASRLIHEDIAVALPKLVDETIAENK

SEQ ID NO: 53199 - protein, 300 aa, Zea mays
  misc_feature (19)..(19): Xaa can be any naturally occurring amino acid
  misc_feature (207)..(207): Xaa can be any naturally occurring amino acid
  misc_feature (221)..(221): Xaa can be any naturally occurring amino acid
SQLDPRVRAWLVAKNTLKXMPFKLPPVGPYDVRVRMKAVGICGSDVHYLREMRIAHFVVKEPMVIGHECAGVVEEVGAGVTHLSVGDRVALEPGVSCWRCRHCKGGRYNLCEDMKFFATPPVHGSLANQVVHPADLCFKLPDGVSLEEGAMCEPLSVGVHACRRAGVGPETGVLVVGAGPIGLVSLLAARAFCAPRVVVADVDYHRXLALARSLGACSAVXLSPLSVDLADEVEPLRPALGPRPSPPPGLLSVLPSCSPCLLLLPLVPRVPGPAWSLPPLFFLVCGVGSGRCTGWLFSVP

SEQ ID NO: 53200 - protein, 132 aa, Pseudomonas sp. BS
MDFDMISEVSSVHAPGAVGPYSQAIKTGNLLFVSGQLPIVPATGQFCSDDAASQARQCLENIAAIADQAGTALTHTVKTTVLLTDLNDFALVNEIYAGFFSAPYPARACYEVKALPRGAKVEIEAVIAMPPA

SEQ ID NO: 53201 - protein, 614 aa, Phaeodactylum tricornutum
MLASSRTAAASVQRMSSRAFHASSLTEARKFFVGGNWKCNGSVQQAADLVSMLNQSSLSQDTEVVICPSQVHLQSVQSTIRGDVAVGAQDVWTQGNGAFTGETSANMLKDLGVKWAVIGHSERRGKGEPDAQVAAKAKYALDQGLSVIACCGEPLEAREAGTTNEYVFPQIKAYVDALEPKDWDRVVIAYEPIWAIGTGLTATPEQAQDTHEAIRQYLGQVAGAEVAANTRILYGGSASAKTAPGLSAKPDIDGFLVGGASLKPEFADIVNCQGDTKSLKPVNIGINGFGRIGRLVMRAAQNDPMINIVAVNDPFIPTDYMEYMFQFDSTHGLYTGTVNMVDESNIAVDGKPIRVFNERDPSKIQWGSAGADYVVESTGVFTTTEKASAHMVGGAKKVVISAPSGDAPMFVMGVNQEKYESSMDVVSNASCTTNCLAPLAKVINDEFGLKEGLMTTVHAVTATQQTVDGPSQKDWRGGRAACYNIIPSSTGAAKAVGKVIPALNGKLTGMSFRVPTIDVSVVDLTCRLDKGAPYATICAAIKAASEGPMKGILGYQNKDVVSSDFISDSHSSIFDEKAGIALTDDFVKLVSWYDNEAGYSMRVLDLIKHMEKSK

SEQ ID NO: 53202 - protein, 330 aa, Methylococcus capsulatus str. Bath
MGNPQYPALDERTLCALAVNVINTEAAAISALADRIDSNFAAGCRLILGCHGRVVVTGMGKSGHIGGKIASTLASTGTPAFFVNPGEACHGDLGMITRNDVVLALSNSGETAELLTILPLIKRLGIPLIAMTGNRLSTLARQSSIHLDTGVQQEACPLGLAPTSSTTAALAMGDALAVALLEARGFTREDFAFSHPGGSLGRRLLTFVRDIMHTGDDTPVIGLEASVRDALLEMTAKKLGMTAIVDGAGTIQGVFTDGDLRRLLEKAQDIHATPITAVMTRSCVTVEGSLLAAEAVRIMEQKRINALPVVENGRLIGAINMHDLLRAGVL

SEQ ID NO: 53203 - protein, 321 aa, Coccidioides immitis RS
MSLPTSRNRTSFQQLEKLGEGTYATEAKSGASANVYKGRNCQTNEIVALKEIHLDEEEGTPSTAIREISLMKELDHENILSLRDVLNTDNKLILVFEYMDNDLKRYMDAQNGPLDPNTIKSFFYQLMRGIAFCHENRILHRDLKPQNLLINRNGRLKLADFGLARAFGIPINTFSNEVVTLWYRPPDVLLGSRSYNTSIDIWSAACIMAEMYNGRPLFSGTTNEDQLLKIFRVMGTPTELTWPGVSQLPEYKSTFPVYAPQSLRRLVPRIDPIGADLLERMLQLRPDFRLSASDALQHPWFHSLPEFTASHQNTLKLNYPN

SEQ ID NO: 53204 - protein, 81 aa, Streptomyces rimosus
MCGIAGWIDFERNLAQERATAWAMTDTMACRGPDDAGLWTGGHAALGHRRLAVIDPAHGRQPMHSTLPDGTSHVITFSGEI

SEQ ID NO: 53205 - protein, 328 aa, Vigna radiata
MSSSSINGWCLSSISPAKTSLKKATLRPSVFATLTTPSSPSSSSSFPSLIQDKPVFAAPSHIITPTVREDMAKDYEQAIEELQKLLREKTELKATAAEKVEQITASLGTSSSDSIPSSEASDRIKSGFLYFKKEKYDKNPALYGELAKGQSPKFMVFACSDSRVCPSHVLDFQPGEAFVVRNVANIVAPYDQSKYSGTGAAIEYAVLHLKVSNIVVIGHSACGGIKGLLSFPFDGTYSTDFIEEWVKIGLPAKAKVKTQHGDAPFAELCTHCEKEAVNVSLGNLLTYPFVRDGLVNKTLALKGGYYDFVKGTFELWSLNFGLASSFSV

SEQ ID NO: 53206 - protein, 379 aa, Vibrio fischeri ES114
MSKRDFYEVLGVSRDASERDIKKAYKRLAMKFHPDRNQGDDTAAEKFKEVKVAYEILTDAQKRSAYDQYGHAAFEQGGMGGGGFGGGGADFGDIFGDVFGDIFGGGRRGGQQRAQRGSDLRYNMELTLEEAGRGCDKEIEVPTLVSCDPCEGTGAKKGTSSTTCSTCHGQGQVQMRQGFFAVQQACPTCHGKGKIIKDPCNSCHGEGRVHKTKTLNVKIPSGVDTGDRIRLSGEGEAGEHGAPAGDLYVQVHVKEHNIFERDGNNLYCEVPVSFTMAALGGEVEVPTLDGRVSLKVPLETQTGRMFRMRGKGVKGVRTHSAGDLIVKLIVETPVKLTKRQKELLQEFQESFDGKDAKKHNPKSEGFLSGVKNFFDDLTK

SEQ ID NO: 53207 - protein, 894 aa, Rhodospirillum centenum
MSSKWVYSFGEGRAEGRAEMKNLLGGKGANLAEMSNLGLPVPPGFTITTEVCTWFYANGRSYPADLRAQVDAALAAVEAVVGMRFGDARNPLLVSVRSGARASMPGMMDTVLNLGLTDATVQGLADRSGDARFAYDSYRRFIQMYGNVVLGVEHHHFEEVLEEVKRERDYTFDTELKAEDWQAVIAGYKAVVDRTLGRPFPQDPVEQLWGAIGAVFGSWMNQRAITYRKLHDIPADWGTAVNVQAMVFGNMGDDCATGVAFTRNPSTGENRFYGEYLINAQGEDVVAGIRTPQHLTIAGKEANGSTLPSMEESMPEVFRQLDAVRLKLERHYRDMQDIEFTVQQSKLYMLQTRTGKRTAAAALKIAVDMAREGLIDERTAVLRIEPKSLDQLLHPTLDPKAKKQIIAKGPAGLAGAASGKVVFTAEEAERLSELGESVILCRVETSPEDIHGMHAARGILTTRGGMTSHAAVVARGMGRACVAGAGELRIDYKRGTMLVRGVEVKAGDILTIDGSTGEVMLGEVPTIQPELSGDFALLMGWADRFRRMKVRTNAETPLDARTARKFGAEGIGLSRTEHMFFDADRIVAVRGMILADTEAGRRAALARIEPMQRQDFVELFKIMTGLPVTIRLLDPPLHEFLPASEAEMEEVAASTGTDLQKVQQRAHQLHEANPMLGHRGCRLGISYPEIYEMQARAIFEAAVVVFQETGETVTPEIMIPLVGTRKELDILKAVIDRVATEVSQRSNRPLDYLVGTMIELPRAALRAAEIARTAEFFSFGTNDLTQTTFGISRDDAASFLPDYQRTGIFEQDPFVTLDTDGVGELVQIAAERGRGARPGIKLGICGEHGGDPSSIYFCEKVGLDYVSCSPYRVPIARLAAAQAAILGEKAASEA

SEQ ID NO: 53208 - protein, 466 aa, Pyrococcus abyssi GE5
MINMTKWDEIKKYTSKKVDENLKIVELDEEYLPRAIGFKYYPLVIERAKGSRVWDKDGNEYIDFLTSAAVFNVGHAHPKVVEAIKEQVDKFLNYTIGYLYTEPPVRLAELLSEMTPGDFEKKVTFGFSGSDAVDSSIKASRAYTKKVHIISFRHSYHGMTYGALSVTGIVDEKVKSIVQPMSNVHIVDYPDPYRNPWNIDGYENPSELANRALDEVEKKIKELNGDVAGIILEPIQGDAGVVIPPLEFIKGLKKLTDEYGMVFIDEEVQTGMGRTGKWWAIEHFEVVPDLLVSAKALGGGMPISAVVGRAEIMDSVPSPLFVFTHVGHAVNASAAIATIKVIKEEKLVERAKELGDYALKRFRELQEEYPIIGDVRGKGLMIGVDIVKEGTKDPNRELAQKICWRAWEKGLIIITFGKHGNVLRIAPPLTISKEDFDRGIEIIEEAIKDAINGKVPDDVIKFLRAW

SEQ ID NO: 53209 - protein, 473 aa, Ralstonia eutropha JMP134
MKTLDQFYIDGQWVDPAPGATAMDIINPATEAVAGKVALGTAADVDRAVAAARAAFPAWSQTSRETRIAMLERITALYKARMTDIAEAVRTEIGAPVALCNTLQAPIGLAHLAAATETLRKFEFETEYGNNYVRHEPIGVAALVTAWNWPLSLICAKTAAALAAGCTVVLKPSEIAPLDAAIFAEIMHEAGTPAGVFNMIYGEGKTVGARLSSHPDVDVISITGSTRAGVEVALSAAPTVKRVHQELGGKSPLLILDDADLQAAVTTGVTQVMMNSGQTCIAPTRMLVPRERYAEAVAVAAAVANAIPVGDPADAATKMGPISNRAQYEKVQRMIGAGIEEGARVAAGGTGRPDGLECGFFARPTVFADVNNGMAIAREEIFGPVLVMIPYDGEEDGIAIANDTPYGLAAYVASGDTARARRVAARLRAGSVRINGAQVDLAMPFGGYKASGNGRENGAYGLAEFFECKSVML

SEQ ID NO: 53210 - protein, 378 aa, Physcomitrella patens
MAGEGEDVQPLVCDNGSGMVKAGFAGDDAPRAVFPSIVGRPRHTGVMVGMGQKDAYVGDEAQSKRGILTLKYPIEHGVVTNWDDMEKIWHHTFYNELRVAPEEHPVLLTEAPLNPKANREKMTQIMFETFNVPAMYVAIQAVLSLYASGRTTGIVLDSGDGVTHTVPIYEGYALPHAILRLDLAGRDLTDALMKILTETRYSFTTTAEREIVRDMKEKLAYVALDFEQGLDTARSSSSLEKSYELPDGQVITIGAERFRCAEVLFNPSLIGMEAAGIHETTYNSIMKCDVDIRKDLYGNIVLSGGSTMFPGIADRMSKEITALAPSSMKIKVVAPPERKYSVWIGGSILASLSTFQQMWIAKSEYDESGPSIVHRKCF

SEQ ID NO: 53211 - protein, 465 aa, Ehrlichia ruminantium str. Welgevonden
MQNYDIVVIGGGPGGYKCAIRSAQLGLKVACVDKNEILGGTCLRVGCIPSKALLHFSHEYYHIKNHLDEVGITCNSLSFNLDKIMSFKNKNITELSNGINYLFASNKIDRLCGVGKIRSINSNNFDITVTGNNGEEKITAKYVVIATGSEVASFPGIEIDEKNVVSSTAALSFKEVPKKLVVVGAGAIGLEMSSVWSRFGSEVTVVEFFDKIAPSMDIDISKALLASLKKQGINFKLSTKVTSIDKSSDNLTIHLESVKDGKSEIIEAEKVLISIGRMPYTDGLIDQNCIECDSRGFIKVNNKYETNIPGIFAIGDVIGGAMLAHKAEEEGIAVAELIAGNIPHVDYDIIPSVIYTHPAVASIGKTEESLKNINYAYNVGKSNFSANSRSKITNNGEGFVKVLTSKENNAILGVHIIGAYADTIINEAAIAMAYRASSEDVFRISHSHPDVNEAFKDACEAAYLK

SEQ ID NO: 53212 - protein, 210 aa, Glycine max
  misc_feature (172)..(173): Xaa can be any naturally occurring amino acid
HASVPLKGCCVVDEEDENHNFEYRRYLVHEYMPNGSLEDHLFPTKLDNQNTKKSLTWPQRKSIILDVANALVYLHFGVQPAVFHRDIKATNILLDADMRGRVGDFGLAKRSSESMSHLNTKVAGTHGYVAPEYAFYGQLTEKSDVYSFGVVILEIMCGRKALEMSPSGTPVXXITDWVWSLMKSGNIGEALDASMLGDENCARNIMERFL

SEQ ID NO: 53213 - protein, 376 aa, marine gamma proteobacterium HTCC2080
MSKRDYYEVLGVDRSTADPDIKKAYRRIAMKFHPDRNPDDKDADAKFKEATEAYDVLMNADKRAAYDQFGHAGLEQGAGGGGFQGGSNFSDIFGDVFGDIFGGGGGGGRQGPQRGSDLRYTMEVSLEEAVRGATREIKVPTLQHCNTCDGSGAKPGTKPVTCGSCGGAGQVRMQQGFFQVQQTCPKCRGQGKTISDPCRDCRGQGLLEKTKTLSVKVPPGVDTGDRIRLSGEGEAGPSGGPSGDLFVQIAVRQHNLFERDGRNLYCEVPINFVDAALGGELEVPTLDGKVKLKIPSETQTGKMFRLRGKGVLPVRGGPIGDLMCRAVVETPINLSAQQKQLLQEFRSTLDEGGNRQSPRQSSWFEGVRSFFDGMTK

SEQ ID NO: 53214 - protein, 501 aa, Ehrlichia ruminantium str. Welgevonden
MTNHSVILCILDGWGNNKNSQFNAIAQADTPYWDSIISQYPQSNIVTHGPDVGLPDRQIGNSEVGHISLGSGRIVLQDLCRINEEIKNIRKNTHLLEFTEQIKRNNGICHIAGLLSDGGIHSSLSHMLDIIDALSYLKIQVVIHIFLDGRDTPPISALKYINILCSHIKDLSNVSIATISGRYYSMDRDNRLDRTTKAYNSIAFGHGKRYEDPISAVQDNYNAGITDEFIIPCVIGNYQGMNPTDGFIMTNFRSDRVIQILKMITEDQNTNHITLKNTIGMIKYSNELNIPCLFPNKKISNTLGEIISNQQLHQLRIAETEKYAHVTFFFNGGREEVFENEERIIIPSPSVTTYDLVPEMSAYEITDTLIKKINLQKYSLIIINYANADMVGHTGNIEATKKAITTLDQCLGKILKCIHNTNYILVITADHGNAEEMFDVQNNMPYTAHTLNPVPFVVCNYPKKIKLKNGRLSDVAPTILEILNIKQPEEMTGISLIDTSN

SEQ ID NO: 53215 - protein, 420 aa, Coccidioides immitis RS
MVVEGDQPYSLAFSVPGFGCNWTMEAPKEESAAPVEPQQQPETPEDAKEEKTNNENQATTTTDNKPNENKSFADTLPLSAADGLIKTLFPRPLDDCRPSSPPELTAEEQTKYETVLKAVSEWTTIPTTSSKNAPTEPLTDDERMFLTRECLLRYLRATKWNVADAIQRLQATLTWRREYGVKEHTQEYISVENETGKQIILGFDNSGRPCLYLNPARQNTEHSDRQIQHLVFMLERVIDLMGPDQESLALLVNFKQTRSGQNATIGQGRQTLHILQNHYPERLGRALVINMPLVILGFMKLITPFIDPRTREKLKFNEDLRQHVPPAQLWKAVNGDVEFEYDHASYWPALNALAAQRREEYRERWNKGGKLVGEHENYLKGGPGKSRAETEVPNTARVEEKLEQLDVTDSPAAPAQPVAA

SEQ ID NO: 53216 - protein, 270 aa, Aquifex aeolicus VF5
MRLSKVLRSDLNTLFLFELEDGYTVESVFYRGDTLCVSTQVGCPVRCTFCASGKNGLFRNLSAEEIYNQYELLKDRYPIKRIAVAGIGEPLSNWRNVKEAFEKFKKEGLKVSFYTTGFPTKHLRELLHLPHSGVTISLHSLNDETRKYLMPHAGKLEEVIKVLEEELPKLSSKKRKKVSLAYILLKDVNDSQEELEKLAELAKRLGVSITLLYYNKTFEFEPVSEKEYEEAFLFLRSKGVRVTLSTRFRKDKLGGCGTLVVNRNKELTKV

SEQ ID NO: 53217 - protein, 276 aa, Listeria monocytogenes EGD-e
MKKITPKAMCAWIPKREDETHKGDYGRVLIVAGNKQFGGAAIMAAEACVKSGAGLTTVASDSVNRPALQTRIPECMFIDYENITSLSEQISQFDTILIGPGLGLDAYAEEIFRLVLQKSTEHQQVIIDGDGITIYAKGENPHPAAKLTFTPHAGEWERLKVLAPDAVTPTDVALAIDATIVLKGHRTKVYSGESAWQNMYGTPAMATGGMGDTLAGTICGLMAQTEKPITGTLAAVFLHSYIGEILAKKRYVVLPTEIAEELPTYLKIFSETDEHA

SEQ ID NO: 53218 - protein, 990 aa, Xanthomonas campestris pv. campestris str. ATCC 33913
MQHGSHCTVVYDGKTLHGQADIPLIEFLSGHGIDLSHICYHPALGAPQTCDVCWVEVGGELVRGCTLRSHDGLEVSSTVERAHAARHEGMDRVLAKHELYCTLCEHNTGDCTLHNTFADMKMPIQRYAFQRKPYEKDHSNPFYTYDPDQCILCGRCVEACQKVEVNETLSIDFSMEHPRVLWDGGKPINASSCVSCGHCVTVCPCNALLEKTMQPDAGPLTALPQELKRPMIDMVKTLENTIGAPPITGVSVLDMHWRQPEIKRTKTVCTYCGVGCSFEMWTRDRHLLKVQPVVDAPANGISTCVKGKFAWDFVNDPKRLTTPLIREHGRFREASWDEALALVARRLLEIRDLHGAQSIGFIGSSKASNEEAYLTQKIARLIIGTNSVDNSSRYCQNPATEGLFRTVGYGGDAGTIADLQQAELVVIVGSNLAENHPVIASKLKAARKLHGQKLIVVDPRKHEMAERADLFLRPVPSTDIVWASALSRYMFDNGYADTQFLAQRVNQVDEYRQSLEPFTLDYAAQITGLSREQLVEAGEMIGRARSVCIVWAMGITQHTHGADTSTALSNLLLVTGNYGRPGTGGYPMRGHNNVQGASDFGCLKNMYPGYESVSDPAVRNKWAQAWHVPAEQLSLEVGSDNFMMVQQADKGEIRAMYVIGEETAFSDADARNVHRGFSKLDFMVVQDLFFSRTAEFADVVLPACPSVEKDGTFVNTERRIQRFHQVFPPLGQSRPDWQILTELAARMGHDWGYTHPSQIMDEVARIATLFKGVSYQRLEGWRSLLWPMQDDGRDTPLLYTERFHTDDGKARLHPLQWKRPGEEADAQFDLMLDNGRMLEQFQGMNQTGRGPRLWSLAPNWFVEVSPQLAAERGLQEGDWVKLSSRRGSLEVPVVITDRVAGNTLFLPIHQGKPGINLLTGEHHDPDVNTPAYKELAVRMEPLGRTGKPPLPAHNFRHGHRTPNDGVPVQQKWAREDYVAPPARAPHPERF

SEQ ID NO: 53219 - protein, 1121 aa, Solanum lycopersicum
MASGSGSRGKHDRNHQPKNQSQFSGTSNTNALSKAVAQYTTDARLHAAFEQSGESGKNFDYSQSVRNSTESVTEHQITAYLNKMQRGGHIQPFGCTIAVEEASFCVIAYSENACEMLDIMPQSVPSLEKNEILKIGTDVRTLFSSSSSGLLEGAFGAREITLLNPIWVHSKNSGKPFYAILHRIDVGIVIDLEPARTEDPALSIAGAVQSQKLAVRAISLLQSLPGGDIDLLCDTVVKSVRELTGYDRVMVYKFHDDEHGEVVAESRRSDLEPYIGLHYPATDIPQASRFLFKQNRVRMIVDCTAIPVRVIQDESLMQPLCLVGSTLRAPHGCHPQYMVNMGNVASLTLAVVINGNDDEVVGGRNAMRLWGLVVGHHSSARFIPFPLRYACEFLMQAFGLQLNMELQLASQLAEKRVLRTQTVLCDMLLRDSPTGIVTQNPSIVDLVKCDGAALYYQGRYYPLGITPTAAQIKGIVEWLLTCHVDSTGLSTDSLADAGYPEAASLGAAVCGMAVAYVTSKYFLFWFRSHTASEIKWGGAKHHPEDKDDWQKMHPRSSFKAFLEVVKNRSLPWENAEMDAIHSLQLILRDSFKDASNSKSIVRVQLREEGLQGMDELRSVAREMVRLVETATAPIFAVDVEGRINAWNAKVAELTELSVEEAIGKSLVHDLVHEESQTTAQNLLRKALRGEEDKNIEIKLRTFGAEQLKKTVFVEVNACSNKDYTNNIVGVSFIGQDITAQKVVLDKFVRIQGDYKAIMHSPNPLIPPIFVSDENTCCFEWNTAMEKLSGWNKEEIIGKMLVGEIFGTFCRLKGPDDMTNFMIMLHKAIGGQEIDKFPFSFSDRNGKFVQALLTANKRVNVDGQIIGAFCFLQIASPELQKTLMQRQQEKTSNIHMKELAYICRELKNPLNGIRFTNSLLEATELTENQKQFLETSAACERQMSKIIRDIDLDNIEDGSLELEKGEFFLASVIDAVVSQVMLLLRERGVQLIRDIPDEIKTLRVYGDQVRIQQVFADFLQIMASYAPPREGWVEVHLRPSIKQISDGVTIVHIEFRIVCPGEGLPPELIQDMFHNSLWVTQQGLGLSMCRRILQLMNGQVQYIRESERCFFLIILQLPMLIQ

SEQ ID NO: 53220 - protein, 204 aa, Fagus sylvatica
GTRIAFALDIARGMEYIHSQGVIHRDLKSENVLIDQEFHLKIADFGIAYEEDYCDSLADDPGTYRWMAPEMIKHKSYGRKVDVYSFGLILWEMVAGTIPYQDMNPVQAAFAVVNKNLRPVIPRDCPPAMRALIEQCWSLQSEKRPEFWQVVKVLEQFESSLARDGTLNLVQSLTCQDHKKGLLHWIHKLGPVHPNGSMPKPKLT

SEQ ID NO: 53221 - protein, 423 aa, Oryza sativa (japonica cultivar-group)
MGWKAPTRIQAEVIPFALQGRDVIGVGQTGSGKTAAFALPIIQALLEHEHRPCFFACVLAPTRELAIQIAKQFEALGSAISLQCSVVWWRSSRACLPEHLRKGFDSWQLWKERNSRVGTPGRLLDHLTNTKGFSFNKLKYLVLDEADDLLKVDFQKAVDDILNVIPKERRTFLFSATMTEKVKKLRRACLKNPVKVEVASKYSLVDTLRQDLYVVPAKYKDCYLIHVLNKMPGSMIMVFVRTCESTRLLALMLRNLRFKAISISGQMSQDKRLGALNRFRTRDCNILVCTDVASRGLDIQGVDVVINYDFPLNSKDYIHRVGRTARAGQSGYAVSLVNQFEGEFFKLTEQFLGGEEIPARKVDADEIMILHERIYDSKRIALKTMNESGYHKRMRRRMEDDEEEVEEAPVSSRSRSLKKSRRR

SEQ ID NO: 53222 - protein, 282 aa, Thermosynechococcus elongatus BP-1
MFESFMTSVSSLPSRPLRPNWGVIFFMAIVHLGALLVFVPGTFSWSAVLLCFVLYWVSGGLGITLGWHRLVTHRSFQCPKWLEYFFVFCGTLACEGGIIEWVGLHRNHHLHSDQELDQHNSQKGFWWSHMGWMLQEVPAKAEVERLTKDINTDPVYRFLNQQFLPIQGVLGVLLYLWGGLPFVVWGIFVRLVLVYHLTWFVNSATHKFGYRTFESGDRSTNCWWVALLTFGEGWHNNHHTYPHSARHGLQWWEFDITWITIRALQGIGLAQKVRLVEAPPKQ

SEQ ID NO: 53223 - protein, 321 aa, Haemophilus influenzae R2846
MIKKIAVLTSGGDAPGMNAAIRGVVRSALAEGLEVFGIYDGYQGLYNNKIKQLNRYSVSDVINRGGTFLGSARFPEFKDPNIRAKCAEILRSHGIDALVVIGGDGSYMGAKLLTEEHSFPCVGLPGTIDNDVAGTDYTIGYQTALQTAVDAIDRLRDTSSSHQRISIVEIMGRHCSDLTISAGIAGGCEYIVASEIEFNREELIQQIERSIIRSKRHAIIAITELLTDVHSLAKEIEARVGHETRATVLGHIQRGGSPCAFDRILASRMGAYAVDLLLQGKGGYCVGIQNEQLVHHDIIDAINNMQRVFKADWLKVAKRLE

SEQ ID NO: 53224 - protein, 310 aa, Oryza sativa
MAPSRPLMRGIRPPRVFPTRGGRTSPLALALAALLLASALLLTLIAFGVFSLPVSAPNAATTDSAAAGGDAEPADPRPPRTRARRDLSEGLGERGAQWTEVISWEPRAFVYHNFLSKEECDYLIGLAKPHMVKSTVVDSTTGKSKDSRVRTSSGMFLQRGRDKVIRAIEKRIADYTFIPMEHGEGLQVLHYEVGQKYEPHFDYFLDEYNTKNGGQRMATLLMYLSDVEEGGETIFPDANVNSSSLPWYNELSECARKGLAVKPKMGDALLFWSMKPDATLDPLSLHGGCPVIKGNKWSSTKWMHVREYKA

SEQ ID NO: 53225 - protein, 314 aa, Azoarcus sp. EbN1
MPLSSQAKALLDMVYRVGAPRFHELSVDQARHSFRKLQWAFGLPSPAVAATVEVAMTRVDGSTLNARLYRPLESSRDDELPLLIYFHGGGWCVGDLESYDVLCRQLANGSGCAVLSIDYRLAPENPFPAAVEDAIFSIEWAAEQAQRLGIDRGCIALGGDSAGGNLSIVGALLAHERASVAIRFMFLVYPSTEIASDRPSRQLFGQGYLLDGESLEWFYGHYLPAGNDEDWRASPMRAPSLAGLPPILLVTAECDPLADDCMAFAERVRAEGGEIEHVAVDGVVHGFITLGQFFPEATHAVDRITAGLRRAVRP

SEQ ID NO: 53226 - protein, 149 aa, Triticum aestivum
MEQTFIMIKPDGVQRGLIGDIISRFEKKGYYLKAMKFMNVEKSFAQQHYADLSAQPFFAKLVDYIISGPVVAMVWEGKDVVLTGRRIIGATRPWEAAPGTIRGDHAVEVSRNVIHGSDSVENGKKEIALWFPGGLAEWKSNLHPWIYEN

SEQ ID NO: 53227 - protein, 547 aa, Ralstonia solanacearum GMI1000
MTQIASGIDAPPRRATLDDAHVGDIRGALGTIAPHDIGPRRGWRARLRTLLAILGPGLIVMVGDNDAGAFGTYAQAGQNYGTTLLWTLLLLIPVLYVNQEMVLRLGAVTRVGHARLIFARFGRFWGSFSVIDLFLVNALTLVTEFIGISLALAYLGIPRHWGVCVSAALVLLAAATGDFRRFERFALALVVGSLALIPVLAMAHPPLGQMARDFFVPALPAGAPLSEVVLLIIAIVGTTVAPWQLFFQQSYVIDKRITPRFIRYERADLWLGIVLAVVGAVAMMAFSAQAFHGTPEFGRYTDALGTAVGLERHAGRWAGILFAIALLDASIIGACAVSLSTAYAIGDVLAVRHSLHRKPTEARCFYAVYFGLTLLAAGLVLTPGVPLGLLTSAVQSLAGVLLPSATVFLLLLCNDKAVLGPWTNSRLTNLFTGTVVAVLVMLSVILTAAVLFPGIGMVEIVAVLAGGSLIAAVVSLALWRIERRANHGIARRRVSVLDRTRWTMPPLEQLTAARLTPLKRTWMLVLRGYLVIAAGLVLVRIAGLVAG

SEQ ID NO: 53228 - protein, 182 aa, Brassica napus
MPLSLRLAPSPTALSPTTGGFSPAKKQCRIPSYSGVATTTRRIGLCSLDYVKRGDSSVVRCSLQTVNVSVGQVTEVDKDTFWPIVKAAGEKIVVLDMYTQWCGPCKVIAPKYKALSEKYEDVVFLKLDCNPENRPLAKELGIRVVPTFKILKDNQVVKEVTGAKYDDLVAAIETARSASSSG

SEQ ID NO: 53229 - protein, 169 aa, Arabidopsis thaliana
MTAADVGSLGGGNRALYGSPPSHNLFPHNLPIFSAFLAFALAQFLKVFTNWYKEKRWDSKRMISSGGMPSSHSATVTALAVAIGFEEGAGAPAFAIAVVLACVVMYDASGVRLHAGRQAELLNQIVCEFPPEHPLSTVRPLRELLGHTPIQVFYTHQSILFIIPIIKHF

SEQ ID NO: 53230 - protein, 426 aa, Debaryomyces hansenii CBS767
MSNQGTIYSIPNSKKPTNNKLPNLLIPSPVSINKSDQTYKQPRRKPPPIDFLRIHGAYSNTPDTISPNPSSGTHSGIQSATSDILENLRAHNIGNNTKQNNEQCKNNEQSKNNNDEIQKRVEDLSPDDWNRLANDNQIIELNKLGEGNGGSVSKCTLVNGSQIFALKLINADPNPNIQKQIIRELQYNRVCDSPNIVKYYGTFMVEKQLMIGISMEYMGGRSLDAIYKRVIELDPTNRINEKVLGKVAESILTGLNYLHQQRIIHRDIKPSNILLDSEGNIKLCDFGVSGEVVNSLATTFVGTQYYMAPERIMGKPYTVSCDIWSLGLTLLEVAICKFPFITDDTMVGPIELLSLILEYEPKLNDIPEQGIFWSDSFKNFIGYCLKKNSEERPSPRQMLSHPWCVSQLKIKVRMDKFVKKLWGQLD

SEQ ID NO: 53231 - protein, 148 aa, Zea mays
  misc_feature (45)..(45): Xaa can be any naturally occurring amino acid
  misc_feature (92)..(92): Xaa can be any naturally occurring amino acid
MSVCVTGGRQGQVVLAMVFDDARLGGIASSIRVIPDFSKSGIMFXDITTLLLDPKAVRDIIDLFDERHQEQGITVGAGVQARGFSFGHPIGXANDAKFVVLLKSKNLPSVAIFEEYALEYGREQIEVHASVVRATQRALVLDELIATA

SEQ ID NO: 53232 - protein, 659 aa, Corynebacterium glutamicum ATCC 13032
MDKFHIEDEGTTPNAVTTSTTTRVKHPVDQVPPAPKLAALGLQHVLAFYAGAVIVPLLIAQSLNLDTATTIHLINADLLTCGIATLIQSVGIGRHIGVRLPIVQGVTTTAVAPIIAIGLGVTDGQGGVASLPAIYGAVIVSGIFTFFAAPVFARFLKFFPPVVTGTVLLVMGASLLSVSANDFVNYADGVPAARDLAYGFGTLAVIILAQRFFRGFMGTLAVLIGLVGGTAVALILGDANLDEVGNAEAFDITTPFYFGVPEFNAVAIFSMIIVMIITMVETTGDVFATGEIVGKRTRRSDVTRALRADGLSTLMGGVMNSFPYTCFAQNVGLVRITGVKSRWVAAAAAGFMIILGVLPKAGAIVASIPSPVLGGASLALFANVAWVGIQTIAKSDLADSRNSVIVTSALGLAMLVSFRPDVAQAFPEWARIFVSSGMSVGAITAILLNLLFFHVGRQSGGQVATSKSGERINLDAVNKMDRTDFVETFAPLFNSKTWPLETAWESQPFANVTELREAIQVAVLTAPLSDREELIHDYPDMAQLILATEEEAATISQDRGSIGLDDLDDVDQEKLITVTEQYRERFNMPYVAYFDTMDSVDTVVAAGLRRLDNSDEQEHRQALSEIIEIANDRFDILLADANPARSAFDRKFTETDFLG

SEQ ID NO: 53233 - protein, 190 aa, Aquifex aeolicus VF5
MNLERGNMLELRRKLFHFLSILLLIIPVKFFPFWLNVFLFLSAILLNLLIIFRVSPFYNIFEVFIKLFEREKNLETPGIQSLWAILGVFISYLLFGENAVVGIVVLALGDGFSGLVGYYFGRRKLFYNPKKSLEGTLAFFTASFLGLLLFTDFCEAFVISLICAVLESLPLKLDDNFYIPVLASFLGEVL

SEQ ID NO: 53234 - protein, 378 aa, Physcomitrella patens
MAGEGEDVQPLVCDNGSGMVKAGFAGDDAPRAVFPSIVGRPRHTGVMVGMGQKDAYVGDEAQSKRGILTLKYPIEHGVVTNWDDMEKIWHHTFYNELRVAPEEHPVLLTEAPLNPKANREKMTQIMFETFNVPAMYVAIQAVLSLYASGRTTGIVLDSGDGVTHTVPIYEGYALPHAILRLDLAGRDLTDALMKILTERGYSFTTTAEREIVRDMKEKLAYVAIDFEQELDTARSSSSLEKSYELPDGQVITIGAERFRCAEVLFNPSLIGMEAAGIHETTYNSIMKCDVDIRKDLYGNIVLSGGSTMFPGIADRMSKEITALAPSSMKIKVVAPPERKYSVWIGGSILASLSTFQQMWIAKSEYDESGPSIVHRKCF

SEQ ID NO: 53235 - protein, 322 aa, Aquifex aeolicus VF5
MEEKDLLEFAREVIREEIKGLERLLSSLDENFSKAVEILRNCEGKVILTGIGKSGHIARKISSTLSSTGTPSVFLHPAEALHGDMGLLDSKDALIAISNSGESTEVLYVLQYAKALNIPVIGITGNEKSSLAKYSDVVLKIPVDREACPFNLAPTVSSTVTLALGDAIAMTLMKLKGFSQEDFAKRHPAGALGRKLRLVKDLYHTGEEVPIVKEDTSMKEAIIEMTAKGFGATAVVNEEGKLVGIITDGDLRRFVNRGGSFENTRAKDVMTKNPKTIKPDELALKALRKMEDHNITVLIVVNEENEPIGILHMHDILKAELS

SEQ ID NO: 53236 - protein, 473 aa, Rhodococcus sp. RHA1
MNAHPAGPKHAEQLHAPGLPERPADAAAFAALSPEVWPRNAHRGADGVVSLAGIPVTELAEKYGTPLFVVDEDDFRSRCRDMARAFGPTAKVHYASKAFLCGEIARWVADEGLSLDVASGGELAVALHAGFPAERIAMHGNNKSVAELNAAVSARVGHIVLDSATEIDRLDKVAAEAGVVQDVLIRVTVGVEAHTHEFISTAHEDQKFGFSLAGGKAIDAVRRVFAAGNLRLVGLHSHIGSQIFDVDGFELAAHRVIGLLRDVVAEFGVEKTAQISIIDLGGGMGISYVPSDDPPPVDQLAAKLGDIVRNESALAGLPEPTLAVEPGRAIAGPGTVTLYEVGTIKDVTVGANLTRRYVSVDGGMSDNIRTALYQAEYEAKLVSRVSDAAPVVSRVVGKHCESGDVVIRDTWMPEDIDAGDLLAVAATGAYCYSMSSRYNLLARPAVVAVRDGQSRVILRRETVEDLLSLEVQE

SEQ ID NO: 53237 - protein, 195 aa, Triticum aestivum
  misc_feature (149)..(149): Xaa can be any naturally occurring amino acid
ALFMDEISTGLDSSTTFQIVNSIRQTIHIIGGTAVIALLQPAPETYELFDDIILLSDGQVVYNGPREHVLEFFKSMGFKCPERKGVADFLQEVTSRKDQGQYWINSDETYRYVPVKEFAEAFQSFHVGQAIKSELAVPFDKNGSHPAAXKTSQYGASMKELLKANINREVLLMKRNSFVYIFKATQVMMLKGKIY

SEQ ID NO: 53238 - protein, 188 aa, Zea mays
  misc_feature (43)..(43): Xaa can be any naturally occurring amino acid
  misc_feature (154)..(154): Xaa can be any naturally occurring amino acid
  misc_feature (170)..(170): Xaa can be any naturally occurring amino acid
MASHDHDHHHHDHEQGHKKPEGGGGDTSWVGPDGRVYHSHDGXLAPHSHEPIYSPGYFSRRAPPLNDRNFSERDFTVGIGGPVGTAKTALMLALCRVLRDKYSLAAVTNDIFTKEDGEFLVKHGALPEERIRAVETGGCPHAAIREDISINLGXPLEELSHLQKTVLLLXKSAGKNNLGANFPKKEAR

SEQ ID NO: 53239 - protein, 70 aa, Glycine max
KKEKLGERIAALQQLVSPFGKTDTTSVLHEAIGYIRFLHDQVPVLCSPYLESSPSSYHQNQHDPSSNTWR

SEQ ID NO: 53240 - protein, 347 aa, Listeria monocytogenes str. 4b H7858
MKNTIKWIAIGFAGIILLPLLIVFFIYKKAVGKKEYNPEVLENLDEASQKFVKNTSPLSDVDSRYKYMRLATKALPSAKDIEIGDVENKKIDGPAGKIPIRIYTPQEDGPFEIIVYYHGGGFVLGGLQTHDAIARKLVQTTGARVVTVDYRLAPENPFPAAVEDAYAALLWVQNHRTSLRAKSSDIIVAGDSVGGNLATVVTQIAKSKGKPNITAQILLYPATDIFSRDASVLYPSMDEFAEGYVLTKESLDKFFKLYIANASDRKYDPLVAPIRSKDLVGLPKTFIATAEFDPLRDQGEAYAKKLKDAGVEVFAKRFEKVPHGFMTTNSEATDETYELISEFLEEK

SEQ ID NO: 53241 - protein, 149 aa, Triticum aestivum
  misc_feature (128)..(128): Xaa can be any naturally occurring amino acid
MTMAARLMLVAALLCAAAAAATAQQATNVRATYHYYRPAQNNWDLGAPAVSAYCATWDASKPLSWRSKYGWTAFCGPAGAHGQAACGKCLRVTNPATGAQITARIVDQCANGGLDLDWDTVFTKIDTXNGSGTQQGHLNVNYQFVDCRD

SEQ ID NO: 53242 - protein, 420 aa, Ehrlichia ruminantium str. Welgevonden
MLFLANPFFHYKSNVLNIENVSVLEITNSIGTPVYCYSLNAIKNNYIQFKENLPNNSIICYAVKSNSNLSILSLLSSLGSGADAVSEGEIRRAITAGISPNKIVFSGVGKTEQEISFALDNRILQLNVESIEELQLINKISYHKNIIAPVSIRINPNINANTNDKITTGLKVNKFGIPEESLDQVFNSSLTNIKIIGISVHIGSQIANLGIFQNTIDKVKRIVKIFEQHNIHILRVDMGGGLGIPYKNSDIFPTIQEYTNLLKNNFEKESYNIICEPGRAIVGNTGILLAKVLYHKSNYEKNHLVLDTGMNDLIRPALYNAEHTIIPAVVSSKSHLSFDIVGPICESDDTFAYSYWINNVDNNEIVAICTVGAYGSSMSSNYNSRPLVPEVIVNQDNYHIIRHRQTYNDMLKDEVTLKFK

SEQ ID NO: 53243 - protein, 110 aa, Glycine max
LISCPAATTVNRAEAGMVAPFTVLKTMAGFPTRKTNNDITSIASNGGREQCMQVWPPGGKTKSETLCYLPDLDDAQLATVVEHLLRQGRIPCLEFESEHGFAHREHSRSP

SEQ ID NO: 53244 - protein, 885 aa, marine gamma proteobacterium HTCC2080
MSEQPLLDVQERQEWLDALDSVVREGGVAAGEALINALSQHAENTGVPLPLAITTPFRNTIAPANERPMPGDLFMERRIRSLIRWNAMAMVMRANDNDEGLGGHISSFSSSATLYDVGMNYFFRGTENGHPGDLVFYQGHSAPGMYARSFLEGHITETQLQNFRREVDGQGLSSYPHPWLMPNYWQFPTVSMGLGPIQAIYQAHVMKYQQNRGLVDHRDRKIWCFMGDGECDEPESLGAIALAGREKLGNLHFVINCNLQRLDGPVRGNGKIIQELEGVFRGAGWNVIKVIWGRKWDPLLDRDSSGLLQRRMDEVCDGELQNFKYNGGAYTREHFFGKYPETLELVKDLSDDEIMRLNRGGHDPYKVYAAYSAACEETTRPTVILAMTVKGYGTSEAGEASNETHSLKKLDLNSLKAFRDRFGIPISDRELKDVPFYRPPADSPEMRYMKERRGELGGHIPARRAQSQSLPAPAKSAFASQLKSSGKREISTTMAFVRILSSLLKDKVLGERVVPIVPDEARTFGMEGMFRQMGIYSSVGQQYTPHDAGGILYYKEDVSGQILEEGINEAGAFSAWLAAATSYSVSDYPMVPFFIFYSMFGFQRIGDLAWAAGDSQARGFLIGGTSGRTTLNGEGLQHQDGHSHLMAATVPNCVSYDPTYGYELAVIIQDGMRRMYEVGENVFYYITTMNENYHHPDMPAGIENGIVKGAYALRTGAAADRPRVQLMGAGTILREVEAAAEILEKDYGVATDVWSLTSINELARDGADAVRWNRLHPTDDPKIPYITGLLADREGPTVIATDYIKAYAEQLREFIPGSCTVLGTDGFGRSDTRKNLRHHFEVSRDFIAIAALKALVDDGVLQPSVVAQAIEALGIDVEKINPRNA

SEQ ID NO: 53245 - protein, 340 aa, Oryza sativa (japonica cultivar-group)
MHVGLTLVLLVYLPIAFACRALGRLLVRPFVSGEDLRGKVVLVTGASSGIGEHLVYEYAKKGACVALTARTEIALRAVAKTARDLGAPDVLVVPADITKVDDAKRAVEETVAHFGKLNHLVANAGIWSSCFFEEITNITAFHNVIDLNFWGAVYPTYFALPYLKASRGNIVVTSSVAGRVPTARMSFYNASKGAVIRFYETLRAELGSHVRVTILTPGYVVSNLTMGKGIQKDGHVGIDEEARDINVGPLPVGKTETLAKVVVAAVRRGDYYVTWPGWYWPFHMVMCTAPELVDWFSRTFYVSKSSDHDGDALSKKILEAVGGKKFLYPKTIRSHAIAAS

SEQ ID NO: 53246 - protein, 460 aa, marine gamma proteobacterium HTCC2080
MSVTVIVPDIGGAEGAEVVEIFVAVGDVIEVEQSLIVVESDKASMEIPSTVAGKVLELRVALGDALSEGDAVLVVEAEAAEAKTQDDVNSAGESPPAAAEVNAASEPSKRLAEKSSEKAAETPTASLNVAAESADASASQIKPSPALVSKEQGSLQTQTRTEADVYAGPAVRKLAREFGIDLLSVTGSGRRGRVLKEDLQAFTRKNLKKADPSASTGVPAVPEIDFSQFGEVAVEERSRLEQITATNMSRSWLNVPHVTQFEGADITDLEAFRQSMKKEAEQLGNKLTPMPFVLKACAVALGAHPKMKSSLAAGGKELVYKQYCHIGMAVDTPAGLMVPVIRDVDTKGIWQLAEEIRDMATRAREKKLTPAQMQGGVFTISSLGSIGGEGFTPIVNTPEVAILGLSRAEIKPVWDGESFLPRQILPLSLSYDHRVVNGGDAGRFLTDLAALLSDVRRIIL

SEQ ID NO: 53247 - protein, 136 aa, Corynebacterium glutamicum ATCC 13032
MTERTLILIKPDGVTNGHVGEIIARIERKGLKLAALDLRVADRETAEKHYEEHADKPFFGELVEFITSAPLIAGIVEGERAIDAWRQLAGGTDPVAKATPGTIRGDFALTVGENVVHGSDSPESAEREISIWFPNL

SEQ ID NO: 53248 - protein, 369 aa, Arabidopsis thaliana
MSLIPERAKLHIAMVVFQTGYAGNHVIMRYALNLGVSKLVFPLYRTIVAFSVLAPSAYFLEKKERPAMKISFLIQFFLLGLVGITLNQGFYIFGLDNTSPTFASATENVVPAVSFLMAALLGIEKVEWKRKDGIAKVVGTIVSVAGSLVITLYKGPTIYQPSLNIVNQTIKPEEAEEENKNWTLGCLCLMGHCLCWSSWIVLQSPLLKKYPARFSFVSYSCFFAVIQFFGISAYFERDLERWKIISGGELYALLYTGLVGSAMVFAIQIYVVERGGPLFVSAYLPLQTLIAAVLATLALGEHFYLGGLIGAILIMSGLYLVVMGKSWENQALCQQQQHMISSAASDFGDEEDYHNNKPRSPISQPLISS

SEQ ID NO: 53249 - protein, 543 aa, marine gamma proteobacterium HTCC2080
MHGLMMDVPLTITSIIQHAESVNGHKEIVSVTRDNPRHRYTYKDAFSRSRQLANVIAGWGLSQGDRIATLAWNDYRHLEAYYAAACSGYVCHTINPRLFPEQIVYIINHAEDQFIFVDPDFWPLIEQVAGECSNVKGWVVMATPENMPETELANVYCYETLLEGQSDQFSWPELDENAACALCYTSGTTGNPKGVLYSHRSTVLHTYATLMPDALGMSGGDVVMPIVPMFHVNAWGNPYACPVAGCKMVMPGNKMGDGATLAALINEEGVTMSAGVPTVWLNLLNHLRSEGLRVDTLKQIVVGGSACPLSIMEEFDTYGVDTRHAWGMTEMSPLGTANAAGAHRDLHTQEEFTRLRMTVGTPIWGVEVKITDDDNNPLPRDGVAFGALKVRGPWICSSYYKLEGSEAHAEPGWFETGDVATISPEGYVAITDRTKDVIKSGGEWISSIEVENCATGHPQVAEAAVIGRMHPKWGERPLLIVVRNAEGADLQPEALKTFLDGKIAKWWIPDDVQFIEDMPHTATGKIQKTTLRDIFADYQFPDA

SEQ ID NO: 53250 - protein, 267 aa, Triticum aestivum
  misc_feature (241)..(241): Xaa can be any naturally occurring amino acid
FDHAAAAREVFERFHGCYDALRASGLPEAGLGALDIAGLPLYSVGHSNGALLQLLVGSYFSEKIPKANAIVSFNNRPASEAVPYFEQIGPLISQLTPMMETSPVCSAARDASGNAWKALFDLAGGLIREYDREAMVSVSKFVDQLPSVMNQVTEGVSEFKPTPPENREFCKNSYSVANTLLVKFSVDAIDDTDIIEDILRPRVDSIGGQIKKVVLSGTHLTPCIQDVKWQVGSEYTPADAXAQGLKSLALNETRVLSRTIADYFRSL

SEQ ID NO: 53251 - protein, 244 aa, Desulfitobacterium hafniense DCB-2
MQDWLPILWVSTIAGLATTLGSLVVLMFGRPKEQVLAMLLAGAGGVMLAVVSLDLLPTAWQIGPLSQVILGFIIGLAFMKLADQKLNASPPSLPLPRRQRLKRIGLLVAAGIALHDLPEGMAIALGQEATEDLGVLIAMAITLHNLPEGMATTAPLKMAGIKSWKILLLNFGIAFFTPFGALIGLLAIDSVQNSLSFFLALAGGAMAFLVFAELWPLSRERHPRYALLGGVLGYLFFAGISFLH

SEQ ID NO: 53252 - protein, 154 aa, Arabidopsis thaliana
MALRATTQRTIRIAATLRRVARPFATDAVVESDYKRGEIGKVSGIPEEHLSRKVIIYSPARTATQSGSGKLGKWKINFVSTLKWENPLMGWTSTGDPYANVGDSALAFDSEEAAKSFAERHGWDYKVKKPNTPLLKVKSYSDNFKWKGNPQPEN

SEQ ID NO: 53253 - protein, 364 aa, Zea mays
MADAARGLGSSSLPVANVQALAESCNDNGADAPVPGRYLIKDPSAEEVVAAGDSACAIPVIDFRKLLDPGSSEEECARLGAACHHWGFFQLINHGVPAEVTGNLMKDVAGFFRQPLEAKKECAQQAGSIEGYGQAFVVSEDQKLDWADMLFLIVRPREARDMRFWPTRPESFRDSVDAYSLEASKLAYRLLEFMARGVGADPASLQSMFQGQVQGMRVNYYPPCQQAADQVLGLSPHSDPNGLTLLLQMSHDVHGLQVSKDGRWFPVQALPGAFVVNVGDALEIVSNGAFRSVEHRAVIHPTKERISAALFHFPDQDRMLGPLPELVKEGDTVRYATTTYQEFMKRFFAAKLDGKKLIERFKLQ

SEQ ID NO: 53254 - protein, 163 aa, Eremothecium sinecaudum
MSQQMNNPSIRRKLVIVGDGACGKTCLLIVFAKGKFPQVYVPTVFDNYVADVEVDGRRVELALWDTAGQEDYDRLRPLSYPDSNVVLICYSIDLPDSLENVMEKWISEVLYFCQGVPIILVGCKADLRNDPQVIEQLRQQGQQPVSQSQAQEVADQIGAVEYI

SEQ ID NO: 53255 - protein, 280 aa, Oryza sativa
MGNWNHHRRPWYRRTRHDRAPRPPSPPPDLGHNCHPIPLWEREFCIYVGGISWHRFCDNKRYVCMYKNIEQWDDSEAFDNFKNAKARFWANYHGQPSDISLPDPDMYIDKIDHNSKIDPELIADLKMVRLPFERDDELLPADGLGSTDTDNKCQQKQNQSGNWDIYVEKPTEVNKWEQDSRSNMDWGTKHESWNEWSKNCSGWGSALADSSALADSSWGNWNNSNNHHSSNNRASFNGINRNRYQDPSSISGRKRNSGGYIQQRNSRQRNQIEGYQGSRW

SEQ ID NO: 53256 - protein, 384 aa, Rhodobacter capsulatus
MAKVDFYEVLGVSKGASAEEIKKAYRSKAKELHPDRNQGQSAAEAQFKEVNGAYDVLKDGDKKAAYDRYGHAAFEGGMGGGGPRGPYGQGADFSSAFSDVFEDLFGDFMGGRGGPGGGGRRVRRRGSDLRYNMRVTLEEAFKGAQKTITVPGSAACGSCNGTGAEGGAEPQTCPTCSGLGKVRAQNGFFTVERTCPTCGGQGQVVKNPCRVCHGSGRIEKERTLSVNIPAGVETGTRIRLAGEGEAGMRGGPSGDLYIFIEVREHAIFQRDGVNLFCRVPVSMVSAALGGEVEVPTIDGGRSKVKVPVGSQSGRQMRLRGKGMPALRGGGIGDMVIELAVETPVNLTARQKELLDEFQRIQAENNPEGASFFQKVKSFWDGMKG

SEQ ID NO: 53257 - protein, 519 aa, Oryza sativa (japonica cultivar-group)
MLIMLGLGLVPAGAAAALAVALVCLAAAAWWTVERAPRRLERALRAQGVGGGRYQLLLGGDVAENGRLNREAWSRPLPLGCHRIAPRVLPLLWNAVRDHGKLSFIWFGPVPRVMIPDPELVREVFNKFDQFGKPKMIRVGKLLATGVVSYEGEKWAKHRRILNHAFHHEKIKRMLPVFANCCTEMVTRWENSISLEAASEIDVWPEFRNLTGDVISRTAFGSSYQEGRRIFQLQEELAQYLTEALQKLFIPGYWYLPTKNNRRMREIDREVRKILLEIIGNKERAITNGENSNDDMLGLLVESNTKQPELRMSTDDIIEECKLFYFAGMETTSVLLTWTLIVLSMHPEWQERAREEVLHHFGRTTTPDYDSLSRLKIVTMILYEVLRLYPPVVLLNRRTFKETNLGGIKFPADMNLILPILFIHHDPEIWGKDASEFNPGRFADGISNASKYHDASFFPFGWGPRICIGQSFALLEAKMALSMILQRFSLELSPSYIHAPYIVLTLRPQHGAQIKLKRI

SEQ ID NO: 53258 - protein, 378 aa, Physcomitrella patens
MAGEGEDVQPLVCDNGSGMVKAGFAGDDAPRAVFPSIVGRPRHTGVMVGMGQKDAYVGDEAQSKRGILTLKYPIEHGVVTNWDDMEKIWHHTFYNELRVAPEEHPVLLTEAPLNPKANREKMTQIMFETFNVPAMYVAIQAVLSLYASGRTTGIVLDSGDGVTHTVPIYEGYALPHAILRLDLAGRDLTDALMKILTERGYSFTTTAEREIVRDMKEKLAYVALDFEQELDTARSSSSLEKSYELPDGQVITIGAERFRCAEVLFNPSLIGMEAAGIHETTYNSIMKCDVDIRKDLYGNIVLSGGSTMFPGIADRMSKEITALAPSSMKIKVVAPPERKYSVWIGGSILASLSTFQQMWIAKSEYDESGPSIVHRKCF

SEQ ID NO: 53259 - protein, 415 aa, Methylococcus capsulatus str. Bath
MDHFNYRDGILHVEDVPLSAIAEQHGTPCYVYSRATLERHWHAFDAALGDCPHLVCYAVKANSNIAILNLLARLGSGFDIVSVGELERVLAAGGDPSRVVFSGVGKREDELARALDTGIRCFNVEVAEELDRLDRLAGERGVKAPVSLRVNPDVDAGTHPYISTGLSENKFGIEVEEALVQYRRAARMPNLEVVGIDCHIGSQLTSSMPFIDALDRVLALVARLRGEGIAIRHLDLGGGLGIRYRDEDPPHPTEYAEQLFRRLGRHDFEILIEPGRAVAGNAGILLTRLEYLKANQTKHFAIVDAAMNDLLRPALYGAWQEIVPVAPRNDVESHSYDVVGPVCETGDFLGKSRELRLVPGDLLAVRSAGAYGFSMSSNYNSRPRPAEILVDGSAVYLIRERENVARLFAGERLLP

SEQ ID NO: 53260 - protein, 875 aa, Arabidopsis thaliana
MMQRVFTFGKGRSEGNKGMKSLLGGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKERKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQGEDVVAGIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTINEGEWISMNGSTGEVILGKQALAPPALSPDLETFMSWADAIRRLKVMANADTPEDAIAARKNGAQGIGLCRTEHMFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 53261 - protein, 344 aa, Kineococcus radiotolerans SRS30216
MSARVLTLGETMALLTTPASGRLTLGGSLTVGLGGAESNTAIGLARLGVPTAWVSRVGDDAYGRLITRELRAEGVEVLVDVDAVAPTGSMLKELHAGRPRRVRYQRAGSAASRLTPAHVDAVSARITAADVVHLSGITPALGPGPAAAVERAVELARSAGTEVSFDVNHRTALWSAQEAGPVLAGTAARADVLFAGPEEAAMLLTGAGAGTENHPVPTDPDAAAACARRLCELGAGTVVVKLGALGSVAAQGGRVWVAPTHPVDAVDTVGAGDAFVAGFLAARLAGQDVPRSLAQGNAAGGAVCQVPGDWEGAPTRDELADLLERGRSNVGGPRTTRPSMEVQR

SEQ ID NO: 53262 - protein, 484 aa, Glycine max
ASAASPTTFSLLHSATPSSSSTATSASPSPSRVQLTSSLRARPLRRLGFAAADPLLAASVAARVAAVRGGGKGARGVVSMAKKSVGDLSAADLKGKKVFVRADLNVPLDDNQNITDDTRIRAAIPTIKHLIQNGAKVILSSHLGRPKGVTPKYSLAPLVPRLSELIGIQIVKAEDSIGPEVEKLVASLPDGGVLLLENVRFYKEEEKNDPEHAKKLASLADLYVNDAFGTAHRAHASTEGVTKYLKPSVAGFLLQKELDYLVGAVSNPKRPFAAIVGGSKVSSKIGVIESLLEKVDILLLGGGMIFTFYKAQGLSVGSSLVEEDKLDLATSLLAKAKEKGVSLLLPSDVVIADKFAPDANSKVVPASAIPDGWMGLDIGPDSVKSFSEALDTTQTIIWNGPMGVFEFDKFAVGTEAIAKKLADLSGKGVTTIIGGGDSVAAVEKVGVASVMSHISTGGGASLELLEGKELPGVLALDEAVPVAV

SEQ ID NO: 53263 - protein, 109 aa, Arabidopsis thaliana
  misc_feature (10)..(10): Xaa can be any naturally occurring amino acid
  misc_feature (22)..(22): Xaa can be any naturally occurring amino acid
  misc_feature (43)..(43): Xaa can be any naturally occurring amino acid
  misc_feature (49)..(49): Xaa can be any naturally occurring amino acid
MASSMLSSAXVGTAPAQATMVXPFTGLKSSAAFPVTRKTNKGXSSIASXWGRVSYIKVWPPIGKKKFETLSYLPDLSDVQFAKEVDLPFPHQGDSLVLLLLSHKHRIWN

SEQ ID NO: 53264 - protein, 510 aa, Zea mays
MIKQILGRLPRKPGKAGDSREAAAAGNGTEPSNSYSVARSMDPGNKRAGNGDYPVPSGVIPNPVMNGAVVYHSNEPLPAFKDVPMSEKQNLFVKKVSLCCAVYDFVDPTKNLKEKEVKRQTLMELVDYVTSANGKFSEVVMLEITKMVSINLFRSSSPTPRENKAIEGVDLEEDEPLMDPAWSHLQIVYEVFLRFVASQETDAKLAKRYIDHSFILRLLDLFDSEDPRERDYLKTILHRIYGKFMVHRPFIRKAINNIFYRFIFETEKHNGVAELLEILGSIINGFALPLKEEHKLFLVRALIPLHKPKCVSMYHQQLSYCITQFVEKDCKLADTVIRGLLKYWPVTNSSKEVMFLGELEEVLEATQLAEFQRCMVPLFRQISRSMNSFHFQVAERALFLWNNDHIETLIKQNYKVLLPIIYPALERNSRDHWNQAVRSLTLNVRKIFSDHDSTFFGECVQRFSDEELKQAESDSKRDAMWKRLEEMGASKPGGNHPLGAPNGKPSHAAG

SEQ ID NO: 53265 - protein, 152 aa, Apium graveolens
AIMFYAPVLFSTLGFKDNASLYSAVITGAVNVLSTVVSIYVVDKLGRRILLLEAGVQMFIAQIIIAIVLGIKVTDHSDNLGTAYAVIVVVMICTFVSAFAWSWGPLGWLIPSETFPLETRSAGRSVTVCVNLLFTFVIAQAFLSMLCHFKFG

SEQ ID NO: 53266 - protein, 125 aa, Picea mariana
MAEGNVFACHSTEGWRSKLQEAIDTKRLVAVDFTATWCGPCRVIGPVFVELSKKFPEIFFLKVDVDELRDVAQEWDVEAMPTFIFIKDGKAVDKVVGAKKDDLERKVAALAAAATTTEATLPAQA

SEQ ID NO: 53267 - protein, 476 aa, Ralstonia solanacearum GMI1000
MPATFPAAAQANAAARLERLPFSGYHKRIFIIIAIAFFFDSVDLATMTFVLGSIKKEFGLSTATAGLVASSSFFGMVIGAAVAGLLADRFGRRPVFQWSMVLWGVASYLCSTAQSVEALIAWRILLGIGMGMEFPVAQTLLSEFVPTANRGRLIALMDGFWPLGFITAGIVSYFVLPQFGWRAVFALLAVPAIFVLIVRRAVPESPRWLEHAGRNAQADTVMRGIEAKVMRSLNTTTLPPIVQHSAPQPVRRHSALREIWSAAYRRRTTMVWLLWFFALLGFYGLTSWLGALLQQAGFAVTQSVYYTVLISLGGVPGFLCAAWLVERWGRKPTCIASLLGGGAMAYLYGQSALYGGSVTLLICTGLAMQFFLFGMWAVLYTYTPEQYGTGARATGSGFASAIGRVGSLIGPYVVGVVLPVFGQGGVFTLGAISFAVAALAVWALGIETRGLALEALASEDAAAETAPYSTTADNIS

SEQ ID NO: 53268 - protein, 398 aa, Ralstonia solanacearum GMI1000
MSNNRGVVYLGPGKVEVQKIDYPKMVDPSGRAIGHGVILKVVSTNICGSDQHMVRGRTTAPAGLVLGHEITGEVVEIGRDVETLKIGDLVSVPFNVACGRCAMCKEQHTGVCLSVNPARAGGAYGYVDMGGWIGGQAEYVLVPYADFNLLKFPDRDQAMAKIRDLTCLSDILPTGYHGAVTAGVKPGSTVYIAGAGPVGMAAAASARLLGAACTIVGDMNPARLAHAKAMGFEVVDLSKDATLGEQIAEILGTPEVDCAVDCVGFEAHGHGSGHTEEAPATVLNSLMEITRPAGAIGIPGLYVTDDPGAKDVAAKHGGLSIRFGLGWAKSHSFHTGQTPVLKYNRNLMQAILHNRLPIAEIVNVSVISLDQAPEGYKQFDGGAPRKFVIDPHGLLAAA

SEQ ID NO: 53269 - protein, 96 aa, Glycine max
  misc_feature (72)..(72): Xaa can be any naturally occurring amino acid
  misc_feature (86)..(86): Xaa can be any naturally occurring amino acid
MAEILASKSLLALPARQSSVSGHGLHRSQYYVSWLRAHSLFTKREDEERELLAQDISMDRSPVFERIINTLXFLTEMVRGLTLTLXKYFFETNVTI

SEQ ID NO: 53270 - protein, 272 aa, Listeria monocytogenes str. 4b H7858
MDVVNAEQAKIAEEAGAVAVMALERVPSDIRAAGGVARMADPRIVEEVMNAVSIPVMAKARIGHITEARVLEAMGVDYIDESEVLTPADDEFHLLKSDFTVPFVCGCRDIGEALRRIGEGAAMLRTKGEPGTGNIVEAVRHMRQVNGQIRQIAGMTDDELMVAAKNFGAPYELIKEIKTLGKLPVVNFAAGGVATPADAALMMELGADGVFVGSGIFKSDNPAKFASAIVQATTYYTDYELIGKLSKELGSPMKGIEMSRLNPEDRMQDRSI

SEQ ID NO: 53271 - protein, 664 aa, Yersinia pseudotuberculosis IP 32953
MSSRKELANAIRALSMDAVQKAKSGHPGAPMGMADIAEVLWRDYLNHNPTNPHWADRDRFVLSNGHGSMLIYSLLHLTGYDLPMEELKNFRQLHSKTPGHPEYGYTAGVETTTGPLGQGIANAVGFAIAERTLGAQFNRPGHDIVDHHTYAFMGDGCMMEGISHEVCSLAGTMKLGKLTAFYDDNGISIDGHVEGWFTDDTAARFEAYGWHVVRGVDGHNADAIKAAIEEAHQVTDKPSLLMCKTIIGFGSPNKAGTHDSHGAPLGEAEVAATREALGWKYPAFEIPQDIYAAWDAKEAGKAKEAAWNEKFAAYAKAYPELAAEFKRRVSGELPANWAVESKKFIEQLQANPANIASRKASQNALEAFGKVLPEFLGGSADLAPSNLTIWSGSKSLSDDLAGNYIHYGVREFGMSAIMNGIALHGGFIPYGATFLMFVEYARNAVRMAALMKIRSVFVYTHDSIGLGEDGPTHQPVEQMASLRVTPNMSTWRPCDQVESAVAWQYALERKDGPSALIFSRQNLAQQPRTAEQLANIAKGGYVLKDCAGQPELILIATGSEVELAVAAADQLTATGRKVRVVSMPSTDAFDKQDAAYRESVLPSAVSARVAVEAGIADYWYKYVGLNGAVVGMTTFGESAPAELLFKEFGFTVENVVAKAQALLK

SEQ ID NO: 53272 - protein, 377 aa, Glycine max
MADAEDIQPLVGDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDALMKILTERGYTFTTSAEREIVRDMKEKLAYIALDYEQELETAKTSSAVEKSYELPDGQVITIGAERFRCPEVLFQPSMIGMESPGIHETTYNSIMKCDVDIRKDLYGNIVLSGGSTMFPGIADRMSKEITALAPSSMKIKVVAPPERKYSVWIGGSILASLSTFQQMWIAKAEYDESGPSIVHRKCF

SEQ ID NO: 53273 - protein, 565 aa, Oryza sativa (japonica cultivar-group)
MERESSTPASSWLGIDEAAPFAGKKATKDAAAADAFVRRWPKVVNATLVAFIMTMPPLLILLGGGRPGAPAVWIKSTVASLAARGEPKKDVLLGGLLLPGFDEQSCVSRYQSVYYRKNMTRPPSPHLLRRLRQQEALQRRCGPGTEPYRRASERLRSGQNAGDDFVATVDGCGYLVLISYRGLGNRILAITSAFLYAMLTGRVLLLDPGKTMADLFCEPFQATSWMLPGDFPLEHFRDLGEDAPESYGNVAVNRSGSVAGLRFVYAHLDHAATPANRLLYCDDHRQFLHRVQWVILRTDSYIAPGIFLNPAYKEELDMMFPNKDAVFYLLSRYLLHPTNDVWGMVTRFYHSYLKNADERLGVQIRVFDGDEPFQHILDQILECTSQEHLLPGVVVSGHGGGVAPPPIARSKAVLTTGLNSWYHDSIRDMYWRSPSATGEVVSVHQPSHELHQHFFRSTHDMKALAEMYLLSLTDKIVTSGWSTFGYVGAGLGGLTPYIMIKPENHTVPNPPCVRAMSMEPCDHGPPYFECTKKEIDKIIDTGNLVPHVRSCEDVPWGRKLADPIS

SEQ ID NO: 53274 - protein, 55 aa, Arabidopsis thaliana
MLIKRIKLCIEIMMKAKEFFVVLANAITIFLRQSSPPPPALLRHGLYSYSAFPYQ

SEQ ID NO: 53275 - protein, 671 aa, Ehrlichia ruminantium str. Welgevonden
MSQKYSNMIAMANAVRVLSIDAIQKAASGHPGMPLGMADVGTMLFAKFLKFNPKDPNWFDRDRFVLSNGHGSMLLYSILYFLGCLDIEEIKKFRQIHSLTPGHPEYGCTPGVDATTGPLGQGLASAVGMAIAEKILSEKFGADIVSHNTYVMVGDGCLMEGISHEAASLAGHLQLDKLIVLFDDNNVSIDGPISLSVSDNVKGRFLSYGWDVDEIDGHDFSQIESSIKNAKNSKKPSLICCKTIIGKTIPSKENTCDIHSWPVTEEDIIVMKKRLGWAYKPFEFPEEILQLWQDIACNSEEEYKLWVERVSEYGKTSQDFMDVMADGVSNEVFLNLKSLKEELCSLNLNEATRKSSGRVLDVIMGSTGKLIGGSADLSNSNNTKPKFTSVINKDNFSGSYLHYGVREHAMAACMNGMALHKGVIPYGGTFLIFSDYCRPAIRLSALMKRQVIYIMTHDSIGVGEDGPTHQPVEHLPSLRLIPNLYVFRPADAIEVLECWEIALKLIDAPSVLILSRQNVKCVRSTYVAENMSNKGAYIIREYKNDLDVTIFATGSEVEIALKASDILIGKGLGVRVVSVPCWELFYKQDKKYIISLLNNKSIKAAVEAANSFGWCKYIGEDGIFVGLEDFGISAPFKDLYKYFGITPENLVDKILSKLRINSNYESNVTAD

SEQ ID NO: 53276 - protein, 377 aa, Hordeum vulgare
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVLLTEAPLNPKANREKMTQIMFETFNVPAMYVAIQAVLSLYASGRTTGIVLDSGDGVSHTVPIYEGYALPHAILRLDLAGRDLTDSLMKILTERGYSFTTSAEREIVRDIKEKLAYVALDYEQELETAKNSSSVEKSYELPDGQVITIGAERFRCPEVLFQPSMIGMESSGIHETTYNSIMKCDVDIRKDLYGNIVLSGGTTMFPGIADRMSKEITALAPSSMKIKVVAPPERKYSVWIGGSILASLSTFQQMWISKDEYDESGPAIVHRKCF

SEQ ID NO: 53277 - protein, 459 aa, Gloeobacter violaceus PCC 7421
MLRTEWIARRHGHANVSQMYYARQGLITEEVAYVAHRENLEPELVRSEVARGRLIIPANTNHPNLEPMGIGIATRCKVNANIGASPNASNLGEEVAKLELAVKYGADTVMDLSTGGGDLDAIRSAIIQASPVPIGTVPMYQALEAVHGNVEKLTPEHILDVIEKHAKQGVDYMTIHAGILIEHLPLTQGRLTGIVSRGGGILARWMLAHHKQNPLYTHFDEIINIFKKYDVSFSLGDSLRPGCQHDASDAAQFAELKTLGELTRRAWTHDVQVMVEGPGHVPMHQIEMNVRKQMQECSEAPFYVLGPLVTDIAPGYDHITSAIGAALAGWYGTAMLCYVTPKEHLGLPNAEDVRTGLIAYKIAAHAADIARGRPGARDRDDELSRARYNFDWNRQFELSLDPERAREYHDETLPADIYKSAEFCSMCGPKFCPMQTKIDSQALSELEAALKPQPVAAQE

SEQ ID NO: 53278 - protein, 452 aa, Fulvimarina pelagi HTCC2506
MSGVIEADRRHVWHHLTQHKPYETIDPRVMIEGIGMRVWDATGKEHLDAVSGGVWTVNIGYGRETMADVIRDQLLKLNYFAGASGSVPGALFAQRLIEKMPGMSRVYYSNSGSEANEKVWKMVRQISHRHHGGKKSKILYRERDYHGTTFGALSAGGQAQRNAQYGPFMPGFVEVPHCLEYRSQWGPVDDYGERAANAIEDVILREGPDTVGCLCLEPITAGGGIITPPEGYWERVQDICRKYDILLHIDEVVCGMGRTGTWFGYQHYDVEPDFVTLAKGVASGYAAISCTVTTEAVFDYFRDDADDPLSFFRDISTFGGCTSGPAAALENMRILEEEKLVDNSARMGERLIGNLQALMEKHAVIGEARGQGLFAGAELVSDRESREPAPEALVKAVVADCMSNGVIIGAQNRSLSAGLNNTLLFAPALIATENDIDEITETVDAALMRIFG

SEQ ID NO: 53279 - protein, 556 aa, Zea mays
MASSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFENGTLHLIGLLSDGGVHSRLDQLQLLLKGVSERGAKKIRVHILTDGRDVLDGSSVGFVETLENDLLELRGKGIDAQIASGGGRMYVTMDRYENDWDVVKRGWDAQVLGEAPYKFKSALEAVKTLRAQPNANDQYLPPFVIVDDSGKAVGPVLDGDAVVTINFRADRMVMLAKALEYADFNNFDRVRVPKIRYAGMLQYDGELKLPSRYLVSPPEIDRTSGEYLVKNGIRTFACSETVKFGHVTFFWNGNRSGYFDETKEEYVEVPSDSGITFNVAPKMKALQIAEKARDALLSGKFDQVRVNLPNGDMVGHTGDIEATVVACKAADEAVKIILNAVEQVGGIYLVTADHGNAEDMVKRNKSGKPLLDKNGGIQILTSHTLQPVPVAIGGPGLHPGVKFRNDIQIPGLANVAATVMNLHGFEAPADYEQTLIEVADN

SEQ ID NO: 53280 - protein, 250 aa, Burkholderia sp. 383
MQSVPASLSLTDTAFFFDFDGTLVELAPTPDSIHVPPSLLTLLDELQRRSHGAVAIVSGRGIDNIDTFLKMPDMPIAGLHGAERRDANGDTQRIGFNDERLLRIERELAAVVDRHPGMLLEIKGAAVALHYRNAPEREAAARAATERLVADYADAYVLQPGKMVFEIKPKGVDKGRALAAFLDEPPFAGRVPVFAGDDLTDEKGFAVVNARGGLSIKVGAGETSARMRLDSVDALHEQIACWLGAGQSDA

SEQ ID NO: 53281 - protein, 124 aa, Aggregatibacter actinomycetemcomitans
MSSSVPSLGAFLAKVEQRDGNQPEFLQAVREVFTSIWPFLEQNPKYCSEALLEALVEPERAIQFRVAWTDDKGQVQVNRAFRIQFKSAIGPFKGGMRFHPSVNQSILKFLGFEQIFKNALTTFA

SEQ ID NO: 53282 - protein, 622 aa, Streptomyces griseus
MCGIAGWVVRQDGRPREDPAVAEAMAGAMACRGPDEQGVRGGRHVTLVHTRMAVIDLLGGRQPMAADESEDPAATLTYCGEIYNAAELRSDLAGRGHRFRTRSDTEVVLRAYLEWGERCPERLEGMFAFAVWDARTRSLFLARDRFGVKPLYYAETGDGLVFGSEPKALLVHSDVSPEVDLDGLRVLFSMARAPGECVYRSLSDLPPAHTLRFGPDGRLSLRRYWQLEARPHEEDLAGTVATVRGLLESSVARELVSDVPLSVLLSGGLDSSTVAALAARALADGDGGPVRTTTVTYSGYGDNFQPDLVRSAPDSPYARAVAEHIGAEHLEIELTTADLIDPVARRTVLRAQDVPAPFGDMDTSTYQAFAGVRRHSRVALTGESADEIFGGYSWVHIPDLAHEEQFPWVAFEQWHPGTRRGLGQGLLSPAFKDRLDMGSYYAERYAQAMSRIPRLPREGEEERRAREICDLHLTHWLPRLLERNDRLSMVSGLEVRVPFCDHRLVQYAYNIPWAMKTFDGREKSVLRAAARDLLPERVLDRPKAPFPVSQDATYTKALHQELTEVLADPASPVLPLLDLEAARAVVAREGGADLQDWLHRMNVEMVLQVDAWLRELGGDVEL

SEQ ID NO: 53283 - protein, 206 aa, Arabidopsis thaliana
MQGVIRSFVSGGNVVKGSVLQHLRVINPAIQPSVFCSRSESTQPARMEESGFESTTISDVMKSKGKSADGSWLWCTTDDTVYDAVKSMTQHNVGALVVVKPGEQQALAGIITERDYLRKIIVQGRSSKSTKVGDIMTEENKLITVTPETKVLRAMQLMTDNRIRHIPVIKDKGMIGMVSIGDVVRAVVHEHREELQRLNAYIQGGY

SEQ ID NO: 53284 - protein, 222 aa, Brassica napus
MTSSVFLISLLLLSLSSAVFSDDASFQKLPIPGKRSGPEAFAFDTIGKAFFTGVSGGKILKYTADKGFEDFAEITTTSNSSWCNGIIGTALAGKCGRPAGIAFNPKTGDLYVADAPLGLHVIPPAGGLATKIADSVDGKPFKFLDGLDVDPTTGVVYFTSFSSKFSPSEVLIAVGLKDASGKLFKYDPATKAVTVLMEGISGGAGCAVSSDGSFVLVTEFIK

SEQ ID NO: 53285 - protein, 517 aa, Bradyrhizobium sp. BTAi1
MTDTPSRSITSLADEVDALLARLGVEPGRHKGGTLVARTPITGEITGRVHEVSAAQAAVEIDKAHAAFLEWRQVPAPKRGELVRLLGEELRANKEALGRLVSIEVGKIASEGLGEVQEMIDICDFAVGLSRQLYGLTIATERSEHRMMEIWHPLGVTGIISAFNFPVAVWCWNAALALVCGNSIVWKPSEKTPLTALATEALFARALERFKQAGGPAPDALSVVLFGGRDIGEILVDHTKVPLVSATGSTAMGRAVGPRLANRFARAILELGGNNAAIVTPTADLDLTLRGVAFAAMGTAGQRCTTLRRLFVHETVYDTFVPRLKRAYQSVTIGDPLQAGALVGPLIDHGAYSSMQKALDAARAVGGHVLGGERVALAGADEAYYVRPALVEMSTQTGPVRHETFAPILYVMTYRDLDAVLELHNDVPQGLSSSIFTNDLREAETFLSARGSDCGIANVNIGPSGAEIGGAFGGEKETGGGRESGSDAWKAYMRRATNTINFGRTLPLAQGVKFDLA

SEQ ID NO: 53286 - protein, 416 aa, Fulvimarina pelagi HTCC2506
MRIVVVGAGHAAVQLVTSLRQDGFEGTLTMVGDEPHLPYQRPPLSKTFMKDGDASRLLLKPESFFASNQIEVIKGTRVTEIDRANKHIVTDRDDTIGYDRLVLAIGAENVRPPLTGADHPALLELRTLAHAETIRERLAVAKQAIVIGGGFIGLEFAAMAALQRVTSTVTEASSRLMARAVSPAISAHFLDFHRSIGNTVLLDAPVAEIAGSNEGRIESVRLADGQSLAGELVLLAAGVKPSTTLAEKAGLQCRNGIVVDGQLTTDDPAIFAIGDCAAVLTIDGIHQRLESVQAATDQAKHLSRYLAKGEGGTSYHAVPWFWSDQGDQKLQIAGLPSAANYFEARPGDGSCLTVLGYRDDHLVSVETVNAAGDHMAARRLLALPGSLTRARIEADGHDLRAIAKSMAPPTLRRARA

SEQ ID NO: 53287 - protein, 863 aa, Pisum sativum
MFPNVTGLLNKGHKIRGTVVLMRKNVLDFNTIVSIGGGNVHGVIDSGINIIGSTLDGLTAFLGRSVSLQLISATKSDANGKGKVGKDTFLEGVLASLPTLGAGESAFNIHFEWDHEMGIPGAFYIKNYMQVEFFLKSLTLEDVPNHGTIRFVCNSWVYNSKLYKSPRIFFANKSYLPSETPSPLVKYREEELQTLRGDGTGERKLHERIYDYDVYNDLGNPDHGEHLARPILGGSSTHPYPRRGRTGRYPTRKDPNSEKPATETYVPRDENFGHLKSSDFLAYGIKSVSQCVVPAFESAFDLNFTPNEFDSFQDVRNLFEGGIKLPLDVISTISPLPVVKEIFRTDGEQVLKFTPPHVIRVSKSAWMTDEEFAREMLAGVNPCMIRGLQEFPPKSNLDPAEYGDHTSKISVDVLNLDGCTIDEALASGRLFILDYHDTFIPFLRRINETSAKAYATRTILFLKENGTLKPVAIELSLPHPDGDKSGFVSKVILPADEGVESTIWLLAKAYVVVNDSCYHQLMSHWLNTHAVIEPFVIATNRQLSVVHPINKLLAPHYRDTMNINALARDSLINANGIIERSFLPSKYAVEMSSAVYKYWVFTDQALPNDLIKRNMAVKDSSSPYGLRLLIEDYPYAVDGLEIWTAIKTWVQDYVSLYYATDNDIKNDSELQHWWKEVVEKGHGDLKDKPWWPKLQTFDELVEVCTIIIWTASALHAAVNFGQYPYGGLILNRPTLSRRLLPEEGTAEYDEMVKSSQKAYLRTITPKFQTLIDLSVIEILSRHASDEVYLGQRENPHWTSDSKALQAFQKFGNKLAEIEAKLTNKNNDPSLYHRVGPVQLPYTLLHPSSKEGLTFRGIPNSISI

SEQ ID NO: 53288 - protein, 749 aa, Burkholderia sp. 383
MLAAARPGAAASCDPGALFQQVLPIGSLLYRTITTMTRSNRRDFLRVAAGTAGAAALNLFPPVIRDALAIPANRRTGTIRDIEHIVILMQENRSFDHYFGTMRGVRGFGDPRPLRLANGKSVFHQPVGPAELLPFHPGADKLGLQFLQDLPHGWQDMHAAWNKGRYDQWVPNKGTTTMAYLKRDDIPFHYQLADAFTICDAYHCAIPSSTDPNRYYMWTGYVGNDGTGGGPVLGNEEAGYGWTTYPEVLENAGVSWKIYQDVGTGLNAAGSWGWTQNPYIGNYGDNSLLYFNQYRNALPGTPLYDKARTGTNISAGGTLFDVLQQDVKNGTLPQVSWICAPEAYSEHPNWPANYGAWYIEQVLQALVSNPEVWSKTALFITYDENDGFFDHVQPPFAPQSRDNGLSTVATTNEVFPGDASHMAGPYGLGPRVPMLVVSPWTKGGWVCSQTYDHTSLLQFIEARFGAQYPVKAGNISPWRRTVCGDLTAAFDFATADAGWPKLPDTSGYAPPDRLRHPDYIPVPPVFQKLPKQEAGLRPARALPYELFAHGRVESVNGLFRLTFANTGRAGASFQVQSRNRLDGPWAYTVEAGKRIDDTWSAAASLGLYDLDVYGPNGFYCHFRGPFATGVGSANVNPEVIYGYDVANGNITLRLMNRGHKAVRLKVTNAYGHGRARTFDLAPGQQIDDYWDLRGSHGWYDLTVSDGRLLGFLRRFAGHVETGRPSISDPLIRTHASHDDAEAASDALSD

SEQ ID NO: 53289 - protein, 287 aa, Symbiobacterium thermophilum IAM 14863
MELFLTENQTEDMRLSVRATRVLHHEKTPYQELLVVETPQWGRLMALDGFFQTCDRDEFVYHEMGAHVPLCTHPNPRRVLIIGGGDGGMAREAARHPEVERVDLVEIDERVVECCKQYFPQIAVALSGNPKVHVHIADGIQWVQEHEAEYDVVIIDSSEPIGPGEGLFTANFYARVFRCLKDDGILVAQTESPWVNAPVIQRAYRGIRQSFPITRLYTCAVPTYPTGLWSFTLGSKKYDPLQAEPEKRVGTLGELRYYTPEVHRAAFQLPVFVQRILAEAEAEEEQP

SEQ ID NO: 53290 - protein, 513 aa, Glycine max
MLPRSRTLPSRIHQGIIEERHNVRHYLQVEVRPNNTQTETEAMNIQSNYSKCFDDDGRLKRTGTFWMATAHIITAVIGSGVLSLAWAVAQLGWVAGPIVMFLFAVVNLYTSNLLTQCYRTGDSVSGHRNYTYMEAVNSILGGKKVKLCGLTQYINLFGVAIGYTIAASVSMMAIKRSNCYHSSHGKDPCHMSSNGYMITFGIAEVIFSQIPDFDQVWWLSIVAAIMSFTYSSVGLSLGVAKVAENKSFKGSLMGISIGTVTQAGTVTSTQKIWRSLQALGAMAFAYSFSIILIEIQDTIKSPPAEHKTMRKATTLSIAVTTVFYLLCGCMGYAAFGDNAPGNLLTGFGFYNPYWLLDIANLAIVIHLVGAYQVFSQPLFAFVEKWSARKWPKSNFVTAEYDIPIPCFGVYQLNFFRLVWRTIFVLLTTLIAMLMPFFNDVVGILGAFGFWPLTVYFPIDMYISQKKIGRWTSRWLGLQLLSASCLIISLLAAVGSMAGVVLDLKTYKPFKTSY

SEQ ID NO: 53291 - protein, 368 aa, Ralstonia solanacearum GMI1000
MKTKAAIAWKAGAPLTVEEVDLQGPRAGEVLVEIKATGICHTDYYTLSGADPEGIFPAILGHEGAGVVLEVGAGVTSLKAGDHVIPIYTPECRQCKFCLSRKTNLCQAIRATQGKGLMPDGTSRFSLDGKPLFHYMGTSTFANHIVVPEIALAKIRPDAPFDKVCYIGCGVTTGVGAVVYTAKVEAGANVVVFGLGGIGLNVIQGAKMVGADKIIGVDLNPAREAMARKFGMTHFINPKDVGNVVDHIIQLTDGGADYSFECIGNTQVMRQALECTHKGWGQSIIIGVAEAGAEISTRPFQLVTGREWKGSAFGGARGRTDVPKIVDWYMEGKLNIDDLITHTLPLERINEGFDLMKRGESIRSVVLY

SEQ ID NO: 53292 - protein, 191 aa, Mesembryanthemum crystallinum
MAMQLSLSHQSWAKSLASPITSFDPARSPPKRVELGPNCLNGGATAGKLMREKVGERMRMSGRSCCVKASLETAVGAESETLVGKVTEVDKDTFWPIANGAGDKPVVLDMYTQWCGPCKVMAPKYQELAEKLLDVVFLKLDCNQENKPLAKELGIRVVPTFKILKGGKIVDEVTGAKFDKLVAAIEAARSS

SEQ ID NO: 53293 - protein, 120 aa, Glycine max
  misc_feature (58)..(58): Xaa can be any naturally occurring amino acid
  misc_feature (88)..(88): Xaa can be any naturally occurring amino acid
  misc_feature (92)..(92): Xaa can be any naturally occurring amino acid
AASMISSPAVTTVNRAGAGMVAPFTGLKSMAGFPTKKTNNNITSITSNSGRVQFIQVXPPIGKNKFKTLSYLPDRNNTQLSKKVQYLXKKDXIPYYKFELKHDFLYPEHNRSPRYYNKRY

SEQ ID NO: 53294 - protein, 309 aa, Mycobacterium tuberculosis CDC1551
MLSTSRIFGVDGLAVDDDIVASRAHMRAICEAMPGPQIHVDVTDLSIPGPAGEIPARHYRPSGGGATPLLVFYHGGGWTLGDLDTHDALCRLTCRDADIQVLSIDYRLAPEHPAPAAVEDAYAAFVWAHEHASDEFGALPGRVAVGGDSAGGNLSAVVCQLARDKARYEGGPTPVLQWLLYPRTDFTAQTRSMGLFGNGFLLTKRDIDWFHTQYLRDSDVDPADPRLSPLLAESLSGLAPALIAVAGFDPLRDEGESYAKALRAAGTAVDLRYLGSLTHGFLNLFQLGGGSAAGTNELISALRAHLSRV

SEQ ID NO: 53295 - protein, 88 aa, Glycine max
IFGRIKGGKGSGNGGAKPHRKVLRDNIHGITNPSIWCLALTGDVNRIIGLIYEETRCVLNIFLENVIRDALTYTEHARRKTVTPLDVV

SEQ ID NO: 53296 - protein, 406 aa, Kineococcus radiotolerans SRS30216
MARDVDIVLFGASGFVGRLTAAHLAAHAPSGTRIALAGRSRERLAAAARDLGPVAADWPLVVADASDEESLRTLAESTRVMVSTVGPYLRHGLPLVQACARAGTHYADLTGEVLFVRASIDTADEAARASGARIVHSCGFDSVPSDLAVLLAHEWAQAQDAGPLTSATLEVLSARGGFSGGTVDSLRLQLDTARRDRQARRLVGDPYALSPDRAREPDLGRQPDVFRPHRREATSEWVAPFVMATYNTRVVRRSNALLDHAYGPRLRYAEVMAFSGRTAALRASAVTGVLAGLTGLLAVQPLRPLLDRLLPSPGTGPGERTRRTGHFRLRVDARTESGRRATVTVAAQGDPGYAATAVMLGQSALALALDGDRLPARAGVLTPATGIGMPLVNRLRHEGFTLDVAT

SEQ ID NO: 53297 - protein, 380 aa, Clostridium perfringens ATCC 13124
MKVIIFYAKTGGGHLSACKSLEESLNSLNIPVVTLDSLEFAGHLVSKEVCSAYTYIVKSVPELFGALYNAGEKISDHNKKSIIYKLNSFYADNILTVLEEEQPDIIISTHIFATQSISYLKQKNKIKALTASIVTDYTCAPFWEETDLDYYFLPHKDLIKEFEDKGLDSSKLIAFGLPIDSKFKVKTPKEKAKVSLGLEKNKPHILIMGGSMGAGSVKDTTLYISKHLKECNITTICGNNKELFKEISEIEKLNPRIHALQFTHEMNELMDSADILVTKPGGLTSTEAMNKSLPIVMINPIPGVESANCNFFMKHNLGVKSNSLHETLKICEKLISDKNFYEKIVSSQKLNSNINAAEDICKFLITKYHEIQYNSDNNSL

SEQ ID NO: 53298 - protein, 484 aa, Fulvimarina pelagi HTCC2506
MPTEILMPALSPTMEEGTLAKWVKNVGDTVEAGDIIAEIETDKATMEVEAVDEGKLGKILVDAGTENVKVNAPIAILLAEGEDDSDIEKASSGNGASKKEEVATKSDDEPVAESGSQERGAKSITPLDERRVPAEGKTHPDVEDEGPFGQKVPDDVELVSTTVREALRDAMAEELRRDEAVFVMGEEVAEYQGAYKITQGLLDEFGARRIVDTPITEHGFAGLGVGAAFGGLRPVVEFMTFNFAMQAIDQIINSAAKTLYMAGGQMGCPIVFRGPNGAAARVAAQHSQDYAAWYSHVPGLKVVQPFTAADYKGLLKSAIRDPNPVVFLENEILYGQSFDVPKMDDWTVPIGKARVHRKGSDVTIVSWSIGMTYAIEAAEELAKDGIEVEIIDLRTIRPMDMPAVVKSVKKTNRCVIVEEGFPQCSVSGHIASELMVQAFDYLDAPVLKVNGKDVPMPYAANLEKLALPSVQDVIDAVKAVCYRN

SEQ ID NO: 53299 - protein, 178 aa, Rickettsia rickettsii
MRLKEPYSVLKKMKRKEVPIDALKDLIACRIIVKSKALCYNALDIVKSSPHLDWLYTKDYINRPKSNGYQSLHNIMQLLHSKRNFEIQIRSENMHKDAELGRAAHLNYKEEQDRHLQKVFDITNDTILFKARQMVKQFEGFEEQIVEYEKEIMRIWHTKYDEMLKWANTAEVLIFNKD

SEQ ID NO: 53300 - protein, 479 aa, Fulvimarina pelagi HTCC2506
MPINVTMPALSPTMEEGNLAKWLIAEGDSVSAGDIIAEIETDKATMEVEAVDEGTLAKILVPGGTEGVKVNDVIAILAAEGEDVEEAAKSGGGSDPAPSGDDKGGAMMANAEADNAAEGSEEDAKDASKRGYARPEGGIGSGEIKEATESAGPAPKAEDGDRVFSSPLARRLAKEAGIDLAQVKGSGPHGRVVKADVETATENGVGKAAAADKPKDAAKADAAPAPAAKGPSDDAILKMFEEGSYEKIPHDGMRKTIAKRLVESKQTVPHFYLSVDCELDALLALRKQLNDAAPKTKSDDGEKPAYKLSVNDMVIKAMALALKTVPTANVSWTDTAMLKHKHADVGVAVSIDGGLITPIIKRAEEKTLSTISNEMKDLAKRARARKLQPQEYQGGTTAVSNLGMFGINNFSAVINPPHATILAVGAGEERAIVKNGEVKVATLMTVTLSTDHRAVDGALGAELIAAFKQYIENPMGMLV

SEQ ID NO: 53301 - protein, 484 aa, Fulvimarina pelagi HTCC2506
MADTYDVLVIGGGPGGYVAAIRAAQLGFKTAVVEREHLGGICLNWGCIPTKALLRTAEIFHYAENGKNYGLEIAKPKFDIEAVVKRSRGVSAQLNGGVGYLMKKNKIDVIWGQAKIKKAGKGGPVEVEVGKMQKPIVEPQHPVPKGTLGEGTYKAKHVIVATGARPRVLPGIEPDGDRIWTYFEAMKPKSMPKSLIVMGSGAIGIEFASFYRTMGAEVTVIELLPQILPVEDAEVAKLARKQFEKQGMKIMTDAKVAKVEKGKDGVTVTVETKGGKSETLKAERLISAVGVQGNTEGLGLEEAGVKIERGVVQTDGLGKTDAPGIYAIGDVAGPPMLAHKAEHEGTICVEAIKGMHPHPMKKTEIPGCTYCHPQIASVGLTEAKAKEIGHEVKVGRFNFTGNGKAIALGEPDGMIKTVFDAKTGELLGAHMVGAEVTELIQGFVIAIGLETTEEELFHTCFPHPTLSEMMHESSLDAYGRVIHQ

SEQ ID NO: 53302 - protein, 353 aa, Arabidopsis thaliana
MANISVVTTATNNQVILRNYVSGFPKESDLYIAATTVDLRVPPGSMAVLVKNLYLSCDPFSRIRMEKPDPSSPASVARAYSIGKPISGFGVAKAIDSCHPNYKTGDLLWGRVGWEEYSVITPTPSSHFKIHHTDVPLSFYTGLLGIPGLTAYVGFYEICSPKKGETVFVSAASGAVGQLVGQFAKMAGCYVVGSASSKEKVDLLKTKFGYDEAFNYKEEHDLSAALKRCFPEGIDIYFENVGGKMLDAVLENMRTHGRIAACGMISQYNLKEPEGVHNLASIVYKRIRVQGFAAVEFFDKYSKFLDFILPYVREGKITYVEDIAQGLENGPSALIGLFHGKNVGKQLVAVARE

SEQ ID NO: 53303 - protein, 450 aa, Glycine max
MERYKLIKEVGDGTFGSVWRAINKQTGEVVAIKKMKKKYYSWEECVNLREVKSLRKMNHPNIVKLKEVIRESDILYFVFEYMECNLYQLMKDREKLFSEGEVRNWCFQVFQGLAYMHQRGYFHRDLKPENLLVTKDFIKIADFGLAREISSQPPYTEYVSTRWYRAPEVLLQSYLYTSKVDMWAMGAIMAELFSLRPLFPGASEADEIYKICGVIGNPTFESWADGLKLARDINYQFPQLAGVHLSALIPSASDDAISLITSLCSWDPCKRPTASEALQHPFFQSCFYIPPSLRNRAVARTPPPAGTRGALDQQGVKRYSGALPTSKLSNNFSSMKLHPPLASGVQRKLDMVNQDGIKNEKPMRTTKPKYRQPGKDSPTSMNKGRSVRGVSETAEKLGNLSVSSRRQSMGQPRPPPPMKAGGNWISESGNFILGPAQQIPTGRTFARKVA

SEQ ID NO: 53304 - protein, 490 aa, Pseudomonas fluorescens Pf-5
MGCASGRWPFCSNCSVRVRDMSAVTSLMEDSPVGLGAAPQETLYQFDESPLLARQSRQESNARSYPRRIPLALKRASGIHVEDVEGRRFIDCLAGAGTLALGHNHPVVIAAIQQVLADELPLLTLDLTTPVKDQFVQDLFGLLPEALAGEARIQFCGPTGTDAVEAALKLTRTATGRSTVLSFQGGYHGMSQGALSLMGSLGPKRALAGLLNNGVQFLPFPYDYRCPFGLGGAEGVKVNLHYLENLLTDPEAGVALPAAVIVEAVQGEGGVIPADLEWLQGVRRITEKAGVALIVDEIQSGFGRTGKMFAFEHAGIIPDVVVMSKAIGGSLPLAVMVYRDWLDTWQPGAHAGTFRGNQMAMATGSAVMRYLKEHRVPEHAAAMGERLREHLLILQRDFPQLGDIRGRGLMLGVELVDPAGVPDAQGHPPQHARLAPLVQRECLKRGLILELGGRHGAVVRFLPPLVITAAQIDQVAQIFSKAVAAAVASL

SEQ ID NO: 53305 - protein, 404 aa, Oryza sativa (japonica cultivar-group)
LPPIGLVLSTPRAHQKTHTPTRANQPAAPRLAAVAMRPGGPPSLRAGLQQQQQQQPGTPGRSRRRPDLTLPLPQRDLTSLAVPLPLPLPPSSAPSSTSSSGSSSLGGVPTPPNSVGSAPPAPPPLSELERVRRIGSGAGGTVWMVRHRPTGRPYALKVLYGNHDDAVRRQITREIAILRTAEHPAVVRCHGMYEQAGELQILLEYMDGGSLEGRRIASEAFLADVARQVLSGIAYLHRRHIVHRDIKPSNLLIDSGRRVKIADFGVGRILNQTMDPCNSSVGTIAYMSPERINTDLNDGAYDGYAGDIWSFGLSILEFYMGRFPLGENLGKQGDWAALMCAICYSDSPAPPPNASPEFKSFISCCLQKNPARRPSAAQLLQHRFVAGPQQQQQPQPQPLAPPPS

SEQ ID NO: 53306 - protein, 308 aa, Yersinia pseudotuberculosis IP 32953
MVTTLDNALLNDILQQVRPLIGQGKVADYIPALAEVPANKLGIAVCTLDGQIFQAGDADERFSIQSISKVLSLTLALSRYSEQDIWQRVGKEPSGQPFNSLVQLELEKGKPRNPFINPGALVVCDMLQSRLSAPKQRLLEVVRQLVKDDSISYDPRVARSEFEHSDRNAAIAYLMKSFGNFDNDVLTVLQTYFHYCAMRMSCVELARCFVYLANQGRSISGSESLITPMQARQINALMITSGMYDGAGEFAFRVGMPGKSGVGGGIIAIVPDEFCIAVWSPELDHAGNSLAGTAALERLAQQIGRSIF

SEQ ID NO: 53307 - protein, 212 aa, Zea mays
MTSVWKTKVLPGLNKIFDKDGKKAAAAGFLKSFNKEEIDKEIEDKKTELEPKVVEAYEASPPEVKALFKDKKPVKVSKKNSAAVTKFLDELAKIDFPGAKVVSEAVAKSGTSPLLPAITFILDKVAPFIPKEEPKEEPAAEATSREVAVEEKKEEAEPAAATEAAPAPAETPSEAAVVEEKKEEEKKEEEDKPAAEEAAPPAAAAAAAAEEK

SEQ ID NO: 53308 - protein, 979 aa, Debaryomyces hansenii CBS767
MSSQVVTNLEETTNQHKAINNPNVVKRIHREVRFGLYILGSTLGEGEFGKVKLGWRKDGKHPSQVAIKLIKRDTIMKDSESEIKIHREINSLKMLNHPNIVNLVEVMKSGKYIGIVLEYASGGELFDYILQHKYLKENVAKKLFAQLVSGVDYMHSKGLIHRDLKLENLLLDKHKNVIISDFGFVNSYNKDKNDLMKTSCGSPCYAAPELVLTQAPYEGRKVDTWSLGVILYAMLAGYLPFDDDPENEDGSDIVRLYHYICKTPLTFPEYISPLARDLLRKIIVPDPKKRITIKNIKNHPWLTPYVNLLSVTQPEWDKVHKDNKTVNPKSAATANNSYTNLIHSNTNKRFSMINEKTNSSSLMMPAGRSYSSTNVVNQLYSNPSAPTTSSSLANAVALSKPKDPASDRSRTPSPTKQLPNGNNYSSTNYQRGHAKSTSISNPYSSASNALKAMVTENDSKRNSLVSLDSTTSSMISLTSSTKPAQHNHLPSPHLPRSTTYTGSAISTIAESPSKPSPATHLAVDNESNVTHHNTASSSNITNLKPNSSSRESAKLPHANKKPRPTSYHPSSMSASLMSSNGSSLQDYIKIPTPLLPIPQLLSTSPTKASPSSETSSPVFTDTNNSSPTMRSNASINSRRNSVVTHVHVNGVLTSESNANHNENKRNSVLSYLEDKMDALELTELHSPLKSNKPGFTDNASDTNITPQINQLPMFDGQTESPIIHTSKAEESQVKDQSEEGNKIETDEHPFVNVANQVDENKVVDLALEKESISEAPEEPNVSHSQDRTNQQENITLEFEEPKYTLEAQPAEPVSQTFKDEPVVSLDEQLIKRDHVNIIDEQEKENLDRKTTNTKKETSREINKSSAKEIKDNKKRNRFSLLSFYSNYNGSSSSNVVLQQAPTSNVSHSGKRILEPSLEQNVPTQPQDQKRNVSNSSGKSSTSKKSNNSGTAHISSNNGKEASAARKVMDFFKRRSVKIG

SEQ ID NO: 53309 - protein, 133 aa, Glycine max
MADLFAWLISFFLLIALLVLVMYQLMCLADLEFDYINPYDSSARINMVVLPEYITQAVLCCFYLLTGHWIMALFCLPYLSLNLRLYRQGRHLVDVTEIFNLLSWEKKQRLVKLFYLVFTLFLSVFWMIYTSLD

SEQ ID NO: 53310 - protein, 409 aa, Streptomyces coelicolor A3(2)
MAAEIVNPRSDSEAGAEQEAGAEPLDSFDPAFALHRGGKMAVQATVPIRDKEDLSLAYTPGVAKVCSAIAEQPDLVHDYTWKSSVVAVVTDGTAVLGLGDIGPEASLPVMEGKAILFKQFGGVDAVPIALNCTDADEIVETVVRLAPSFGGVNLEDISAPRCFEIERKLQERLDIPVFHDDQHGTAVVTLAALRNAARLSGRTLGELRAVISGAGAAGVAIAKMLVEAGIGDVAVADRKGVVSADREDLTPVKQELASFTNKAGLSGPLEAALAGADVFIGVSGGTVPEPAVASMAEGAFVFAMANPNPEVHPEVAHKYAAVVATGRSDFPNQINNVLAFPGIFAGALQVRASRITEGMKLAAAEALASVVGDDLAADYVIPSPFDERVAPAVTAAVAAAARAEGVARR

SEQ ID NO: 53311 - protein, 409 aa, Oryza sativa (japonica cultivar-group)
MEPFKGNFSNLLNQGSSSQATNSDAQNSPSTQFPTSYPQNFRPSFLQNFHPFGPPSNYQPYRHPPIFQGAQQQDYYGQPTPGSLEGFQLQENLVHSSNQAFGFAANRSQFGMQYSTSIGAAANTSSHGSASPCHTRHNEKEVVEVEEASDSSEEGRRGTRINWTEDDNIRLMSSWLNNSVDPIKGNDKKSEQYWKAVAREFNSNMPSNGNKRNPKQCRTHWDNVKRDVTKFCGFYSKARTTFTSGYSDDMIMEKAREWYKKHNNQKPFTLEYMWKDLKDQPKWRRVLEESSHNKRNKISESGAYTSSSNQDTEEETERKEKRPEGQKAAKQRQKGKGAPSPLGDKPNQNMVLFHEAITTKAAALLKAAEATLIGAEAKKEKAIAKKREGKGKKIPNVFKTDGEGYINLQ

SEQ ID NO: 53312 - protein, 734 aa, Arabidopsis thaliana
  misc_feature (423)..(423): Xaa can be any naturally occurring amino acid
MMLVFLLIRRQWRSASVRREEVIRLIALATEESYLAEEVRPATVDYGGDSVSDVYRCAVCLYPTTTRCSQCKSVRYCSSKCQILHWRRGHKEECRSPDYDEEKEEYVQSDYDAKESNVDFPSRGTAYESSSNVSVDVACDMSTSRPSIHKVQPRSEAVDFTTSLNIKDNLYETRPLSRKKSRNRTDKVESASNYSKGKTDAKLRKLGNQNSRRSGDSANMSISDQFLSVGFEEEMNALKHERITSEPSSASAAMSSSSTLLLPSKANSKPKVSQASSSGLKTSVQKVVQHFRPPQSSKKSQPSSSIDEMSFSYELFVKLYCDRVELQPFGLVNLGNSCYANAVLQCLAFTRPLISYLIRGLHSKTCRKKSWCFVCEFEHLILKARGGESPLSPIKILSKLQKIGKHLGPGKEEDAHEFLRMPXCAVDTMQSVFLKEAPAAGPFAEETTLVGLTFGGYLHSKIKCMACLHKSERPELMMDLTVEIDGDIGSLEEALAQFTAYEVLDGENRYFCGRCKSYQKAKKKLMILEGPNILTVVLKRFQSDNFGKLSKPIHFPELLDISPYMSDPNHGDHPVYSLYAVVVHLDAMSTLFSGHYVCYIKTLDGDWFKIDDSNVFPVQLETVLLEGAYMLLYARDSPRPVSKNGGRKSKQRRNLAAIPSRKGNKKQRDGDNNSLLPRVDWSSGSLSSMFSSSDTTSSCSTKDSSGIENLSDYLFGGVEPVWKWDRHNKSQTFD

SEQ ID NO: 53313 - protein, 613 aa, Glycine max
  misc_feature (66)..(66): Xaa can be any naturally occurring amino acid
MRTSWADSADNSTIGSGNSNSSACPPRGAYVPPHLRNRVFSSEVPPAASHPVAPGNDRVNHGGPAXIQGGGYFKPDHGRQPQQGFGYGLVFRSGGGGGWNGRGAGKGPVGGPRRTLFENVEAEDQSFSELENTGINFDAYDDIPVETKPGRMCQPPGNPFAEIDLGEALNQNIQRCKYVKPTPVQRYAIPISLAGRDLMACAQTGSGKTAAFCFPIISGIMREQYAQRPRVARTAYPLALILSPTRELSCQIHDEAKKFSYQTGVKVVVAYGGAPINQQLRELERGVDILVATPGRLVDLLERARVSLQMIRYLALDEADRMLDMGFEPQIRKIVEQMDMPPPGMRQTLLFSATFPKEIQALASDFLSNYVFLAVGRVGSSTDLIAQRVEYVLESDKRSHLMDLLHAQRETGVNGKQGLTLVFVETKKGADALEHCLCVNGFPAASIHGDRTQQERELALRSFKTGNTPILVATDVAARGLDIPRVAHVVNFDLPNDIDDYVHRIGRTGRAGKMGLATAFFNEGNFNMAKPLADLMQEANQEVPAWLSRYAARATYSGGNRNRKSGGSRFGGRDFRKEGSFNKATDYYGGGTGGGYCGNYGGGYGQGVPSAWD

SEQ ID NO: 53314 - protein, 432 aa, Vibrio fischeri ES114
MSKIVKVLGREIIDSRGNPTVEAEVHLESGFVGMAAAPSGASTGSREALELRDGDKARFLGKGVLKAVAAVNGPIAEALVGKDAKNQAEIDQIMIDLDGTDNKANFGANAILAVSLANAKAAAAAKSMPLYAHIAELNGTPGVFSMPLPMMNIINGGEHADNNVDIQEFMIQPVGAKTLKEGLRIGAEVFHNLAKVLKSKGYSTAVGDEGGFAPNLKSNAEALEVIAEAVAAAGYELGKDVTLAMDCAASEFFDKEAGIYNMKGEGKTFTSEEFNHYLAELANQFPIVSIEDGLDESDWTGFKHQTELLGDKLQLVGDDLFVTNTKILAEGIEKGVANSILIKFNQIGSLTETLAAIKMAKDAGYTAVISHRSGETEDATIADLAVGTAAGQIKTGSMSRSDRVAKYNQLIRIEEALGEKAPFNGLKEVKGQ

SEQ ID NO: 53315 - protein, 178 aa, Rickettsia montanensis
MRLKEPYSVLKKMKRKEVPIDALKDLIACRIIVKSKALCYNALDVVKSSPHLDWLYTKDYINRPKSNGYQSLHNIMQLLHSKRNFEIQIRSEDMHKDAELGRAAHLNYKEEQDRHLKKVFDVTNDTILFKARQMVKQFEGLEEQIVEYEKEIMRIWHTKYDEMLKWANTAEVLIFNEK

SEQ ID NO: 53316 - protein, 129 aa, Zea mays
MAAAGLRKGNARLPPEVNRVLYVRNLPFNISSEEMYDIFGKYGAIRQIRLGNAKDTRGTAYVVYEDIYDAKNAVDHLSGFNVANRYLIVLYYQPAKMSKKSDVKKEDEITRLQEKYGIGSKTPGPGSTD

SEQ ID NO: 53317 - protein, 776 aa, Debaryomyces hansenii CBS767
MEKLKNALSKDHGIEIESKNVNEIESAEEHVLMASKSQEFDPVTSRLEEVILDDDYAAVTVEDDSPYAEVRASVPSSDDADLPQNTIRMWILGMILNTIGSALNLLFSLHSPQIILTTLVTSLLAWPIGMAWARFIPNIKIFGTPLNPGPFNIKEHTIIVIMANVSFGGGAAYATDILLSQNKFYEQDFGWGFDLLAIWSTQCIGFALGGLARRVLVYPASMIWPQNLVTVTFLTNLHVNSNHVADGWKISRLYFFALIGICSFLWYWFPNYIFQALSWFAFPTWIAPKNVIVNQVFGANTGLGLIPITFDWNQISGYIGSPLIPPASAIATILLSMVTIFWIIVPAIHYSNTWYAQYLPISSSGSYDRYGSNYNVSRIINKDTLSFNEKSYKNYSPLFLSTTFAISYGLSFAAMFATLVHTVLFHGKDIMRQLKQKEKPDVHMRLMRQNYKDVPEWWFLIVFLVFFGISIVTIRCWNTEMPVYALIVALLIAVLFLLPVGVIFALTNIGVGLNVVTEFIIGYMVPGKPLAMMFFKTYGYITNNQAITFVQDMKLGHYMKVAPRLLFAAQFIASIWGSLVQVAVLRWSYGNIPNLCEADQANNYTCPNGKVFFNASIIWGVIGPERQFSQGQIYYGLLFFFIIGALLPLMNWLILKKWPKSPIRWLNWPVFFSGTGYIPPATPYNYSAYCAVGLTFGYWIKRRWFHWWSKYNYSLSAGLDIGMAWSSVIIFLTISLTKTSAPNWWGNNVIETTMDMTSTAIRQPLAEGEWFGPSSW

SEQ ID NO: 53318 - protein, 765 aa, Oryza sativa (japonica cultivar-group)
MASSSNPSNLPCSSDGVCMLCKVLTTEVEQLRCSTCATPWHTPCLSSIPPLTDVAHWVCPDCSGDVTASYPPSDVVRPESSLIAAIRVIEADPVLSIQEKARRRQELLGHAGDAGAAITEAVGENVEDSESNNPLSMLNKNINCSFCMLLPERPVTTPCGHNFCLKCFRRWIENGKRACVICRAPITQKVAQDLRINLALVQAIRMAKAANNASTTGETTVYHYKENEDKPDRAFTTERAKRAGMANASSGQIFVTIAPDYFGPILEDHDPRRNRGVRVGDHWKDRMEGRQWGAHFPHIAGIAGQSTHGAQSVALSGGYLDDEDHGEWFLYTGSGGRDLSGNKRTSKEQSFDQKFEKLNAALRVSCLNGYPVRVVRSFKEKRSPYAPESGVRYDGIYRIEKCWRKTGVQGTFKVCRYLFVRCDNEPAPWTSDEHGDHPRPLPDIEELKNAIDITERKGNPAWDFDATDGWKWMITPPISRKAVVTGDPRGKKMQGAARHTNNLSMRERLLKEFRCSICRNVMEEPVTTPCAHNFCKKCLLGSYDNLSLTEERSRGGRTLRARKIVKKCPSCPSDIADFVQNPQVNRDIMNVIESLQKEAEKEDHARVSGEGSSAALVDSDDENDTAWENQDDGNLDEGGCNNPEDMITESVDLNSVTNVDNTENKVEVQQPHKRTAGAGKGKGGKWARTSSAPGDADARNVVTSTETLDGIAAENVADLVQIEDCTFTGVERADPNALEVDGKNMIPDFSEAEKVNPKQDQEVLP

SEQ ID NO: 53319 - protein, 374 aa, Debaryomyces hansenii CBS767
MSSIIRRTFSTSTAALKSLKIGLIAGDGIGREVMPAGQAVLENLPSKHDLQFEFVNLDAGFEYFQKNGTALPQETVDILQKECDGALFGAVSSPTTKVEGYSSPIVALRKKMGLYANVRPVKSVEGNARSVDMVIVRENTEDLYIKEEKSYTKEDGTRVAEAIKRITETATSRIAKMAYDIALQRQAIRKANPGLKSLHEKPSVTVTHKSNVLSQSDGLFREVCRQVYDENADKYKDIAHKEQIVDSMVYRMFREPEIFDVVVAPNLYGDILSDGAAALVGSLGVVPSANVGDNFAIGEPCHGSAPDIQGKGISNPIATIRSTALMLEFMGYPEPAADIYAAVDANLTEDKIKTPDLGGSSSTQEVIDDIIRRF

SEQ ID NO: 53320 - protein, 281 aa, Flaveria pringlei
MAEMFRNCIALCCAKKPSVAEDMEANGKPVHIDDVIDRLTKLLSEKNDLQVFAAEKIKQLTAELEVADAGEFNAVERIRNGFARFKKEKYDTNPTLYGELAKGQSPKFLVFACSDSRVCPSHILNFQPGEAFVVRNIANMVPPYDTIKHSGAGAAIEYAVLHLKVENIVVIGHSCCGGIKGLMSIPDDGTTASDFIEQWVKIGLPAKSKVKADCSNLEYSDLCTKCEKEAVNVSLGNLLTYPFVREAVVNKKLSLKGAHYDFVNGSFDLWNLDFGISSSLI

SEQ ID NO: 53321 - protein, 436 aa, Thiomicrospira crunogena XCL-2
MAVNSRYIALKICLTVIEHGRSLSQSLAEGLAQFSDRRERAFTQNLVLGTLRWQERLEAIRSHLLKKPLKAKDEDVNQLILLGLYQILYMDTPEHAAVSETVNLTKSLKKPWARGLINGVLRTFLRDKDSICEEVDKKPAYRYSHPQWFTKTIRNAYPDHWEQILSANNEPAPLTLRVNPLYQTREAFLALLSDQAVEADIHPKAPQGIVLKNSLDITQLPTYDEGGFSVQDAAAQQAAYLLAPQPNEFILDACAAPGGKTTHLLELSDNQAKVFALEKEPERIERLSENLYRLALTAEIEVGDASQPDQWWPEIQFDKILLDAPCSATGIIRRHPDIKWHRTPEDITVLTQLQAAILQAIWPRLKPGGKLLYATCSVLPQENRDQISQFLQQTPDAKEIPIGADWGITIDAPGRQILPGQDGMDGFYYCLIEKGC

SEQ ID NO: 53322 - protein, 406 aa, Streptococcus suis 89/1591
GAFGRGMVPSGASTGEHEAVELRDGDKSRYLGLGTQKAVDNVNNVIADAIIGFDVRDQQAIDRAMIALDGTPNKGKLGANAILGVSIAVARAAADYLEVPLYTYLGGFNTKVLPTPMMNIINGGSHSDAPIAFQEFMILPVGAPSFKEGLRWGAEVFHALKKILKARGLVTAVGDEGGFAPKFEGTEDGVETIIEAIEAAGYEAGENGIMIGFDCASSEFYDKERKVYDYTKFEGEGAAVRTSAEQIDYLEELVNKYPIITIEDGMDENDWDGWKALTERLGKRVQLVGDDFFVTNTDYLARGIKEGAANSILIKVNQIGTLTETFEAIEMAKEAGYTAVVSHRSGETEDSTIADIAVATNAGQIKTGSLSRTDRIAKYNQLLRIEDQLGEVAVYKGLNSFYNLKK

SEQ ID NO: 53323 - protein, 508 aa, Fulvimarina pelagi HTCC2506
MTTFSELGLSAKVLAAVEATGYTQPTPIQAEAIPHALERRDVLGIAQTGTGKTASFVLPMLTMLEKGRARARMPRTLIIEPTRELAAQVEESFARYGKEQKLNVALLIGGMSFEEQDKKLDRGCDVLIATPGRLLDHFERGKLLLTGVEILVIDEADRMLDMGFIPDIERICKLLPFTRQTLFFSATMPPEITKLTQQFLQNPVRVEVAKPASAALTVEQRLVASGAKDYDKRARLRDLLRANEDVTNAIIFCNRKRDVSTLFRSLEKHGFSAGALHGDMDQRARMTMLHNFREDKLQLLVASDVAARGLDIPAVSHVFNFDVPIHAEDYVHRIGRTGRAGRSGKAFTLVTKSETKHLDAIKKLIGTEIEWLDGDLSKVEVTESDEGEGDRRSRSRGGSGRGGRNRKGRSRGGADKDDQQQQDDVAAKADDPKPQNDETETEDTVEAVAIQQNDNARKPNSRAHNGSRSRSGERGGRGGRGRSSRDDSNTMVGFGDDIPAFMLIATGT

SEQ ID NO: 53324 - protein, 213 aa, Desulfitobacterium hafniense DCB-2
MVTEKLLKGIVNFRNGDFETHRQLFEELKDNQKPHTLFITCSDSRIDPNMITGTLPGELFIVRNVANIVPPCRETSEYVSTTSAIEYAVQMLGVENIIVCGHSNCGGCSASLNAPEKLDQLPHTKKWLELMESVRERVLSEFAEDEPTVREWMMEQINVVEQLRHLMTYPYIYEKVMAKELMLSGWHYMIETGEVFIYDYRAGEFRLANGSRA

SEQ ID NO: 53325 - protein, 549 aa, Shewanella sp. MR-4
MTQKLPRQATASEDSLMRIFTVPEDAESTLSIIEQKLSEDLAGFLGDSIAALEKPLSEIETDFQAFEIPSQPRFVSDYTDEIMQNLVAHSVHTAAPSFIGHMTSALPYFVLPLSKMMVGLNQNLVKIETSKAFTPLERQVLGMMHHLIYAQNDDFYRNWMHSANHSLGAFCSGGTVANITALWIARNQLLKADGDFKGVTREGLIKALRHYGFDDLAILVSERGHYSLGKAVDLLGIGRDNIISIPTDGNNKVDVAKMREVAAELANKRIKVMAIVGVAGTTETGNIDPLRELAALASELNCHFHVDAAWGGASLLSNKYRHLLDGIELADSVTIDAHKQMYVPMGAGMVLFKNPEFAHAIAHHAEYILRRGSKDLGSQTLEGSRPGMAMLVHACLQIIGRDGYEILINNSLEKARYFAEQIDAHPDFELVTAPELCLLTYRYVPSNVQAAMQLAIEQGDKTKLARYNELLDGLTQFIQKHQREQGKSFVSRTRIQPARYFRQPTVVFRVVLANPLTSHEILNQVLIEQGEIAALDKEFLPALLAMVNE

SEQ ID NO: 53326 - protein, 469 aa, Fulvimarina pelagi HTCC2506
MTDANEILKQIKDNDVKFVDLRFSDPKGKLQHVTMDISQVDEDLFSEGTMFDGSSISGWKAINESDMVMMPDPETAHMDPFFAQSTMAITCDILDPISGEAYNRDPRTTAKKAEAYLSQSGIGDTAFFGPEAEFFVFDDVRYKTDPYNTGFKLDCTELPSNDDTEYETGNLGHRPRTKGGYFPVPPIDSAQDMRSEMLTVMAEMGVSVEKHHHEVAAAQHELGIKFDTLTRNADKLQIYKYVIHQVANAYGKTATFMPKPVYGDNGTGMHVHQSIWKDSKPTFAGDEYAGLSESCLHYIGGIIKHARTLNAFTNPSTNSYKRLVPGYEAPVLLAYSARNRSASCRIPFGQSPKAKRVEVRFPDPTANPYLAFSAMLMAGLDGIKNKIHPGAAMDKDLYDLPPEELKEIPTVCRSLREALESLDSDRDFLKAGGVFDDDQIDAYVELKMEEVERFEMTPHPVEFEMYYSV

SEQ ID NO: 53327 - protein, 466 aa, Mycobacterium leprae TN
MNAQPAATAAQDRRHQVVIIGSGFGGLNAAKKLKRANVDIKLIARTTHHLFQPLLYQVATGIISEGEIAPPTRVVLRKQRNIQVLLGNVTHIDLANQCVVSELLGHTYETLYDSLIVAAGAGQSYFGNDQFAEFAPGMKSIDDALELRGRILSAFEQAERSNDPERREKLLTFTVVGAGPTGVEMAGQIAELADHTLKGAFRRIDSTKARVVLLDAAPAVLPPMGEKLGQRAAARLQKMGVEIQLSAMVTDVDRNGITVQDSDGTVRRIESACKVWSAGVSASRLGRDLAEQSLVELDWAGRVKVLPDLSIPGYRNVFVVGDMAAIDGVPGVAQGAIQGAKYVANNIKAELGEANPAEREPFQYFDKGSMATVSRFSAVAKIGPLEFSGFIAWLMWLVLHLMYLIGFKTKITTLLSWTVTFLSTRRGQLTITEQQAFARTRLEQLAELTAESQSTAAANRATMRAS

SEQ ID NO: 53328 - protein, 327 aa, Aspergillus oryzae
MPTKYVDRPIPQISLANFDQRIDEITADLVHAAENVGFFTIVDHGISIDEIETMFATTERFFNLPDDVKATVPWNPNNVGWEKKSQVRPSTGQPDTKESYQLQFGENMTNLWIGDAHLPGFRTTSLTFMHRVQGVSEQLMRCFARGLGFPEEYFIKCHDVSRHNEQTTMRLLHYFALPEKSDGNTYHRAGAHADWDFLTLLFQKDGQSGLEICPGREAVTEFGIGDEWTRVEARTGEIVCNIGDLLMSWSDDRFKSTFHRVKAPLEPGDYYGDRYSIAYFNQPCKDALIQGPKKKYPMLTGEQFNTRAMQRNFAALQEKLKTMEASA

SEQ ID NO: 53329 - protein, 608 aa, Mesorhizobium sp. BNC1
MDARNNPKPEITTGPLPASSKVYKPGTLHSEIRVPMREIAVHPTAGEPPVTVYDSSGPYTDTSVTIDIEKGLPRLRETWIEARGDVERYDGRIVKPEDNGFVSGERLTPEFPVRNRPLKARDGKAVTQLAYARAGIVTPEMEFIAIRENLGREKLKEKLVRDGESFGAAVPDYVTPEFVRDEVARGRAIIPANINHPESEPMIIGRNFLTKINANIGNSAVTSSMAEEVEKLVWATRWGADTVMDLSTGRNIHNIREWIIRNSPVPIGTVPIYQALEKVGGIAEELTWEVFRDTLIEQAEQGVDYFTIHAGVRLHYVPLTVNRVTGIVSRGGSIMAKWCLAHHKESFLYEHFAEICDICRAYDVSFSLGDGLRPGSIADANDAAQFAELETLGELTKIAWAKDCQVMIEGPGHVPMHKIKENMDKQLEICGEAPFYTLGPLTTDIAPGYDHITSAIGAAMIGWFGTAMLCYVTPKEHLGLPDRDDVKTGVITYKIAAHAADLAKGHPAAKVRDDALSRARFEFRWEDQFNLSLDPETARALHDETLPKEAHKVAHFCSMCGPKFCSMRISHDIRAEAQKEGMAAMAEKYREGGDLYVAVEETAETQGA

SEQ ID NO: 53330 - protein, 493 aa, Debaryomyces hansenii CBS767
MKLYFEAEQFLSPYKGKGIGGSLQSRIFNEAKLVNSPKHIYALVYSTLKYKEHIQAIIRKSKIKQTLQTKKLKISDNLLLLVVHDLLFNSKGRIQLGKHPIKDAILQHKTRLQAEFTKLKLKYKAKSAEDLPTSVSSDDETPIRWFRVNTIKTTPEKFFQDHPFFAKLEPISSIEIKETGFIYTDDYIPNLYGIHPKEKLTSTAAYLKGEVIIQDRASCFPAHILNDDPSDNHIEIIDSCAAPGNKTTHCASYLPRSEDSVVYAFERDSNRVKVLKTMCEKATGIKYKNLIQITHADFTSTKPQDFPCVTGLVVDPSCSGSGIFGRAIEDAQLQEQEKEEIDTERLNRLAGFQFKIMKHALLFPKARKVVYSTCSIHPHENERVVVDLLMDKEIKASGWQLASRDIVISEWPKRGWKEEFTAVCGGNEEECEALAGGCVRATPKEDGGIGFFAACFIKKDISDEDSERQKVNKEENDIDEETEEQGEEWSGFD

SEQ ID NO: 53331 - protein, 549 aa, Aspergillus oryzae
MLVGNIYVIAGIAVVGGALFGFDISSMSAQLNENSYKCYFNQGPQGPPFTDDADCSGPESLVQGGITASMSAGSWLGALISGPLSDRIGRKTSIMAGCSLWIIGSTIMCASQNIGMLIVGRIFNGLCVGIESAQVPVYISEISPPSKRGRFVGVQQWAITWGILIMFYISYGCSYIGDRSAFGYSTAAWRIPWGLQMIPAVFLFLGMMILPESPRWLARKDRWEECQTILAKVHCKGDMSHPFVALEMQDIREMCDFERQFKNVTYFDLFKPRMLNRTIIGLFMQIWSQLTGMNVMMYYITYVFSMAGYSGDSNLLASSIQYIINVLMTLPALIWLDRWGRRPTLLIGAVLMGTFMYANGAIMAVHGEVVPGGIDGVAQQSMRLHGAAAKGLIACTYLFVASYAPTWGPVSWTYPPELYPMRLRGKGVALSTSGNWAFNTALGLFTPPAFANIRWQTYIIFGVFNTAMFIHVYFFFPETAGKTLEETEAMFEDPNGIKYIGTPAWKTRVTTGRIEQLERGDVEGLESKAQQEPAAREVEVTQPEQKTAS

SEQ ID NO: 53332 - protein, 358 aa, Glycine max
VAAIRIQKAFRGYLARRELRALRGLVRLRSLMEGPVVKRQAISTLRSMQTFAHLQTQIRSRRLRMLEENQELQKQLLQKHAKELESIRLGEEWDDSIQSKEQVEAKLLSKYEAAMRRERAMAYSFSHQQNWKNASRSVNPMFMDPTNPAWGWSWLERWMAARPWESHSLMEKEKNDNKSLRSSSRGITSAEISKSFAKFQLNSEKHSPTASQNPGSPNFESHSNPPKPSSPAVARKLKKASPKDILAIDDGTKSMVSVQSERPRRHSIAGSIVGDDESLASSPSIPSYMVPTKSAKAKSRMQSPFAAENGTPDKGSSGTAKKRLSFPASPARPRRHSGPPKVESSFNAEITVGNGVAG

SEQ ID NO: 53333 - protein, 1007 aa, Oryza sativa
MVIARGLLRSNASSSSSQAINLLKYVTSTGSLQGHTQNLCDASTRHFSSVPSPQYNSTEENGFKGHGMLAPFTAGWQSTDVHPLVIERSEGSYVYDIDGKKYLDSLAGLWCTALGGSEPRLVKAATEQLHKLPFYHSFWNRTTKPSLDLAKELLSMFTAREMGKVFFTNSGSEANDSQVKLVWYYNNALGRPDKKKFIARSKSYHGSTLISASLSGLPALHQKFDLPAPFVLHTDCPHYWRFHLPGETEEEFATRLANNLEELILKEGPETIAAFIAEPVMGAGGVIPPPKTYFEKVQAIVKKYDILFIADEVITAFGRLGTMFGSDMYNIKPDLVSMAKALSSAYVPIGAIMVSPEISDVIHSQSNKLGSFAHGFTYSGHPVACAVAIEALKIYQERNIPDHVKQISPRFQEGVKAFAGSPIVGEIRGVGLILGTEFADNKSPNDPFPAEWGVGAIFGAECQKRGMLVRVAGDNIMMSPPLIMTPDEVEELVSIYGDALKATEERVAELRRLNVDIEATTSLELEWRLQTSPQLLRFKGHGMLAPFTAGWQRTDVHPLVIERSEGSYVYDIDGKKYLDSLAGLWCTALGGSEPRLVKAATEQLHKLPFYHSFWNRTTKPSLDLAKELLSMFTAREMGKVFFTNSGSEANDSQVKLVWYYNNALGRPDKKKFIARSKSYHGSTLISASLSGLPALHQKFDLPAPFVLHTDCPHYWRFHLPGETEEEFATRLANNLEELILKEGPETVQSSFHRNLYCAKRSKIAAFIAEPVMGAGGVIPPPKTYFEKVQAIVKKYDILFIADEVITAFGRLGTMFGSDMYNIKPDLVSMAKALSSAYVPIGAIMVSPEISDVIHSQSNKLGSFAHGFTYSGHPVACAVAIEALKIYQERNIPDHVKQISPRFQEGVKAFAGSPIVGEIRGVGLILGTEFADNKSPNDPFPAEWGVGAIFGAECQKRGMLVRVAGDNIMMSPPLIMTPDEVEELVSIYGDALKATEERVAELKSKKNN

SEQ ID NO: 53334 - protein, 328 aa, Flaveria pringlei
MYATAAAFAPSFTTSRRKPSSSSSTVSTCFARLSNSAQSSSSSATPPPSLIRNQPVFAAPTPIITPTVRGDMGSESYDEAIAALKKLLSEKEELAPVAAAKIDEITAQLQTLDTKPAFDAVERIKTGFAKFKTEKYLTNPALYDELSKGQSPKFMVFACSDSRVCPSHVLDFQPGEAFVVRNVANIVPPFDKLKYAGVGSAVEYAVLHLKVEQIVVIGHSKCGGIKGLMTFPDEGPTSTDFIEDWVRVGLPAKSKVKAEHGSASLDDQCVSCEKEAVNVSLANLLTYPFVRNGLMNKTLALKGAHYDFVNGAFELWGLDFSLSPPTSA

SEQ ID NO: 53335 - protein, 206 aa, Polaromonas sp. JS666
MTTPSTAPTPAPRKAEVSRNTAETQITVKLNLDGTGKASLSTGIGFFDHMLDQIARHGLIDLDIQAKGDLHIDGHHTVEDVGITFGQAVAQAVGDKKGLRRYGHAYVPLDEALSRVVIDFSGRPGLEMHVPFKSGMIGTFDSQLAYEFFQGFANHAFVTLHIDNLRGDNAHHQAETVFKAFARALRMALEIDPRSAGVIPSTKGSL

SEQ ID NO: 53336 - protein, 299 aa, Kineococcus radiotolerans SRS30216
MSIVLADHRYGKAENRVVRFRRDTARHEIVDLNVTTTLRGDFADAYLSGDQSKVLPTDTQKNTVYAYAKEKGVATVEGYALDLARHFVDDVEPVSGARVDVEAYPWTRAQVGGNEHDHTWIRSGAEVRTAAATVSDGDGRQVVHVLAGLKDLTLLKSTGSQFKGFLTDAYTTLPETDDRVMATSLVATWRYGAAALADGFDFDAAYATIREALIEQFATLHSLALQQTLWHMGRSALERVPEAAEIRLLAPNKHHFDYDLARFGTDNHGEVFHAADRPYGLIQAVVANDVFPAAPEAWA

SEQ ID NO: 53337 - protein, 331 aa, Flaveria linearis
MYATAAALIAPSFTTSLRKPSSSSSTVSAPFARLITNNSLASSSLSATPPPSLIRNQPVFAAPTPIITPTVRGDMGSESYDEAIAALKKLLSEREDLAPVAAAKIDEITSQLQTLDTKPAFDAVERIKTGFAKFKTEKYLTNPALYDELSKGQSPKFMVFACSDSRVCPSHVLDFQPGEAFVVRNVANIVPPFDKLKYAGVGSAVEYAVLHLKVEQIVVIGHSKCGGIKGLMTFPDEGPTSTDFIEDWVRVGLPAKSKVKAEHGSASIDDQCVSCEKEAVNVSLANLLTYPFVRNGLINKTLALKGAHYDFVNGTFELWGLDFCLSPPTSA

SEQ ID NO: 53338 - protein, 398 aa, Kineococcus radiotolerans SRS30216
MPSAAPPPRADERGRGILAPGLQHRPHVARRDLGQVHQHQQQRLDPRGPRVVERGEDASARAAVPVGHLEDVHPVRQAGADLPGGGADGDGHRRAAAGPEDLRRPGRPAGAPGRAQQRLGNPHACSRARCEHHPQDRHRPIPPRDRRPAGAGEDAVGGGDGGGVGGGVSGTFPAGSGLRAVWWFRPGTAVADTERWHFGGCAASPDPVTLAVRHQEEATMVSTTEGRVQGVVALNALPEQEFRDLLLACCHAPGWAAALAAQRPFPAVAALLDAADAALATASEEDVDAALAAHPRIGERPANAASRREQAAALSADAAVLDDLAAGNRAYEARFGHVYLVCASGRSAEELLAVLRSRLDNDPVTERAVLRRELAAITRLRLERAVGDASPVRAGTAS

SEQ ID NO: 53339 - protein, 537 aa, Magnaporthe grisea 70-15
MAEPDAPPATKGGDALADTPSLKRRGSSSQQSDTSQTAAEFIREQMQLEADAREALPYSIKDCTRSLGSLRQAVFSCLTCNPPPSDPKAPYDAAGVCYACSIQCHGEHTLVEIFTKRNFTCDCGTTRFSSTSPCSLRVNPETNSKGVHSEPASTSNKYNHNFRNRFCGCECDYDPFEQKGTMFQCLGLGTHETGGCGEDWWHPGCLVGLGPAWFENMEAKKSAVKADTGGASITNKPLETISEDAEASNGATSATAGTANADPPAAVEEAEDDDPPMPPGFPEEDAFESFLCYKCVDAYPWAKRYAGSQGFLPPVFSKQTTNGAAPTLESSAVSTSGLGSQKRKAEDDFEDTAEVESKRHKTEEPVPAVTSTENPSDVKPLDKPVCKINSLAAAPSDQFSLFFKEDFREHLCRCEACFPLLKPHPQLLEEEETYEPPVSEDGNGSEHGSTQGSLLEMGESALRNVDRVRAIEGVMAYNHLKDKLKMFLQPFAQSGEAVSAEHIKEIFAKMRGDDEAIKEAAEGAKKSSDNRREQSGY

SEQ ID NO: 53340 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSFS

SEQ ID NO: 53341 - protein, 508 aa, Fulvimarina pelagi HTCC2506
MEWRRFHTLLTPDEMGQADRITIRRGVSGFVLMKAAGNRVAEAALKMIGDIGTGGTCRIACLGGPGNNGGDAFVAAELLRRSGHSVVVHTLSKPECLSGDAALAAGYYEGTVEPLDTFEPEKTDLVIDGLLGAGLSRPIEGDVAALIARTNTAAPRLLAIDLPSGVSGKSGAILGDAFQAERTVSFFRAKPGHFLEPGRTRCGSVDIRQIGIEANVLDTIRPKAFLNQPELWRLQLNLPAGAGHKYDRGHAVVFSGPALKTGAARLAANAALRAGAGLVTLLSPPNAILVNASHLTAVMLRKCEGSGDLGEILVDHRFNAFVLGPGFGTGERVRDYARLVLEAGRALVLDADGISAFSDVRNILFDNEKQPSEGEGVRLVLTPHAGEFARLFPDIAEADRLSKLDRARQAAERANAVIVLKGRDTVIASPDGRAVINANGTPWLATAGTGDVLSGIIAAQLAQGMPAFEAAAAGVWMHGRAAELFGPGLTAEELAGQLPRVFVELMEA

SEQ ID NO: 53342 - protein, 468 aa, Oryza sativa (japonica cultivar-group)
MPAPTASSLAAAADPALPAAFLSLPSPLLPASPPLPAAPAPSSNAFCVPRGPARAVAVSVSVSAYGAGSTAAASRLHRMWAEFSRFVRLHGNQIAPLGFASLGLGVGGGGGGSGEGAGGGGGGGGGEVDGLVEEEGVARAEAPKKVLILMSDTGGGHRASAEAIKAAFIQEFGDDYQVFVTDLWTDHTPWPFNQLPRSYSFLVKHGPLWKMTYYGTAPRVVHQPHFAATSTFIAREVAKGLMKYQPDVIISVHPLMQHVPLRILRSKGLLDKIPFTTVVTDLSTCHPTWFHKLVTRCYCPSAEVSKRALKAGLQPSQIKVYGLPVRPSFVKPIRPEDELRRELGMDEYLPAVLLMGGGEGMGPIEATARALGDALYDEVLGEPTGQILVICGRNKKLTSRLQSINWKVPVQVKGFVTKMEECMGACDCIITKAGPGTIAEAMIRGLPIILNGYIAGQVILQSVNVVIA

SEQ ID NO: 53343 - protein, 250 aa, Oryza sativa (japonica cultivar-group)
MRVAATTRPASSSAAAPLPLFLLLAVAAAAAALFLVGSASLAMAGHVLGGAHDAPSAANSVETDALARFAVDEHNKRENALLEFVRVVEAKEQVVAGTLHHLTLEALEAGRKKVYEAKVWVKPWLDFKELQEFRNTGDATTFTNADLGAKKGGHEPGWRDVPVHDPVVKDAADHAVKSIQQRSNSLFPYELLEIVRAKAEVVEDFAKFDILMKLKRGNKEEKFKAEVHKNLEGAFVLNQMQQEHDESSSQ

SEQ ID NO: 53344 - protein, 455 aa, Burkholderia sp. 383
MKNLQRHLSARHIRFLALGSAIGTGLFYGSASAIQLAGPAVILAYILGGAAVYMVMRALGEMAVRDPVAGSFGHYATENLGPFAGFVTGWTYTLEMVIVAIADITAFGIYMGFWFPDVPQWIWVLGVVAIICGLNLCHVKVFGELEFWLSIIKVGAIVAMIGGGVAILLTGMHFGHSADVPTFANLWNHGGFLPNGVGGLIASLSVVIFAYGGIEVIGMSAGEAKDPERVIPRAINAVPARILLFYVLTMVVLMSISPWTGVGNEGSPFVQIFSALGVKSAATILNLVVISAAISAINSDIFGAGRMMFGMARQGQAPRVLMTTSRHGVPWVTVVVMAAALLVGVLLNYLMPKDVFLMVAAIATFATVWVWLMILLSQVAMRRRLSSTEVAALKFKVPLWPVAPALTIAFMGFVIVMLGWFEDTRVALYVGAAWLALLALVFYARIRPKFAPASR

SEQ ID NO: 53345 - protein, 468 aa, Mesorhizobium loti
MRLSNLGTEQLREKDRSFVFHPSTHLAKHSRGETPNRIMAGAEGVYIWDTEGRKSLDGFGGLYCVNMGYGCTEIAEAIARQAHEMPFAHIYASQGTEPVALLAEAVVEYFGQNMRRVFFGLSGSDANETNIKLVWYYNNILGRPEKKKIISRHRGYHGSGLVTGSLTGLAFFHNFFDLPLDLVRHTTTPHHYRQAHDGESEQAFSKRCADELEALIVAEGPETVAAFIGEPVLGTGGIVPPPKGYWTAIQSVLDKYDILLIADEVVCGFGRTGEKFGSHLYGMRPDFVTIAKGLSSAYLPISGSIIGDRVWSILEQGTEKHGALGHGWTYSGHTLCAAAALANIRLLKERNILEHVRDVGPYWHARMNAELAGHPIVGEVRGVGILSAVELMRDPKQRIPFESDLQVGVRAAAALFENGVIGRAMPHGDILGFAPPLIITRKEIDIIVNATAKSVETTYRALKAEGAI

SEQ ID NO: 53346 - protein, 129 aa, Polaromonas sp. JS666
MNWLDEVSWDEKGLIPVIAQEASSGDVLMFAWMNREALQKTAELGQAVYYSRSRGRLWHKGEESGHLQTVHEIRLDCDNDVVLLKVTQLGHEPGIACHTGRHSCFFHLYKDGQWVVTEPVLKDPGSIYK

SEQ ID NO: 53347 - protein, 127 aa, Polaromonas sp. JS666
MSSNDSLQRLAQIIESRKPANGGDPGTSYVARLLHRGPDAFLKKIGEEATETVMAAKDLDHGGPTPELRAKLVGEVADLWFHSLIALAHYGLQPADVIAELERREGTSGIEEKALRKVQNRDAAEKS

SEQ ID NO: 53348 - protein, 119 aa, Polaromonas sp. JS666
MSHSDNCIFCKIAAGAIPSRKVYEDDELFAFHDIHPWAPVHFLIIPKAHIPSMAQVGPEHEGVLGRMMVLAPRLALELGCNPYPAGGFRILTNTGAEGGQEVHHLHFHVIGGPRPWLKG

SEQ ID NO: 53349 - protein, 477 aa, Mesorhizobium loti
MSEARSYELFINGKWRAGGSRVTLPVINPATEKVVASVASATVSDLDEALASAERSRKAWCSRPAKERGEILVAAARVLATQIEPAARDLSAEQGKTIAEATGEYARAVETLEWNGTHAEELSATIPLGPNRMIVPEPLGVVAAFTPWNYPAVLITRKLAPALAAGCPVILKGAEETPSVAVHIVESLRQAGVPDGVVNLVFGVPVHISRHLLSSPIVKVLTFTGSTAVGKQLAMLAANNLQRCILELGGHSPVIVCEDADLAKAIPAISEYKFECAGQSCNAPSRILVARTLYEEFLSRMTEAARKIRIGLPDDPATEMGPMANARRIEAMQRLTKDAVDRGAHIETGGTRLDGAGFYWPPTILTGVPKDARVLHEEPFGPILTVAPFDTLDEAIGEANDTEYGLAAYFFTDAADTQRKLTNSLSAGAVSVNYLKGVSADAPYGGVKQSGYGYEGGEQGVRSFQILKMVNGLGSFG

SEQ ID NO: 53350 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYQAEENSPKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQEHYRADMKTLEVFTNWLHQRSFS

SEQ ID NO: 53351 - protein, 757 aa, Oryza sativa (japonica cultivar-group)
MEIQKSDHHEQNLTSPRGLIHKVLRRTSSRRSPTAADHNPSPVFLETSNSKFLKQKDIDDAIKDPEKAGTHDNRIEDEKSDLLGYEICSGKLTLDNKAKSASGEQSGSGSSSNCFDARLTTEALVWGSNILKLEDIVSVSYHSGLRHFTVHACPLEKRSSGLSCFMKPRKIQKDLRFLSTSPHEAFRWVNGFADQQCYVNLLPHPMASSKKHSSELIPFDNMFDPCVKCRSPPKILVILNPRSGHGRSSKVFHGKVEPIFKLAGFKMEVVKTTHAGHAKSLVSTIDFSTCPDGIVCVGGDGIVNEVLNGLLCRDDQNVAVSVPIGIIPAGSDNSLVWTVLGVKDPISAAMSIVRGGFTPIDVFAVEWIQSGTIHFGTTVSYFGFVSDVLELSERYQKRFGPLRYFVAGFLKFLCLPKYNFELEYLPISDGGGGEHKIVEGQDKVDASDLYDDVVRRSRVECLPRASSLSSIDSIMSTGIMSGGDLEVSSPHANNEPSELVRALDPKSKRLSLGRTSTFKEPEEVIHPQAHVSSTPNWRRSKSKSRTEKAWPGSGATNDANSSRGTTTHDKEDASSTISDPGPVWDSGPKWDDEPKWDNQPNWEPETPIDLPGPLDDIELGLTKELVPSLDERWTVRKGRYLGVLVCNHSCKTVQSLSSQVIAPKAEYDDNCLDLLLVGGSGRLRLLKFLVLLQFGKHISLPNVEYLKVKSVRLKAGPNTHDGCGIDGELLHVKGQVRCSLLPQQCRLIGRPAKNPVQ

SEQ ID NO: 53352 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAISTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMITPPHELVDTCNPRIYPDFTWPMLLEFTQKHYRADMKTLEVFTNWLHQRSLS

SEQ ID NO: 53353 - protein, 385 aa, Populus tremula
MAIDCIKTMPSITTPHHHPKDQDQCKDDGKSFVFDAQVLRHQTNIPQQFIWPDNEKPNINAPELQVPLVDLGDFLSGNPVAAVEASRLVGEACKKHGFFLVVNHGVDKTLIAHAHNYVDTFFKLPLSEKQKAQRKIGESCGYASSFTGRFSSKLPWKETLSFRYKAEENSSKHIEEYFHNRMGEDFAEFGTVYQDYCEAMSTLSLGIMELLGMSLGVSREHFREFFNENDSIMRLNYYPPCQKPDLTLGTGPHCDPTSLTILHQDQVGGLQVFVDNEWRSINPNFDAFVVNIGDTFMALSNGIYKSCLHRAVVNSQTPRKSLAFFLCPKNDKMVTPPHELVDTCNPRIYPDFTWPMLLEFTQKHYRADMKTLEVFTNWLHQRSLS

SEQ ID NO: 53354 - protein, 77 aa, Glycine max
  misc_feature (42)..(42): Xaa can be any naturally occurring amino acid
MKGGRKNLRRACEEGTAVTLAEGESIMQVVTLRGSNLIEVTXGEGVKSLALFPAKFQKSFWIKNGNFVVVDASGRDE

SEQ ID NO: 53355 - protein, 649 aa, Yarrowia lipolytica CLIB122
MDRLSHLYTCLEAEKAADVASMSSLTSSLTPKQLASRGLAIVNLTLASLRTGFGGKLVATLEPDVSISPEITGGNDIRTGDLIKIIKNKTSKDDKAVEAVVLKSTKAKIEVALDENFDATDSLDGVRLHVVKLANNATYRRMEFALKDMLRMKEQEMSDLMRVCVDKETISDHKDDPNLQLYNTALNPSQVEAVQHSVGSAQVTVVHGPPGTGKTHTLVEIIRQLVQKKGQRVLVCGPSNISVDTLLERLHPHFNGNQLLRIGHPARLLEANLQHSLDIVSKTCDSGQIVKDVQVNIDQQLRKISKTKSGREKYAMYKEIGMLRKEFKERQKKVVADLLLQAKVVCATLHGTGDSCLKDVQFDTIIIDEISQSLEPQCWIPISRYPSAQKLIIAGDNQQLPPTVKCEQSKIKKQLELTLFDHLVGNYDNIRRLLKVQYRMHDAIMQFPSQELYGGQLVAHSSVARHTLADLPHVTEDYETTTPVVWIDTQGDDFYEQEDESGKLNPSRLNDSEAYLVRRHVGKLLDLGVLESEIGVITPYSAQASLIRSLIHPTNPAVEVATVDSFQGREKEAVILSLVRSNENHEIGFLGEYRRLNVAMTRPRRHLCVVGNMETLARGSDFTQAWAKHGEDNDDIEFPSLDEVIELQQ

SEQ ID NO: 53356 - protein, 210 aa, Magnaporthe grisea 70-15
MLGMIASFRVAADGGANQLLEASRDLANNLDVIIGDLDSFTASSAEFYSSLPSPPQVIKITEQESTDFSKAVTHIRSRTDKPSDIVAIGGLGGRVDQGLSQMHHLCIFQEDPSYGQGRVYLVSEESLTFLLKPGKHNILVPDWAGLFGKHVGIIPIKGPAIISTKGLEWDVKEWKTEFGGRISTSNHLLPETEVVEVETDKDVIFTIALK

SEQ ID NO: 53357 - protein, 541 aa, Pichia angusta
MAGDSITGVAGTADVNRVEAPLTVRAYLMCAFGAFGGILFGYDSGYISGVMGMDYFIHEFTGKVKHGDDDSSFVVGSSQKSLITSILSAGTFFGAVCAGDLADMFGRRTIIVTGCSIYSVGVALQVASTTVALLSVGRVIAGVGVGFVSSVVVLYLSEISPKKIRGAIVSGYQFFVTIGLLLASCVDYGTEHRNDSGSYRIPIALQLIWAIILAVGLILLPESPRYYVLKGKFDRAAKVLSRLRGQPIDSDYIQEELAEIVANHEYERSVIPTTSYWQSWAACFTGGLRRPSSNLRKTILGTSMQMMQQWTGVNFIFYFGTTFFQQLGTIHNEFLISMITTIVNVASTPLSFYTIEKFGRRALMIYGAAGMVVCQFIVAIGGTVDGDNQKTVSAMIAFICIYIFFFASTWGPGAWVIIGEIFPLPIRSRGVGLSTASNWLWNCIIAVITPYMVDGDKGNLGAKVFFIWGSLCGCCLLYAIMLIPETKGLTLEQVDKMLEETTPWTSAKWKPHSTFAAEMGLAKDDKGVTHELKEHASVESV

SEQ ID NO: 53358 - protein, 363 aa, Actinoplanes sp. SE50/110
MSTGVRAVLLAGGEGRRMGALGAGRLKPLVPFGGAARLIDFSLANARDSGLDQVLLLSQYQERQLMDDLRRTWWQPGFRVHFGPYDRAYTDGIPVEYEPPTGPPERGTADALIRKAPYLFGPDVTEVLVQHADHVYRFDYRPMIAEHRASGAALTVSYQRIDRRYVHLFGMVEFDDRNRLVSFVEKPAEPTSDLVFAAFCVFDAAVLHRYLELLDGTDWQHDISRDVIPAMLAAGEHIRGCPVPGYWADIGTVERYHEAHLSLVGTPPSLAVDAMPWTVAPRTARALVTSADGVRHSVVPADLVNHGTVERSVLFPAARIGPGATVRDSVLLPGAVVPAGAEIDGAVVLEDGTVQQVTTGARR

SEQ ID NO: 53359 - protein, 426 aa, Mycobacterium leprae TN
MFVNLTCLSEGNGSRGKALAESTQAELKTSWYLLGPAFVAAIAYVDPGNVAANVSSGAQFGYLQLWVVVVANVLAGLVQYLSAKLGLVTGQSLPQAISKQMSHPFRLGFWLQAELVAMATDVAEIVGGAIAFHILFRVSLLLGGVITGTVSLLLLMVKDRRGQLLFERVITGLLFVIVVGFTSSFFVATPSPEDMVNGLLPRFQGTESVLLAAAIIGATVMPHAVYLHSGLALDRHGHPHAGRSRRRLLRVTRLDVILAMTIAGIVNTAMLLVAAINLQHHQVTAYIEGTYTAIQDTLGATIAMLFAIGLLASSLASASVGAYAGALIMQGLLQRSIPMLIRRLITLCPAIAILALGFDPTRALVLSQIVLSFGIPFAVLPLVKLTNNRGLMGNDTNHPATTVLGWAVAILVSLLNVVLIYLTVTS

SEQ ID NO: 53360 - protein, 2679 aa, Mesorhizobium sp. BNC1
MTQSVLPDIAAIDENVGRIAIVGMSGRFPGAPSVDALWDLVSKGKHAFAHFRPEELEDAFEDAVRASKDYVPARPYLDDVDLFDAEFFGMYPRETALIDPQFRVFLEICWEAIEGAGYDPYSLPGQVGVFAGSALSTYLINNVLSDREKAEAFASNYQVGMFSELIGAINDTLATRVAYKLDLRGPAFTIQSACSTSLLAVAQACQNLLTYACDMALAGGVSITFPQKRGYIHQEGGMVSQDGFCRPFDADAGGTVFGSGAGVVLLKRMEDALKDGDHIHAVILGYGVNNDGSSKVGYTAPSVDGQAEAISAAHASAGIDPGTIGYIECHGTATPLGDPIEFAGLRKAFGDASMGQSVCALGSVKGNLGHLDAAAGVTGLIKAVHALKHAKIPPMANFQNPNPRIKLEDSPFYIPRELHDWPAQDHPRRAGISSFGVGGTNAHLVAEEAPPSPDLQEEEKEENSSFIIPLSARNESSLRAARRNLAAMLKSGPHMPIAAVAHTLQHGRHHFSHRAAVIAGNIEEAIAGLEGERPITGKATETSPPVVFMFPGQGAQYVGMGLGLYEREPEYARWIDHGARLLEEQAGIDIRKFLCRNNVQGEELSAALKDTRITQPALYLVEYAAARLWMSRGLKPDAMIGHSVGEFVAATLANVMTFDDALLLVAARGQLMQEQPKGAMISVRADAETVRDFLDDGVEIAAINAPKLCVVSGTFEAADVICKKLEAADIAFSRLHTSHAFHSAMMNEAAAALREQTDKIAYGRATIPYISCLTGEWQTDELGTSPEYWARHCRDAVRFAEGLVTVCRDRKPALLEVGPGRTLSTFAAQTIGRSDLAAVIQSLPEHDRASQAASAFAEAHARLWVAGCTLEWPALPAEARRRVPLPTYPFERRRHWIDPPPPIRRAIPNVEASPTGQAASQDGPPYPTPSFGNTPMNAVTPAPSPSRIEKLENALLARLAEMSGEEMTPDALCATFLELGFDSLFIGQFAQKIEKEYKVKLSFRELLGNIPSVSALARHLDKEMPPEAVQQPLPAQTAQGPGQAVSSPARQQQAITAPPPTAGAVDAIFQSQMLMMQQLFAQQIQALQAMGGAQAAQPPEELPAPTAQAPAALPPSSVPAKMADREIGGERLRLHKPGARASDGELSPEKRKFIADLAESYAARNARSKAFTAAHRSRLADPRTAAGFRPEWKELVFPIVSDRSKGSRIWDIDGNEYIDLVNGMGQTAFGHAPDFVVDAIRAQTEKGFAIGPQTPLAGEVADLISKMTGHERVTFCNTGSEAVMAAMRVARAVTGREKIVVFGNDYHGQFDEVLVKGRTRNGSPVALPIAPGIPPSSLSNMTVLSYGSSESLDWIRANAEDVAAVIIEPVQSRHPELRPVEFVRELRQIANEREFALVFDEVVTGFRVHPGGIQAVWGIRGDMATYGKVLGGGMPIGVLAGDSRFMDALDGGRWNYGDDSAPMVAPTFFAGTFVRHPLVLAAAKAVLRHLEGDGQALYTRIADRTKLLVDELSADLAARGIEGCINHYSSWFVTDFSSRDPLGMLFYPKARMLGLHIQDGYPCFLTTAHAEEDFRRIAEVFRETLDALQRVGILAPAGERASPQPAPVARPAAENVITSAGLTESQKEIWLAAQAGDEASCSFNESFSLNLQGTLDKEIFVQAIEMVVARHDALHIRFSRAGDRFEMIPDFRIPLETIDLTHNNTPEAALEEIVAEEASTPFDLANGPLARARLLSLAQDRHVLIFTAHHIVCDGWSANVILEELASAYTALCDGRTPDLPPALSFAAYADDVAAREAQPATEEFWLKQFETIPELPEMPTDRPRPEQRTFAGGTCTAFVEKDVYKRLKMAGAKSGATLFSTLLGALQVMISRLSGSTDIIIAIPSAGQSLVPDQTLVGHCVNLLPIRQQIDAEARFEEHLRQTQQLVLQAFEHQDYTYGTLVRKLGLKRDPSRLPLTEIQFNLERVARNAVFKGLSAKVTPNPKAFSNFDMFLNMVEGNDGIRIDIDYNGDVFDRATIERWLGHFTILVSVLADGMGAKIADLPILSENEMRWLIEELNETDADYERDRFMFELFAAKAAEQPKAIAAVHEGKSITYGALEARSNQLARHLQTKLSMPGLRVALALDRSIDMLVALLAIMKAGHTYVPLDPGHPPARLAQTMKTARVSGVICASGEIGKLGEPDTSVIRMDTESEEIARQDSRPLDLQLLDTEAPAYVIFTSGSTGTPKGVEISHRALVNFLSSMAMEPGFSSEDTLLAVTTISFDIAGLELYLPLIMGGRVVIANRTEVQDGFALVKLLRASGANVLQATPTLWQMLVEAGLSNQPKLKMLCGGEPLPKDLARKLLTIGGELWNMYGPTETTIWSSVARIVNADDPIHIGRPIANTQLYILDGHDRIAPVGVTGELYIGGEGLANGYFDRLDLTQAAFRSVRIGDGLPRRLYKTGDVGRRLPDGTLQLHGRRDNQIKLRGFRIELGEIEAVIGKKAGIRQCAVVAARNKNGDRQLVCHFVPDGQELSPDELSTHAKEHLPAHMVPSFWVATADLPKTANGKLDRKTLEERGVPQRHSAAPVRIKPRTPMEQKLSVIWQEVLQVGEIGIHDNLYALGADSLSIFRIAARMMDDGLPLEAKHLMRHPTVAGLAGFAEEQGNAAANGAVAPIPSLRDFRHGARRRLERLT

SEQ ID NO: 53361 - protein, 670 aa, marine gamma proteobacterium HTCC2143
MPSRSELASAIRALSMDAVQQANSGHPGAPMGMADIAEVLWNDYLKHNPANPNWADRDRFVLSNGHGSMLIYSLLHLSGYDLPIEELKNFRQLHSKTPGHPEYGYAPGVETTTGPLGQGLTNAVGMAAAEKILAAQFNRDGHAIVDHHTYTFLGDGCLMEGVSHEASSLAGTLGLGKLICFYDDNGISIDGEVEGWFTDDTPKRFEAYGWQVIPAVDGHDSAAIAAAIEEGRADTSRPTLICCKTIIGKGSPNKQGTEDCHGAALGLDEVALVRETIGWQHPPFFIPSDIYAGWSARDKGANSESEWNQRFDSYAQAHPDLAIELARRLTGELPDNFAEQCDEYIRQLQEQGASIASRKASQNCLEQYAPMLPELLGGSADLAGSNLTLWSGSKGVSADDASGNYLFYGVREFGMSAMMNGIALHGGFVPYGATFLMFMEYARNAVRMAALMRLRTVFVYTHDSIGLGEDGPTHQPVEQLTSLRATPNLDTWRPCDTVESAVCWKAALQRTEGPAALIFSRQSLAHQQRDEQQLADIARGGYILSDCEATNGEKDPDAIIIATGSEVQLAMDAKAVLEQQGRRIRVVSMPSTSVFDAQDVAYRESVLPSNVLPRVAVEAGHKDFWYKYVGLDGRIVGMETFGESAPIKELMEHFGFTVDAVVEAVEDALG

SEQ ID NO: 53362 - protein, 207 aa, Triticum aestivum
  misc_feature (175)..(175): Xaa can be any naturally occurring amino acid
  misc_feature (192)..(193): Xaa can be any naturally occurring amino acid
MADAVDARRVCGMPEKAQLHVAMLALQFGYAGFHVVSRLALNMGISKLVFPVYRNIIALFLLVPFAYFLEKKDRPRLTLGLAVHFFFLALCGITANQGFYLLGLDNTSPTFASAIQNSVPAITFGMAAALRIEKVRLDRRDGVAKVLGTLACIAGASVITLYQGPTIFAPTGDDXPSLQQEVPFLAAVAGEXXDWTLGWVRLLIGHC

SEQ ID NO: 53363 - protein, 233 aa, Arabidopsis thaliana
MARKRSKSSSSLSIPLDIATDIFLRLPAKSVVRFSCVAKHWSSITTAPYFTNSFETRPNLLFFFKEADRFFVVTVPKPNRRPNESVSHTSSQILDSYQTPYPKHSCFTIKTESVHGLICFQRGTKPIVWNPTMRKFKPLRKPDKSWESLTVFLGYDPLERTHKVVAMPCDKASDECRILTLGSADQESWRTVKTNYKHHPSRGNRKNNYGPCRCINGVLYYLAEIDRHRLIGL

SEQ ID NO: 53364 - protein, 243 aa, Yarrowia lipolytica CLIB122
MSSELPPLEQAKRIAAHQAVEQHYPKDAKVVGIGSGSTVVYVAEKIASLPKELTKDTVFISTGFQSKQLIQNAGLRLGCIDQYSNGDLDVAFDGADETDPQLNCIKGGGACLFQEKIVAECARKFVVVADYRKQSKALGTVWIQGIPIEVVPDAYNKVIADLKKMGAQSAVLRPGSPGKAGPIITDNGNFIVDAYFGEIQPDAVKDLHIKIKLLLGVVETGLFTNADVAYFGNADGTISTITK

SEQ ID NO: 53365 - protein, 147 aa, Thiomicrospira crunogena XCL-2
MSQQLTFKQLEKAQQGDSFDWEAVKKQVKYDDNGLIPAIAQQFDSKEVLMMAWMNEAALQETLETGRVCYWSRSRQSYWRKGEESGQIQLLKDLRFDCDGDAILLLVDQTGPACHTGRKSCFYTAIHDHQAKILTNPIIDPEALYKK

SEQ ID NO: 53366 - protein, 938 aa, Magnaporthe grisea 70-15
MADQPTVAPALSTPAEHLFEHVSDEARVDTGQESHATNHDLAVVYEVARTAQELHDGGRRRIALQFPDHMLPDAPAVAALLEDALAVLCDGGDAVVKSDKPEAAASSQSDPNPHVAVAKVSESSSQAATDVQGSSSKVTKTTSTGLQKQRIYILADTSYSACCVDEIAAEHVDADVVVHYGRSCLSPTSRLPVIHVFTKHRLDRQAVISEFVREFPAMDSRVVLMADVAYQDHVDSVASDLSARGYTNVLTTSAIHLPFGKLPNRTARNSSGDSVEFEGPSAADLTEYDIFHISTPPTSLLLALSSRVKSLRIFPTAAPNASSSSHLSDAPSVAQFSRRLLGRRYAKLLTLSTAGIIGILVNTLSVSNYLSSLDAIRKQIAAAGKKSYTVVVGKLNPAKLANFAEIDGWVVVGCWESSLVEDDASFYRPAITPFELEVALMKDEERVWGDKWWGGIEAIKAPQEGVDTSAGKEKSATGPDGLASPDAEDDDDESEPPEFDLRTGKLVSRSRPMRGQRVANTSTGDDATFRAPVSGQLAVRQKAEVATINGVVSPGAEFLRSQRTWTGLGSDFDTEERSTVVEEGRSGVARGYTNSPRELSPRDQRVGHKSPKIGQRYPDQWSHHIHREIYEPSGPCGGMDSSRRGLRAQARYHHGVAFPPQQPPMYIFYVLTKMMHAHLYPQDKILLHEAFAVQEARKFDWWIVHVLILSSGPCSSPARMKRRSCIDLSEAPSGQSADVHCNGSVQREAISSPRSISKAIVPPPFPPLDEELIRTKRNPYGTDFESKREAARWDRLEALADDARMDHDYPNCWGYVFLLSHFLRSRGRQKKKALDPTPNDMLWSRHYNIVIEDPELAGATAGNVGYRFEDWANEHMRLDQRARRCFVKLVTGGHLDEEERPWYFLVEMHELWDLWFPAGNIEFSEIVWRSKIDDQPQD

SEQ ID NO: 53367 - protein, 397 aa, Nitrosomonas europaea ATCC 19718
MKLSQRVQAIKPSPTLAVTAKAARLKAEGKNIIGLGAGEPDFDTPLHIKDAAITAIRNGFTKYTAVGGTASLKQAIISKFKRENSLEFMPGEILVSSGGKQSFFNLVLATIDPGDEVIIPAPYWVSYPDIVLIAEGKPVFIDTGIEEKFKISPDQLEKAITPRTRMFVVNSPSNPSGSVYSLEELQALGAVLRKYPDILIATDDMYEHILLSGDGFVNILNACPDLKARTVVLNGVSKAYAMTGWRIGYCGGPAAIITAMENIQSQSTSNPNSIAQVAAEAALNGDQSCMVPMIEAFRERNQFLTNALNSIAGIHCLLSEGAFYAFVDVRQAISRLNTQQILQNSSDIAFCNYVLEKAEVAAVPGSAFGCEGYMRLSFATSMDNLQEAVKRIASLLS

SEQ ID NO: 53368 - protein, 138 aa, Magnaporthe grisea 70-15
MSGEAWLYLFAVLVNAVNLFLQVFFTIMYSDLECDYINPIDLCNRLNTYIIPEAAVHGFLTFIFLINGYWLPLILNLPLLGWNIKKIVDNAHLLDATEIFRKLNVHKKESFIKLGFHLIMFFFYLYSMIVALIKDESH

SEQ ID NO: 53369 - protein, 121 aa, Synechococcus sp. RS9916
MLLSFHQKMRALLAIGLSALISLLSPSIAFAADAAHGAQVFSANCAACHIGGGNVVNGQRTLQQDDLKAYLANYNDGHEEAIAYQVTNGKNGMPAFGGKLSSDDIADVAAYVESQSVNGWA

SEQ ID NO: 53370 - protein, 239 aa, Zea mays
  misc_feature (187)..(187): Xaa can be any naturally occurring amino acid
MGLGLRLPFCLLLLLLVSLGSAQGRSTVFLDIQEEARGPGQIINDQLTLSKIPVRVERGSPLCPACEKFTDEALSYLSQKQSQDKMMEVLHEACSQTFSLEKKCVEFVDSYATLLFAKIAEIKPEEFCKRNGLCRDNALLSGVRSESTCVFCHHLMDEVLSKLKDPDAEFEIIQILLKECKKIEGHXQQCKRLVLQYIPLILVNGEKFLEKNDICTIVQACDAGKRRWSAILPRGLLRD

SEQ ID NO: 53371 - protein, 1786 aa, Anabaena variabilis ATCC 29413
MNTYTIDNHNSYSLVTNQSQECQNTLANLRVIIADLLKCEPEEVDVKVPFLEMGADSIVLVDAIRQIENNFRIKITIRQLFEELTNLSVLANYIEENVKLEPSTLLGQETLELSVNPQPLPQSQQSEQKSETLVEIVLRQQFELMSQQLEILRESNLPTNLSVTPSQNQAAKSVPNAVVQTTPDLKTGELNKSTLKKADSPSSFWRVEQSQAKTLTSQQQQYLNSLIARYTKRTAKSKQRSQSYRPVLADRRASIGFRPETKEILYPIVGDRSQGSRIWDVDGNEYIDISMGFGVHLFGHNVPFITAALEDQIKQGIQIGPQSKLAGEVATLICEMTGMERVTFCNSGTEAAMTAMRIARAATGRAKIAIFKGAYHGHFDGTLAIPQTSEDGKLPAQPMVPGVLQNMVDDVLLLTYGTPESLEIIKANAHELAAVLVEPIQSRKPDLQPKEFLQQLRVVTQQLDIALIFDEVITGFRVHPRGAQAWSGVDADIVTYGKLIGGGMPIGVIAGKAAYMDKIDGGFWSYGDDSYPEVETTFFAGTFSKHPLTMAATRATLLHLKAEGASLQERLNQRTSNLAATLNSYFEQANVPLRIVHFSSLFRFTLSGNSSYLYQPLEMDLLYYSLIEKGVYIWEGRTCFLSTAHTDEDVDYVIQAVKDSVQELQAVGFFSKSPKLSTNQPQTPKTSERVNSAVSLTVQDTIKPEVKEAFKIPLSDAQKQLWFLAQMGDNGSVAYNISLNIQLQGTLDLAAIRQAVQQVVQRHEALRTTISSQGDFQEILPSLKIDVPVIDFSNVKDSQLQVNQWLQNYSRESFDLSNGPLFRVRILKLAEQLHLLVVSAHHIITDGWSISIILQEMMALYSAKCQGHVCQLEPPIQFSSYLDWHRQFCATDEMKAHESYWLQKFADPVPVLDLPTDRQRPPSKTYQGGRQQLLLDPNVSAAIKQLSKQNGCTLFMTLLSAYAVLLYRLTNQDDLTIGIASAGRSLEGSERLVGYCSHMLPIRTQIVGDATFVEHLKACKSVLLEAYEHQDYPFAKLIDKLRVNSNTGMSPLVNATFNLERPVAIPQMYGLESSLLPQSISFADYDIGLNVTEIDHELLLECDYNADLFDAATIDRILGHYQTLLLGIIASPQTLVSQLSLLTATERQQILVEWNQTQIDYDRNQCVHQIFEQQAQLTPNAVAVESGEQKLTYRELNHRANQLAHFLQSLGVKPEVLVGICVERSVEMLVAMLGVLKAGGAYLPLDPAYPQERLAHMLTDSQASVLLTSANLASQLPKSSAKLVKLDTDWQVISRQPIINPTGIVVPSNLAYVIYTSGSTGKSKGVLIPHQALVNHNYAIAKNYELKASDRILQFASFSFDVAAEEIFPTWLSGATLVLRPEEIFSIPDFVQFVKQQDLTVLNLPVAYWQEWVSQMPQISWTPNVRLLVVGSERVPLERFLTWQQLVGSNVSWRNAYGPTEATITATIYGSHLSSHQQTAASLFIGRPIANTQIYILDQHLQPVPIGVTGELHIGGNGLAQGYLHRPELTAEKFIAHPFSNQPTARLYKTGDLARYRSDGTIEFIGRIDHQVKIRGFRIELGEIETALNQHPQVRECVVIASDDQLAHQQLQAYIVFHQQLKVDSSELHRFLKQKLPEYMIPTSFFQLENIPLTPNAKIDRQALNRLGVLINNIEVNRVAPSNHIEEVLANIWTEVLNLKQVGIHNNFFELGGNSLLAMQLLNRVNEAFLIDLPLRSLFECSTIAELSELIQAYKLEHLESDALEQILAEVDELIDTEIEQMLAKF

SEQ ID NO: 53372 - protein, 392 aa, Neisseria meningitidis Z2491
MAFLKLTEQNVQGKTVLIRADMNVPFKDGKISDDTRIRASIASVKYCVDNGASVIVMTHLGRPTEGEFHPEDDVAPVAAHLGSLLGKDVKVLNDWRENKPALNAGDVVMLQNVRINKGEKKNDLELGKAYASLCDVFVNDAFGTAHRAQASTEAVAQAAPVACAGVLMAGELDALGKALKQPARPMVAIVAGSKVSTKLTILESLADKVDQLIVGGGIANTFLLAEGKAIGKSLAEHDLVEESKKIMAKMAAKGGSVPLPTDVVVAKAFAADAEAVVKDIADVAEDDMILDIGPKSAAALADLLKAADTVVWNGPVGVFEFDQFAGGTKALAEAIAQSKAFSIAGGGDTLAAIAKFGVTEQIGYISTGGGAFLEFLEGKELPAVAALEKRGA

SEQ ID NO: 53373 - protein, 357 aa, Arabidopsis thaliana
MGIYLSTPKTDKFSEDGENHKLRYGLSSMQGWRASMEDAHAAILDLDDNTSFLGVYDGHGGKVVSKFCAKYLHQQVLSDEAYAAGDVGTSLQKAFFRMDEMMQGQRGWRELAVLGDKINKFSGMIEGLIWSPRSGDSANKPDAWAFEEGPHSDFAGPNSGSTACVAVVRDKQLFVANAGDSRCVISRKNQAYNLSRDHKPDLEAEKERILKAGGFIHAGRVNGSLNLSRAIGDMEFKQNKFLPSEKQIVTASPDVNTVELCDDDDFLVLACDGIWDCMTSQQLVDFIHEQLNSETKLSVVCEKVLDRCLAPNTSGGEGCDNMTMILVRFKNPTPSETELKPEASQAEGNHDEPSSSN

SEQ ID NO: 53374 - protein, 633 aa, Mycobacterium sp. MCS
MPVCNGVQPLCSRRRRCALGHMTQTLADPREPTTDLTPQQRVDAWLADFEAALAVRDIERVVAKFATDSFWRDLVAFTWNIKTLEGRDGIADMLTARLTETDPARFRTREAPTVDGDVTTAFIEFETGVGRGVGHLRLRGDECWTLLTTMQEIKGHEERKGPSRVLGAVHGSDPDPRSWAEKRAEEDAALGRTVQPYALVIGGGQGGIALGARLRQLGVPAIVVDRHERPGDQWRKRYKSLCLHDPVWYDHLPYLPFPQNWPVFAPKDKIGDWLEFYTRVMEVPYWSKTTCLSAVFNPGSDGAPDTWTVEVDRDGERLTLRPTQLILATGMSGKPSVPTLPGQDVFRGEQHHSSAHPGPDRYVGKRAVVIGSNNSAHDICKALVENGVDTTMVQRSSTHIVKSDSLMDLGLGDLYSERALAAGMTTEKADLTFASLPYRIMHEFQTPIYDAIRERDKDFYERLTAAGFELDWGDDGSGLFMKYLRRGSGYYIDVGACDLVADGTIKLAHGQVSHLTEDTVVLADGTELPADVVVYATGYGSMNGWAADLIGQDVADKVGKVWGLGSSTTKDPGPWEGEQRNMWKPTQQENLWFHGGNLHQSRHYSLYLALQLKARFEGIPTPVYGLQEVHHLS

SEQ ID NO: 53375 - protein, 361 aa, Oryza sativa (japonica cultivar-group)
MDVEATKDVVHEQAAAPGRGRAARWLLVALNCGMLVVGTTGGPILSRLYFSKGGHRKWLSAWLETAGWPLLLVPVSASYHSRRARDRGAPLFLTPRRVLLAGAVLGVLTGADDFVYAYGLAYLPVSTSAILISTQLAFTVFFACLIVRQRLTAATLNAVALLTIGAVVLGLHASKDRPAGVTTGKYWMGFFLTLGAAALYGLILPLVELAYKHAAGGGRAVTYALVMEMQLVMGFFATAFCTVGVIVNKDFQAIPREAKQYELGEARYYVVLVFNAVLWEFFFVGAVGVIFCVHTLLAGIIIAVFIPITEVLGVIFLHEKFSSEKGVALVLSLWGLASYSYGEYADAKAKKKAALEAEEAS

SEQ ID NO: 53376 - protein, 507 aa, Mycobacterium sp. MCS
MTVYARPGAADALMAFESRYGNFIGGEWVAPAGGEYFENLTPVTGQTFCEIPRSTEADIDKALDAAHGAATAWGKTSPGERAQILIKIADRLEANLESLALAESWDNGKPIRETLNADIPLAIDHFRYFAGAIRAQEGALSQIDEDTVAYHFHEPLGVVGQIIPWNFPILMATWKLAPALAAGNAVVLKPAEQTPASILYLMSLIADLLPAGVVNVVNGFGVEAGKPLASSNRIAKIAFTGETTTGRLIMQYASQNLIPVTLELGGKSPNIFFSDVMAANDDYQDKALEGFTMFALNQGEVCTCPSRSLVQADIYDEFLELAAIRTKAVRQGDPLDTETMIGSQASNDQLEKVLSYIEIGKDEGARVVTGGERAELGGDLNGGFYVQPTIFEGKNSMRVFQEEIFGPVVAVTSFKDYDDAISMANDTLYGLGAGVWSRDGNTAYRAGRDIKAGRVWTNCYHMYPAHAAFGGYKQSGIGRENHKMMLDHYQQTKNLLVSYSNKAQGFF

SEQ ID NO: 53377 - protein, 273 aa, Paeonia suffruticosa
PVPENWGLYEIVNHGISPEFMDTVEKLTKEHYKKCMEQKFKELVASKALETEINDMDWESTFHLRHLPISNMAEIPDLDDEYRKVMKEFASKIETLAEELLDLICENLGLEKGYLKKAFYGSKGPTFGTKVSNYPPCPKPDLIKGLRAHTDAGGLILLFQDDRVSGLQLLKDDQWVDVPPMRHSIVINIGDQLEVITNGKYKSVMHRVIAQTDGNRMSLASFYNPGSDAVIYPAPALLGKEAQVYPKFIFEDYMKLYAGLKFQAKEPRFEDPG

SEQ ID NO: 53378 - protein, 89 aa, Oryza sativa
  misc_feature (30)..(30): Xaa can be any naturally occurring amino acid
  misc_feature (62)..(62): Xaa can be any naturally occurring amino acid
TRAHQYETVEDTSKLLFGGSAPIGLGENTXIRNCLIYMNAKIVRNAIIANTQAVQDSDHPEXGYYIRTGIVVILNNATMNDRTVISKHT

SEQ ID NO: 53379 - protein, 382 aa, marine gamma proteobacterium HTCC2143
MTDLDLAGKRVLIREDLNVPIKDGHVSSDARIRAALPTIEHALQCGAKVMLMSHLGRPTEGDYESQFSLQPVADQLGRLLGRSIPLISDWGNGIEMSDGDLILLENVRFNVGEKKDNENLSKAYAALCDVFVMDAFGTAHRAQASTHGVAKFAPVACAGPLLTKELDALSKVLAKPARPMVAVVGGSKVSTKLAVLETLADIVDQLIVGGGIANTFLAASGKPVGKSLCEHDLLGQAKSLMAKTEIPIPQDVITAKEFAETAAAELKSANDVADDDMIFDIGPQASEDIAKILEEAKTILWNGPVGVFEFDQFGNGTKSLSEAIANSDAFSVAGGGDTLAAIDKYGIADKVSYISTGGGAFLEYVEGKVLPAVAILELRAKG

SEQ ID NO: 53380 - protein, 343 aa, Vibrio vulnificus YJ016
MKIKALSKLKPEEGIWMTEVDKPVLGHNDLLIKIKKTAICGTDVHIYNWDEWSQKTIPVPMVVGHEYVGEVVGIGQEVRGFEIGDRVSGEGHITCGHCRNCRGGRTHLCRNTIGVGVNRTGCFSEYLVIPAFNAFKIPANISDDLASIFDPFGNAVHTALSFDLVGEDVLITGAGPIGIMAAAVAKHVGARHVVITDVNEYRLDLARKMGVTRAVNVAEQKLDDVMVELGMTEGFDVGLEMSGNPSAFNSMLKTMNHGGRIALLGIPPSDMGIDWNQVIFKGLVIKGIYGREMFETWYKMASLIQSGLDLTPIITHHFKVDDFQQGFDIMRSGMSGKVILDWE

SEQ ID NO: 53381 - protein, 431 aa, Mycobacterium leprae TN
MADTDDTVTLKYPGGEIDLQIVRATEGNDGIAIVPVLAKTGYTTFDVGYGNTASTKSSITYIDGDAGILRYRGYPIEQLAEKSTFIEVCYLLIYGELPATDQLAEFTHRIQRHTMLHEDLKRFYDGFPRNAHPMPVLSSVVNALSAYYQDALDPMDNGQVELSTIRLLAKLPTIAAYAYKKSVGQPFLYPDNAFSLVENFLRMTFGLPAEPYEPDPEVVRALDMLFILHADHEQNCSTSTVRLVGSSRANLFTSISGGINALWGPLHGGANQAVLEMLEGIRESGDDVGGFVQKVKNCQAGVKLMGFGHRVYKNYDPRARIVKEQADKILVKLGGDDDLLNIAKGLEEAALTDDYFIERKLYPNVDFYTGLIYRALGFPTRMFTVLFALGRLPGWIAHWREMHDEGDSKIGRPRQIYTGYTERDYTAIETR

SEQ ID NO: 53382 - protein, 426 aa, Brassica oleracea
MESSCKLFIGGISWETTEDRLREYFQSFGEVLEAVIMKDRATGRARGFGFLVFADPTVAERVVLIRHVIDGKIVEAKKAVPRDDHVVLNRSSSSLQGSPGPATSKKIFVGGLASSVTEAEFKKYFAQFGTITDVVVMYDHRTQRPRGFGFISFESEEAVDRVLQRTFHELNGKMVEVKLAVPKEMALNPIRNQMNVNSFGSSRISALLMNEYTQGFSQSPISGYGVQPEVRYSPGVGGNRGGFSPFGHGFGIELNFEPGHYGSGSNAGFGRPFSPGYAASQGRYGSQIESGVRNNLWGNGGGLGGYMSNSPISRSSFNGNSGMSSLGSIGDNWGGAARARSGYRSEGGGLGLDAMRGVHVGGYSSGSSSLETESLYSDSAWLSPPAKAEERLGMGAFDFVSKGPAAGYINRQPNGGMNNMIMNAHF

SEQ ID NO: 53383 - protein, 215 aa, Triticum aestivum
  misc_feature (129)..(129): Xaa can be any naturally occurring amino acid
MDNSGVIFYGGAYATVMSAPPKRPAGRTKFRETRHPVYRGVRRRGAAGRWVCEVRQPNNKSRIWLGTFASPEAAARAHDVAALALRGRAACLNFADSAALLAVDPATLRTPQDIRAAAITLARAACPHXRARVAAEASAPAPAMMAMMQEPSAVEYDDYPMQYGGIGDFDQHSYYYDGLSAGGGDWQSSSHMDGADDDSNCGGGYGAGEVPLWSY

SEQ ID NO: 53384 - protein, 638 aa, Arabidopsis thaliana
MINLSLYQTNSLSYTIIWMLFVIPSCVLSVDERQKHCSPTFRCGKQTDLYYPFWSPDREECGHPVFKVNCSGDFAEFTISTVKFHVLEMNYESRIIRLVRTEYLNNLCPWHPENRSINQEVLPFLQDTELGTFYYNCSGPTVDELANGYIRQLGCDEEVGGKSYFVSSPSHPGNRAILDGLSASCERNVDIPVSRSAMETTATNQSLEAIKKVLDVGFELGFNSDCSLCVASKGACGFNQSSKAFVCYCKDEPHEHTCGKMGIGIGLGCGFLGATLITVCLLCFFFQKRRTSHHLRPRDNNLKGLVQLKQYSYAEVRKITKLFSHTLGKGGFGTVYGGNLCDGRKVAVKILKDFKSNGEDFINEVASMSQTSHVNIVSLLGFCYEGSKRAIVYEFLENGSLDQFLSEKKSLNLDVSTLYRIALGVARGLDYLHHGCKTRIVHFDIKPQNILLDDTFCPKVSDFGLAKLCEKRESILSLLDARGTIGYIAPEVFSGMYGRVSHKSDVYSYGMLVLEMIGAKNKEIEETAASNSSSAYFPDWIYKNLENGEDTWKFGDEISREDKEVAKKMTLVGLWCIQPSPLNRPPMNRIVEMMEGSLDVLEVPPKPSIHYSAEPLPQLSSFSEENSIYTEVFIGSTS

SEQ ID NO: 53385 - protein, 325 aa, Xylella fastidiosa Temecula1
MALASTSSQAAGSPGVEHRTQAFLEDLAKGGGAPIETLSPANARQVLVNAQKGAKLPPADVSEKTITIDGKQIVLNIVRPAGVKGILPGFMFVHGGGWVLGDFQTHERLVRDLVSDSGAVAIFVNYTPSPEARYPVAINEIYAATQWVAEHGAQINVDGQRLAIVGNSVGGNMATVVAQMAKEKGTPALRAQVLFWPVTNANFENTSYNEFANGHFLTKNMMKWFWDAYTTDSKQRQDIYASPLLATAEQLKGLPPTLIQTAEKDVLRDEGEAYARKLDAAGVNVVITRYNGMIHDFGLLNVLADLPATRAALHQASEELKIHLR

SEQ ID NO: 53386 - protein, 224 aa, marine gamma proteobacterium HTCC2143
MTQDDLKKAVARAALDYIKPKIENDSVIGIGTGSTANYFIDYLAEIKSHINATVASSEASADRLRKHGIPVFELTSVNEITVYVDGADESDPNLALIKGGGAALTREKIVAASAREFVCIADESKCVAQLGNFPLPVEVIPMARSFVARELVKMGGDPVYREGVVTDNGNIIIDVFNFMIPNPIETEQHINNITGVVTNGIFAQRPADILLVATSEGIKTLHKA

SEQ ID NO: 53387 - protein, 629 aa, Cryptococcus neoformans var. neoformans JEC21
MYPGSSTSALTRAAIARIALRRSTVACRRSVTSRTISADDKNLIPIRTNLRGSALLNTPRLNKGAGFTREERQIFGLEGFLPYDVHSLEKQCLRAYNQLCKQPSVILKHAFLASLRDQNQVLFYRLMQDRLKELLGVLYTPGAAEAVAGYSSLFRRPVGCYISFPNQDGMRAQLEGHLTDVNRTADVAYDSNKPDDAIDLVVVTDAEAILGIGDQGVGGITISTSKAALYTLGAGINPNRILPVVLDCGTDNHALFSDPLYMGWKRTRIRGKNYDQFIDRFITNCRELFPNAIIHFEDFGMANAYRLMEKYKNIPMFNDDIQGTGAVALAALLSAIKVAGSRLSDQRIVIYGAGSAGMGIADQIKDGLMILEGLNKDEAARRFWCVDRNGLLVESMGNGLRHSQMPYARPDAEVEHWNKEDEDRNGIWLMDVIKNVKPTVLIGTSTHSRAFSEELVREMGKHVERPIIFPMSNPTALCEVDPADALAWTENRALVATGSPFPPVQLGNGQEYIVAQTNNALIYPALGLGAILARSKTISNSMLMAGVNSLASLSPALSNSEASLLPDLADVRKVSVDVAAAVVRQAVEDGNAYDENTIKYVKGKGDVSLEEYIRSRMWDAVYRPLELVD

SEQ ID NO: 53388 - protein, 103 aa, Petunia x hybrida
MSGRGKGGKGLGKGGAKRHRKVLRDNIQGITKPAIRRLVRRGGVKRISGLIYEETRGVLKIFLENVIRDAVTYTEHPRRKTGTAMDVVYALKRQGRTLYGFGG

SEQ ID NO: 53389 - protein, 333 aa, Staphylococcus aureus subsp. aureus MW2
MQNKQILFNKIPEGMPQEDTFKIEETDTPKLESDGVLVQTLYISVDPYMRGRMTKADSYVQPFEIGKPIVSHVVAKVIDSTLADYKKGDVVVGMLPWRIINHVQADQITKVPTTDVPLDLYLSVLGMPGQTAYHGLLDIGQPKAGDTVVVSAASGAVGSVVGQIAKIKGCRVVGIAGGDKKVNYLTGTLGFDAGIDYKKEDFAEALAQAVPDGIDVYFENVGGTVGDEVFKHLNRFARVPVCGAISSYNHPEADIGPRIQGTLIKKQVMMRGFLVSEFANAFKEASEQLATWVQEGKIQSQVTIEDGFENAPHAFKNLFTGDNFGKQVIKVTE

SEQ ID NO: 53390 - protein, 152 aa, Triticum aestivum
  misc_feature (43)..(43): Xaa can be any naturally occurring amino acid
  misc_feature (102)..(102): Xaa can be any naturally occurring amino acid
MAEQTFIMIKPDGVQRGLIGEVISRFEKKGFYLKGLKLQNVEXKSFAEQHYADLSSKPFFAGLVEYIVSGPVVAMVWEGKSVVSTGRKIIGATNPLASEPGXTIRGDFAVDIGRNVIHGSDSVESARKEIALWFPEGIAEWRSSQHNWIYEA

SEQ ID NO: 53391 - protein, 423 aa, Gibberella zeae PH-1
MAAAESARVQEAQKLAKSDPRKAEAIYKDIISKAPSTTSDAATREYETALVSLGEIYRDEKKTQELVNLVKESRTVFSSFAKAKSAKLVRQLLDLIKEIPDSTDIEISVTKDCIEWATAERRAFQRQDLEVRLVALQMAKQSYYEALGLINNLLRELKRLDDKLRLVEVQLLESRVYHALGNIPKARAALTSARTSAASVYTPPMLQANLDMQSGMLHAEDKDFNTAFSYFIEALDGYHSQDESTRAQAALQYMLLCKIMLNLVDDVNNLMASKQALKYAGKNLEAMKAIARAHSNRSLEEYERALSSYRYELGSDTFIRNHLRRLYDAMLEQNLIKVIEPFSRVEIDHIANMVGLDTQQVERKLSQMILDKVIIGVLDQGAGCLIIFDETHRDESYDAALATIEKLSSVVDVLYTNQASMLE

SEQ ID NO: 53392 - protein, 145 aa, Triticum monococcum
MAGRMALAVVLLSAAAAMAAAQSASNVRATYNYYSPEKINWDLNAASAYCATWDAGMSYAWRSKYGWTAFCGPAGPTGQASCGKCLLVTNTATGAQITARIVDQCSNGGLDLDFDTVFSKIDTDGQGVAQGHLTVNYQFVDCGDN

SEQ ID NO: 53393 - protein, 365 aa, Anabaena variabilis ATCC 29413
MDNIFRFADELGPAKIIHIYEREADLKAIVVVDNIDCGPAIGGVRMATDVTTEEVFRLARAMTLKNAAADLPHGGGKSAILADPKQPLADKERLVRTFARAIRDVTEYIPGPDMGTDEQCMAWIKEEIGRAVGLPKAIGGIPLDEIGATGFGLSICAEIASKFCHLNLEGARIVIQGFGSVGKNAARFLTAKGALLIGAADSQGTLFNPLGIDVKQLIKLKNSGKSVISYPQGDKLDRDAVIDIECDIWIPAARPDIIHADNVDRLKTQLVISGANIPFTEAAERICHERNIIVVPDFIANAGGVICAAVEYDGGNQTTAFETIAKKIRYNTTLVLEQVAKTGKLPRQAAVELAQRRICLARQDI

SEQ ID NO: 53394 - protein, 445 aa, delta proteobacterium MLMS-1
MPKAKPDVMAVVLAGGRVDELSVLTAHRPKSAVPFGGFARVIDFALSNLMQSGLELVAVLSQYRSFSLINHIGIGASWDMIGRHRGVFVLPPYQGFGQSSWYRGTADAVRQNLDFIQFHAPETILVISGDHVYHMDYREIIAYHRQKGADCTFACVEVPAPLAHRFGVAEIDDEDGRIGGRVLQYQEKPAEPCSRWASMTVYCFKPRVLYELLAANAREDESFEFGRDILPRAMATHRKVYGYKFRGYWGYTRTIEEYWQTSMDLLGYQPRLPLEQWGIRTNLEQRDIRDCPPLKVGEGAVISNSLVYNGCQVEGRVENSVLFPGVQVKPGAVVRDSVLFFDNVVGRDCHLEKVVSDVNVTVGDGVVIGVPGPPAAGGATGAGRASGAENLAGGESGGATTTVTVLGWNNQIPAGMVIGAGCTLYPSLGPEKMARQRVADGEVLR

SEQ ID NO: 53395 - protein, 421 aa, delta proteobacterium MLMS-1
MSRKQDDPLVLLLAGGVGSRLNNLVQSRAKPAVPFGGIYRIIDFSLSNVMNAGFSQVGVLTQYKPLSLMRHIGDGAAWDFAGRTRGAKILPPRTGSRDSDWYKGTADAVRQNIDFIRSYPSPEVVILSGDHIYSMDLADLVGSHRRKKADLTVATMVVPKEQIHQFGAAITDAQGRIVEWEEKPAVPRTDLASMGIYVLSTDYLLNYLEKYRDDLDFGMDLIPRAIATDRVFAYPFRGYWRDVGTIQAYWEANMDLLAADSPLNPAAWGTRPNPEAEGLPYDRCPARFMGDGTVRQSLIPAGCIIEGTVLNSVLAPGVRVGPGAVVRDSILFHDCRVAAGATVDLAILDKRVQVGEKAVVGQGEDKTVANRANPKHLYSGISLIGKQARIPAGAVIGRNCIIAPHSRSQQVPAQLPTGESV

SEQ ID NO: 53396 - protein, 466 aa, Mycobacterium sp. MCS
MTHYDVVVLGAGPGGYVAAIRAAQLGLNTAIVEPKYWGGVCLNVGCIPSKALLRNAELAHIFTKEAKTFGISGEATFDYGAAFDRSRKVAEGRVAGVHFLMKKNKITEVHGYGKFTDDHTIEVDLNEGGTETLTFDNAIISTGASTKLVPNTSLSENVVTYEEQIMERELPGSIVIAGAGAIGMEFGYVMKNYGVDVTIVEFLPRALPNEDAEVSKEIEKQFKKLGVKIMTGTKVESIKDEGGDGSVTVTVSKDGKSQELKTDKVLQAIGFAPNVEGYGLDKAGVELTDRKAIGIDDYMRTNKPHIYAIGDVTGKLQLAHVAEAMGVVAAETIAGAETLPLGDYRMMPRATFCQPQVASFGLTEEQAREEGYDVKVAKFPFTANGKAHGMGAPGGFVKLIADAKYGELIGGHLIGHDVSELLPELTLAQKWDLTANELARNVHTHPTLSEALQEAFHGLAGHMINF

SEQ ID NO: 53397 - protein, 213 aa, Oryza sativa
MAEGAELVGESAHQDMPRVVAALAGILERVAGRNDAAATPAELAAAPASPFRATAKPGISVRAYAARIARFAGCSPACYVVAYIYLDRLLRRGRRCLALALAVDSYSVHRLLITAVLSAVKFMDDICYNNAYFAKVGGISLAEMNYLEVDFLFGVGFDLNVTPETFADYCAVLQSEMLCAAAPPTRLHYCCLSEDDAGSSSSSSLREAAMEAS

SEQ ID NO: 53398 - protein, 748 aa, Arabidopsis thaliana
MELVSGKVVPGCSNAGNPFHECTAICFERVNSPDVHKKEKKLFGFGKRTPSRDQTPPASPARGSRSPLASYFAKKKVESSAESSPSSYDHTNGNFLSRLSPLQGRKIEPSSNVDSLPVSPSLALYSGGDYFARRADQRGDEDDDVSPRPFGTQPKTPEHPLRTPQHRPRTPQHRSAHQEDAFSLETRPRTPERRSNTSDTRPRTPIHESAATGRRPQTPETRPRTPDHRYATYDNRPRTPIHESAATERRPQTPETRPRTPEHRSAIPDTRPRTPIHESAATGRRPQTPETRPRTAQRRGRSPEFMERSPGPRSKTPEPQPTYFEPSSRTPKQRSKTPEPSPRIPQTQPMSHRSLDNAALKMPRTVETRPRTPEHQPRTVETKPRIHESRPKTAVYGGRSPDHREKISQEMGQRSSHAYNYLGSKAESVYIEKNEESVLLFPELILSPQERPPSRLITLNHRGYETPNKQKEHCDEMDDSASTDDDKFSFVDDHDEHTVSIYAETTSKSGSSEQEEQHKANNEPPELPDESQSFSLAEISRMKGIITNNEIRDVMQSILSESYVSVGQYKVRASVSTTLQHILQKHGDIASGSKLQSLATRSYYLDMLASVVFELQTTPLKYLKESRVVEMVAIVKDIESVKIKAGWLKPVLEEIVEAVKHYDEHKMSVVEKEVWERDVLLAKQETEKQVKELGEKEKKIKEWRAKMTEMAAKLGDLDMKRARLHKSFTFLSSKVDKFQGKPLLQGIL

SEQ ID NO: 53399 - protein, 166 aa, Schizosaccharomyces pombe 972h-
MHQVKLEEAEYEWDQTIADVDIVIHVPKGTRAKSLQVDMSNHDLKIQINVPERKVLLSGPLEKQINLDESTWTVEEQERLVIHLEKSNKMEWWSCVIKGHPSIDIGSIEPENSKLSDLDEETRATVEKMMLEQSQKRTDEQKRKDVLQNFMKQHPELDFSNVRDQI

SEQ ID NO: 53400 - protein, 587 aa, Arabidopsis thaliana
  misc_feature (54)..(54): Xaa can be any naturally occurring amino acid
  misc_feature (76)..(76): Xaa can be any naturally occurring amino acid
  misc_feature (117)..(117): Xaa can be any naturally occurring amino acid
  misc_feature (129)..(129): Xaa can be any naturally occurring amino acid
MEVQSSSNNGGHSSFSSLRVYLNSLSATPSRLSRRAISVSTSSDEMSRVRAVSXGEQMRRTLRWYDLIGLGIRGNXVGAGVFVTTGRASRLDAGPSIVVSYAIAGLCALLSAFCYTXEFAVHLPVAGGXAFSYIRITFGEFPAFFTGANLVMDYVMSNAAVSRSFTAYLGTAFGISTSKWRFVVSGLPKGFNEIDPVAVLVVLVITVIICCSTRESSKVNMIMTAFHIAFIFFVIVMGFIKGDSKNLSSPANPEHPSGFFPFGAAGVFNGAAMVYLSYIGYDAVSTMAEEVENPVKDIPVGVSGSVAIVTVLYCLMAVSMSMLLPYDLIDPEAPFSAAFRGSNGWEWVTKVVGIGASFGILTSLLVAMLGQARYMCVIGRSRVVPFWFAKIHPKTSTPVNASTFLGIFTAALALFTDLNVLLNLVSIGTLFVFYMVANALIFRRYVPVGPTKPWPTLCFLTLFSITSLVFTLIWKLVPEGKPKAFMLGASAVVAIAIVLSFQCVVPQARKPELWGVPFMPWTPCVSIFLNIFLLGSLDAPSYVRFGFFSGLIVLVYLFYGVHASSDAEANGSFGVKDGQVMKELIEV

SEQ ID NO: 53401 - protein, 603 aa, Arabidopsis thaliana
MAFTSSPSYGSLNAAFWRTIFVVHCISTLVFTTISTPPEDPVKCVSGNTNCTVTNSYGAFPDRSTCRAANVAYPTTEAELISVVAAATKAGRKMRVTTRYSHSITKLACTDGTDGLLISTKFLNHTVRTDATAMTLTVESGVTLRQLIAEAAKVGLALPYAPYWWGLTVGGMMGTGAHGSSLWGKGSAVHDYVTEIRIVSPGSVNDGFAKVRVLRETTTPKEFNAAKVSLGVLGVISQVTLKLQPMFKRSLRYVMRNDSDFGDQAVTFGMKHEFADFIWLPSQGKVVYRMDDRVAVNTSGNGLLDFMPFRSQLSAALAIIRSSEETQERFRDANGKCAGATLITSTLFATSYGLTNNGMIFTGYPVIGSQNRMMSSGSCLDSLHDGLITACPWDSRIKSEFFHQTTFSIPLTQVKSFINDIKSLVKIESKSLCVLELYDGILMRYVTSSPAYLGKETEALDFDLTYYRAKDPLSPRLYEDFIEEIEQIALFKYNALPHWGKNRNLAFDGVIKKYKNVPAFLKVKESYDPMGLFSSEWTDQILGIKGNVTIIKDGCALEGLCVCSEDAHCAPTKGYFCRPGKVYKEARVCTRADDISVIQSLSY

SEQ ID NO: 53402 - protein, 300 aa, Brassica oleracea
MEELSRNIRDMKFILYGNSEAEPVAEACAQLTQEFFREDTLRLFITCLPILNLETRKDATQVVANLQRQQVNFKLIASDYLEANVDLMDVLIQGCENLDMALHYGAMFRECIRHQIVAKYVLESEHVKKFFDYIQLANFDIAADAAATFKELLTRHKSTVADFLTNNEEWFFADYNSKLLKSVNYVTRRQAIKLLGDILLDRSNSAVMTKYVSSMDYLMILMNLLIESSKSIQIEAFHVFKLFVANQNKPAEIVNILVTNRSKLLRLFADLRPDKEDERFEADKSQVLREISSLEPLVLA

SEQ ID NO: 53403 - protein, 364 aa, Arabidopsis thaliana
MVIMQVLASKTKINMVMELVTGGELFDRIVSNGKLTETDGRKMFQQLIDGISYCHSKGVFHRDLKLENVLLDAKGHIKITDFGLSALPQHFRDDGLLHTTCGSPNYVAPEVLANRGYDGAASDIWSCGVILYVILTGCLPFDDRNLAVLYQKICKGDPPIPRWLSPGARTMIKRMLDPNPVTRITVVGIKASEWFKLEYIPSIPDDDDEEEVDTDDDAFSIQELGSEEGKGSDSPTIINAFQLIGMSSFLDLSGFFEQENVSERRIRFTSNSSAKDLLEKIETAVTEMGFSVQKKHAKLRVKQEERNQKGQVGLSVTAEVFEIKPSLNVVELRKSYGDSCLYRQLYERLLKDVGTSSPEQEIVT

SEQ ID NO: 53404 - protein, 389 aa, Magnaporthe grisea 70-15
MSTVGKVSKANTRMTITCKAAVAWEAGKDLSIEDIEVAPPKAHEVRIEIYHTGVCHTDAYTLSGKDPEGAFPIVLGHEGAGIVESVGEGVTNVKVGDHVVALYTPECKECKFCKSGKTNLCGKIRATQGKGLMPDGTSRFKCKGKDLLHFMGTSTFSQFTVVADISVVAVQPEAPMDRTCLLGCGITTGYGAARVTANVEEGSSLAVFGAGCVGLSVVQGAVINKAGKIIVVDVNPAKEEWARKFGATDFVNPTKLPEGKTVVDALVELTDGGCDYTFDCTGNVQVMRAALEACHKGWGESIIIGVAAAGQEISTRPFQLVTGRVWKGCAFGGIKGRSQLPGLVDDYLQGRLKVDEFITHRKKLVEINNAFETMKQGDCIRAVVDMRAV

SEQ ID NO: 53405 - protein, 161 aa, Crocosphaera watsonii WH 8501
MNPLFSARTSVEQVEEGLFLAPKFDGNGLIPVVTTDVNTGEVLMHAYMNEEALVKTIETGEAHYYSRSRQQLWHKGKSSGLVQKVAQLTIDDDQDCLWMQVRVAGSGASCHVGYRSCFYRSIPTGKSAIDSQQPLQLTFTETEKTFDPKAVYGDAPNPTQL

SEQ ID NO: 53406 - protein, 394 aa, Anaplasma phagocytophilum HZ
MLSERMNCIKPSPTLELSRLTLELRAQGLDIISLGAGEPDFDTPDHVKDAAIAAINAGKTKYTPVEGIPELKDSIIRSVRRDYGIDYVANQVLVGAGAKQCIYNLFMATINEGDEVIIPAPYWVSYPDMVKIAGGAPVIVNCGDYLKLTPELLRGAITPKTKWLIINSPSNPTGAVYSREELAAIAEVLKQHKHVLVITDDIYAKLVYDAEFCGILQVEPSLYDRVYIVNGVSKAYSMTGWRIGYILGNAEAIKAVSTIQSQSTTNANSIAQYAAIAALDGDQSFLDTRIKAFARRRDRVMDAVLSSGVLQADVPQGAFYVFISCGNAIGKHAPKVGVINDGSDMAKHLLNHRVAVVPGVAFGAPNFFRISYALSDDRLSEACERILEACSYLS

SEQ ID NO: 53407 - protein, 327 aa, Polaromonas sp. JS666
MSANSSSTAAALALIADDMRGMDAVIERRLKSDVPLVSQVSQYIVAAGGKRLRPALLLLMCGALGYRGDQRYNLAAVVEFIHTATLLHDDVVDESTLRRGRATANEAFGNPASVLVGDFLYSRAFQMMVEAGDMRVMQTLAEATNVIAEGEVLQLMNMHDATLSEDGYLRVIRSKTAKLFEASARLAALLAQSPPPVEQSCADYGQALGTAFQVIDDVLDYDGDVSEMGKNLGDDLREGKTTLPLIIAMQRCTELERAVIRRAIETGGTDQMPQIIAIVQQTGALQATRDAAAAEAQRALDALQVLPQNPYSNALGHLASQLLQRRS

SEQ ID NO: 53408 - protein, 219 aa, Brassica oleracea
MAFHSEDDRSEDYLFKIVLIGDSAVGKSNLLARFARDEFYPNSKSTIGVEFQTQKIDINGKEIKAQIWDTAGQERFRAVTSAYYRGAVGALLVYDISRKQTFHSIGRWLNELHTHSDMNVVTILVGNKSDLKDIREVPTAEGKALAEAQGLFFMETSARDSSNVAAAFETVVKEIYNILSRKVMSSQELNKQDPASLSNGKKVVIPSEAQGEAKKGGCC

SEQ ID NO: 53409 - protein, 111 aa, Nostoc sp. PCC 7120
MKKIFSLVLLGIALFTFAFSSPALAADSVNGAKIFSANCASCHAGGKNLVQAQKTLKKADLEKYGMYSAEAIIAQVTNGKNAMPAFKGRLKPEQIEDVAAYVLGKADADWK

SEQ ID NO: 53410 - protein, 243 aa, Staphylococcus aureus subsp. aureus MW2
MRNDLETLKHIIDSSNRITFFTGAGVSVASGVPDFRSMGGLFDEISKDGLSPEYLLSRDYLEDDPEGFINFCHKRLLFVDTKPNIVHDWIAKLERNQQSLGVITQNIDGLHSDAGSQHVDELHGTLNRFYCNACHKSYTKSDVIDRTLKHCDNCGGAIRPDIVLYGEMLDQPTIIRSLNKIEHADTLVVLGSSLVVQPAAGLISNFKGDNLIIINKDRTPYDRDATLVIHDDMVSVVKSLMTE

SEQ ID NO: 53411 - protein, 437 aa, Nostoc sp. PCC 7120
MRRIGEKHMVSMPTLPLEGASPAHICPFDQACSYLEAAAKELRLDQGALEILSHPRKVVTVSIPVRLDNGDIRVLAGHRVQHSDILGPYKGGTRYHPAVTLREVSALAMLMTWKCALLGIPYGGAKGGIAIDPEHYSVGELERITRRYTSELIKDIGPSVDIPAPDVGTSAREMAWMMDTYSMNVGHAVPGVVTGKPISIGGSRGREMATGRGVMIIVREALADMGRTLEGVKVVIQGFGNVGGAAAELLYQAGAKILAVSTGAGGLFASDGLDIPALKAYAAENHRSIVGFPQAVPISNAELLTLPCDVLIPAALENQITEENVDQIQAQIVAEAANGPVTLEANRVLEGRGVTVLPDILANAGGVVVSYLEWVQGLSYLFWDEERVNREMEHLMVQAYHQVIKQSQMRQVPLRLAAYTLGVGRVAQALSDRGLYP

SEQ ID NO: 53412 - protein, 380 aa, Brassica oleracea
MATSLSIGGSLVSLSLFLGVSSLDGDETPSRCLSSKHDGDGELSRWISSNGKGINQVFGTKLIAIQRVLEMDSNPFMHTGNFVDLLSQQSISFANYEDISTLSSSQLPSLHRDDVGERRERKTWTPTDDILLISSWLNTSKDPVVSNEQKAGTFWKRVAAYFNASPKAAGGEERTPNNCKQRWHKINDLVCKFCGAYEAATREKTSGCNENDVLKRAHEIYHNNLKKKFTLEHAWKELRNDQKWCEVASARNEGSSKKRKCEDAEVSSAFQPSESKRPADVKASKARGKATVAEEALTNGFQSMWDIKQKDLEVKERLSKMKILESLIAKTEPLAEYEEALKKKLISDLMWSQVSRSGALCYGVKSHGVYCRVEQSESGV

SEQ ID NO: 53413 - protein, 135 aa, Capsicum annuum
MVGGMLLHCKSLRRFEQSGGWIKALLEEAENERMHLMTFMEVAKPKWYERALVFAVQGVFFNAYFVTYILSPKLAHRIVGYLEEEAIHSYTEFLKELDNGNIENVPAPAIAIDYWRLPKDSTLRDVVLVVRADEA

SEQ ID NO: 53414 - protein, 212 aa, Pseudomonas syringae pv. syringae B728a
MNELQDLIDNNARWADAIKQEDPEFFAKLARQQTPEFLWIGCSDARVPANEIVGMLPGDLFVHRNVANVVLHTDLNCLSVIQYAVDVLKVKHILVTGHYGCGGVRASMQDRQFGLIDGWLRTIRDLYYENRELLAKLPTEEERVDRLCELNVIQQVANVGHTSIVQNAWHRGQSLSVHGCIYGIKDGRWKSLDVTISGFEQLPPQYRLRPQD

SEQ ID NO: 53415 - protein, 574 aa, Schizosaccharomyces pombe 972h-
MLSKFYEDIDSKLENAMLSQIESSTITCDGKSLNTLPTPKQEDVEFGVPLQPEDTQDLQRKLKPRHMQMIAIGGCVGTGLFVGSGNALADGGPASILIAFAVIGTYVLFTTSALAELSAIYPVSGSFYTYFSKFIDPAWGFAVGIQYWLSFAVTVPLELTVAPLIINFWNASGPVSIWISVFYVIIIAINIWGTEGYGEVEFFLSIMKVISVIGFVILSIIIAAGGVPTDDRGVIGVSYWKQPLVFNNGFKGLCAVSVIAIFSLSGTELVGLAASEAKNPQKTVPAAVKQIFWRIFLFYIVALFMLTLVVPSDLPGLRTSDNSNVLISPFVIAIQLANIRALPSIMNVVILLSTLSVGNSASYAASRALFALAKNGYAPKIFNKTNKRGHPIYAIAVTLLFGSIAYFTEAGVGGALFGWLLSICGLSTTFIWGSICLAHIQFRRAWKIQNRKLEDLPYRSIFGVYGSIYGVAMTILALIAQFYVAVFPIGKKPNPVDFFQAYMAAPILIISFVAWKFFRRTSFVRIEKIDLSEGAHGEQKQNLEPVINIPVEEIDFPMKVATKESMKNVEKNAL

SEQ ID NO: 53416 - protein, 662 aa, Thiomicrospira crunogena XCL-2
MSTRRELANAIRVLSMDAVQKAKSGHPGAPMGMADIAEVLWNDHMKYNPTNANWADRDRFVLSNGHGSMLIYSLLHLTGFDLSIDDIKNFRQLHAKTAGHPEYGYADGIETTTGPLGQGLTNAVGMAIAERTLGAQFNKPGHNIVDHNTYVFMGDGCLMEGLSHEAAAMAGTLGLGKLIAFWDDNDISIDGHIGDWMEKGVPGRFKSYDWHVIPNVDGHDADAIDAAIREAKSVNDKPTLICTRTTIGFGSPNLCGSHDCHGAPLGDEEIKLTRENLGWDYEPFVIPDEVYQGWDHKEKGATSEAEWNAKFEAYRAEYPKEAAEFERRMAGDLPANFEVEMDNFIAKTQEEMPNIASRKASQNAIEAMGPLLPEMFGGSADLTGSNLTNWSGTVKVNSTVADGNYLSWGVREFGMAHMMNGMVLHGGFKVYGGTFFMFMEFMRNALRMSALMKIGTIYVYTHDSIGLGEDGPTHQPVEQLATMRVIPNFQTWRGCDAVESAVSWKVAMMRGDAPTALVFSRQNLTPMERTPEQVKNIEKGGYVLKDCDGTPDIIFIATGSEVGLAVEAADAMNEKVRVVSMPSTCAFDTQDQAYRDSVLIPGVKRVAIEAGVAQSWYKYVGLDGGMVCMSTFGESAPAGELFKEFGFTVENVVATANKVLGK

SEQ ID NO: 53417 - protein, 137 aa, Frankia sp. EAN1pec
MSAERTLILVKPDGVSRGLVGEVVGRIERKGLKIVALELRTLERSVAETHYGEHASKPFFGELVEFITSGPLVALVAEGPRAVEALRGLIGATDPVKAAPGSLRGDFALEIGQNLIHGSDSPESAKREIDLFFPGLS

SEQ ID NO: 53418 - protein, 143 aa, Pseudomonas syringae pv. syringae B728a
MPKTPAPYLKPDECVVLFDGVCKLCNGVVKFLIRHDPHQRLRLAAVQSEQGQALLKWAGLPLDDFHTIAVIVNNRVFVRSDAFLHIMGLLPAPWPLLKVLGIFPRFLRDWAYNRIALNRYRLFGRYDHCLLPSPEDRQRFLGD

SEQ ID NO: 53419 - protein, 140 aa, Gluconobacter oxydans 621H
MALERTLSIIKPDATKRNLTGKINAVFEGAGLRIVAQKRIQLTEKQAGAFYAVHKERPFYGSLVSSMIAEPVVVQVLQGENAVAKNREVMGATNPADAAEGTVRKLFAESIEANSVHGSDSLENAKNEISFFFAETEILP

SEQ ID NO: 53420 - protein, 411 aa, Brassica napus
MNALAATNRNFRHASRILGLDSKIERSLMIPFREIKVECTIPKDDGTLVSFIGFRVQHDNARGPMKGGIRYHPEVDPDEVNALAQLMTWKTAVADIPYGGAKGGIGCNPRDLSLSELERLTRVFTQKIHDLIGIHTDVPAPDMGTNAQTMAWILDEYSKFHGHSPAVVTGKPIDLGGSLGREAATGRGVVYATEALLAEYGKSIQGLTFVLQGFGNVGTWAAKLIHEKGGKVVAVSDITGAVRNPEGIDINALLKHKDATGSLKDFNGGDAMDSEELLLHECDVLIPCALGGVLNKENAGDVKAKFIIEAANHPTDPDADEILSKKGVIILPDIYANAGGVTVSYFEWVQNIQGFMWEEEKVNLELQKYMTRAFHNIKSMCHTHSCNLRMGAFTLGVNRVARATQLRGWEA

SEQ ID NO: 53421 - protein, 1102 aa, Streptomyces avermitilis MA-4680
MPKRTDIQSVLVIGSGPIVIGQAAEFDYSGTQACRILRAEGLRVILVNSNPATIMTDPEIADATYVEPITPEFVEKIIAKERPDALLPTLGGQTALNTAISMHEQGVLEKYGVELIGANVEAINKGEDRDLFKGVVEAVRAKIGHGESARSVICHSMDDVLEGVETLGGYPVVVRPSFTMGGAGSGFAHDEEELRRIAGQGLTLSPTTEVLLEESILGWKEYELELMRDKNDNVVVVCSIENFDPMGVHTGDSITVAPSMTLTDREYQRLRDIGIAIIREVGVDTGGCNIQFAVNPDDGRIIVIEMNPRVSRSSALASKATGFPIAKIAAKLAVGYTLDEIPNDITEKTPASFEPTLDYVVVKAPRFAFEKFPSADSTLTTTMKSVGEAMAIGRNFTEALQKALRSLEKKGSQFTFVGEPGDKALLLEEAVRPTDGRINSVMQAIRAGATPEEVFEATKIDPWFVDQLFLIKELADELAAADKLDPELLAEAKRHGFSDVQIAEIRGLREDVVREVRHALGVRPVYKTVDTCAAEFAAKTPYFYSSYDEESEVAPREKPAVIILGSGPNRIGQGIEFDYSCVHASFALSEAGYETVMVNCNPETVSTDYDTSDRLYFEPLTLEDVLEIVHAETLAGPVAGVIVQLGGQTPLGLSQALKDNGVPVVGTPPEAIHAAEDRGAFGQVLAEAGLPAPKHGTATTFAGAKAIADEIGYPVLVRPSYVLGGRGMEIVYDETRLESYIAESTEISPSRPVLVDRFLDDAIEIDVDALYDGEELYLGGVMEHIEEAGIHSGDSACALPPITLGGFDIKRLRASTEAIAKGVGVRGLINIQFAMAGDILYVLEANPRASRTVPFTSKATAVPLAKAAARISLGATIAELRAERLLPANGDGGTLPLDAPISVKEAVMPWSRFRDIHGRGVDTVLGPEMRSTGEVMGIDSVFGTAYAKSQAGAYGPLPTKGRAFISVANRDKRSMIFPARELVAHGFELLATSGTAEVLKRNGINATVVRKQSEGEGPGGEKTIVQLIHDGQVDLIVNTPYGTGGRLDGYEIRTAAVARSVPCLTTVQALAAAVQGIDALTHGDVGVRSLQEHAEHLTAARD

SEQ ID NO: 53422 - protein, 448 aa, Xylella fastidiosa Temecula1
MPRHLRKRRVFELLIVIALIFLNGFFAMSEMSLMTSRKSRLKQMAHSSKHAAKALTLAQNPESFLSTVQIGITLIGILTGLFGGDAIGTAIGQWLTALTPQLGEYTSIIGKTLSVALITFLTLIFGELVPKRLALTHSEKIASTIAVPMSVLARIAAPGVWVLAKSTQLVLRVFGFGKIPSSAVTEEEIRLLVAESHEAGVIDDYERNMMNRVMRLGDRTADSLMTPRNRIAWLDNSADLEHNLEIMREHQFSRYPVYRSSDQDIVGILEVKSVITRIDSQTQTTLSLFQELCEPVFVSESTHALKLLEIFREEQQSMALVVDEYGEILGLVTISDLMGAVIGRLQNVENTDEDALMVTREDGSFLIDGTLPIEELREVLGAELPDGEENNYHTLAGMCISYFGRIPHVGEYFDWAGWRIEIVDLDGARIDKLLLQRLNKEKNHVPHK

SEQ ID NO: 53423 - protein, 765 aa, marine gamma proteobacterium HTCC2143
MMRKNMLESLRRIVQEVNTAGNLQAVLDVAVLRVRRAMGTEVCSVYLREPSLGRLVFSATQGLNKDFVGKVSMAANEGLVGQVAGREEPLNLEHAEAHAAFLLMPGIGEERFSSFLGVPIIHQRQVLGVLVVQQQERRRFNEDDEAFLVTVSAQLAGVIAHAQATGSIVTLEAGQEKHRSARFRGVAGAPGIAIGETAIITPFADLYAVPMRRCKDIDEERDFFRECIEAVKEDMRALGRKFSRRLVPQEQALIDVYLHMLDDNALAGEVDARISRGEWAQGALSKVIIQHLRTFETMSDEYLKERATDVKDLGRRILAYLQSANSGPKEYPARTILVGEELTASMLAEVPPENLVGLVSIRGSSNSHVAILARSMGIPTVMGAVDLPFTQLEGREIILDGYNGHVYFNPSAELYGRFQAIYEGEQQLSKGLEALKDLPCITTDDVRMPLWVNTGLQADIARSLDRGAEGVGLYRTEVPFLLRERFPSEEEQRQIYREQLQAFAPMPVTMRTLDVGGDKSLPYFPIEEDNPFLGWRGIRVTLDHPEIFLVQVRAMMKANAGLGNLQIMLPMISSVPELEEALELIYRAHDELIVELGVDLEIPVVGVMVEVPAAVYQAREFAKRVGFLSVGSNDLTQYLLAVDRNNARVADIYQAYHPAVLQALQKVVDDGHAEGRKVSICGELAGDPAAAILLTAMGYDVLSMNATNLPRVKLVLRSISSVRARELLREVMTMESAHQIQAFMEQALIDTGVQQLVRPQVAEIA

SEQ ID NO: 53424 - protein, 109 aa, Polaromonas sp. JS666
MSTTDTTQQRIDQIVKSSDVVLFMKGTAQFPMCGFSGRAIQVLKACGVNKPVTVNVLEDEEIRHGIKEYSNWPTIPQLYVKGEFIGGSDIMMEMYQNGELQQVLGTPTA

SEQ ID NO: 53425 - protein, 266 aa, marine gamma proteobacterium HTCC2143
MCLILFAYQHHSDYPLIIAANRDEFFNRPATAAHYWPESPEIFAGKDLQAGGTWMGVTRTGRFAAVTNHRSTHTPPNPAISRGALCTDFLRSNVSPQQFLQEIGKNRLDYAGFNLLLGSPNQLLYYANQTGDAVELKAGIHGLSNGVLNDSWPKVEQGKSALSAALAQSTEAEHLLHILMDDNPADASQVPDTGIGIDAEIVLSSRFIPPINVRDNHYGTRNCTVLKIDRQNNSEWLEQAFSPDGKLGSRASHQIEGITATNTTNN

SEQ ID NO: 53426 - protein, 110 aa, Escherichia coli
ALQKVENFRKPMLWDADALNLLAINPDKRHNRVITPHPGEAARLLGCSVAEIESDRLHCAKRLVQRYADVLAARFGTRGMLATDLFSTLQRIVNPEVTDKNHDESSNSAP

SEQ ID NO: 53427 - protein, 355 aa, Escherichia coli B
MSQKYLFIDRDGTLISEPPSDFQVDRFDKLAFEPGVIPELLKLQKAGYKLVMITNQDGLGTQSFPQADFDGPHNLMMQIFTSQGVQFDEVLICPHLPADECDCRKPKVKLVERYLAEQAMDRANSYVIGDRATDIQLAENMGINGLRYDRETLNWPMIGEQLTKRDRYAHVVRNTKETQIDVQVWLDREGGSKINTGVGFFDHMLDQIATHGGFRMEINVKGDLYIDDHHTVEDTGLALGEALKIALGDKRGICRFGFVLPMDECLARCALDISGRPHLEYKAEFTYQRVGDLSTEMIEHFFRSLSYTMGVTLHLKTKGKNDHHRVESLFKAFGRTLRQAIRVEGDTLPSSKGVL

SEQ ID NO: 53428 - protein, 572 aa, Arabidopsis thaliana
MAVVSKNQTQQQTPNPGGGVSRIEDSTNGKTCHQCRQKRTDLVGSCVTKKKDKTCPIKLCTKCILNRYGENAQEVALKKDWICPKCRGNCNCSYCMKKRGQKPTGILVHTAKKTGFSSVSELLKTSGSDKYFYTKKVKPEGVVVVSPLKLDQENSIEQKHVSIKKSRKTKREELKDINNGCSNENVVVKKSNPKKIKLSDSVHATTEVIKKVLAEGKKKKTTAKGIKENNVAEKIKRIKPALKKKEEDQVEIKIPQGNISITVSGIDLAPEDAGNVFQFLEFCSAFGKALDLRKGQAECVIREMLSGRSKRRQQYSTLTQMIIQLLTVILEDRGETSVCLSATDPSWFTTIGECLSESEVKLDDFPPEMFEKGISQYEKLNSSKRLKLLNFLCDETLGTLVMRNCIDSQNIESVERKKEAKEKINAAKDKEKQLKQKLQDELAQAVKAKNGIPLLITEHDAIVSRINAETQEVYSEMQNAIDMLSKKSQGSDDAVRTNPVELDDNGLIFWRLKSYNDEQNILLQDLGSWNEVCPHEKWFSFSSEQKPEIEKYISFIRMKRVQAQKNASTIIT

SEQ ID NO: 53429 - protein, 557 aa, Anaplasma phagocytophilum HZ
MHMNISEIYPSSNKIYINCTLYPDVKVGMRQINIRNSSQRFLLYDTAGPYTDCDIKVNLTEGISSIRRDWIARRNDTYPIRKAKTNSDARGVKALSGDDRVILKGIAGGAPVTQLFYAKKGIITPEMEYVAVRENALLEQAEAIPGLLLPTKTRKITPEFVREEVACGRAVIPSNINHPESEPMIIGRNFLVKINANIGNSAVLSNIEDEVKKMVLAVTYGADTVMDLSTGHDIHNIRELIVRNSPVPIGTVPIYQALNKVNGIVGDLSFEVFKETIIEQAEQGVDYFTIHAGVLKSYIEHTRSRTTGIVSRGGAIMAQWCLLHNKENFLYENFEEICEIMRSYDVTFSLGDGLRPGSINDANDVAQFLELRTLGELVKIARAHDCQVIVEGPGHVPMHLIEENVKKQLDFCDEAPFYTLGPLTTDIAPGYDHITSAIGAAMIGWYGTAMLCYVTPKEHLGLPNAEDVKAGVISYKIAAHAADLAKGNPASFARDYALSQARYDFRWEDQFNLSIDPATAKKLHDESLPGKGGKTAHFCSMCGPKFCSMKLSKALND

SEQ ID NO: 53430 - protein, 254 aa, Brassica napus
MTHTLQSPPSAAALSASIQKGRWKTVAAGFSVAPPPPAVNFTLRRSIPRIHASASSSSSSSSPSSPSLGAGENSELDAVSAFSEIVPDTVVFDDFERFPPTAATVSSALLLGICGLPDTIFRNAVDMALADSTCAGLDTTDSKLSCFFDKAIVNVGGDLVKLVPGRVSTEVDARLAYDTNAIIRKVHDLLRLYNEIDVPHDRLLFKIPATWQGIEAAKLLESEGIQTHLTFVYSLAQAAAAAQAGASVIQIFVG

SEQ ID NO: 53431 - protein, 981 aa, Oryza sativa (japonica cultivar-group)
MSTRLELLVVFVFIVAPALAATKPSYIVYLGGRHSHGDDGGVISPEEAHRTAAESHYDLLGSVLGDREKARDAIFYLYTKNINGFAARLEAEEAAAVAERPGVVSVFPDRGRRMHTTRSWQFLGLERPDGSVPPWSPWEAARYGQNIIIGNLDSGVWPESLSFNDRELGPIPNYWKGACRNEHDKTFKCNSKLIGARYFNNGYAKVIGVPLNDTHKTPRDANGHGTHTLATAGGSAVRGAEAFGLGGGTARGGSPRARVAAYRVCYPPFNGSDACYDSDILAAFEAAIADGVHLGALDGKKVMGKIVVCMRGGNPRVEKGEEVSRAGGAAMILVNDEASGNDVIADAHVLPAVHINHADGHALLAYINSTKGAKAFITRAKTVVGVKPAPVMAAFSSQGPNTVNPEILKVRNFSWRELDVAPRAHERRVAFNAQSGTSMSCPQVSGVAGLIKTLHPDWSPAAIKSAIMTTATELGNDMRPIMNSSMSPATPFSCGAGHVFPHRAMDPGLVYDLTVDDHLSFLCTIGYNATALALFNGAPFRCPDDPLDPLDFNYPSITAFDLAPAGPPATARRRVRNVGPPATYTAAVVREPEGVQVTVTPTTLTFESTGEVRTFWVKFAVRDPAPAANYAFGAIVWSDGNHQLDQEYSNSYQISYVYESSMSLTDKMRKLKELLHKSENRICADCSSPDPKWASANIGVFICLKCSGIHRSLGTHISKVLSVTLDEWTDDEINSMLEVGGNSYANAIYEAFLPGGYHKPHPDSSQEERADFIRSKYELQEFLKPSLRIVSNKSSLQAMDSRKDIGNASNSYSFKSEAGMVEFIGIIKVKVIRGTKLAVRDILSSDPYVVLTLGQQKAKTKVIKSNLNPVWNEVLTLSVPQKYGPLKLQVYDHDVLSRDDIMGEAEVDLQPMITAAMAFGDPGLLSDMQIGRWLMSRDNALARDSAVSVVGGRVKQEVSLRLQNVECGEVDLELEWIALNQ

SEQ ID NO: 53432 - protein, 333 aa, Thiomicrospira crunogena XCL-2
MTIKVGINGFGRIGRMAFRAAAKDFANIEVVAINDLLDPEYLAYMLKYDSVHGRFDGTVEVKDGNLVVNGKTIRITAERNPADLAWSDVGADLVIECTGFFLTEESCQAHIEAGAKKVVQSAPSKDHTPMFVYGVNHEEYAGQAIVSAASCTTNGLAPVAKVLNDNFGIKRGLMTTVHAATATQKTVDGPSMKDWRGGRGILENIIPSSTGAAKAVGKVLPALNGKLTGMAFRVPTSDVSVVDLTVELEKETSYDDICAAMKKASEGEMAGVLGYTEEANVSTDFRGDSHPSIFDAKAGIALDPTFVKVVAWYDNEYGYTCNMMRVVEHVGNN

SEQ ID NO: 53433 - protein, 393 aa, Thiomicrospira crunogena XCL-2
MSVIKMSDLNLAGKRVLIREDLNVPVKDGKVTSDARIRASLPTIKMASEAGAKVMLMSHLGRPTEGEYAEEFSLAPVAADLSAKLGKEVRIIKDYLGGDFDVAEGEVVLLENVRFNVGEKKNDETLSKQYAALCDVYVMDAFGTAHRAQASTHGAGAFAETACAGPLLAAELDALGKALNNPARPMVAIVGGSKVSTKLTVLESLSEKVDQLVVGGGIANTFIEAAGYNVGKSLSESDLVPTCKKLNEIMEARGAAIPLASDVVCGKEFSESAAAETKNVSEVADDDMIFDIGPDSAAELATIIKNAGTVVWNGPVGVFEFDQFGEGTKAISMAIAESSAFSIAGGGDTLAAIDKYDIADKVSYISTGGGAFLEFLEGKKLPAVEMLEKAAAK

SEQ ID NO: 53434 - protein, 148 aa, Solanum chacoense
MEQTFIMIKPDGVQRGLVGEIIGRFEKKGFSLKGLKLITVDRAFAEKHYADLSAKPFFNGLVEYIVSGPVVAMVWEGKGVVATGRKIIGATNPLESAAGTIRGDFAIDIGRNVIHGSDAVESARKEIALWFPEGIAEWQSSLHSWIYE

SEQ ID NO: 53435 - protein, 164 aa, Glycine max
MGGKSGVVWILLALIAAAWCLLTPARANSTTIYEELRAQGLPVGLLPKGIAKYSMNATSGEFEVWMKEACNAKFENEVHYDSNIKGVLGYGRIGELSGVSAQELFLWFPVKGIRVDVPTSGLIHFDVGVADKQFSLSLFEDPPDCNPQAQVNVGGGEGERRAAW

SEQ ID NO: 53436 - protein, 163 aa, Arabidopsis thaliana
MAETKKMIILKSSDGESFEVEEAVAVESQTIKHMIEDDCVDNGIPLPNVTGAILAKVIEYCKKHVEAAAEAGGDKDFYGSTENHELKTWDNDFVKVDHPTLFDLLRAANYLNISGLLDLTCKAVADQMRGKTPAQMREHFNIKNDYTPEEEAEVRNENRWAFE

SEQ ID NO: 53437 - protein, 129 aa, delta proteobacterium MLMS-1
MLAFDKDEKGLLPAIVQDHASGEVLMLAYINETAWQKCLETGQAHYWSRSRNKLWLKGESSGHVQLIREILVDCDADTVVLRVEQLGKAACHTGHRSCFYRRLHKPADGQPEWENIQTPVFDPAEVYKK

SEQ ID NO: 53438 - protein, 407 aa, Kluyveromyces lactis NRRL Y-1140
MNYIGLRNCARAVSSRVSIPSRGIKSHILTSYRAMSLDASKVKITKVETPSKPRPNDELVFGQTFTDHMLTIEWTAENGWGVPEIKPYGNLSLDPSSCVFHYAFELFEGLKAYRTPDNKISMFRADKNMERMNKSAARICLPSFNSDELIKLIGKLIEQDKHLVPQGQGYSLYIRPTMIGTTNGLGVGTPDRALLYVITSPVGPYYKTGFKAVRLEATDYATRAWPGGVGDKKLGANYAPCILPQLQAAERGYQQNLWLFGPEKNITEVGTMNVFFVFKDSKTGKKELVTAPLDGTILEGVTRDSILQLARENLNSDEWIVSERYYTITEVEERAAKGELVEAFGSGTAAVVSPIKEIGWNGHDIQVPLLPGEQCGPLTKQVAEWIADIQYGRKEHKGWSRIVADLN

SEQ ID NO: 53439 - protein, 486 aa, Prochlorococcus marinus str. MIT 9515
MSENELDKIKFGTDGWRGIIGFDFNLSNLSRVVVASCQELDYQYFDETKSKKILIGYDRRFMASEFANEIASYVKGCGFEPVLSHTYVPTPACSLYAKHNMFLGCLVITASHNPYNWLGLKIKSFKGCSVDESFTKEVEKRLLLENSIERLEGPYDKVDIKKFHLDQIKSNFNIDFIVNNLKKMNLHIFVDSMHGSAANCISQIFDSYDSNIFTEIRANYDPLFGGNPPEPLLKYLENLSEILITNSKKGIKTLGIIFDGDGDRIAVIDEKGRFCSTQVLLPFFISYLGEKNKNLFPVLKTVSGSDIIGNIAKNQNREVVELPVGFKYIAKKMINEEIFIGGEESGGVGFGDFMPERDALYAAMVLLNGIAEKSKYLCETLDEIQQKFGPSFYRRIDIKFPNQSEKEIFKKFINNNIPSEICGHKIISISHVDGIKLRLDNNFWLLFRFSGTEPLLRLYCEATSEYDLNEVLQWSQKFINRVKQNQ

SEQ ID NO: 53440 - protein, 170 aa, Streptococcus suis 89/1591
MNLKDYIATIPNYPKEGIEFRDISPLMADGNAYSYAVREIVQYATDKQIDMIVGPEARGFIVGCPVAFELGIGFAPVRKPGKLPREVISADYEKEYGVDTLTMHADAIKPGQRVLIVDDLLATGGTVKATIEMIEKLGGIVAGCAFLIELDDLKGREAIGDYDYKVLMHY

SEQ ID NO: 53441 - protein, 194 aa, Schizosaccharomyces pombe 972h-
MSFRGGRGGGFRGGRGGSRPFTPSGPPDQVIELGLFMHDCEGEMVCQSTNVKIPYFNAPIYLENKSQIGKIDEVFGPMNQVYFTVKPSEGIVSSSFKVGDKVYLSGDKLIPLDRFLPKPKTVGPKKPKGARNGPAGRGGRGGFRGGRGGSRGGFGGNSRGGFGGGSRGGFGGGSRGGSRGGFRGGSRGGFRGRF

SEQ ID NO: 53442 - protein, 248 aa, Mycobacterium sp. MCS
MGDSTLILLRHGESEWNAKNLFTGWVDVDLTDKGRAEATRAGELIADLDRLPDVLYTSLLRRAITTANIALDKADRHWIPVHRDWRLNERHYGALQGLNKAETKEKYGEEQFMAWRRSYDTPPPPIEAGSEYSQDRDPRYADIDGGPLTECLADVVARFVPYFEQTIVPDLREGRTVLIAAHGNSLRALVKYLDGMSDEDVVGLNIPTGIPLRYDLDSDLKPTVAGGTYLDPEAAAAGAAAVASQGAK

SEQ ID NO: 53443 - protein, 201 aa, Prochlorococcus marinus str. MIT 9515
MSSSRQAEIKRKTNETDISIFINIDGNGISEIDTGIPFLDHMLHQISSHGLFDLKIRAIGDTHIDDHHTNEDVGIALGKAFTKALGERKGINRFGHFFAPLDEALVQVTLDCSGRPHLSYGLKLKAPRIGNYDTELVREFFIAFVNSSGITLHINQIEGRNSHHIVEACFKAFSRSMRMATEIDLRRSGTIPSSKGMLEID

SEQ ID NO: 53444 - protein, 430 aa, Xylella fastidiosa Temecula1
MTVIAKIYAREILDSRGNPTLEAEVTLENAVCGRAAVPSGASTGTKEAVELRDGDKTRYLGKGVRAAVDNVNGVIAAALVGFDGADQTGLDHRLINLDGTENKGRLGANALLGVSLATAHAVAAARKQPLWMYLSTLGESKLSLPVPMMNIINGGAHADNNVDFQEFMVLPVGFASFSEALRAGTEIFHALKSVLKGQGLSTAVGDEGGFAPDFRSNVEALDAILEAIGRAGYIAGEDVLLGLDVASSEFRNNGKYNLVGENKRLTSEQFVDFLDDLVAQYPIISIEDGLAEDDWVGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGARYAGRDAFVSLKS

SEQ ID NO: 53445 - protein, 507 aa, Glycine max
  misc_feature (400)..(400): Xaa can be any naturally occurring amino acid
MLPSARSPGLGSLSVRPPIQLATSTALNQQMHASLLQHSVHVGNSTVGHNVQKVRPDANFQPGPSMSTTNSQLLSKGDKSSKVIEDLNWAKRTNTYSKSNIPLGVEKTNMVRDSSESFTRPSKVMKLDEGRSTPLSAGILDMPVTNGSSHILGRSSLPVHAAANAEGQLFRYVRPPPLTLHLAKMSRSQLTEIISELKGMATQNKELARQLLLSRPQLPKALFQAQIMLGMVTSQVLQMPNLRLVSDQTSQSLMNEGQLGQPSLVQTLSGLPPPGQGKLQPGLTPYAQEGQVNTIPHNPLAPNQLTAHPKPPVQPRIPLQQHPNNLVLPGTLSGQSNLMLPSARPPGLGSLSVRPLIQPGTSTALNQQMHPSLLQHSVHVGNSTVGHNVQKPTFSLAPPXSFTRPSKVMKLDEGRSTPLSAGILDMPVTDGSSHILGRSSLPVHAAPKAEGQYSEQQSSQLPPDVESVLLQQVLNLTPEQLSSLPPDQQQQVLQLQQALRRDQIQPS

SEQ ID NO: 53446 - protein, 262 aa, Glycine max
  misc_feature (212)..(212): Xaa can be any naturally occurring amino acid
  misc_feature (242)..(242): Xaa can be any naturally occurring amino acid
DKVADGFKVVARSGNIVAGIANESKKLYGVQFHPEVGLTENGKVILKNFLYDIAGCSGNFTVQNRELECIREIKEKVGTSKVLVLLSGGVDSTVCTALLNRALNQDQVIAVHIDNGFMRKRESQSVEEALKKLGIQVKVINAAHSFYNGTTTLPISDEDRTPRKRISKTLNMTTSPEEKRKIIGDTFVKIANEVIGEMSLKPEEVFLAQGTXRPDLIESASLVASGKAELIKTHHNDTELIXKLRGEGKVIEPLKDFIKMKS

SEQ ID NO: 53447 - protein, 278 aa, Arabidopsis thaliana
MGELDEAFIQAPEHRPNTHLTNSGDFIFSDEIPTIDLSSLEDTHHDKTAIAKEIAEACKRWGFFQVINHGLPSALRHRVEKTAAEFFNLTTEEKRKVKRDEVNPMGYHDEEHTKNVRDWKEIFDFFLQDSTIVPASPEPEDTELRKLTNQWPQNPSHFREVCQEYAREVEKLAFRLLELVSISLGLPGDRLTGFFNEQTSFLRFNHYPPCPNPELALGVGRHKDGGALTVLAQDSVGGLQVSRRSDGQWIPVKPISDALIINMGNCIQVNVDFRLKTN

SEQ ID NO: 53448 - protein, 1067 aa, Aspergillus fumigatus
MSTPAMAPTNTKDSDTPGWLHRHGTSVLGSVARQACKQPIYTLVITALLATMTYTSLLEGSLYNANLTRLSNSHLNQLDVTDFLQGSRSLRLGKATAWQWETDDESMSDQEVRPSFFLDPVASHLALITLVFPTSENNPGISAVQESIISDLAAAQLVSRTPSVLSSTFRETSITLSVPYNNLEEVLRKTQNFPQPEAEHSWTLKNAGKCNSGPKLRLWLIDVLASFVGLIKHAQIIDIIIMLLAYLAMHLTFLSLFMSMRQLGSRFWLAYSVLLSGFFSLFFGLKVTTSSGVSTSMITLSECLPILVIIVGFEKPIRLTRAVLRAATESYLPAKPMARRSTPEAIEVAIMREGWRIVRDYAIEIAILAAGATSRVQGALPQFCFLAAWILLFDSLLLFTFYISVLCVKLEITRIRKHVEPRRALEDDDISTGNQDFDSRVFGCKVKAANISRFKFLMVGGFVLFNVLQLSSLTYGNVRVSDWMPYLSNLSNTLMPAPINPYRVARNGLDDIYVASRANNIETRVTVLPPIKYVLQSQSRHCRDNFAGPLCDTLRGRTLGCVLAWLEDPVISKWVIAALFLSLVLNSYLMKAARWNLRQSEVIPDSSATVSQTKDSSNKLAEKRTVDAMLQEGRVSLLEDEEIVNLCLRGKISAHALEKTMERHPTMSRLEAFTRAVKIRRTVVSRTPSTIDVSSSLEYSKAPFENYDYTLVHGACCENIIGYLPLPVGAAGPLVIDGRNYFIPMATTEGVLVASASRGCKAINAGGGAVTVINADGMTRGPCLAFSSVSRAAEAKQWIDSDEGKKILATAFNSTSRFARLQGLKSAQAGTYLYVRFKSTTGDAMGMNMISKGVEKALEVMKGHGFSDMSTISVTGNYCVDKKPAAINWIDGRGKSVVAEALIPADAVRSVLKTDVDALVELNTAKNLVGSAMAGSIGGFNVHASNLVAAVLLATGQDPAQNVESSSCITIMKNVNNNLHISVSMPCIEVGTIGGGTILEPQAAMLDLLGVRGAHATNPGDNARQLARIVAAAVLAGELSTCAALAAGHLVSAHMAHNRSKVAAKTG

SEQ ID NO: 53449 - protein, 335 aa, Spinacia oleracea
KLKVAINGFGRIGRNFLRCWHGKDSPLDVVVINDTGGVKQASHLLKYDSILGTFDADVKTAGDSAISVGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDASHRDLRRARAACLNIVPTSTGAAKAVALVLPQLKGKLNGIALRVPTPNVSVVDLVVQVSKKTFAEEVNAAFRESADQELKGILSVCDEPLVSIDFRCTDVSSTIDSSLTMVMGDDMVKVIAWYDNEWGYSQRVVDLADIVANKWQA

SEQ ID NO: 53450 - protein, 484 aa, Agrobacterium tumefaciens str. C58
MPNRSCPAMFGGRGGVSAVAFMGVRSVMNEVSKPMSNLAAIDAAHHLHPFSDMGKLNAAGTRIIERAEGVFIYDSTGKKYLDAFAGLWCVNIGYGRREIADVVQRQMNELPYYNAFFGTTTPPATLLAQKIASRAGPKMNHVFFTNSGSEATDTWFRMARVYWKALGHPTKTRVIARRNGYHGSTVAGASLGGMKWMHEQGNLPIEGIAHIGQPYWYAEGGDLSPAEFGLKVARELDAKIDELGEENVAAFVAEPIQGAGGVIVPPETYWPEIARICKARNILLVSDEVICGFGRLGSWFGYQHFGVEPDLAPVAKGLSSGYLPIGGVIVSDRVAEVMLSEVGDFNHGFTYSGHPVCAAAALENLRIIEDEGLVERVRDDIGPYFSEGWKSLADHELVGEAVNVGLMGGLQLTADKATRRRFAKPDDIGTAVRNHCLANGLVMRATGDRMLASPALTVSRSEVDEIIETLRQGLNHLRDTREHF

SEQ ID NO: 53451 - protein, 474 aa, Crocosphaera watsonii WH 8501
MIATPTKTPHTGQDYLPKKVTETTQLSPNQSLLPLTANINNHDHLEIGGCDLQTLVEQFASPLYILDETTLRTACHQYRDGFKTYYQGESQVIYASKAWSSLAVVGVIATENLGFDVVSGGELYTTQKALTQLGYSCQEIAQKIYFHGNNKSVAELEQALEMGCTIIVDNWLELQTLVQLGETIPNQKTPILIRLTPGIECHTHEYIRTGHLDSKFGFDPNQLETVFSYIAEQKSLDCRGLHAHIGSQIFERQPHQDLAGVLVEWLKIGQEYGLTLSELNIGGGLGIRYTEDDDPPSIEEWIKAASEAVMKACQRSGIPLPKLIAEPGRSLIGSACVTAYTVGSSKEIPDIRTYVAVDGGMSDNPRPITYQSSYSVVLGNKMSAEINETVTVAGKHCESGDIVIKDAQLPQTHPGDILVIMGTGAYNYSMASNYNRLPRPAAVLVNNGEANLILKRETYDDLIRQDCLPEKLLS

SEQ ID NO: 53452 - protein, 568 aa, Solanum lycopersicum
MASSALISDTQSWKDLRAHVEEINKTHLRDLLNHTDRCQSMMVEFDGILIDYSRQRATLDTLKKLFNLAEAAHVKEKIIRMFNGEHINSTENRPVLHVALRAPRDAVINSDGKNVVPEVWHVLDKIRDFSERVRSGSWVGATGKALKDVVAVGIGGSFLGPLFVHTALQTEAEASECARGRQLRFLANVDPIDVARNITGLNPETTLVVVVSKTFTTAETMLNARTMREWISSALGPQAVAKHMVAVSTNLKLVEQFGIDPNNAFAFWDWVGGRFSVCSAVGVLPLSLQYGFSIVEKFLKGASSVDQHFLSAPFEKNIPVLLGLLSVWNVSFLGYPARAILPYSQALEKLAPHIQQVSMESNGKGVSIDGVPLPYQTGEIDFGEPGTNGQHSFYQLIHQGRVIPCDFIGVVKSQQPIYLKDEVVNNHDELMSNFFAQPDALAYGKTPEQLQKENIPEHLVSHKTFSGNRPSLSILLPSLSAYNIGQLLAIYEHRVAVQGFVWGINSFDQWGVELGKSLATQVRKQLHASRKKGESVEGFNFSTKMLITRYLEASADVPSDPSTLLPNI

SEQ ID NO: 53453 - protein, 399 aa, Aspergillus oryzae
MAPSAIESQKTKPEAPVVTEKQAGQPLDASKLIYTYTTNPRDVPDETTAHSGDETICTDHMVVATWKASTGWSAPELKPYGPLNLMPTASCLHYATECFEGLKVYRGYDGKLRVFRPDRNAARLNMSASRISLPQADADEITKLIFALLEVDGAKWLPKERAGNFLYLRPTLIGTQPTIGLVKSKQAILYIILSYMPRQDTPPGGMRLLTSPEDMVRSWVGGFGYAKVGANYGPSVLATQDAMQRGFHQILWLYGDQGECTEAGGSNFFVVWHRKDGKKEIITAPLDDRLILDGVTRRSCLELAKERLSDEFEVTERKYTIGELIEAEAEGRLLESFAAGTAWFITPVSAIQHREHDIPIPTGPDGGPGEVTGKIKGWLSDIMYGRAEHEWGIVVSERE

SEQ ID NO: 53454 - protein, 456 aa, Arabidopsis thaliana
MDLLSNLPYELLCHILSFLTTKEAALTSVLSKRWRNLIAFVPNVDIVDHDIRELFMDFVDRVLALQGNSPINKFSLDCSGVDSDRVDCWIQNVMVRGVSELNLSIFVDSVFEDDYNLFPKVFENKKLVKLGLSYISWLDGSIFLPMLKTLVLESVLLSVEKFEILLHALPALEELVMNNIYWKERDVVDLIVSSESLKTLTINFIVCTHTLSFDTPILAYLSYSGYVVDDYAEAKMENLFEARISLLVVEGDISRVRALINNDLLEDDEYDVLQFENVWKLMNGIRNIRCLYLSPNTLEVLSLCCESMPVFKNLKSLSIKSAENRGWQAMPVLLRNCPHLETLVLEGLLHHVTDKCGDACDCVSREDKGRSLTSCPVKVLEIKGFQGTTKEMNMIKHFLEYFPCLKELKMYMEENDPAQLRVPEVITGEMMERYKKSSSCNVQLLVGGKLYKKWTP

SEQ ID NO: 53455 - protein, 157 aa, Triticum aestivum
  misc_feature (66)..(66): Xaa can be any naturally occurring amino acid
HISAPKPSILPAVYSRSMSVSSAQIEESGFETATVADILKSKGKSADGSWLWCTTDDSVYDAVKSXYLRKIIVQGRSSKSTKVGDIMTEENQLITVKPDTRVLQAMQLMTEKRIRHIPVIDGTGMVGMVSIGDIVRAVVSEHREELNRLNAYIQGGY

SEQ ID NO: 53456 - protein, 339 aa, Brassica oleracea
MDTRQMLVIFSYVVLTHMTLGNIDEYDCVYIYKQPAFQHPLLKHHKIPEKFTSNESFDRKNKYKTNDQSCPKGTVAILRQRSETESLHLDTVDQFGHHFAAMDAFADESIYRGAQADISIHNLTLQNNQYSKSQIWLENGPPGELNSIQVGWAVHPRVYGDSATRLTIYWTGDGYKKTGCYNTECPGFIIITRKPSIGSIFKQSSVYGDKPVTFTPQVVQGFFGNWALTVDDEIIGYWPGELFTHLNKGASRVRFGGNTFISPDGISPPMGNGHDPIYDYERSSSFLHVKLTNDKYQSIEAETLMGVADSKCFKLMNRDYTNETGKSFSFGGRGGRCGF

SEQ ID NO: 53457 - protein, 2859 aa, Ustilago maydis 521
MTIPKSSTGQSYPPVLDYRIVQLIGGGGFSKVFRAVNPSSESHSVAAIKVISYAPNRSNKYPIDRRALQKEVQVHSILKHPNVLEFLGAVERGVDKNGNAGKEKGILMGEAVATTKESIRARDKERQQMLSSPSHDQNYVPGLYMVLELGAGGDLFDKIAPDYGVEEDLAHFYFQQLLAGLEYIHSQGVTHRDIKPENMLLDAEGNLKIADFGLCSVYKYKGKERELTGACGSLPYIAPEMNGKPYRGEPVDVWSSGVVLFAMLVGSTPWDEPTSRSPEYSAYRTGKLFEYDPWPRIPQDALSLLKKMMHPTPEKRITFEGIRRHRWFKRANDLMTQKGKCNDPVNLAEKLLQGLAVSGDIIVEVNGAAAAAARRLDLHSDGQRAQVPENVSLTQPDAILTSSFDLAARAVARGWADDTGPGGGLPLPSSTAMPAFASDDMSRRLAMSQHISSRRAEFSTTASGSGYDMALPGASQFTQALNHFTQFEALTHVAGTGSSHLRFSPHLTRFFSSASAATILALIIDVLDRLAVLNAHQAIGDQEELELEEAYNFMADGEPETTVPSDDSSRPTGGSKRLLIGSRGARIRLKTMDRRKCVLRGEVYVENLAAPDSTSDSASAPDRNAAKCLVVMKKGKGDPLEWRRLFREVCRRPEIMQTIISTASLLLLSMRQNRQDARQKMCVRCTVDDEQEWGNTEQRHEQSRVAADAHQNWRELSRNLLHSRLINVRGKRRERAQTSTGQFTTDKRVGVTRAAPHCAHHTCVLTGAQHRTLPLFRHSAIMGEEDIGEAVPKEQRQGWGQFLKQIATFSGDLSSLTAPSFILSPVSLVEFPAYWGEHPDEFAKISTGKDEIERMNLVLKWFIGTLKGQFTARNTSMGSEKKPLNPILGELFLGKWPDKNDRGETTLTAEQVSHHPPVTAYHIENRKAGVTLEGHCAQKTSFSGRTIQVKQVGHAILRVKLAGSDKEELYLITLPNLLIEGLWYGAPYVELTGNSYIQSTTCLLTTLSYTGKGYFSGKAHSFKATIGAGGNALYTVEGEWAGVSKYKGKSVSGGSNELFWDASTQREEVSVEAVEQQGEMESRKVWKTVAHGIRSGDFETASKDKARIENAQRQKRKDEAAAGTPHQLERFVHLDNDQEYSQLAAMFKVHAAERLFTWRIATCRRMLAALPDQRSFVQPVLDRIDTSSEAPLGRKRLICKYDSDCVNPERRHLNEKYYRIRPIRMSVLLETSLGDIVIDLHTELAPRSCTNFLKLCSKHYYKLNAFFRVEKDFLAQTGDPSNTGKGGASIWSQLPSTSQDSSTSTYFTPESSDGQLKHLKKGTVSFACFRKHVQGADEDGEGGSCELLAGSQFFVTLKDELDYLDGRHAPFGMVVEGHEPGGTLDKINHAFTDDQKRPLRDIRIRHVVVLEDPFADPDGFCAPSRSPSPTPCQVRALRLADDEDVHSDVDPASKEEMRRNADTNAAALTLEMVGDLPFAEIRPPENILFVCKLNPVTRSDDLELIFSRFGKILSCEVIKDKKTGDSLQYAFIEFDKKDDAERAYFKMQNVLVDDRRIWVDFSQSVDIRSEVMIDGTIDATSLQLEGTQALGIADKTASGATEKATTTQETGRTKGRDAITTMYPSKAAHDPNVMIHTAITSVITSVDMLDLRTKASRNVVTKRIPIQDTTSIPGVTTAVQPQLVETRTEDLSVHAMIVIVIVIVIVIVIVNANIDAGLRTDGDMMIANVPVMVHAGDASAASSILAYYFQAYLCLFYLGISTCKPSAALAPSPTAAFFPSTSRVYTSKAATVVDDDEALDEIRRYESFSTVDWVVDNTRERNRLARERQAASAHFVSSSSNAHLGNADAAWGHIGFGRGGVPPRWWSRGPWGRRAWLVWGIVKSASSAFTDSGVIVLVGILIGLNMGVISLATEWASDLKQGYCSSGWWLNQKFCCWEMMDQAGPGGAPLPAAAKALATATVTVTASIGAAAAATDSAPILPATPAATPTAAIRAVAQEAYNLTIRAIPDHQLWSRSAQDVIQDGFGTGLRLLSRAEGAASGAGDLSETCTDWVRWSKWSFPAWIIYMLFAGLLSFICAHLVKSFAPYAAGSGISEIKCILAGFVINGYLGFWTLAIKSLTLPLAIASGLSVGKEGPAVHVACCIGNVVASFFRSFNRSQAKMRELLTASSAAGVAVAFGSPIGGVLFSLEEMAYNFPASTMWRSFLCALAATVTLSFMNPFRTGKLVLFQVSYDRDWHYFEIMFYILIGIFGGLYGAFVIKYNLQVQSFRRSYLVKHGVSEVVVLATLTAFVGYANKFLRIDMTESLEILFRECEGGGDYDNLCQSWAQWRMVNSLLLATVLRTALVIVSYGCKVPAGIFVPSMAIGATFGRMVGILVKALYNAFPHWSLFSACQPDVPCITPGTYAFLGAAAALAGVTRITVAVVVIMFELTGALTYILPTMIVVGITKGVADWFSRGGIAEQMIKFSGYPFLDKDDHNFGIPVADVMRVCPQVLFASGMKLSELEGKLADGSYKGFPLVLAKHDATLLGYVGKVELRYAIGKARRARALDGDTLCLFSVGPNALDRADGVESSAHGAQQQQPDLLSVASLPTTAAADRAVREDMLSRFSGATGAGSASGLGSTSATGVASQRRHESESLIGQLDVEDDRSSAPSYRSRVDAGDNMSSSSDDDAVVGNAGGGVDGESDLDKLELGGWIDPTPLIVQPGMPLETVMDMFKNLGPRVILVVEYGRLSGLVTVKDVLKRIAMQEKAEAAARTAAAAGLPMSGSANSFTGEGAGAGGGELEALLKEAYEWAQEKWALISPRIERISARRASASRGVAEDMPMHSTRQTSATKNTRSEHHQFVLGAQDDDDE

SEQ ID NO: 53458 - protein, 129 aa, Oryza sativa
  misc_feature (27)..(27): Xaa can be any naturally occurring amino acid
TPPAEVVEVSTFMHACEGDAVTKLTKXDEIFGPINESLFSIKMLEGIIATSYSEGDKFYIDPMKLLPLSRFLPQPKGQSQGGGRGGGRGGGRGGFRGRGGGGFRGRGAPRGRGGPPRGGGRGFRGRGRF

SEQ ID NO: 53459 - protein, 424 aa, Gluconobacter oxydans 621H
MDARDGLLFEGVPLHVIAAAVGTPCWITGAETLRRRAKALRAAFEARNLPVNMHFAMKSQDHQATLTILRQCGYGVDIVSGGEMQRALHAGISPSGIVFSGVGKSDAELRAAVEHDIAQINVESVEELYRLDDIARACGRVARAALRVNPDVDADTHDKISTGRAGDKFGIEHRRAVALYGEAASLKNVRLVGLAVHLGSQMLTAGPFREGYSRLADMVREIRAAGHTVEAVDCGGGLGIRYRDEIAPSPDMLAGVLAETLGDLDVRLSIEPGRWLSAPTGILLTRVIETKAGNPDFVVLDAAMNDLARPSLYESWHGIMPVAPNGLTSLTKLWDIVGPVCESSDIFARDRALPADTKRGDLIALLDTGAYGSVMSSTYNTRPLAAQVLIDNGKWEIIRQRQSVAELIAAETVPEWLTAKDDHG

SEQ ID NO: 53460 - protein, 475 aa, Streptococcus pyogenes M1 GAS
MAKQYKNLVNGEWKLSENEITIYAPATGEELGSVPAMTQAEVDAVYASAKKALSDWRALSYVERAAYLHKAADILVRDAEKIGAILSKEVAKGHKAAVSEVIRTAEIINYAAEEGLRMEGEVLEGGSFEAASKKKIAIVRREPVGLVLAISPFNYPVNLAGSKIAPALIAGNVVALKPPTQGSISGLLLAEAFAEAGIPAGVFNTITGRGSVIGDYIVEHEAVSFINFTGSTPIGEGIGKLAGMRPIMLELGGKDSAIVLEDADLALAAKNIVAGAFGYSGQRCTAVKRVLVMDKVADQLAAEIKTLVEKLSVGMPEDDADITPLIDTSAADFVEGLIKDATDKGATALTAFNREGNLISPVLFDHVTTDMRLAWEEPFGPVLPIIRVTTVEEAIKISNESEYGLQASIFTTNFPKAFGIAEQLEVGTVHLNNKTQRGTDNFPFLGAKKSGAGVQGVKYSIEAMTTVKSVVFDIQ

SEQ ID NO: 53461 - protein, 492 aa, Streptomyces avermitilis MA-4680
MLDQGAPPQSRSHPSAPGLGARLMRRKPVENLVAEGGQGEGGTLRRSLGLWQLTMISIGATLGTGIFVVLGEAVPKAGPAVTLSFVIAGLTALFSALSYAELAGTIPVSGSSYSYAYATMGELIAWICGWCLVLEYGVSVAAVAVGWGEYLNELLDGTIGVTIPDALSAPPGDGGIFNLPALIVVLLAMAFLLGGAKESARANTIMVIVKIAALLMFCAIGIQGFKSGNYENFMPLGMAGVSAAGATLFFSYIGFDAASTAGEEAKNAQRDLPRAIMLSLVIVTALYVLVAAVAVGAKPWKGFNDSEAALAGIMKDVTGQTFWGTLLAACAVIAIASVVLTVLYGQTRILFAMARDGLVPKVFARVHPKTGAPRANTVIVSLFCGVLAAAIPLGQLADATSIGTLFAFGLVNIAVVVLRRTRPDMRRTFRVPLSPVLPAIGFALCVWMMGSLSAVTWVVFGVWMAVGLVFYFSYGHRRSRLATADTAVSAQK

SEQ ID NO: 53462 - protein, 243 aa, Schizosaccharomyces pombe 972h-
MSLAFTLLTSKDNTDEDEEHLELSSFNQEKLLEMISVFLSRLTRLNDSKQEATESDQIPLSPTSLKNPCLIFSAKNVPSISIQAYLTRILKYCPATNDVFLSVLIYLDRIVHHFHFTVFINSFNIHRFLIAGFTAASKFFSDVFYTNSRYAKVGGIPLHELNHLELSFFVFNDFNLFISLEDLQAYGDLLLSWYRQNGQNYNPTDVSCSIESPISHTPQQNQQDEQPRRPIMDRRLLSSHSIG

SEQ ID NO: 53463 - protein, 577 aa, Streptococcus pyogenes M1 GAS
MTEMLKGIAASDGVAVAKAYLLVQPDLSFETVTVADTNAEEARLDVALQAAQDELSVIRENAVESLGEEAAAVFDAHLMVLADPEMISQVKETIRAKQTNAETGLKEVTDMFITIFEGMEDNPYMQERAADIRDVAKRVLAHLLGVKLPNPATINEESIVIAHDLTPSDTAQLNKQFVKAFVTNIGGRTSHSAIMARTLEIAAVLGTNDITKRVKDGDVIAVNGITGEVIIDPSEDQVLAFKEAGAAYAKQKAEWSLLKDAHTETADGKHFELAANIGTPKDVEGVNDNGAEAVGLYRTEFLYMDSQDFPTEDEQYEAYKAVLEGMNGKPVVVRTMDIGGDKELPYFDLPKEMNPFLGFRALRISISETGDAMFRTQMRALLRASVHGQLRIMFPMVALLKEFRAAKAVFDEEKANLLAEGVAVADDIQVGIMIEIPAAAMLADQFAKEVDFFSIGTNDLIQYTMAADRMNEQVSYLYQPYNPSILRLINNVIKAAHAEGKWAGMCGEMAGDQQAVPLLVGMGLDEFSMSATSVLRTRSLMKKLDSAKMEEYANRALTECSTAEEVLELSKEYVSED

SEQ ID NO: 53464 - protein, 533 aa, Gluconobacter oxydans 621H
MTLTQQDASTVEKLDETLHEDRILILDFGSQVTQLIARRVRESGVYCEIWPFTATEEKIRAFNPRGIILSGSPASVHDENAPPIPNVVFALNRPVLGICYGQQAMCQMLGGKVESHEHREFGRAYIDIAEDCSLFRGVWARGKREQVWMSHGDRVTQLPPGFRAVAHSEGAPFAIIADEGRRLYGVQFHPEVVHTPHGAALIRNFTHNVAGCSGTWTMAGFRELEIARIRKQVGSGRVICGLSGGVDSSVAAKLIHDAIGDQLTCIFVDPGIMRTGEADEVVKTFRGRFNIRLVHRDASELFLKELAGVTDPETKRKTIGRLFIEVFEEEAAKLGGAQFLAQGTLYPDVIESVSFSGGPSVTIKSHHNVGGLPDRMNMELVEPLRELFKDEVRMLGRELGIPESIVGRHPFPGPGLAIRIPGDVTKEKLDLLRKVDAIYLEEIRRAGLYDAIWQAFAVLLPVRTVGVMGDGRTYDQACALRAVTSTDGMTAEVYPFDFAFLNRVAGRIVNEVRGINRVTYDITSKPPGTIEWE

SEQ ID NO: 53465 - protein, 226 aa, marine gamma proteobacterium HTCC2143
MARIIIFIFLGLAAAAFIFFDVGQYLSLDFFKAQKQTIEGYQEQQPLAVAAAYFVTYVIVTAFSLPGAVVMTLIGGALFGLGWGLLLVSFASSIGATLAFLIARIVLRDWVQRRMGHHLSAINEGVEKDGALYLFTLRLVPVFPFFVVNLAMALTPIRILPFYWVSQLGMLAGTVVYVNAGTQLAQIDSLAGILSPALIGSFVLLGFFPWIAKTIVATIQRRKNAG

SEQ ID NO: 53466 - protein, 345 aa, Brassica oleracea
MRIVLSLCSQAKLADEALWVLRKFPEFDLSADTVAYNVVIRLFADKGDLSMGMKLMEEMESIDLSPDVMTYTSLINGFCNAGKVDEAWKLAKGMSEHGCVLNTVTYSRILEGVCKCGEMERALELLTEMEKEEDGGFISPNAVTYTLVIQAFVEKKRVQEALMVLDRMGDRGCSPNRVTASVLIQGVLENGEDVKDLSKLIDKLVKLGGVSLSEFFSSATVSLIRLKRWEEAEKMFRLMLVRGIRPDGLACSLVLRELCLLERYHDCFLLYEEIEKVDVVSTIDTDVHSVLLLGLCEQGRSWEAAKLAKSMLDKKMRLKVSQVEKIIQALKKTGDEDLMRRLSTS

SEQ ID NO: 53467 - protein, 2025 aa, Arabidopsis thaliana
MESSLPQVAALDRSTLLKAFDETKTGVKGLIDAGITEIPSIFRAPPATLTSPKPPSSSDFSIPTIDLKGGGTDSITRRSLVEKIGDAAEKWGFFQVINHGIPMDVLEKMIDGIREFHEQDTEVKKGFYSRDPASKMVYSSNFDLFSSPAANWRDTLGCYTAPDPPRPEDLPATCGFLRPHYSLVCLKDFGGHFFREMMIEYSKEVMKLGKLLFELLSEALGLNTNHLKDMDCTNSLLLLGHYYPPCPQPDLTLGLTKHSDNSFLTILLQDHIGGLQVLHDQYWLITNDKFISVEHRVLANVAGPRISVACFFSSYLMANPRVYGPIKEILSEENPPNYRDTTITEYAKFYRSKGFDACLIRVLGTLIICVMPSFMTVKAMHETVTRSIFGYIIGLCVNSRQLNHLMFQVLLFISMDAKKLDTGPRDAINWLPDEILGKILSLLATKQAVSTSVLSKKWRTLFKLVDTLEFDDSVSGMGEQEASYVFPESFKDLVDRTVALQCDYPIRKLSLKCHVGRDDEQRKACVGRWISNVVGRGVSEVVLRINDRGLHFLSPQLLTCKTLVKLTLGTRLFLGKLPSYVSLPSLKFLFIHSVFFDDFGELSNVLLAGCPVVEALYLNQNGESMPYTISSPTLKRLSVHYEYHFESVISFDLPNLEYLDYSDYALYGYPQVNLESLVEAYLNLDKAEHVESPDVTKLIMGIRNVEILSLSPDSVGVIYSCCKYGLLLPVFNNLVSLSFGTKKTRAWKLLADILKQSPKLETLIIEDLNGYPLDVSMPLNQVKELQILEYGESDDERLQSRLESKNKLGSFDFEKFLFPIPPPIKITVSPHPSDSGGDGSNSKSSSDDEFVSLDSSTSGLCSSSGKFFDLIKFLIALSVLRETKTMESTKIAPSFDRASELKAFDETKTGVKGLVDSGISKIPRIFHHSSVELANPKPLPSDLLHLKTIPTIDLGGRDFQDAIKHKNAIEGIKEAAAKWGFFQVINHGVSLELLEKMKDGVRDFHEQPPEVRKDLYSRDFGRKFIYLSNFDLYTAAAANWRDTFYCYMAPDPPEPQDLPEICRDVMMEYSKQVMILGEFLFELLSEALGLNPNHLKDMECLKGLRMLCHYFPPCPEPDLTFGTSKHSDGSFLTVLLPDNIEGLQVCREGYWFDVPHVPGALIINIGDLLQASLRNQYMFASSDFTSLFTMLDLFKKSSSWFKLITNDKFISLKHRVLANRATRARVSVACFFHTHVKPNPRVYGPIKELVSEENPPKYRETTIRDYATYFNGKGLGGTSALLDFKQLVPSLNLRKMFHSCSVIREAKTMETKNIAPSFDRASELKAFDETKTGVKGLVDSGISQIPRIFHHSSVKLANPEPVSSDLLHLKTIPTIDLGGRVFEDELKHKNAIEKIKEAAEKWGFFQVINHGVSLELLEKMKDGVRGFHEQSPEVRKDFYSRDLTRKFQYSSMSPFLILDLMCNLYSYMVNCFRDVTIEYSEQVMNLGEFLFTLLSEALGLNPNHLNDMDCSKGLIMLCHYYPPCPEPDLTLGTSQHADNTFLTVLLPDQIEGLQVLREGYWFNVPHVPGALIINIGDLLQASLHNQYIFLLCFAELITNDKFVSLEHRVLANRATRARVSVAETKTMEMMKIDPLFDRASELKAFDETKTGVKGLVDSGVSQVPRIFHHPTVKLSTPKPLPSDLLHLKTIPTIDLGGRDFQDAIKRNNAIEEIKEAAAKWGFFQVINHGVSLELLEKMKKGVRDFHEQSQEVRKEFYSRDFSRRFLYLSNFDLFSSPAANWRDTFSCTMAPDTPKPQDLPEICRDIMMEYSKQVMNLGKFLFELLSEALGLEPNHLNDMDCSKGLLMLSHYYPPCPEPDLTLGTSQHSDNSFLTVLLPDQIEGLQVRREGHWFDVPHVSGALIINIGDLLQASSLMHFCSVLHCITYLPYCSFLGFVVLMQLITNDKFISLEHRVLANRATRARVSVACFFTTGVRPNPRMYGPIRELVSEENPPKYRETTIKDYATYFNAKGLDGTSALLHFKI

SEQ ID NO: 53468 - protein, 405 aa, Agrobacterium tumefaciens str. C58
MTGRLVIVGAGQAAFALASKLRALKDERPITIIGSEDAYPYQRPPLSKKYLLGEMSFDRLMFRPEEWYAENNVDIRLSTWVEEIDRAAKTVRMQDGSTLSYDKLALATGAAPRLLPASIGGDLEGVLTVRDKRDADRLVEEMKPGRRLLVIGGGYIGLEAAAVARKLGLEVTLIEMADRILQRVAAKETADIMRGIHQAHGVSIREKTGLVRLVGMDGRVAAAELSDGSMLDVDFVIVGIGVTPNDRLARESGLDVGNGIVVDALTRTSDADIHAVGDCNMLPWRGQHVRLESVQNAVDQAEAAAEVLAGTEAAYEAKPWFWSDQYEVKLQIAGFNLGYDETMLRPGAREGSWSVWYFRDGRFVAVDAVNDAKAYVAGKKLLDIGAEPDRAILADAAADLKLLLS

SEQ ID NO: 53469 - protein, 445 aa, Brassica oleracea
MDMESGKLFIGGISWETTEDRLRDYFQSFGEVLEAVIMKDRSTGRARGFGFLVFADPNVAERVVLLRHVIDGKLVEAKKAVPRDDHKSNSSLQGSSPGPANSKKIFVGGLASSVTEAEFKKYFAQFGTITDVVVMYDQRTQRPRGFGFISYESEDAVDRVLRRTFHELNGKMVEVKLAVPKDPVRNQMNVNGFGSNRISALLMNEYTQGFTPSPISSYGVKPEVRYSPGVVNRGGFSPFGHGYGIDLNFEQDQTQRYGSGSSAGFGRPFSPGYTPSLSRYGSQIETGGGANGSVLNASTKNHLWGNGGGLGYMSNSPVSRSSFNGNSGMSSLGSIGDNWGGAGARARNSYRSEGGGLGLEAMRGVHVGGLSNGLNSLEADSLYSDSAWLSMPAKADEKLGMGAFDFMSRGPAGYINRQPNGGMNNDHLFSSKNMNIFVFLLEKKN

SEQ ID NO: 53470 - protein, 142 aa, Glycine max
  misc_feature (135)..(135): Xaa can be any naturally occurring amino acid
MASLAAVSVKPVAIKGLAGSSISGRKLAVPRPTARSIRRPRAAAVVAKYGDKSVYFDLDDIGNTTGQWDLYGSDAPSPYNPLQSKFFETFAAPFTKRGLLLKFLLLGGGSLLAYVSAVASPDLLPIKKGPYEPSXPGPRGKI

SEQ ID NO: 53471 - protein, 216 aa, Oryza sativa (japonica cultivar-group)
MAAAETSGTVAAPGRWSLHGKMALVTGGTRGIGRAVVEELAALGAAVHTCSRNEAELGERLKEWEARGFRVTISVCDLSARDQRERLIGDVADRFGGKLDILVNNVGTNIRKPTTEYSADEYSFLMATNLESAYHLCQLGHPLLKASGSGSIVFISSVAGIVALFSGTIYAMTKGAMNQLTKNLACEWAKDNIRTNCVAPGYILTSLSEGVSVFLC

SEQ ID NO: 53472 - protein, 263 aa, Oryza sativa (japonica cultivar-group)
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGVKLLLINHPDLSCLDTCHFKSEHVVKYSTNCQDTVFRLHTTVLASRLPSSCF

SEQ ID NO: 53473 - protein, 268 aa, Oryza sativa (japonica cultivar-group)
MAAAAETSAKVGAPRRWSLQGKTALVTGGTRGIGRAVVEELAALGATVHTCSRKEEELSERLKEWEARGFRVTTSVCDLSVRDQRERLLRQVADLFGGKLDILVNNVGTNIRKPTTEFSAEEYSFMMATNLESAYHLCQLSHPLLKASGSGSIVFISSVCGLVAVFSGSLYAMTKGAINQLTKNLACEWARDNIRSNSIAPWYIRTSLTEGVKLLLINHPDLSCLDTCHFKSEHVVKYSTNCQDTVFRLHTTVLASSFWQIRTLKVLW

SEQ ID NO: 53474 - protein, 533 aa, Zea mays
MEAAAELALRLRAAANDRLAHYEPLALVAAPLLALLVARTLHATASAVADRGLIAIAIAAVKLLPGVSGYIAAEKKKVVDKMQSGGAKNNRRAELPTIGLAEQVIEELETLKAKDVDWQGKCSGTVYIAGSESEGHFQLINKAYSMFSHTNPLHQDVFKSVANMEAEVVAMTAALLGSKEKSSGGQICGNMTSGGTESILLAVKTSRDYMRSKKGITRPEMIIAESAHSAYDKAAQYFNIKVRRVPVNKEFLADVKGFKRCINGNTIMMVGSAPGFPHGLIDPIEELGELASRYDICLHVDLCLGGFVLPFAHKLGYPIPPFDFSVKGVTSISSDVHKYGLAPKGTSIVLYRNHEIRKHQFVAVTEWTGGLYVSPTIAGSRPGGLIAGAWAAMMSLGLNGYLDSTSRIMDVSKKIQRGIGEIPGLFVIGKPDMTVVAFGSDVVDIFEVNDIMSSKGWHLNALQRPNSLHICVTLQHTTVYDQFLKDLQDSVNTVKANPGPISGGKAPIYGAAGKMPDRGTVRELLVEFMDSSC

SEQ ID NO: 53475 - protein, 209 aa, Glycine max
  misc_feature (127)..(127): Xaa can be any naturally occurring amino acid
  misc_feature (133)..(133): Xaa can be any naturally occurring amino acid
  misc_feature (150)..(150): Xaa can be any naturally occurring amino acid
  misc_feature (177)..(177): Xaa can be any naturally occurring amino acid
  misc_feature (190)..(190): Xaa can be any naturally occurring amino acid
MACIDKFWVFALALLLLASPLLQVARCQSDSDDVVEAAEESGDIGIVGDDVQDFGDGTFPSAPGIETISVFPKNSARLITAGEESELLVGVKNDGDSSLNVIAIKASVHLPFDHRMLVQNLTAQGFXNGSVPXSAQATFHYLFAGSKFLXQSGTFDLCGTIIYEIDEHPFQSPYFSXTVDVGECSAFRRXDSVILVRLEVQLLSLWGYG

SEQ ID NO: 53476 - protein, 176 aa, Prochlorococcus marinus str. MIT 9515
MDQNNLSKSSEEIVEQRGIVSNRLYKDGITNNSLGNDHIGVELLSVKPEKLYEAISSLKKYGFNYLQCQGGYDEGPGKRLVSFYHLISLQDIEELEEIKEIRVKVFLNRDSDLSVPSLYKIFKGSDWQERETYDMYGINFQDHPNPKRILMPEDWRGWPLRKDYIQPDFYELQDAY

SEQ ID NO: 53477 - protein, 435 aa, Schizosaccharomyces pombe 972h-
MTDLRRNRYSISAGVGKSVLDSLGKFYGSPKRQLPNKFEAGKEYTGYNAPWIPFALDWLKQGKYSSEWIAMGSLNEEPNNMIQLLKLITGDDGNSHLEKAQAATDLEYPVTKLLWNPSSVGSNTDSQLLASTDQQLRLWKTDFEAGIDSPLLCQASLSTHVKTHNNAPLTSFDWCKTDPSYIVVSSLDTTCTVWDIVAQQSKTQLIAHDKEVYDVAFLKDSINVFVSVGADGSVRMFDLRSLDHSTIIYEGDSTFWKRNGDYTNASPPVSAPLLRLSACDSDVNLMATFHHNSSDVQMIDIRVPGTAYATLRGHKGDVNAVKWMPGSKSKLATCGDDCVVSLWDLDQPVNPSPAPTLSVSGTTPGMTGSTSEYVTPVSSVNSMRETASPLNADNQYSPLLSWKLEHEVNNLSWSVKNDGLAVVYGKSLEILKVPQ

SEQ ID NO: 53478 - protein, 279 aa, Gluconobacter oxydans 621H
MIDGHTKLAGVMGWPVEHSRSPLMHNHWCRVNGVNGAYVPLPTHPHGFDQALRGLAAAGFQGVNVTIPHKEAAMLACDELTPTAKRAGAVNTICFVAGRIIGDCTDGTGFCDNLSAHDVAIAGRAMVLGAGGAARAVAAALLDRGCEVVIANRTLERAEALVEALGGGEAVAWYEWPSLLSGCSLLVNATSMGMGGKAGLDWDAALREAAPGLCVTDIVYTPRETPLLLAAQARGLRTVDGLGMLVHQARAGFRAWFGVDPQADRTTFDLLAASLRTDA

SEQ ID NO: 53479 - protein, 503 aa, Schizosaccharomyces pombe 972h-
MSFELSAPVPLSDNSEAILEKEIGETVKIEGDLVEVYEINRTVDFIKSGNYNSVALQFPDEHLADSGKVASILTNLVEANVQILADTNYGSCCVDEVAAEHMSADAIVHYGRACLSPTSRLPVLYVFGRLPINLHKLEKCLTIPLDQNILLVSDTRWYYAQDSILKSLKTLGYQNVYESHLKERIEPNLEEASTSYTIPGRTYSLPKSLSLQDMTLLYIGPDSPTLSSILMSHYSLVNQFLSFDPLSNKIVEESSFTGAKLRRRYALVQRCRDAGVIGIVIGTLGVHRYLHVLNQLRKMILNAGKKPYMLAVGKLNPAKLANFQEIECFVLIACGENSLIDSKEFYRPIVTPFELVKALSSDMSWNNDFILSFDEVLKLSEGKQSKEPSEVLTEESAEPHFSLITGKFVNSTPMRHLDVTLETADAKNNDSSSASIEKRGMRSLAVNGVYSPAAAFLQSKSWSGLDSVDEGEGPSKLYEGQSGIAKGYVGEGSKEKIQRDFGK

SEQ ID NO: 53480 - protein, 479 aa, Streptomyces avermitilis MA-4680
MDLGVRWKLHGDGRTPAPGAVVRPDERLSWPRTVGLGAQHVVAMFGASFVAPVLMGLDPNLAIMMSGVATVIFLLATRGRVPSYLGCSLSFVGVAAVIRAQGGTSATVTGAVFVVGVALFLVGLAVQRFGARIIHAAMPPIVTGAVVMLIGFNLAPVTASTYWPQDQWTALLVMAFTGLAVVCLRGFWSRIAIFLGLVFGYGISWASDRIFGKIHSVDASGKLTDHWRLDLSGVGKADWIGLPSFHGPSFQWSAILVALPVVIALVAENAGHVKAVGEMTGDPLDDKLGTAISADGVASMLSTAVGGPPNTTYSENIGVMAATRVYSTAAYWAAAGFALLFGLSPKFGAVVAAIPGGVLGGITVILYGMIGLLGAQIWLNARVDLRNPLNLVPAAAGIIIGVGGVSLKFTDNFSLSGIALGTLVVIIGYHGLRAMAPAHLKTQEPLLDSGTSSYDEAEGDKAGVSEAGDDKAEDQRASS

SEQ ID NO: 53481 - protein, 365 aa, Glycine max
MLNNNCSSSLLFRGPGLAFSHSIATTCNKRNTCWKAPQAAVRNDFCLPMSSSAVKNRTSIGDIRSLRLITAVKTPYLPNGKFDLEAYDNLVNMQIANGVEGILVAGTTGEGQLMTWDEQIMLIAHTVNSFGNKVKVVGNAGSNCTSEAIKATERGFAVGMNAALHINPYYGKTSLDGLVAHYNSVLSIGPIIIYNIPTRTNQDIPPSVVQNLAQNPNLVGLKECVGNERIKHYTDQGIVVWTGIDKTSHDARWDFGAVGVQSVASNLIPGLMRELMFEGKNATLNSKVIPLFDWLSQEPVPIALNTALAQLGVIKPVFRLPLLPLLVEKRIEFVMLVKEIGREHFVGDKDVQVLDDDDFITVGRY

SEQ ID NO: 53482 - protein, 315 aa, Arabidopsis thaliana
MAATSLTAPPSFSGLRRISPKLDAAAVSSHQSFFHRVNSSTRLVSSSSSSHRSPRGVVAMAGSGKFFVGGNWKCNGTKDSIAKLISDLNSATLEADVDVVVSPPFVYIDQVKSSLTDRIDISGQNSWVGKGGAFTGEISVEQLKDLGCKWVILGHSERRHVIGEKDEFIGKKAAYALSEGLGVIACIGEKLEEREAGKTFDVCFAQLKAFADAVPSWDNIVVAYEPVWAIGTGKVASPQQAQEVHVAVRGWLKKNVSEEVASKTRIIYGGSVNGGNSAELAKEEDIDGFLVGGASLKGPEFATIVNSVTSKKVAA

SEQ ID NO: 53483 - protein, 294 aa, Agrobacterium tumefaciens str. C58
MFKGSIPALITPFTDNGSVDEKAFAAHVEWQIAEGSNGLVPVGTTGESPTLSHDEHKRVVELCIEVAAKRVPVIAGAGSNNTDEAIELALHAQEAGADALLVVTPYYNKPTQKGLFAHFSAVAEAVKLPIVIYNIPPRSVVDMSPETMGALVKAHKNIIGVKDATGKLDRVSEQRISCGKDFVQLSGEDGTALGFNAHGGVGCISVTANVAPRLCSEFQAAMLAGDYAKALEYQDRLMPLHRAIFMEPGVCGTKYALSKTRGGNRRVRSPLMSTLEPATEAAIDAALKHAGLMN

SEQ ID NO: 53484 - protein, 341 aa, Oryza sativa
  misc_feature (66)..(66): Xaa can be any naturally occurring amino acid
MGERASAAAAVAAFGRRAARLRSWQIRPVPAWILRAVRFPPRFFLWRESDVGFKEFLASDLIPPRXDLPFVVAPLHFDCVEQEGCSIQRLLRYLAELLAERHKLSPFIPVLPNSVRLLNQEILRVSTLLENASLLNQSGLEHGSPLTTGGLYSNGAAADMNGWTSAFQSEGSPAYSWRGGSQGSSSGLIVKKTMKVDIPVDKYPTFNFVGRILGPRGNSLKRVEATTDCRVLIRGRGSIKDPAREDMMRGKPGYEHLNEPLHILVEAELPVEIIDTRLIQARDILEDLLKPVDESQDFFKKQQLRELAMLNGTLREEGMQRSGSASPFHNSLGMKRAKTRG

SEQ ID NO: 53485 - protein, 340 aa, Brassica oleracea
MKGLFKSKPRTPSDLVRQTRDLFLYAHGSISLPDSKRDEKMAELSRNIRDMKSILYGNSEAEPVAEACAQLTQEFFREDTLRLLITCLPKLNLETRKDATQVVANLQRQQVNSKLIASDYLEANLDLMDVLIEGFENTDLALHYGAMFRECIRHQIVAKYVLESEHVKKFFDYIQLPNFDIAADAAATFKELLTRHKSTVAEFLTNNEDWFFADYNSKLLESSNYITRRQAIKLLGDILLDRSNSAVMTKYVSSRDNLRILMNLLRESSKSIQIEAFHVFKLFVANQKKPADIVNILVANRSKLLRLLADLKPDKEDERFEADKSQVLREIAALEPQDLA

SEQ ID NO: 53486 - protein, 413 aa, Cryptococcus neoformans var. neoformans JEC21
MSFALRARGLRAATRSLGAKPLRSTLPQVRYVQIDADKSSPMHDLPASGSEPFKVQLHADSFHSYRCDAPPPETTVTKDELINMYRTMVQMRRMEQAADALYKQKLIRGFCHLAIGQEAVSVGMETAITGQDRVITSYRCHTFAVLRGGTIKGVIAELMGRKDGMSFGKGGSMHIFTPSFFGGNGIVGAQVPVGAGVALAQKYNKEKAATFALYGDGAANQGQVFEAFNMAKLWNLPCVFVCENNKYGMGTSAERSSMNTQFFTRGDQIPGLQVNGMDILAVREATKWAREWATSGKGPLLVEFVTYRYGGHSMSDPGTTYRTREEVQQMRSSQDAIAGLKKYILEWGATDEASLKAIDKAAKEEVDAAVEEAKQSPFPDQVEFWSDIYYKGSEPTHMRGREKEEVHYYNKSA

SEQ ID NO: 53487 - protein, 221 aa, Brassica oleracea
MAFHSEDDKSEDYLFKIVLIGDSAVGKSNLLARFARDEFYPNSKSTIGVEFQTQKMDINGKEIKAQIWDTAGQERFRAVTSAYYRGAVGALLVYDISRQQTFQSIGRWLNELHTHSDMNVVTILVGNKSDLKGIREVPTSEGKALAEAQGLFFMETSALDSSNVAAAFETVVKEIYNILSRKVMSSQELNKQDPASLSNGKKVVIPSEEQGESKKGGCCST

SEQ ID NO: 53488 - protein, 241 aa, Populus trichocarpa
MGRGRVQLKRIENKINRQVTFSKRRTGLLKKAHEISVLCDAEVALIVFSHKGKLFEYSTNACMEKILERHERYSYAERQLVATDLDSQGNWTLEYNRLKAKVELLQRNHRHYLGEDLDSVSLKELQNLEQQIDTALKLIRERKNHLMYQSISELQIKEKAIKEQNNMLVKQIKEKEKALAQPALWDQQDHGPNASSFLLPQPPLPCLNISYQEEDPEARRNYELDLTLEPIYSCHLGCFGT

SEQ ID NO: 53489 - protein, 529 aa, Anaplasma phagocytophilum HZ
MLTIAIIDFGSQVTQLIARRVRELGVYSEVFSVDTDFPALLAQGKKIAAFILSGGPNSVSELQNIPKVVSDVLEINLKTGTPIMGICYGFQLLAHSFSSTVESDKAREYGHAQLQIVGESAITKGIWSVGQTACVWMSHSDSVVDNVPQGFNVVARSMNTQAIAFISNEERKIYGLQFHPEVSHTPEGRDILNSFLTTVGCARNWTVSSFLNTQIDDIRRTVGNGVVVAAISGGVDSSVASVLLHRAIGDQLKCVFVDTGLLRKGEVETVREFFVDKLKMSVSIVSAAFLFIERLRGVVDPEEKRKIIGNTFIEVFEQEAKKLGDAQFLMQGTIYPDVIESGASGLGVKIKSHHNVGGLPENMNLSLVEPLRCLFKDEVRALGSELGLPDVILKRHPFPGPGLAVRIIGEVTEEKLQLLQEIDNIYISMLYESGLYHDIWQAFSVLIPARTVGVMGDSRTYGHVCCLRAVTSSDGMTADCFPFGEAKEKQLKFLEFLQKVSVAIVGSLPRVNRVVYDVTSKPPATIEWE

SEQ ID NO: 53490 - protein, 500 aa, Mesorhizobium sp. BNC1
MQTAHTWKADRQQSLRGHTVPTALLIAGEWIERDKSFTVTNPATNEEIARVSDGTAEDALRALEAATASQEAWAAWAPRQRANLFHRAHRLMLERATAFAEVMTLESGKPLAEAKAEFALSADFFLWYAEQIAHLHGTFASGSPGGYRIIATHRPVGPCFLVTPWNFPLLMIARKGGAALAAGCTTIVKSARETPLTAALFAQTLLEAGFPAGTVNLIHTTSSASISEALLADPRLRKVSFTGSTEVGSRLLSGAAQNIVNASMELGGDGPFVVLEDADIDLAVRQAIICKFRNAGQACVAANRIICHAAVVDEFTQKFVDETRKLRVGDGFEPGTDVGPIISSPQLERVDRMVAMLKDAGAELLTGGKRKGVTGNFYEPTVMRIKGSAPACRNEELFAPIAVIYSVDSVAEAIRFANDTIYGLAAYVFTRNVDRAIAVSEKLDFGMVGINRGIMADPAAPFGGIKSSGLGREAGHDGIYEFLEPQYLALTVNEAAGISQ

SEQ ID NO: 53491 - protein, 345 aa, Brassica oleracea
MKKEMIEEVVIVGGLVMVQFVYAGNSLLMSYLMSLGLGPFTIVIFSTFATFLILSPFAILFERKQWPKELSARLIGKLVLISFAGVTLFQSLFLEGIRLTSPAMATAMPNLAPGLIFFIAWIVRLEKMNMKCVYSKLKILGTLLCVFGALTMSLMHSASIIQDEKDNASIFVFDRDRVVGCIYLLGAVFVLSTNVVLQASTLAEFPAPISLSAITALIGVLITMLVQLLQNQSGKVLTRSLISIGNLVGFSLLGGMVSGACVSFNGWAMKKRGPVMVSMFSPFATVISVGFSVLTLGESICLGSVGGMALMFMGLYLVLWAKGKEGFSQIESFECEFDAKKPLLS

SEQ ID NO: 53492 - protein, 162 aa, Populus trichocarpa
MGRGRVQLKRIENKINRQVTFSKRRTGLLKKAHEISVLCDAEVALIFFSHKGKLFEYSTNACMEKILERHERYSYAERQLVATDLDSQGNWTLEYNRLKAKVELLQRNHRHYLGEDLDSVSLKELQNLEQQIDTALKLIRERKNHLMYQSISELQIKLYPIG

SEQ ID NO: 53493 - protein, 332 aa, Buchnera aphidicola str. Sg (Schizaphis graminum)
MTIKIGINGFGRIGRVLFRLAQERENIEVVAINDLLDPKYIAYMLKYDSTHGNFKKDIEVKNNNLIINGKKIRITSIKDPEKLMWDKLLIDVVIESTGLFLTKDTAYKHILSGAKKVVITGPSKDDIPMFVRGANFDKYKGEKIVSNASCTTNCLAPLSKVIDDHFGIIEGLMTTVHASTATQKIVDSASKKDWRGGRGALQNIIPSSTGAAVAVGKVLPNLNGKLTGIAFRVPTANVSVVDLTVRYKKTATYNEICEVVKNASEQKMKGILGYTEDEVVSTDFNGKELTSIFDAKAGLSLNKNFAKLISWYDNETGYSSKVLDLVELVALK

SEQ ID NO: 53494 - protein, 293 aa, Polaromonas sp. JS666
MFFTKPVILEWRPEIAYRLPLLPLPAAPFLTPVFTSSLSFPPDCHTMYKLVLIRHGESTWNLENRFTGWTDVDLTETGIQQAKDAGKLLKAEGYDFDLAYTSVLKRATRTLWHVLDEMDRTWLPVVNSWRLNERHYGALQGLNKAETAKKYGEDQVLIWRRSYDTPPPPLAANDERCERGDPRYAKLPPEQVPLTECLKDTVARVLPFWNESMAPAIKAGKRVVVAAHGNSIRALVKYLDNISDSDIVGLNIPNGIPLVYELDAQLRPLRHYYLGDSEAAARAVAAVSAQGKA

SEQ ID NO: 53495 - protein, 484 aa, Oryza sativa (indica cultivar-group)
MEMTTTKRQQDHQVETMTTKKIDEEDEEVDDDGRAKRRGTVWTAASHIITAVIGSGVLSLAWAIAQLGWVVGPTVMLLFAAVIYFTSNLLADCYRTGDPATGRRNYTYMEAVKANLGGAKVKVCGCIQYLNLLGVAIGYTIAASISMMAIQRSNCFHARGEQDPCHASSNVYMIMFGIVQVFFSQIPDFDQVWWLSILAAVMSFRYSAVGLALGAAQVAQNRTFAGSAMGVAVGFVTKTGDVVTPAQKVWRNLQALGDIAFAYSYSIILIEIQDTLRSPPAEARTMRKATGISVVVTSVFYLLCGCMGYAAFGDDAPGNLLTGFGFYKPYWLLDVANMAIVVHLVGAYQVYCQPLFAFVERRAERRWPNGLPGGDYDLGWIKVSVFRLAWRTCFVAVTTVVAMLLPFFNDVVGILGALGFWPLTVYFPVEMYIAHRRIRRWTTTWVGLQALSLACLLVSLAAAVGSIAGVLLDLKSYRPFRSTY

SEQ ID NO: 53496 - protein, 396 aa, Mesorhizobium loti MAFF303099
MAETSVRNFNINFGPQHPAAHGVLRLVLELDGEVVDRVDPHIGLLHRGTEKLIEAKTYLQAVPYLDRLDYCAPMNQEHAFALAAERLLGIEVPKRGQLIRVLYCEIGRIMSHILNVTTQAMDVGALTPPLWGFVEREKLMVFYERASGSRMHAAYFRPGGVHQDLPRQLVEDIGKWIDPFLKSIDDLDRLLTGNRIFKQRNVDIGIVSLADAWAWGFSGVMVRGSGAAWDLRKSQPYECYSEMDFDIPIGKNGDCYDRYLVRMEEMRQSARIMRQCVDLLLGKESTGPVSNLDGKVVPPKRAAMKRSMEALIHHFKLYTEGYRVPAGEVYAAVEAPKGEFGVYLVSDGTNKPYRCKLRAPGFAHLQAMDFLCRGHLLADVTAVLGSLDIVFGEVDR

SEQ ID NO: 53497 - protein, 201 aa, Mesorhizobium loti MAFF303099
MAASLSELSTYLGERLIGRVNDADIAYGELTMHVEPRNLIEVVTFLRDDQRCQFISIIDVCGADYPSRPKRFDVVYHLLSPKQNVRIRLKVQADEETMVPSITGVFPGADWFERETYDLYGVLFSGHPDLRRLLTDYGFEGHPLRKDFPLTGFVEVRYDDEAKRVIYEPVELKQEFRNFDFLSPWEGTDYVLPGDEKAKTN

SEQ ID NO: 53498 - protein, 329 aa, Arabidopsis thaliana
MGNKRNLGFVIFFWALVVAVVATAIEHRRNERTKGVNGLDKIIIRDRRGRSAEVYLYGGQVSSWKNENGEELLVMSSKAIFQPPTPIRGGIPVLFPQYSNTGPLPSHGFVRQRFWEVETKPPPLPSLSTAHVDLIVRSSNEDLKIWPHKFEYRLRVALGHDGDLTLTSRVKNTDTKPFNFTFALHPYFAVSNISEIHVEGLHNLDYLDQQKNRTRFTDHEKVITFNAQSITKKKHTLQKKLDRLYLSTPDQLRIVDHKKKKTIVVHKEGQVDAVVWNPWDKKVSDLGVEDYKRFVTVESAAVAKPITVNPGKEWKGILHVSVVPSNRKA

SEQ ID NO: 53499 - protein, 586 aa, Gluconobacter oxydans 621H
MCGIAGLSCLPGHHPDQDALERMSQAIFHRGPDGEGRLDLGGAALRHRRLSIVDIAGGAQPFRLGAAALIANGEIYNDPAIRRRFPKTCFQTHSDCEPPLHLWLHDGAGYTHELRGMYAIAIVENEHGRHEMVLSRDPFGIKPLYIAAYEGGIAFASEPQALLAGGFGRRSVRDGARNELMQLQFTTGQDIIFDGIRRLLPGETLRIVDGRIVESRRRHVLHEARDTVPARLSDEQALARLDTALLDSVSAHLRADVPLGLFLSGGIDSSVILAAAHRLGLPHPRTWTARFDAGKADESADAAALAASVGAEHHVLTVTEDMVWRDLPSIVACMDDPAADYAVIPTWFLAREARKDVTVILSGEGGDELFAGYGRYRRVMKPWWKGGRAPYRSGTFGKRFAEHGRQWRRGIAMTELALGVSGLEGAQALDIAEWLPNDLLLKLDRCLMAHSVEGRTPLLDPVVAKAIWPLPEHFKVRDGYGKWLLRRWLQDALPQARPFAPKQGFTVPVGPWIEKQAHRLGPLVARQPCIRAMMPAADVERLFARASQRGVARQAWTLLFFALWHRHHIEGVPVDGDTFETLARAS

SEQ ID NO: 53500 - protein, 333 aa, Zea mays
MGISHVELQFNKMHNHQMFQLSYEILVEGPQSTVQVKRRPVARRKLANFCTKEDCRLSQCWLAIKCDPVVNTGQKQQGLWNRLTEAYNHRRGNMPERSTKSLMSRWDTIKTQCSLFSGYMANVLRENSSGLSDADKTSLAASRFATMEKRPFTLLHCWSILKDEPKWMDHSSNKQVRIIEVAPIGSNIIDLDPKDSFLGSTTSKQHLGQDASKGKTKKARSSSITVSSSDEYLAKMDDLSLQRLSVYQTTMAFEQQKAERDDQFRKQQLEIEQQKLAIERERLERQKRIDEKAEEERILAIDMSICNPAQRAYYKKLQQQILSKIQADMSNIE

SEQ ID NO: 53501 - protein, 721 aa, Photorhabdus luminescens subsp. laumondii TTO1
MNKKILILPGDGIGQEVCDAALPVFQALNLPVTLEIGDIGWTCWEREGNPVPANTWEKIASVDAVLLGAITSKGKEEAQQALPPHLRVKTRNYVSPVIQLRQRLGLYANIRPVRYVEGDRKPFRCCVIRENSEGLYAGFDFKGIPATATTWLQHPNIDKYGPEEAAWTVRLQTRFGLERLFITAFEYAKENNYSRVTFADKPNVMRESGHFAKGIFDTVAAGYPEIKADIHNVDAIALWMVKKPHEFGVIVSENMFGDILSDLAAGVMGGLGLAPSANIGSDIAYFEPVHGSAPGMAGKNKANPAAMFYTIALLLEHLGFADAAQQINCAVDNVIREGRTVTYDLGGSATTQQMAQAIISTLSKKCTSYSASVITVGDELLSGKYPNTNLQDISEYLTEQGYKVKQHQVCADDINQIATAVVRRLGQDTLIVVCGGLGPTLDDKTREAIAKVAGSPLEIRDNVWVEIQKQLEKLGVYCDHSNRFQAMFPSGAKVIPNVTGTAPGFSLNVDSSKIVVLPGPPSQMRLMLSEEHSIPPVAGMRERNYHWTLIGVSESKVGTMVNAFFDGVECDIHYLWKAPYVVVQVITPADAPLSVRQLVNFGAMFENKLVSDCQMTAMEKLSEQYRINWFTDDDELNTYLHTTYAVNNPSKSLSVNITAFPSISSFLSGEEMLGQMTLTTIDDEGRQHSVDFPCNKLLLQQSIPEYAAWSVLCARASKEEM

SEQ ID NO: 53502 - protein, 442 aa, Brucella melitensis 16M
MLTKTNAPSLDNFWMPFTANRQFKAAPRLLASASGMYYTDVDGNQVLDGTAGLWCCNAGHGRKRITEAVERQISTMDFAPIFQMGHNVAFDFAEKLAAIAPGGAEAKLDRVFFTNSGSESVDTALKIAIAYQRAIGQGTRTMVLGREKGYHGVGFGGISVGGLVNNRCVFPQIPADHLRHTLDIEKNAFSKGLPANGIELADDLERLVQLHGAEKIAAVIVEPMSGSAGVILPPKGYLERIRATADKYGILLIFDEVITGFGRLGTPFAVDYFGVVPDLVTTAKGLTNGAIPMGAVFAARKVYDGLMTGPENAIELFHGYTYSGHPVASAAGLATLEIYAEEGLLTRGAGLADYWQEALHSLKGAPNVIDIRNLGLVGAVELASRKDAPGARAYDIFVECFKKGLLIRVTGDVIALSPPLIIEKEQIDTIISVLGDAIKRAA

SEQ ID NO: 53503 - protein, 385 aa, Zea mays
  misc_feature (365)..(365): Xaa can be any naturally occurring amino acid
MAHAQEIQLQIRGIPDEESVDARDGPKAATGRSTRSSFRWWMTVLVDMLMVLCGTTVATLLGRLYFNSGGNSKWMATLTQSGGSPLLVVPLLLSPARSAEERRPAALKMVAIYAGIGVMIGFDNLMYSYALQYLPVSTFSLVAATQLGFNAITSRLINAQRFTALIANSVVVLTFSAAILGVGSSSDETSSNVPRGKYPLGFVLVLAASAVFALILSLFELTFEKVVRVRTARWVLRMQMHTNLVASAVSVAGLLASGDWRTIPGEMASFKDGRTRYVLTLVGTAVSWQAAAVGLVRLIMRVSSLFANVTCTLALPLVPVFAVALFGDRMTGIKIVAMLMAVWGFLSYMYQHYIDARRRAGAENXSNAECRVCATRTGSHAVLPA

SEQ ID NO: 53504 - protein, 470 aa, Gluconobacter oxydans 621H
MVGIASSSSEGPSTQQPRSTARATTLGILAALAGLMFGLDTGVVAGALPFIATDFHAGDALQGWIVSSMMAGATVGSLFAGRISVRFGRTGAMLGAAILFLLGTLLCALAPGPAIMIVGRLFLGLAVGVAAFAAPLYISEITVESVRGAMISFYQLMVSLGIFLAFVSDSLLASGGHWRWMLGVMALPASFFLGIVLILPHSPRWLMMRGEKERARRVLQSLRSDEEVAEAELVDIQSRLQKSSDAGLGLFRSNPNFRRTVFLGMLLQIMQQLSGINALLYYAPRVFQAAHFGTNASIWATTLVGLTNMALTGVAIACVDRWGRRPLLILSCGIAAFSLAGVGTLLAIGAQSFGLQLLLCGFVLLFVAGFAIGEGPLVWTLCSEVQPTRGRDFGIGCSTVTNWAANWAISNMFPLGMAMMGASSTFLMFAVFNGLFILVTVLFVPETKGVSLERLEANLFAGTRLRDLGR

SEQ ID NO: 53505 - protein, 329 aa, Streptomyces griseus
MPIPMLPAHVPTIDISPLSGGDADDKKRVAQEINKACRESGFFYASHHGIDVQLLKDVVNEFHRTMTDEEKYDLAINAYNKNNPRTRNGYYMAVKGKKAVESWCYLNPSFSEDHPQIRSGTPMHEGNIWPDEKRHQRFRPFCEQYYRDVFSLSKVLMRGFALALGKPEDFFDASLSLADTLSAVTLIHYPYLEDYPPVKTGPDGTKLSFEDHLDVSMITVLFQTEVQNLQVETADGWQDLPTSGENFLVNCGTYMGYLTNDYFPAPNHRVKFINAERLSLPFFLHAGHTTVMEPFSPEDTRGKELNPPVRYGDYLQQASNALIAKNGQT

SEQ ID NO: 53506 - protein, 212 aa, Triticum aestivum
GAPPAATSFIGNLPSLVISTSHEADGGVICPVCKDPMPIRTRAKQLPCMHLYHSSCILPWLSSRNTCPVCRYELPTDDPESERSERAATNERDVLGVEEHTHLQEIGEEGSDEPEVEETQDMFNDAVEVTNTSEHGVHVAEQSNRARNHRRWLFIAVAPAVSFVGLALVLCFANHTSSGRRRLCRGSQSASAALVDQKEVGGPCSRYPVHVY

SEQ ID NO: 53507 - protein, 251 aa, Brassica oleracea
MVKIAVGSLGDSFSVASLKAYLSEFIATLIFVFAGVGSAIAFGKITSDAALDPAGLVAIAVAHAFALFVGVSVAANISGGHLNPAVTLGLAVGGNITLITGFLYWVAQCLGSTVACLLLVFVTNGESVPTHGVGAGLGAVEAIVMEIIVTFALVYTVYATAADPKKGSLGTIAPIAIGFIVGANILAAGPFSGGSMNPARSLGPAIVSGDLSQIWIYWVGPLVGGALAGLIYGDVFIGSPYEAVETREIRV

SEQ ID NO: 53508 - protein, 129 aa, Glycine max
MWEMKSLISKCCSQIDVKHLNADSENPVTLDSGIVTTGGGSEQGVDVLVPLCQREPSRLCLSNEGHCIGMHPSTADVLTVLLLALPLHTWSGIKEEKLRVEALSLLATEDLPPLLQEEVLFLRDQLHFL

SEQ ID NO: 53509 - protein, 542 aa, Pediococcus pentosaceus ATCC 25745
MTEKAMSILNNPYLNKGTAFTKEERDQLGLNGLIPPYIQTIDEQVEQVYAQFQTKANDLEKRLFLMQIFNENRVLFYKLFSQHVVEFMPIVYDPTIADTIENYSELYVQSQNATFLSIDDPDMMEEALKNSAAGRDIRLIVVTDAEGILGIGDWGTNGVDISVGKLMVYTAAAGIDPSQVLPVVLDVGTNNQDLLKNPMYLGNRHERIKGDRYYDFVDKFVETAENLFPNMYLHFEDFGRDNAANILNKYKDRYVIFNDDIQGTGIITLAGILGALNISKQKITDQVYLSFGAGTAGAGILGRIYEEMIENGLSEEEAKKHFYMVDKQGLLFDDDETLTPEQKPFARKRSEFDNADELTDLLSVVKAVHPTIMVGTSTQPGSFTEEVVREMAAHTERPIIFPLSNPTKLAEAKAEDLLKWTDGRALIATGIPVGDIEYNGVTYQIGQANNALVYPGLGLGVIASTAKVLNDTMISKAAHSLGGIVDVDQPGAAVLPPVSKLSDFSNTVAKAIAQSAVDQGLTKEKIDNVDQAVEDTRWNPEY

SEQ ID NO: 53510 - protein, 230 aa, Buchnera aphidicola str. Sg (Schizaphis graminum)
MKTNKLVLIRHGQSKWNKLNKFTGWHDIELSDNGINEALKAGSLLKKEKFFFDYAHTSMLKRAIHTLRYILDTLDQSWLPVQKSWRLNERHYGALEGLNKDEMISKYGEEQVNLWRRSFEIIPPQIRLNDKRFPGNDIRYSNIDNNELPLGESLELTAKRVIPYWNKFILPQIKKRNRVLIVAHGNSLRALIQFLNKIDNKKILELNIPTATPIILEFNEEYNSIKWYYL

SEQ ID NO: 53511 - protein, 320 aa, Buchnera aphidicola str. Sg (Schizaphis graminum)
MIKKIGVLTSGGDAPGMNAAIRGVVRTALSEKLEVFGIYDGYLGLYENRMTLLDRYSVSDMINRGGTFLGSARFPGFYKNEIRTIAVNNLNKRNIDALVVIGGDGSYIGAQKLTKMGIPCISIPGTIDNDVAGTDYTIGYFTALETVVEAIDRLRDTSSSHQRISIVEVMGRYCGDLTLAAAIAGGCEFIVLPEIHYKKEELVSEIQAGIEKGKKHAIVAITEYICDVEKLAKYIEKKTNRETRATILGHIQRGGAPVVYDRILASRMGAYAVELLIEGYKGKCVGIQNEKMVFNDITDALKNMKRVFKKDWLITAKKLY

SEQ ID NO: 53512 - protein, 934 aa, Aspergillus fumigatus
MSLLARPAKRKLDEVERIEAPKRHLSARGSRSHGIASDAIQPSILTPELDAALPRPESCPRHEQSETSGEHHWYPNSPRTLNSNLASPTRLESPTQPQRVFSPNASIVLIGIRGTGKSSLAVILAATSGKRMIDADQYFQQVTGRSRAAFKKEYDLTEYRQQEARVMESMLAEHKEGCVIACGPGSMERSGQQLLREYAKTHPVIHIIRDPESIQSYLKAWDTVKVRRFLELSGPVYRACSNLEFFNVSEKGFTDYAGKDNHNHSPLDLELDQRSQASTPFLTLKRLQRDFLKFVAFATGDSTILSGQQASFPLSMQPVESRMYTYAVTVPISSLFERELDIEDLESTADAFELKVDIAEGASDGQGIDSALADRISQAVATIRRNIVIPLIYHVESSLTPVGSPVQHNGPLRRSDDAYLSLIKHGLRLAPEYLTVDLSYSDDILSQVIASKGTSKVIGHFAWSHPCPKGWEDAEPLAMYERARRLGCDMVRLTQPATTIEDNFAVERFRHHVRGLPWQLPVIAFNTTPLGRMSSCFNPVLTSVTPPPLLAEMQSKSLPSLTLREAQEALYASFALDPMQFFVFGANVTYSLSPAMHNAAFKACGIPHKYTIYQSPSLRGLNELVENPYFGGTSVSLPYKTEVIPLLHSMSPHARAIGAVNTLIPIRKFPDGVDTAIESSLYLEKSRAGPTKALHGDNTDWIGIGNCFRRGLSPANAIRPSSTGLVIGAGGMARAAVYSMIHLGVQNIFIYNRTKANAEKLAHHYNRQNLLAHGWGGPNSRSKVHTLQSLQDDWPAEYKPPTVICSCIPAHSIGGVPAPNFQLPSQWLGSPTGGVVVEASLQETKANIMQLAYKPLNTPLMKQMRALSHRGWVALDGLDVLPEQGFAQFELFTGRRAPRRVMRRIVLQEYKEVEGQDEQSAIQSRLENLDGQPT

SEQ ID NO: 53513 - protein, 117 aa, Cryptococcus neoformans var. neoformans JEC21
MSRPALLLASRLGLKVITITVLDSSQGKPASGVKVSLQILKAELTTDIDGRCSTLLSPNVKLSPGIYKMVFFTGDYFKATGTETFYPVITFNYADPSQHYHIPLLLSPFSYTTYRGS

SEQ ID NO: 53514 - protein, 254 aa, Buchnera aphidicola str. Sg (Schizaphis graminum)
MKKKIIAANWKLNGSIKTISYFLTFLKSQISSFLKNNIIIIAPPTVFLERVYKDINSINIHLAAQNIDVNLTGAFTGENSALMMKDIGVKYIIIGHSERRLLHNENNEIIAKKFCLVKNLNLVPILCIGETEAEKKSNKTEKILKEQLNSIFNSFGEKAFRNAVIAYEPIWSIGTGVSADPKNVQLIHKFIKNYIKKYDIVSAENLIVQYGGSVTSLNAGNFLKQPDIDGLLIGSASLKHEEFLKIIKISDSFL

SEQ ID NO: 53515 - protein, 125 aa, Triticum aestivum
  misc_feature (67)..(67): Xaa can be any naturally occurring amino acid
MAMVPAASVVSFSPRPSTGTTFGPRAGSASSSVGAGRVRAAGAPEGGKWWAPMLGWSGRADYIEAAXPAPGMAVVEEEEDKAGRSFVGGLTEEKARHLRARMVETESFHEAMYHSGIASRLGRST

SEQ ID NO: 53516 - protein, 208 aa, Triticum aestivum
MVGTVAKDVTTEPELLLERSRAITVRGSDKEGRAVVRIVGEYFPARALGGRAEEALKAHLRKRVLPEVGEREFVVVYMHSLVDRGDNFPGLGAIRAAYECLPAAAKERLRAVYFVHPGIQARLFFATFGRFLFSSGLYEKLRYMSRLEYLWAHIDKGELEVPECARRHDDELERRPLMDYGIEAADRCSVFDAASMDTPASLRSLRCS

SEQ ID NO: 53517 - protein, 266 aa, Escherichia coli K12
MTEPLTETPELSAKYAWFFDLDGTLAEIKPHPDQVVVPDNILQGLQLLATASDGALALISGRSMVELDALAKPYRFPLAGVHGAERRDINGKTHIVHLPDAIARDISVQLHTVIAQYPGAELEAKGMAFALHYRQAPQHEDALMTLAQRITQIWPQMALQQGKCVVEIKPRGTSKGEAIAAFMQEAPFIGRTPVFLGDDLTDESGFAVVNRLGGMSVKIGTGATQASWRLAGVPDVWSWLEMITTALQQKRENNRSDDYESFSRSI

SEQ ID NO: 53518 - protein, 297 aa, Oryza sativa (indica cultivar-group)
MLMDQILELREKEMNLLKENMVLRDQCKALSSPWSTSVGELKNKQADDDVHRHEDYSGGGVRDDDDRRMMEDVETDLAAANQAGKVLKKGKKKQAKDELDRQKQAEKKRRRLEKALANSAAIISELEKKKQKKREEQQRLDEEGAAIAEAVALHVLIGEDSDEPCHLMLNKHRRCNHWDHSAGFDFAVDAQGADIYPPDGLIQCADHVYAPKGRCIDWGIGQPLPSWGEVKDLQLQAPCYQGMFHQSVACPGFIAAQAVSSLQIGGDSSDITSPSQGATVVNRMLGATNRLNLYREI

SEQ ID NO: 53519 - protein, 455 aa, Arabidopsis thaliana
MRGVTETDKLANGIFHLVCLADLEFDYINPYDSASRINSVVLPEFIVQGVLCVFYLLTGHWFMTLLCLPYLYYNFHLYSKRQHLVDVTEIFNLLNWEKKKRLIEMSSISGLVEDEISSFFESSPPLKNKEEIVANLNQFIELNSSCQGGMRRIVCVTSGGTTVPLEQRCVRYIDNFSSGNRGAASTENFVKAGYAVIFLYRRFSEMMLLYIGSIMSSLGELVNRIAGIFLMIHSLNVLSFQMPKTFKVFHYNLFLSSYQTYVVHGSHSGAVKMAVMDQQAAVAEGRLLKLPFSTIYEYLQMLRLIATILKDVGPCSMFYLAAAVSDFYVPWLSMARTEHKIESGSGPLDIRLAQVPKMLSILRSNWAPKAFCISFKLETDSKILLEKATKALQKYKVHAVVANELLTRKEEVVVVSSSGNVVVRRDSNKPESIVEDNLIRLLVDRHSTYIKESLT

SEQ ID NO: 53520 - protein, 323 aa, Synechococcus sp. RS9916
MTTVTELLQPVELDLETLLSDLRSLIGAGHPILQAAAEHLFSAGGKKIRPGIVLLVSRALSPEGELTARHRRLAEITEMIHTASLVHDDVVDEAATRRGVATVHSRFNHRVAVLAGDFLFAQASWHLANLDDLEVVKLLSRVIMDLADGEVKQGLFRYDTGQSFETYLEKSYCKTASLIANSARAAGVLSEQTPDRLDSLYRFGRQLGLAFQVVDDILDFTGSDQQLGKPAASDLASGYLTAPALYALEEKPALGSLIEREFSEEGDLQQALELVRASDAIQRSRALAETFAREARESLEWLPESPCRRALLDLPEFVLSRLY

SEQ ID NO: 53521 - protein, 248 aa, Streptomyces bikiniensis
MEFEGQVALVTGAGRGIGRATVVRLAEAGCDIALHYNQAKAQAEEVAERIAALGRTVELFPGDLSRPETGRQLVAAVQQKFDRIDILVNSAGITRDKLLLSMEADDIHQVIATNLVGPMFLTQAVALTMLRQRSGRIVNISSAAASRPGKGQSNYAASKAGLEAFTRAMAVELGSRGILVNAVAPGIVKTGLTEALREGAEPELLARQVIGSFAEPEAVAEAVAYLASPRNTHTTGTVLTVDGGLKMV

SEQ ID NO: 53522 - protein, 438 aa, Mycobacterium sp. MCS
MGAHHTATEQSARLFADACAVIPGGVNSPVRAFNAVGGTPRFITSANGYWLTDADDNRYVDLVCSWGPMILGHAHPAVVEAVQRVAADGLSFGAPTPSETELASEIISRVAPVERLRMVNSGTEATMSAIRLARGFTGRPKIVKFSGCYHGHSDALLADAGSGVATLGLPSSPGVTGAATADTIVLPYNDVDAVEEIFEQVGDQIAAVITEASPGNMGAVPPEPGFNAALRRITEEHGALLILDEVMTGFRVSRSGWYGLDPVDGDLFTFGKVMSGGLPAAAFGGRAEVMERLAPLGPVYQAGTLSGNPVAMAAGLATLRTADDAVYAALDKNADRLAGLLTDALTDAGVTHRVQRGGNMLSVFFTAEPVGDFATARASETWRFPPFFHALLDAGVYPPPSAFEAWFVSAALDDEAFDRIAAALPGAARAAAEASRPA

SEQ ID NO: 53523 - protein, 476 aa, Streptomyces bikiniensis
MPESRPAPEPTKTEDGTDARPDTPARPGDTHPVDQMLPPLKLFSAGLQHVAAMYAGVVAPPLVVGIGVGLSTADIAFLMSASLFTSGIATLLQTLGFWKVGARLPFVNGVSFAGVAPMLAIAKAEGPDDALPVIYGAVIVAGVFGFLLAPFFCKLIRFFPPVVTGTVITLIGVSLLPVAFNWAQGGNAQAPDYGSLTYIGLATATLLITVVLRRVLTGFLKQISILLGLVAGTLLSLPLGVADFSAVGDADVIGLPTPFHFGAPQFAAAAIISMCIVMLVSMTESTADVLALGEIVERPADEKTLAAALRADGLGTALSPLFNGFAASAFAQNVGLVAITKVRSRFVVAAAGGILLLLGLCPLLASVVALIPQPVLGGVGIALFGTVAASGIQTLAGAALERGDNVLIVAISLGAGIIPIAAPDFYHAFPEGARIVLDSGISTGCVVAVLLNLAFNHLGRRTDPAPETLPAPAAHH

SEQ ID NO: 53524 - protein, 334 aa, Sulfitobacter sp. EE-36
MTNTQIVIAELPSDSLTPAHFKQTTADMPVAGDGQVLLKVILMSIDAANRSWMKGATYRAAVNAGDAMPTYAICEVVESNSDRLAVGDIVASEATWSNFVVADARKCEKLPKVPQLSNLMSVYGIAGKTAYHGLISVGQPVAGETVLVSAAAGSVGGYVGQIAKALGCRVVGIAGGAEKCKWVTEELGFDACIDYRAPGMSKALRSACPDGVDVYFDNVGGTVLEAALFAMNEKGRIVCCGAVSQYDTETPIGPRNLPGLVVVKRLRMEGFIVMDWTQNDAKALRALQTWVEAGQIKVTEDIVDGLENAPQALIGLLAGENKGKRMVRVAADPS

SEQ ID NO: 53525 - protein, 358 aa, Persea americana
  misc_feature (94)..(94): Xaa can be any naturally occurring amino acid
MSAFCGKYQDELIANAAYIGTPGKGILAADESTGTIGKRLASINVENVESNRQALRELLFCTPGALECLSGVILFEETLYQKTASGKPFVDVLXERGVLPGIKVDKGTVELAGTNGENTTQGLDGLAQRCQQYYSAGARFAKWRAVLKISPNEPSQLAINENANGLARYAIICQENGLVPIVEPEILVDGSHDIDRCADVTERVLAACYKALNDHHVLLEGTLLKPNMVTPGSDAKKVTPEVIAEYTVRALQRTTPAAVPAIVFLSGGQSEEEATLNLNAMNKLKGKKPWTLSFSFGRALQQSTLKTWAGKEENVKKAQSAFLSRCKANSEATLGTYKGDAAKGEGVSESLHVKDYKY

SEQ ID NO: 53526 - protein, 472 aa, Podospora anserina
MAPAMRLTSSALRASLKASSFATKQTAFTAARCYSSKTQTLKERFAELLPEKIEEIKALRKEHGSKVVDKVTLDQVYGGARGIKCLVWEGSVLDAEEGIRFRGKTIPECQQVLPKAPGGSEPLPEGLFWLLLTGEVPTEQQVRDLSADWAARAEIPKFVEELIDRCPSDLHPMAQFSMAVTALEQTSSFARAYAKGINKKEYWGYTFEDSMDLIAKLPTIAARIYQNVFKGGKVAPVQKDKDYSFNFANQLGFGNNADFIELMRLYLTIHTDHEGGNVSAHTTHLVGSALSSPFLSLAAGLNGLAGPLHGLANQEVLNWLTEMKKVIGDDISDESITKYLWDTLNSGRVVPGYGHAVLRKTDPRYSAQREFAQKHMSEDPMFKLVSQVYKIAPKVLTEHGKTKNPYPNVDAHSGVLLQYYGLTEANYYTVLFGVSRAIGVLPQLIIDRAVGAPIERPKSFSTEKWIEICKKL

SEQ ID NO: 53527 - protein, 620 aa, Aspergillus fumigatus
MTLAQNHYVIQLPVTPITIGAVNPRDIAQQWLTNLEIQLGTSPVPELKLKLSELFHEDSWWRDMLALDWDFHTIHTVSEIEQYISRNQPRARLTSFRLQHDGRFQPKIETPVEGLRWISSMFFFESRVGRGTGVLRLTQDEAGVWKAYSLYTSLQELRGFEESVGVRRPKGTIESMPGNTSKENWLERRRGQLEFKNEEPTALLVGQAGLNMAARLQALGISCLVVDRNERIGDNWRKRYRTLVTHDPVEFTHMAYLPFPRNWPQFTPKDKLADWFEAYASIMELNVWLKTNVKSAEYDDSTAQWTVTVVRVDTGSERVLHPRHIVWCTGHSGEPKIPTFPNQAHFKGTIYHGSQHHDASDYDVKGKKVVVVGTGNSGHDIAQNFYENGADVTMLQRRGTYVITAAKGVLMQHEGLHEENGPSTEEADIISESLPYPVKFALDVHFTKRAYEAEKDILNGLKAAGFELDFGVDGAGISRAYMTRGGGYYIDVGCSQLIADGKIKIKRSPEGIAGFNDRGLLLRDGSALDADIVVLATGYDNMRTTVRKILGNRVADRCKDVWDLDEEGEVNAMWRPSGHPGFWFMGGNLALCRIYSKFLALQIKAIEVGLASQDTVHAKL

SEQ ID NO: 53528 - protein, 321 aa, Neorickettsia sennetsu str. Miyayama
MTAYDFLNASFSEKLRSVEEVLHDSMTTFTKLKSIEYAKKMLSSGKRIRALLSLLSFALCKNADTNAEIRAAATIELIHNATLMHDDVVDENSIRRGKPNIKSIHGNKISVLTGDFLLSVAFEIILECKNLSVVLLLSKTAKQLSEGEMLQLQSIGEIVSESEYLEVIARKTAVLFSAAAEIAAILTGKQEYVVILREIGFLIGMAFQITDDVLDYGEPQEVGKSVGNDFRECKFTLPCVIAYRDAKSKAAKKFWREVFFTEEKDIQEARFFMYEVDALAKAMEVARKYLSKAEKKLSIFENGASLLTMKTFLRYAAERPY

SEQ ID NO: 53529 - protein, 319 aa, Magnaporthe grisea 70-15
MASTTSNGNGHPASATNGSNGTSNIPSFAVKAGLAQMLKGGVIMDVTNAEQARIAEEAGACAVMALERVPADIRRDGGVARMSDPAMIREIKAAVTIPVMAKARIGHFVEAQILESLEVDYVDESEVLTPADEKYHIEKSDFAVPFVCGCRNLGEALRRIAEGAAMIRTKGEAGTGDVVQAVTHMRTLKADIARAKAALNEGGMPALRAIARELECDPALLKQTVDLGRLPVVNFAAGGIATPADAALMMQLGCDGVFVGSGIFKSGDPAKRAKAIVQATTHFRDAKMLAEYSSGLGEAMVGINCDSMQQSEKLAVRGW

SEQ ID NO: 53530 - protein, 217 aa, Rhizobium leguminosarum bv. viciae 3841
MPETEKPLFGHPWIFIRGVPSLNFLPPEGPLEVAFAGRSNVGKSSLINALVGQKGLARTSNTPGRTQELNYFVPDGYSGEGGDLPPTAIVDMPGYGYAQAPKEQVDKWTKLVFDYLRGRATLKRVYVLIDSRHGIKKNDDDVLDLLDKAAVSYQIVLTKTDKIKAAGVPKLLAETAEKIRKRPAAYPGVLSTSSEKGDGLDELRQAIAETVGIARWK

SEQ ID NO: 53531 - protein, 112 aa, Brassica napus
MASSMLSSAAVVTSPAQATMVAPFTGLKSSSAFPVTRKANNDITSIVSNGGRVSCMKVWPPVGKKKFETLSYLPDLTEVELGKEVDYLLRNKWDSLVFEFELEHGFGPWTEP

SEQ ID NO: 53532 - protein, 450 aa, Bordetella pertussis Tohama I
MAFDFDLYVIGAGSGGVRAARFAAGYGARVAVAESRYLGGTCVNVGCVPKKLLVYGAHFHEDFEQAAGFGWNPGRPEFDWPTLIANKNREIERLNGIYRNLLVNSGVALHEGHARIVDPHTVEINGQRHSAQHILVATGGWPFVPDIPGKEHAITSNDAFFLPELPRRVLVVGGGYIAVEFASIFDGLGAQTVQVYRRELFLRGFDGSVREHLRDELVKKGLDLRFNTDVERIDKRADGVLAVTLSDGSVLETDCVFYATGRRAMLDDLGLENTGVRLAESGYIEVDDEYRTSEPSILAIGDVIGRVPLTPVALAEGMAVARRLFRPQEYRKVDYDLIPTAVFSLPNIGTVGLTTEQALERGFRVTRYESRFRPMKLTLTQSQEKTLMKLVVDADSQKVLGCHMVGPDAGEIVQGLAVALKAGATKQVFDDTIGIHPTAAEEFVTMRTAT

SEQ ID NO: 53533 - protein, 612 aa, Streptomyces bikiniensis
MSQGPALLPRATDHASPTPPHPVDEILPARRMLPAALQHVASMYAGLTAPPLIISSALGLTPAQLSALLAAALLIAGLGTIAQTLGVYGVGAGLPLVNGVSFAVVSPALATAATQGRDGALPAIFGATLVAGLLCLLLAPVFCRLVRFFPPVVSGCVITLVGISLLPVAGTWARGGDAEAAGFGSPADLALAATTLVITLTVHRMLSGRFLGRVAILIGMLAGTLIAIPLGKVDLDPLAQAPLFALPTPFGFGTPQFVPTVIATAAVVMIVSMMESTAALLALGAVAERPVRDRTIAGSLRALGLATVLGGVLGSFTSTSYAQNVGLVSLSRIRSRYVVTLCGAVLVLMGFVPVLGSFVALVPLPVLGGAGVVFFGSVAVTGIRTLAKAALGTGHNAVIVSVTLAFGLFPVLDPDFYARLPAPVATVLGSGITAGCLVAVLLNYLLNHLGRGTEADPDAISAEQVTALDTADTVLGPKRSSDWTPFQPSGSPSGTPDHGRHTRGTARPAPAWPYVTGPVDPTDTGRHHRPHEVPAPPHRPDEVPPPLHPSAAHEGEPPPAVTENAVFPGPLHPLHPLHPRPTGRPDRPRQRHSAEADPWQHPQTPSASGDSQ

SEQ ID NO: 53534 - protein, 308 aa, Xanthomonas campestris pv. campestris str. 8004
MSYATHADTQLPHVGMHCSGMTNTSIPADLGDWIIAQAIAGHPPEHTLQPLLEAGWSEQDAIDAVEALVRAHVQAHAQAHGLPVPVPVRVPAPLQADASSLLDLGDRQVQVLVSLMLPRVVVLGGLLADDECDALIALARPQLARSRTVDNRDGSEIVHAARTSHSMALQPGQDALCQRIEARIAQLLEWPVEHGEGLQVLRYATGAQYAPHYDYFEPDAPGTPVLLQHGGQRVASLVMYLNTPERGGATRFPDVHLDVAAVKGNAVFFSYDRPHPMTRTLHAGAPVLAGEKWVATKWLRERPLHAPT

SEQ ID NO: 53535 - protein, 457 aa, Zea mays
  misc_feature (367)..(367): Xaa can be any naturally occurring amino acid
MAGLLHLQSTLLPSASALRRRAGAPVPCSSRRRCRVEAKIREIFMPALSSTMTEGKIVSWTAAEGDRLSKGDPVVVVESDKADMDVETFHDGFLAAVLVPAGESAPVGSAIALLAESEEEIPVAQSQAASFSSSSPSPPPPQETAQEASPPPPPPPPSAPVAVSAPALPSPATQGGGRVVASPYAKKLAKDLGVDLFSVTGSGPGGRIVAKDVEAALAAPKKAAPVTAARPDVPLGSTVPFTSMQGAVSKNMVESLAVPTFRVGYTITTDALDQLYKKIKSKGVTMTTLLAAATAMALVQHPVVNCSCRDGKSFTYNKSINIAVAVAIDGGLITPVLQDADKLDIYSLSRKWKELVDKARAKQLQPXEYNSGTFTLSNLGMFGVDRFDAILPPGTGAIMAVGASEPTVVGTKDGRIGIKSQMQVNVTADHRVIYGADLAAFLQTLAKIIEDPKDLTF

SEQ ID NO: 53536 - protein, 510 aa, Brucella melitensis 16M
MNTAVRKIDVKKEAADLLSKLGVDASAYTGGDLTGFSPVSGEEIASIKTHSKEDAEKIIAKADEAFRAWRTVPAPKRGELIRLLGEELRASKEDLGRLVSLEAGKIPSEGLGEVQEMIDICDFAVGLSRQLYGLTIATERAGHRMMETWHPLGVVGVISAFNFPVAVWSWNAALAIVCGNAVVWKPSEKTLLTALACDAIFKRALKRFGDAPEGISQLLLGDREIGEVLVDSPKVPVVSATGSTRMGREVGPRLAKRFARAILELGGNNAGIVCPSADLDMALRAIAFGAMGTAGQRCTTLRRLFVHESVYDALVPRLQKAYASVSVGSPLETSALVGPLIDKQAFDNMQKALKEAAAHGGKVQGGERVDTGYENAYYVRPAIVEMPRQEGPVLEETFAPILYVMKYSDFDDVLASHNAVGAGLSSSIFTLNLQEAERFLSAEGSDCGIANVNIGTSGAEIGGAFGGEKETGGGRESGSDAWKAYMRRATNTINYSKALPLAQGVSFDID

SEQ ID NO: 53537 - protein, 479 aa, Prochlorococcus marinus str. MIT 9515
MAERFSQKNLRVRPSSDEDKIVTNAKEHFEKTLIKISGELVGSVAALEHPSKNLKLNYGEIFLRDNVPVMIYLITQKRYDIVRKFLSVCLELQSTSYQTRGVFPTSFVEEKGKLIGDYGQRSIGRITSADASLWWPILCWYYVNKSGDYSFGKSQSVQRGIQLLLDLVLHPTFEGTPVLFVPDCAFMIDRPMDVWGAPLEVEVLLHGCLKSCINLMELSREDHVSRLLDQRLILTSQWVEDLRSFLLKHYWVTSQTMQILRRRPTEQYGEDQHFNEFNVQPQVVPSWLQEWLENRGGYLIGNIRTGRPDFRFYSLGNSLACMFGVLPSSEQRALFRLVLHNRQHLIAQMPMRICHPHMDVEEWQNKTGSDPKNWPWSYHNGGHWPSLLWFFGTSVLLHQKRFPTEDVILMEEMRSLIEESYWCQLNQLPKQEWAEYFDGPTGTWVGQQSRTYQTWTIVGFLLMHHFLREENNDLDMFDL

SEQ ID NO: 53538 - protein, 398 aa, Escherichia coli W3110
MTLNRYRLRHMAKQGNRSAKRVEKLLRKPDRLISLVLIGNNLVNILASALGTIVGMRLYGDAGVAIATGVLTFVVLVFAEVLPKTIAALYPEKVAYPSSFLLAPLQILMMPLVWLLNAITRMLMRMMGIKTDIVVSGSLSKEELRTIVHESRSQISRRNQDMLLSVLDLEKMTVDDIMVPRSEIIGIDINDDWKSILRQLSHSPHGRIVLYRDSLDDAISMLRVREAWRLMSEKKEFTKETMLRAADEIYFVPEGTPLSTQLVKFQRNKKKVGLVVNEYGDIQGLVTVEDILEEIVGDFTTSMSPTLAEEVTPQNDGSVIIDGTANVREINKAFNWHLPEDDARTVNGVILEALEEIPVAGTRVRIGEYDIDILDVQDNMIKQVKVFPVKPLRESVAE

SEQ ID NO: 53539 - protein, 257 aa, Triticum aestivum
  misc_feature (27)..(27): Xaa can be any naturally occurring amino acid
  misc_feature (48)..(48): Xaa can be any naturally occurring amino acid
AAIPQPVEGVLLHPFPCPCILVSPGFXLLYPLFEKHGAASLPVGVKNXGISDKDAINNIPFAWAFTWAGAWSVFLPFLILQVGKDAALRARLRDEVRAALERHAGEVGFASVRGMPLVRSTVYEVLRMNPPVPLQFGRARRDFVLRSHGGEGFSVAAGEMLCGYQPLAMRDPAVFDRPDEFVADRFVGAEGEALLRYVYWSNGPETGEPAAGNKQCAAKEVVVATACMLVAELFRRYDDFECDGTAFTRLHKRPQPS

SEQ ID NO: 53540 - protein, 231 aa, Streptococcus pyogenes M1 GAS
MVKLVFARHGESEWNKANLFTGWADVDLSEKGTQQAIDAGKLIKEAGIEFDLAFTSVLTRAIKTTNLALENAGQLWVPTEKSWRLNERHYGALTGKNKAEAAEQFCDEQVHIWRRSYDVLPPAMAKDDEYSAHKDRRYADLDPALIPDAENLKVTLERAMPYWEEKIAPALLDGKNVFVGAHGNSIRALVKHIKGLSDDEIMDVEIPNFPPLVFELDEKLNIVKEYYLGGE

SEQ ID NO: 53541 - protein, 448 aa, Mycobacterium sp. MCS
MSHSRPGVLIIGGGFGGLFCARRLSRADVDVTVLDRAAGHLFQPLLYQCATGKLSIGQISRPLREEFARHRNIRTLLGEAIELDPVARSVTALRPDETTFTVDYDVLVVAAGMRQSYLGNEQFAEWAPGMKTLDDALDIRQRLFTAFEIAETLPPGPERTSWLTFAVAGGGPTGVELAGQIREVATKTLAKEFHSIDPEEARVLLFDGGDRVLKTFAPALSLKANDTLRELGVELHFGVHVTDVRRDGITVTPKQGGPDQQFGTRTVLWTAGVEAVRFARHVAEVLGAETDRAGRITVGPDLTVAGHPEIFVIGDLAGREGLPGVAENAMQGGLHAASCIRRDLAGRPRRPYRYRDLGSAAYISHGHALLQVGPLRVSGYAGWVAWGLLHIAFLTGVSNRISTVATWLASIARTGRYHRAFMLGAGDRHDQRYTYSSWDLAEPAPEGN

SEQ ID NO: 53542 - protein, 402 aa, Sulfitobacter sp. EE-36
MGHVVVIGAGQAGSSCVAKLRNSGFEGKITLIGAETVPPYQRPPLSKAYLLGDMALERLYLRPESFYADHGIDLMLGTTVDSIDPAAQTVRVNGGDMAYDDLVLTTGSFPRRLPAHIGGDLAGVHVVRDLSDVDTMGPRFTKGARVLIVGGGYIGLEAASVAAKLGLQVTLVEMGDRILQRVAAPQTSDFIRALHEAHGVTIREGVGLERLTGDTHVTGAELSDGTTLDVDFVIVGVGIGAATALADAAGIVNDNGIMTDSHGRTSAPHVWAAGDCASFPYRGGRIRLESVPNAIDQAELVAENIMGADKEYVAKPWFWSDQYDVKLQIAGLNMGYDRVITRHADADSVAFWYYRGDELLAVDAMNDPRGFMIGRRLIEAGKSPAPALIEDPNTDLKALLKS

SEQ ID NO: 53543 - protein, 909 aa, Coccidioides immitis RS
MKTDFKFSNLLGTVYRKGNLLFTPDGTCLLSPVGNKVSVFDLVHNKSYTLPFSHRSNIARIDLSPNGKLLLSVDEQGKAILTNFPRRLTIYHFSFKSPVSALSFSPSGRHFVVGVGRRVQIWRTPSTPGTGASGELEFAPFVLYRDLAGHFDVVQNIRWSGDSRFFLTASKDLTARIWSLDPEEGFEPTTLAGHREGVIDAWFSDDQESIYTVSKDGALFRWQYGDKPGEPESTSESPILHWRITKKDYFMQQNAKLTCSAFHPKTNLLVVGFSNGIFALYELPEFNQLHLLSVSQSNIDYVTVNNSGEWLALGSAKLGQLLVWEWQSESYILKQQGHLNSMNSLVYSPDGQKIITAADDGKIKVWDINSGFCVVTFTEHTAAVTACEFTKQGNVLFTASLDGSVRAWDLIRYRNFRTFTAPSRQQFSSLAVDPSGEVVCAGSLDSFDIHVWSVQTGQLLDRLAGHEGPVSSLSFAADGSHLVSGSWDRTVRLWNIFARSQTSEPLQLQSDLLCVAFRPDGQQVAASTLDGQLTFWSVKDAIQQAGIDGRRDISGGRKITDRRTAANAAGTKTFTTITYSADGSCLLAAGNSKYICLYDVGTGSLVKKFTVSVNTSIDGTMEFLNSKNMTEAGPRALIDETGEASDLEDRIDRTLPGAKRGDAGARNTRPEIRVTSARFSPTGRSFCASSTEGLLVYSLDTDLVFDPFDLDISITPDSIIATVAAAKSASSTSSTTDPSESSFLKALIMSFRLNESSLIRTVYESIPPRDIPHIVRSLPTVYITRLLRFVANAADETPHLEFNLLWIRALLSIHGRYIKDNSGSFATELRAVQRAVDGIRDDLKRVVDKNMYALDYLLEGPAISTSNSADAVQRTTNGARKAADGDDIVTMDDAGKGSDGEGEWMGIED

SEQ ID NO: 53544 - protein, 185 aa, Erwinia carotovora subsp. atroseptica SCRI1043
MTTVTAQQQAELIKNSIKSIPDYPKPGILFRDVTSLLEDPVAYAASIDMLANRYRNTGVTKVVGTEARGFLFGAPVALALGVGFVPVRKPGKLPRPTISESYELEYGSDTLEIHADAISAGDNVLVIDDLLATGGTLEATVKLIRRLGGTVNDAAFIINLFDLGGEQRLTEMGVTCYSLVDFPGH

SEQ ID NO: 53545 - protein, 533 aa, Rhodobacter sphaeroides 2.4.1
MKQIWQALKAHQQAVEHRAILDLFTDPRRAETFSTRLGDMLFDWSKTNIDHTARDLLIDLAGAAGVAEKREAMFSGAKINETEGRAVLHTALRNMDRPVRVDGVDVTPALRETHARMQAFVRDLRSGRFTGQGGPITDVVNIGIGGSDLGPAMACLALAPYADGPRCHFVSNVDGAHIHDTLQDLDPATTLVIVASKTFTTIETMTNAETAKRWMAKRVSDPAAQFAAVSTAADKTAAFGIDASRVFGFEDWVGGRYSMWGPIGLALMIAIGPEAFDAFLAGGAEMDRHFREAPFAENLPVLLALVGLWHNQICGHATRAVLPYDQRLARLPAYLQQLEMESNGKRVAMDGHELTHHSGPIVWGEPGTNGQHAFYQLIHQGSRIVPCEFLVAREGHEPDLAHQHLLLVSNCLAQSEALLRGRSVEEARAILGKKGLTGSELERQARHRVFPGNRPSTVLAYEKLTPATLGRIVALYEHRVFVEGVILGINSYDQWGVELGKELALALQPMLEGRAGTEGKDGSTAQLVAYLRR

SEQ ID NO: 53546 - protein, 702 aa, Oryza sativa (japonica cultivar-group)
MRRHRPYLDGVAAAAATFLLAVLLHAPLAAGEDEPPPWVLCGPYPPSGNYSKNGTYQVNLDLLSTTLPKNTSSSPAMYATGTVGDVPDKVYGLALCRGDANASACERCVAAALRDAPRRCPLVKDVLVFYDLCQLRYSNRDFFLDDDYFVTTYTLQRSRRVGAAAAAAFDAAVAVLVNATADYAAADSSRRYGTGEEEGVDGDSDRPKIYALAQCTPDKTPEVCRTCLSTVIGQLPKEFSGRTGGGMFGVWCNFRYEVFPFFSGRPLLQLPAFVETPPPPPSPSATSGEKTKNRIGTVLAIVMPAIAAILLMVVACFCCWKRIKKRRPEEQTFLSCKSAKNYDSVSSDDIQSIDSLILDLPTIRVATDDFADTKMIGQGGFGMVYKGVLPDGQEIAVKRLCQSSRQGIGELKSELILVAKLYHKNLVRLIGVCLEQQEKILVYEYMPNGSLDIVLFDTDKNRELDWGKRFKIINGIARGLQYLHEDSQLKIVHRDLKASNILLDFDYSPKISDFGLAKIFGGDQSEDVTNRIAGTYGYMAPEYAMRGNYSIKSDVFSFGVLVLEIITGRRNTGSYDSGQDVDLLNLVWEHWTRGNVVELIDPSMGDHPPIEQMLKCIHIGLLCVQKKPASRPTISSVNIMLSSNTVRLPSLSRPAFCIQEVSASDSSNPYSERYPRPRHSGYSDNSTVVSSNDLSITELVPR

SEQ ID NO: 53547 - protein, 643 aa, Oryza sativa (japonica cultivar-group)
MACYYLAAAAAGLALLLLHAPLTDAQTLVPLCGDSGNYTEHGTYHANIQYLATSLPSYASSSPSLFASGSSGTVPDAIYALALCRGDTNSSSCATCVAAAIQSAQELCPLVKTVIVYDDTCILRFANDAFPISPTSNSQGMVVAWKAQNVSAAVAPAFEAAVVRLINTTADYAATDSVRRFGTGEEAFDETTFPKIYSLAQCTPDMAATACRSCLEDIVGRMVSGNLIGRMGGRVLGVRCNLWFEVYPFFSGRSLLQLPGPSPSPAPPVTAAGERSKNKRSAILAISMPTIALVLATIAAWFCSTSWRRRRLARKTLRPKSSEDEMQSFASLVLDLQTLRTATDNFSEHKRLGEGGFGVVYKGDLPEGQEIAVKRLAQTSRQGIEELKTELLLVAKLNHNNLVRLIGVCLEENEKILAYEYMPNRSLDTILFDAERIKELDWGQRFKIINGIARGLQYLHEDSQLKIVHRDLKASNVLLDSAYNPKISDFGLAKIFERDQSQVITHRIAGTYGYMSPEYAMRGQYSMKLDVYSFGVLVLEIITGRRNFGSYGSDHVVDLIYVTWEHWTSDKAIELIDPSLGNHYPVDKVLKCIHIGLLCVQPKPADRPLMSAVNAMLSSTGTVRLPCLSRPSFWVQEIGATAS

SEQ ID NO: 53548 - protein, 219 aa, Arabidopsis thaliana
MTLSRVHQQLITFPAVKTSPAGYLPDPASINKLQIPTSSKFSFLTGKGKSMLRKKKNDSFTNGVRDQDKLGPKLTETVKRKLSLGARILQMGGLEKIYKRLFKVSDEEKLFKAYQCYLSTTAGPIAGLLFISSKKIAFCSERSIKVASPQGELNRVHYKVSIPLCKINGVNQSQNTTKPSQKYLEVVTVDGFDFWFMGFLSYQKAFNCLEQALSLSFKQ

SEQ ID NO: 53549 - protein, 426 aa, Neisseria gonorrhoeae FA 1090
MNRNEILFDRAKAIIPGGVNSPVRAFGSVGGVPRFIKKAEGAYVWDENGTRYTDYVGSWGPAIVGHAHPEVVEAVREAALGGLSFGAPTEGEIAIAEQIAEIMPSVERLRLVSSGTEATMTAIRLARGFTGRDKIIKFEGCYHGHSDSLLVKAGSGLLTFGNPSSAGVPADFTKHTLVLEYNNIAQLEEAFAQSGDEIACVIVEPFVGNMNLVRPTEAFVKALRGLTEKHGAVLIYDEVMTGFRVALGGAQSLHGITPDLTTMGKVIGGGMPLAAFGGRKDIMECISPLGGVYQAGTLSGNPIAVAAGLKTLEIIQREGFYENLTALTQRLANGIAAAKAHGIEFAADSVGGMFGLYFAAHVPRNYADMARSNIDAFKRFFHGMLDRGIAFGPSAYEAGFVSAAHTPELIDETVAVAVEVFKAMAA

SEQ ID NO: 53550 - protein, 262 aa, Arabidopsis thaliana
MKITTEALRWWEDGETVGGRDLVGGGTWLGCTRHGRLAFLTNFKEASSFPAAKSRGDLPLRYLQSEKSPAEFAEEIQDEISLYNGFNLVVAHVLSKSMIYITNRPPHGDKLVTQVSPGIHVLSNANLDSPWPKVNSPNCVFLSLQCLRLREGFQQLLAENGSGEFPVKTMVEEVMTNTVKDEETELPHVFTPETEYHLSSIFVDMQRPTGRYGTRSISAIIVKSHGDGGGDGEICFYERHLEEGDSWKEHTQQFVIIQNQSI

SEQ ID NO: 53551 - protein, 368 aa, Debaryomyces hansenii CBS767
KHCTTNKQHSENAYIRCTIFDSKGDIVVHGKDIRRLQFMKTHNLVPRDFRKITRHYHGSNMSSMNNINVDIVPSIVTRGNSILLNLSNIKALIKSDTVVIFDSLSKNSGSGMNKSHSHGSFLKDMNEKLKTKNEQDDLPYEFRALECISIHVMLNLTTEMNVHKTVLQNILSRLEESIERVKLRYLLIQSKKIAQFHQKTKLIRDLLDNILEQNDELNALYLTEISKGKPRLQANHAEAEMLLESYYKTIDEIVQTVENLRSQIKTSEEIINIVLDSNRNELMLLGLKFSTGLLSMGCALYIAALYGMNLENFIEETDGGFELVVGGGSILLLILLMFSVKQLKKVQRITMTGMGRENSRISINDNKR

SEQ ID NO: 53552 - protein, 389 aa, Petunia integrifolia subsp. inflata
MANDILMKLPEDLVFLVLLTFPVKSLLRFKCISKAWSILIQSTTFINRHVNRKTNTKDEFIIFKRSIKDEQEGFKDILSFFSGHDDVLNPLFPDVEVSYMTSKCNCTFNPLIGPCDGLIALTDSIITILLNPATRNFRLLPPSPFGCPKGYHRSVEGVGLGLDTISNYYKVVRISEVYCEEAGGYPGPKDSKIDVCDLGTDSWRELDHVQLPLIYWVPCSGMLYKEMVHWFATTDESMVILCFDMSTEMFRNMEMPDSCSPITHELYYGLVILCESFTLIGYSNPISSIDPVKDKMHIWVMMEYGVSESWIMKYTIKPLSIESPLAVWKKNILLLQSRSGRLISYDLNSGEAKELNLHGFPDSLSVIVYKECLTSIPKGSEYSTKVQKF

SEQ ID NO: 53553 - protein, 171 aa, Brassica napus
DSEIEKIIAERYGKKKKKKGRSTSVKKKKKRDVSESDSGDGKRVRRLKKRRTHKRRSVSESEDEGKGRSKRRGRKRGDDSNESSDEDDDRRQVKRKSRREKRRRRSRRSGSDDSDSDSSEDDGRGRRQKRRSKLAASSDSNVSGDDGTRVGRGSSKRSEKKSRKRHRRRKD

SEQ ID NO: 53554 - protein, 416 aa, Kluyveromyces lactis NRRL Y-1140
MSLSSKLTVKDLDVTGKRVFIRVDFNVPLDGKKITSNQRIVAALPTIQYVLEKKPKAIVLASHLGRPNGEVNDKYSLAPVADELSRLLQKPVTFLHDCVGEEVTNAVNNAKDGEVFLLENLRFHIEEEGSRKVDGNKVKADKAAVTKFREQLSSLADVYVNDAFGTAHRAHSSIVGFDLPNRAAGFLLSKELQYFAKALENPTRPFLAILGGAKVADKIQLIDNLLDKVDSLIIGGGMAFTFKKVLENTEIGDSIYDAAGAELVPKLVEKAKKNNVKIVLPTDFVIGDKFSADANTKVVTDKEGIPSGWQGLDNGPESRKAFAATVAEAKTIVWNGPPGVFEFAPFAKGTEALLDAVVASSQAGNTVIIGGGDTATVAKKYGVVDKISHVSTGGGASLELLEGKELPGVTFLSNKQ

SEQ ID NO: 53555 - protein, 389 aa, Petunia integrifolia subsp. inflata
MANGILKKLPEDLVFLILLTFPVKSLMRFKCISKAWSILIQSTTFINRHINRKTNTKDEFILFKRAIKDDEEEFINILSFFSGHVDVLNPLFPDMDVSYMTSKCDCTFNPLIGPCDGLIALTDTIITIVLNPATRNFRVLPASPFGCPKGYHRSVEGVGFGLDTISNYYKVVRISEVYCEEADGYPGPKDSKIDVCDLSTDSWRELDHVQLPSIYWVPCAGMLYKEMVHWFATTDMSMVILCFDMSTEMFHDMKMPDTCSRITHELYYGLVILCESFTLIGYSNPISSTDPAHDKMHIWVMMEYGVSESWIMKYTIRPLSIESPLAVWKNHILLLQCRSGLLISYDLNSGEAKELNLHGFPDSLSVKVYKECLTSIPKGSEYSTKVQKF

SEQ ID NO: 53556 - protein, 388 aa, Petunia integrifolia subsp. inflata
MANGVLKKLPEDLVCLILLTFPVKSLMRFKCISKTWSILIQSTTFINRHVNRKTNTKDEFILFKRAIKDEQEEFRDILSFLSGHDDVLNPLFADIDVSYMTSKCNCAFNPLIGPCDGLIALTDTIITIILNPATRNFRLLPPSPFGSPKGYHRSVEGVGFGLDTISNYYKVVRISEVYCEEDGGYPGPKDSKIDAFDLSTDSWRELDHVQLPLIYWLPCSGMLYKEMVHWFATTDMSTVILCFDMSTEMFRNMKMPDTCSVTHKQYYGLVILCESFTLIGYPNPVSPIDPAHDKMHIWVMMEYGVSESWIMKYTIRPLSIESPLAVWKKNILLLQSSSGLLISYDLNSGQAKELNLHGFPDSLSVIVYKECLTSIQNGSEYSTKVQNF

SEQ ID NO: 53557 - protein, 290 aa, Triticum aestivum
YRRPTRPEIGQAIALDTRIPLVSFTGSTKVGQMVQQQVSARFGKCLLELSGNNAIIVMDDADIPLAVRSVLFAAVGTAGQRCTTCRRLLLHESIYQTFLDQLVEVYKQVRIGDPMEKGTLLGPLHTTASKESFLKGIQNIRSQGGKILLGGSAIESEGNFVQPTIVEISPAAPVVREELFGPVLYAMKFQTLKEAIEINNSVPQGLSSSIFTRKPDAIFKWIGPHGSDCGIVNVNIPTNGAEIGGAFGGEKATGGGREAGSDSWKQYMRRATCTINYGSELPLAQGINFG

SEQ ID NO: 53558 - protein, 370 aa, Brucella melitensis 16M
MASRKLLLLPGDGIGPEAMAEVRKVIAFLNSDLNLGFETEEGLVGGCAYDAHGQAISDADMEKALAADAVLFGAVGGPKWDSVPYEVRPEGGLLRLRKDMQLYANLRPAICYPALAHSSSLKPEVIEGLDILILRELTGGVYFGEPKEIIDLGNGQKRGIDTQVYDTYEIERIADVAFELARTRRNKVTSMEKRNVMKSGVLWNQGVTARHKEKHADVQLEHMLADAGGMQLVRWPKQFDVILTDNLFGDLLSDVAAMLTGSLGMLPSASLGAADSKTGKRKALYEPVHGSAPDIAGKGIANPIAMIASLAMCLRYSFGLVAEADRLEAAIAGVLDDGIRTADIWSEGNTKVGTTEMGDAILAKFKALSA

SEQ ID NO: 53559 - protein, 274 aa, Zea mays
MAAATAAASTMSLLPISQLRQQHGAGAMRRRPWVARRRRYVVPTARLFGPAIFEASKLKVLFLGVDDEAGSKQHGPLPRTYTLTHSDVTARLTLAVSHTINRAQLQGWYNRLQRDEVVAEWKKVRGRMSLHVHCHISGGHFLLDLIAGLRYVIFRKELPVVLKAFVHGDGDLFSRHPELEEATVWVYFHSNLARFNRVECWGPLRDAAAPAEDDSTAPPDASNSKEAGQMMAMCEWPHRCPQQCGCCFPPHSLIPWPNEHDMAAADASGSAQQQ

SEQ ID NO: 53560 - protein, 145 aa, Pediococcus pentosaceus ATCC 25745
MSTEKSLILVKPDGVQCGHIGHVISRIENRRYEIKALKMVNATEEQLRQHYSQLVDKPYYADIEKFMTSGPIVAIIAEGNEIIDTFRKMAGPTNPSEAMAGTIRGDFARAWGPGPIKNVVHSSDSVESAEKEIKIWFPERINTEN

SEQ ID NO: 53561 - protein, 110 aa, Brassica napus
  misc_feature (2)..(2): Xaa can be any naturally occurring amino acid
  misc_feature (27)..(28): Xaa can be any naturally occurring amino acid
  misc_feature (43)..(44): Xaa can be any naturally occurring amino acid
MXFFRSVAAFTRLRSRVGQQSSLGSSXXWIQMQSSTDVDLKVXXLQELIPEQQDRLKKLKLTSCVYLNAYFPPFPKPIPHPPQPIPQNLLSLSPPPPPPLTYPSYSSPPP

SEQ ID NO: 53562 - protein, 252 aa, Ustilago maydis 521
MAAQAQQLQQKVEYFIAQVCIQPISPLQFYISCFLPICVVHDLASSYFRCLAINRLTNTHDCDGCLLLNAVPNRNFPSNNFDRRNISWVYTIVDNGCSRLQIDKERQAQICIGAHSFAAYCAYSPATLHGIAWFVFFNIAAGFLTNLLGFFVPAYFSLKALESPQPQDDIQWLTYWVVFGMFTFLETFINIVLYYVPWYYTIKTLAIVWLMLPQTQGAKMVYSKVIRPAFLTTQKTVHQANASTPAAPAETH

SEQ ID NO: 53563 - protein, 503 aa, Burkholderia vietnamiensis G4
MLITDPQATASTGNQSDAHAKEIHNFINGEYVPGQRWFEKRSPLNNAVIAKVAEAGRAEVDAAVAAAQAALKGAWGRMSLAQRVEVLYAVADGINRRFDDFLAAEVEDTGKPMSLARHVDIPRGAANFKIFADVVKNVPTEFFEMPTPDGVGAINYAMRRPVGVVGVICPWNLPLLLMTWKVGPALACGNTVVVKPSEETPQTAALLGEVMNTAGVPPGVYNVVHGFGPNSTGEFLTTHRGINAITFTGETRTGAAIMKAAADGARPVSLEMGGKNAAIVFADCDLDAAIEGTLRSCFANCGQVCLGTERVYVERPIFDRFVSALKKGAEGMQLGRPEDLATGMGPLISQEHRDKVLSYYKKAVEAGATVVTGGGVPDMPEALKGGAWVQPTIWTGLGDDSVIAREEIFGPCALVMPFDSEEEVIRRANDNDYGLATAIWTTNLSRAHRVAGAIEVGIAWVNSWFLRDLRTPFGGAKQSGIGREGGAHSLEFYTELKNVCIKL

SEQ ID NO: 53564 - protein, 1071 aa, Neisseria gonorrhoeae FA 1090
MPKRTDLKSILIIGAGPIVIGQACEFDYSGAQACKALREEGYKVILVNSNPATIMTDPEMADVTYIEPIMWQTVEKIIAKERPDAILPTMGGQTALNCALDLARNGVLAKYNVELIGATEDAIDKAEDRGRFKEAMEKIGLSCPKSFVCHTMNEALAAQEQVGFPTLIRPSFTMGGSGGGIAYNKDEFLAICERGFDASPTHELLIEQSVLGWKEYEMEVVRDKADNCIIICSIENFDPMGVHTGDSITVAPAQTLTDKEYQIMRNASLAVLREIGVDTGGSNVQFAVNPENGEMIVIEMNPRVSRSSALASKATGFPIAKVAAKLAVGFTLDELRNDITGGRTPASFEPSIDYVVTKIPRFAFEKFPAADDRLTTQMKSVGEVMAMGRTIQESFQKALRGLETGLCGFNPRSEDKAEIRRELANPGPERMLFVADAFRAGFTPEEIHEICAIDPWFLAQIEDLMKEEKSVSDGQLQDLDYAALRRLKRKGFSDKRLAQLLNVSEKEVREHRYALKLHPVYKRVDTCAAEFATETAYLYSTYEEECESRPSDRKKVMILGGGPNRIGQGIEFDYCCVHAALALRESGFETIMVNCNPETVSTDFDTSDRLYFEPLTLEDVLEIVRTENPWGVIVHYGGQTPLKLANALVENGVNIIGTSADSIDAAEDRERFQKVLNDLGLRQPPNRIAHNEEEALVKAEEIGYPLVVRPSYVLGGRAMQIIHSAEQLQKYMREAVQVSEDSPVLLDFFLNNAIEVDVDCVSDGKDVVIGGIMQHVEQAGIHSGDSGCSLPPYSLSEEIQDEIRRQTKAMAYALGVVGLMNVQFAVQDGVVFVLEVNPRASRTVPFVSKATGVPLAKVGARCMAGISLKEQGVEKEVVPDFYAVKEAVFPFIKFPGVDTILGPEMRSTGEVMGVGASFGEAYYKAQLGAGERLNPTGKIFLSVREEDKERVIKTAKNFQALGYGICATRGTAQYLTEHGLIVQAINKVPEGRPHIGDALKNGEIALVVNTVSSDPQSVSDSHIIRQSALQQRVPQYTTTAGGEAMSEGAKSRDYLGVYSVQELHGRLKNRN

SEQ ID NO: 53565 - protein, 541 aa, Oenococcus oeni
MTDPVSILNDPFINKGTAFTEAEREELGLNGLLPAKVQALQEQVDQTYAQFQSKVSNLEKRLFLMEIFNTNHVLFYKLFSQHVVEFMPIVYDPTIADTIENYSELFVEPQGAAFLDINHPENIQSTLKNAANGRDIKLLVVSDAEGILGIGDWGVQGVDIAVGKLMVYTVAAGIDPSTVLAVVIDAGTNNEKLLKDPMYLGNKFNRVRGDKYYDFIDKFVNHAESLFPNLYLHWEDFGRSNASNILNSYKDKIATFNDDIQGTGIVVLAGVLGALKISGQKLTDQTYMSFGAGTAGMGIVKQLHEEMVEQGLSDEEAKKHFFLVDKQGLLFDDDPDLTPEQKPFAAKRSDFKNANQLTNLQAAVEAVHPTILVGTSTHPNSFTEEIVEDMSGYTERPIIFPISNPTKLAEAKAEDVLKWSNGKALIGTGVPVDDIEYEGNAYQIGQANNALIYPGLGFGAIAAQSKLLTPEMISAAAHSLGGIVDTTKVGAAVLPPVSKLADFSRTVAVAVAKKAVEQGLNRQPIDDVEKAVDDLRWDPKY

SEQ ID NO: 53566 - protein, 473 aa, Ralstonia metallidurans CH34
MTTESQAQCPFQTAKSPPPAGSPLPHPYGTWPPGPAAGLTGWHLLRRMSRDLLGTLGEWQQTYGDVVHLRMWPEHAVVVTDPQLVRELLVTHHDSLIRWERGTRVFSRVHGHSVLTAEGDAWSRKRQALQPGFMPKAVHGFVPGIVEIVDKGLATWPTRVADWPVESALTSLTMDVIVRMMFSDEIGEDARVAECAVRAISEAANADFYWPASLPDWVPWKRARRRALHTLRDLIERHLQARLRMRTDTWPDDLLSRLLCLHRDDATAWPLQAVRDECMTTFLAGHETTAATLTWWAWCMASNPSAQDAARAEVTHVLRGQAPTADSRQALRQVVQTITESMRLYPVAPVLISRRAVRPITLGPWRLPARTLFMLPLQLMHHDPRLFPEPERFQPDRFSTGSPQAPRGAYMPFGTGPRVCLGQHLATAEMTVIAAMLLQRYKLSVPEGAAHPRPLLNVTLRPDQPLWLAVTPI

SEQ ID NO: 53567 - protein, 540 aa, Lactococcus lactis subsp. lactis
MRAHEILNNPFLNKGTAFTMKERQELGLIGLLPPTVQTIEEQAVQTYEQYLTKPSDLEKRHFLMEIFNTNRTLFYYLFNKHIVEFNPVVYDPTIADTIENYSHLFVDPQYAAYLDINHPENITETLKKAAGDREIRLIVVTDAEGILGIGDWGTQGVDISVGKLMIYTAAAGIDPASVLPVVIDAGTNRKELLEDHLYLGNHQERIYGDQYYSFVDQFVETAESIFPKLYLHWEDFGRSNAATILNNYKTKIPTFNDDIQGTGIVVLGGIFGSLDITGEKLTDQVYLCYGGGSAGAGIAGRVHAEMVSEGLSEEEAYKHFFMIDQQGLLFDDMEDLTPAQKPFAKKSADYKDAGDMTDLLNVVKTVKPTILVGTSTNPGAFTKEVVEAMCANTERPVIFPISNPTKKMETTAEQVIEWSDGKAFVATGVPSGTISYKGVDYQIGQANNSLIYPGLGLGMLASEAKLLTDEMIGAAAHSLSGLVDPGKPGAPVLPPFEFVADVSIKVAEAVAKKAQEQGLTESKETDMAKAVRDLKWYPEY

SEQ ID NO: 53568 - protein, 573 aa, Staphylococcus carnosus
MAKQIKGIAASDGVAIAKAYLLVEPDLSFDNESVTDTDAEVAKFNGALNKSKVELTKIRNNAEKQLGADKAAIFDAHLLVLEDPELIQPIEDKIKNESVNAAQALTDVSNQFITIFESMDNEYMAERAADIRDVSKRVLAHILGVELPNPSIVDESVVIIGNDLTPSDTAQLNKEYVQGFVTNIGGRTSHSAIMSRSLEIPAVVGTKSITEEVEAGDTIVVDGMTGDVLINPSDEVIAEYQEKRENFFKDKQELQKLRDAESVTADGHHVELAANIGTPNDLPGVIENGAEGIGLYRTEFLYMGRDQMPTEEEQFEAYKAVLEAMKGKRVVVRTLDIGGDKELPYLDLPEEMNPFLGYRAIRLCLDQPEIFRPQLRALLRASVFGKLNIMFPMVATIQEFRDAKALLEEERANLKNEGYEVADDIELGIMVEIPSTAALADIFAKEVDFFSIGTNDLIQYTMAADRMSERVSYLYQPYNPAILRLVKQVIEASHAEGKWTGMCGEMAGDQTAIPLLLGLGLDEFSMSATSILKARRLIRSLNESEMKELSERAVQCATSEEVVDLVEEYTKNA

SEQ ID NO: 53569 - protein, 309 aa, Bordetella pertussis Tohama I
MNQPSSLAADLRGAWHAQAQSHPLITLGLAASAAGVVLLLVAGIVNALTGENRVHVGYAVLGGTAGFAATALGALMALGLRAISARTQDAMLGFAAGMMLAASAFSLILPGLDAAGTIVGPGPAAAAVVALGLGLGVLLMLGLDYFTPHEHERTGHQGPEAARVNRVWLFVLTIILHNLPEGMAIGVSFATGDLRIGLPLTSAIAIQDIPEGLAVALALRAVGLPIGRAVLVAVASGLMEPLGALVGVGISSGFALAYPISMGLAAGAMIFVVSHEVIPETHRNGHETIATVGLMAGFAVMMFLDTALG

SEQ ID NO: 53570 - protein, 521 aa, Ustilago maydis 521
MDSSHGTTSRSPEPVTISTPTGNQWQVPSGIFINNSFHASVSGKTFDSINPATGEKLCTLALGGAADIEAAVKAARTAFKTTWGKKSTPTQRSQLLLKFADLVDKNLDELAELESMDNGKPVWMASSFDVPDSAACLRYYGGLADKIEGKTIEQTEGEKIAYTRIEPLGICGQIIPWNYPIQMAAWKLGPALAAGNCVILKPAEQTPLTALKLAQLSVQAGFPAGVISVVNGYGAEVGEAISRHMDIQKVAFTGSTATGKRIMKAAAESNMKKVTLELGGKSPVVVFESADIQQAVRWVCLGILFNQGQDCTAGSRLFVQDRIYESFMEQLVAAFKAHKVGDPFHQLTFQGPQVSQQQQEKILDMIESGKRQGAKVEVGGQAWKSADSKFNKGFFVEPTIFSGCRKGMRIVDEEIFGPVLAVAKFSTEEEAIRLANETVYGLGAGVFSENASQIQRMVSAIDAGTVWVNNYVALSNSVPFGGMKASGFGRELGVDAIKAYCDVKAIHWNYGEKLDWPLPKL

SEQ ID NO: 53571 - protein, 124 aa, Brassica napus
MASKTLILLGVFAFLLVVSEMAAASAQKSESEDTVQPDRYGGGHGGNEGYNGRGGYNRGGGHNGGGGYNGGGGYNGGGGYNGGGGYKGGRGGGYKGGRGGRGGHGGRGGHGGHGAEAVQTQPGN

SEQ ID NO: 53572 - protein, 293 aa, Oryza sativa (japonica cultivar-group)
MAAAETSGTVAAPGRWSLHGKMALVTGGTRGIGRAVVEELAALGAAVHTCSRNEAELGERLKEWEARGFRVTISVCDLSARDQRERLIGDVADRFGGKLDILVNNVGTNIRKPTTEYSADEYSFLMATNLESAYHLCQLGHPLLKASGSGSIVFISSVAGIVALFSGTIYAMTKGAMNQLTKNLACEWAKDNIRTNCVAPGYILTSLSEGILANKEFEGSVKSRTPLRRVGEPAEISSLVAFLCMPGSTYITGQTIAVDGDAKKASPRTLQQNGVSNCPLRDAAAFCLDGHRP

SEQ ID NO: 53573 - protein, 551 aa, Kluyveromyces lactis NRRL Y-1140
MSLKNWLLLRDIQYEGTFYKKFPHVYNIYVIGFIACISGLMFGFDIASMSSMIGTDVYKDYFSNPDSLTYGGITASMAGGSFLGSLISPNFSDAFGRKVSLHICAALWIIGAILQCAAQDQAMLIVGRVISGMGIGFGSSAAPVYCSEISPPKIRGTISGLFQFSVTVGIMVLFYIGYGCHFIDGAAAFRITWGLQMVPGLILMVGVFFIPESPRWLANHDRWEETSLIVANIVANGDVNNEQVRFQLEEIKEQVIIDSAAKNFGYKDLFRKKTLPKTIVGVSAQMWQQLCGMNVMMYYIVYIFNMAGYTGNTNLVASSIQYVLNVVMTIPALFLIDKFGRRPVLIIGGIFMFTWLFSVAGILATYSVPAPGGVNGDDTVTIQIPSENTSAANGVIASSYLFVCFFAPTWGIGIWIYCSEIFNNMERAKGSALSAATNWAFNFALAMFVPSAFKNISWKTYIIFGVFSVALTIQTFFMFPETKGKTLEEIDQMWVDNIPAWRTANYIPQLPIVKDEEGNKLGLLGNPQHLEDVHSNEKGLLDRSDSASNSN

SEQ ID NO: 53574 - protein, 308 aa, Bacillus halodurans C-125
MWKQDETLEQIVLECKKYTEEGTVASYIPALAKADVSTLGIAIYRGGDEQVIAGDADEKFTLQSISKVIALALALLDVGEEAVFSKVGMEPTGDPFNSISKLETSVPSKPLNPMINAGALAVTNMIIGETTEQSLGRLLSFIHELTKNPTITYNLEVAQSEFDTAFLNRSLSYFLKQHGVIQADVEQLLDLYTKQCAIEMCCSDLARIGYVFANEGRDPDTGQRIVPLHVARIIKTFMVTCGMYNASGEFAIRVGIPAKSGVSGAILALVPNKYGIAVYSPALDEKGNSLAGIKLLETLSCREEWSIF

SEQ ID NO: 53575 - protein, 146 aa, Leptospira interrogans serovar Lai str. 56601
MYIKQILAKKDRRVLSVEPETLVMDVVKFMTKYDIGSVIILGEGKLKGIFTERDVLHLSAELGLDLFKKSVSEVMTTSITTMTPEDDVDELLSIMLKKRIRHMPILENDTLIGIISIGDAVKAKIEKTEEENKNLKQYMYSENGFI

SEQ ID NO: 53576 - protein, 323 aa, Escherichia coli K12
MNLEKINELTAQDMAGVNAAILEQLNSDVQLINQLGYYIVSGGGKRIRPMIAVLAARAVGYEGNAHVTIAALIEFIHTATLLHDDVVDESDMRRGKATANAAFGNAASVLVGDFIYTRAFQMMTSLGSLKVLEVMSEAVNVIAEGEVLQLMNVNDPDITEENYMRVIYSKTARLFEAAAQCSGILAGCTPEEEKGLQDYGRYLGTAFQLIDDLLDYNADGEQLGKNVGDDLNEGKPTLPLLHAMHHGTPEQAQMIRTAIEQGNGRHLLEPVLEAMNACGSLEWTRQRAEEEADKAIAALQVLPDTPWREALIGLAHIAVQRDR

SEQ ID NO: 53577 - protein, 772 aa, Oryza sativa
  misc_feature (174)..(174): Xaa can be any naturally occurring amino acid
  misc_feature (193)..(193): Xaa can be any naturally occurring amino acid
MASHIILPKEEEAALGVAVEEDHDSPAAPGYQHQQGPPVAKALPFSATCVRISRDSYPNLRALRNASAMSLPDDDDAAYAKLEEGDYGYLLDDVPHFTDYLSDLPTFPNPLQDHPAYSTVKQYFVNADDTVPEKVVVQKDSPRGVHFRRAGPRQRVYFESEDVKACIVTCGGLXCPGLNTVIRELVCGLSHMXYNVNDIFGIQNGYKGFYSSNYLPMTPKSVNDIHKRGGTVLGTSRGGHDTKKIVDNIQDRGINQVYIIGGDGTQNGAYDIYKEIRRRGLKVAVAGVPKTIDNDIAVIDKSFGFDSAVEEAQRAIDAAHVEASSAENGIGLVKLMGRYSGFIAMYATLASRDVDCCLIPESPFYLEGEGGLFEYIEKRLKENNHMVIVVAEGAGQDLIAKSIAAADQIDASGNKLLLDVGLWLTHKIKDYCKNKKMEMTIKYIDPTYMIRAIPSNASDNVYCTLLAHSAIHGAMAGYSFTVGMVNGRHAYIPFHRVTSTRNKVKITDRMWARLLSSTNQPSFLSQKDIDAAREADKLASKSPVPVNTKEHGENVKKPANGEGSSDAVVQEPFATTPTSPAALAAGAVSNPALTPAAVSMSFYDVNAGEQPSREDEAPEEVVEAAVANGAPTAVEKHNKLYSPAETPAGSGTRPHPTADAVAETAGAAPDDVDGCTTPPPPPVHDSEGSDTQSADDHGSPQREKPRTTSTAGGVKRDVAPSWSSRLLAFRSFSRDKKAKATVDARPPAHGKARDEGDEHKEKGKERRKRFWK

SEQ ID NO: 53578 - protein, 291 aa, Sulfitobacter sp. EE-36
MLQGSLPALVTPFTDGALDLATLKKLVEWHIAEGSNGLVPVGTTGESPTLTHAEHETVVAEVVKAAAGRIPVVAGAGSNNTTESIRLAKHAESVGADAVLVVTPYYNKPTQAGLIAHFTAIHEACGLPIIIYNIPGRSVVDMLPETMAELAKLPRIIGVKDATGDLARVCDQRMLCGPDFVQLSGEDATAHGFNAQGGVGCISVTANVAPKLLSQMQAFCLAGDYAAALEIQDKLMPLHNAIFTEPGLVGVKYAMARLGLCSDEVRLPLVPLTDATKALVDHGLKHAGLLD

SEQ ID NO: 53579 - protein, 743 aa, Aspergillus fumigatus
MVGSSMFRSNMASPTVMQLTSLSRRSLSTRSPALGLRLSRPLRSATSSQQCVQRTFRRSYADAAPTPKPKKRFRFLRWAWRLTWLSGVGLTGALIYSIYEQRHPIEQIEPDPTKKTLVILGTGWGSVSLLKKLDTENYNVVVISPRNYFLFTPLLPSCTTGQVEHRSIMEPIRNILRQKKAHVKFYEAEATKIDYEKRVVYISDDSEIKGDISHTEVPFDMLVVGVGAENATFVNGVITGIKGVKEHSCFLKEVGDAQKIRKRIMDCVETAMFKDQPEEEVKRLLHMVVVGGGPTGVEFAGELQDFFNEDLKKWIPEIKDNFHVTLVEALPNVLPMFSKQLIDYTESTFKEEAITIRTKTMVKNVTDKYIEAEVTKPDGTKELETIPYGLLVWATGNAVRNVVRDLMNQIPAQKNSRRGLAVNEYLVVNGTENVWAVGDCAVTNYAPTAQVASQEGAFLARLFNTMAKTEAIEKELKRLSEAQAVAKNEEERNKIFDEIRERQKQLRRTKQIGPFQYSHQGSLAYIGKERAVADISWLSGNIASGGTVTYLFWRSAYLSMCFSSKCLLRPTNHKIVPFPFLTISIARNRRKLLFSVFVVYRFLYARSMITFQLLFPFSTLLRRHRHYASVTVDHPSGPLSPKDPLIAPNGHKSGEKYRLGTGLFFRHLDMAIILFLLYDSYTDLFLILAAVVIMSVLLKCIELGKWKYGDYVICVSLQPSYRLTILALDPITRVKIPTVDRKR

SEQ ID NO: 53580 - protein, 465 aa, Sulfitobacter sp. EE-36
MDGTFSENDISRVVEADRAHIWHHLSQHKAYETTDPRIIVEGKGMRVWDQKGKEHLDAVSGGVWTVNVGYGRESIANAVRDQLIKLNYFAGSAGSIPGSHFAEKLIDKMPGMSRLYYCNSGSEANEKAFKMIRQIAHKRYGGKKHKILYRDRDYHGTTIACLSAGGQEERNAQYGPFTDGFVRVPHCLEYRKFEQDGAPEDNYGVWAADQIEKIILAEGPDTVGGLCLEPVTAGGGVITPPDGYWERVQEICRKYDVLLHIDEVVCGIGRTGEWFGYQHFGIQPDMVTMAKGVASGYAAIACLVTTEEVFNLFKDDASDPLNYFRDISTFGGCTAGPTAAIENMAIIERENLLQNTRDMGQYMLEELEELSDKYDVIGQVRGKGLFLGAELVQDRSTRVPVIEAQIQAVVADCMAQGVIIGATNRSVPGKNNTLCFSPALIAKKDDIDQIIAAVDGAMGRVFGSK

SEQ ID NO: 53581 - protein, 639 aa, Clostridium tetani E88
MNFIEKQYIPWKDFLNVASACPITNVMDIEFNLTNIKKCINEALNKKVKYIIFPELSITSYSCGDLFLNNQLLNSSLNAIEELCSFLKDKDILVSVGSPFLYRNSLYNCAFIIHYGKILGIVPKSNICSSEQRWFSSGFKIRNEYVSTYFQENIPFGIDLIFQSGNFKFSFVLGDEFNSPIPLSSYLSLKGANIIGNLSASNELVGKSQKRRDFLKTTTQRLSCGYIYSSCGVYESTTDLVYSGHLLIGEKGNLLKENKRFKRENEIIVSSIDVDSLMLNRLRNTYLEEYSNLCPFNARTINFNFDNLQDFILQRDIKKYPFIPYDKEDNRLEEIFNIQVSALAKRLEHTNLKSTVIGISGGLDSTLALLVTVKTFKLLNLDLKNIIAITMPGFGTTDRTYNNAINLCKKLGVSLREIHIVKSCLQHFEDIGHNPNIHDVTYENVQARERTQILMDIANKEGGLVIGTGDLSEMALGWCTFNGDHMSMYGVNASVPKTLIRYLVKHVALEEKDKETSSILLDILDTPVSPELLPKDNEGNITQKTENIVGPYELHDFFLYYFIKGFEVRKIYYLTCEAFKEDYKEDIIKRWLEFFIKRFFTQQFKRSTVPDGPKVGTVSLSPRGDFIMPSDGSYNSFFK

SEQ ID NO: 53582 - protein, 252 aa, Oryza sativa
  misc_feature (126)..(126): Xaa can be any naturally occurring amino acid
MSTKMKKGILRPFRYISNMMDGKEAAQDMQIGFPTDVKHVAHIGWDGPSVPNNNNNTAGAPSWMKDYHSAPLDSASFRSDRGGSAAANPWASQEIVVDGGSLGDTSFSETRSEASGSMDITAGDSXPPSPDSRRSRRHRSRGSAATSSMDCTAADGGAAPEKKDKAKKSSRGKNRKKDKSDKSAAAGAGDDASGATCQDLPAVPKKSNRRKNKGGSEGTGAAAASKADGAGAGGEDAAAPEPPATEEAQDHD

SEQ ID NO: 53583 - protein, 540 aa, Lactococcus lactis subsp. lactis
MRAHEILNNPFLNKGTAFTMKERQELGLIGLLPPTVQTIEEQAEQTYEQYLTKPSDLEKRHFLMEIFNTNRTLFYYLFNKHIVEFNPVVYDPTIADTIENYSHLFVDPQYAAYLDINHPENITETLKNAAGDREIRLIVVTDAEGILGIGDWGTQGVDISVGKLMIYTAAAGIDPASVLPVVIDAGTNRKELLEDHLYLGNHQERIYGDQYYSFVDQFVETAESIFPKLYLHWEDFGRSNAATILNNYKTKIPTFNDDIQGTGIVVLGGIFGSLDITGEKLTDQVYLCYGGGSAGAGIAGRVHAEMVSEGLSEEEAYKHFFMIDQQGLLFDDMEDLTPAQKPFAKKSADYKDAGDMTDLLNVVKTVKPTILVGTSTNPGAFTKEVVEAMCANTERPVIFPISNPTKKMEATAEQVIEWSDGKAFVATGVPSGTINYKGVDYQIGQANNSLIYPGLGLGMMASEAKLLTDEMIGAAAHSLSGLVDPGKPGAPVLPPFEFVADVSIKVAEAVAKKAQEQGLTESKETDMAKAVRDLKWYPEY

SEQ ID NO: 53584 - protein, 508 aa, Triticum aestivum
  misc_feature (411)..(411): Xaa can be any naturally occurring amino acid
  misc_feature (499)..(499): Xaa can be any naturally occurring amino acid
PESSELPLQLTGSLDCHESVGADDTTTLDKIIDSLTSIANAHRGDPNAAEISLKIGRVSECGIDDSMDKVGPKVLILGAGRVCRPAAEFLTSYQNIDQVHVVVASLYQKDAEETVDGIKNATAAQLDVSDTESLSNLVSQVDVVVSLLPASFHAAIARVCIELKKHLVTASYVDDSMSKLEQAAQGAGVTILCEMGLDPGIDHMLSMKMIDEAHARNGKIKAFTSFCGGLPSPAAANNPLAYKFSWSPAGAIRAGRNPAVYKFLGEIIDVDGSKLYESAKRLRLPELPRFGPGNTCQIENSLMYGDLYGISKEASTVYGSTLRYEGFSEIMAILAKIGFFDAENHPLLQETNRPTYRNFLNELLNVNNISTSNTKINGEESGGHDDELVSRLMMLGHCKEKELAVKILKTXQDMVLLHHEVEVEYPDGRPTEKHQATLMEFGKTENGRSTTAMALTVGVPAAIGALLLLQNKVQKKGVIRPLQPEIYIPALEILEAFGXLKVIERVET

SEQ ID NO: 53585 - protein, 558 aa, Neisseria gonorrhoeae FA 1090
MSFKTDAETAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERFGNILVAYAKDGSPVYAKDLKAHGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLEALAKGLPNLLKHISNLKNVFGLPVVVALNRFVSDSDAELAMIEKACAEHGVEVSLTEVWGKGGAGGADLARKVVNAIDNQPNNFGFAYDVELGIKDKIRAIAQKVYGAEDVDFSAEASAEIASLEKLGLDKMPICMAKTQYSLSDNAKLLGCPEGFRIAVRGITVSAGAGFIVALCGNMMKMPGLPKVPAAEKIDVDEHGVIHGLF

SEQ ID NO: 53586 - protein, 436 aa, Zea mays
  misc_feature (404)..(404): Xaa can be any naturally occurring amino acid
  misc_feature (408)..(408): Xaa can be any naturally occurring amino acid
  misc_feature (417)..(417): Xaa can be any naturally occurring amino acid
  misc_feature (420)..(420): Xaa can be any naturally occurring amino acid
MALASKASPPPWNATAAEQPIPTRDKAAANDSTYLNPQAHDSVLGIILGGGAGTRLYPLTKKRAKPAVPLGANYRLIDIPVSNCLNSNISKIYVLTQFNSASLNRHLSRAYGSNIGGYKNEGFVEVLAAQQSPDNPNWFQGTADAVRQYLWLFEEHNVMEFLILAGDHLYRMDYEKFIQAHRETNADITVAALPMDEKRATAFGLMKIDEEGRIIEFAEKPKGEQLKAMMVDTTILGLDDVRAKEMPYIASMGIYVFSKDVMLQLLREQFPEANDFGSEVIPGATSIGKRVQAYLYDGYWEDIGTIAAFYNANLGITKKPMPDFSFYDRFAPIYTQPRHLPPSKVLDADVTDSVIGEGCVIKNCKINHSVVGLRSCISEGAIIEDSLLMGADYYETEADKKLLXEKGXIPIGIGKNXCIXRASLTECSIRHVRYSC

SEQ ID NO: 53587 - protein, 294 aa, Clostridium perfringens str. 13
MKEIFAVLPDKINSCLKDKSNLNKLQEIRVKVGKPLNIVLDNTETIFNYVIRREDVKAIIQKISNYSLYAFEEDIRQGYITIQGGHRVGLAGQCVIEDNSIKTIRNITSLNIRVCREIVGCSNSLMNSLVENNRVNNTLIISPPKCGKTTLLRDITRNISNGISQIGLKGKRTVVIDERSEIAACYNGIPQMNVGMRTDVYDNCIKSEGMMMAVRGLSPEVIICDEIGTYKDMEGLMMAYNSGVSIIATLHGRNVEELYRRPVFREIVENNIINKVVVLSGKKGIGTIEGIYNV

SEQ ID NO: 53588 - protein, 507 aa, Streptomyces avermitilis MA-4680
MAARAAGRRPCLTRTTPQEAIVPDLFIDGEWRAALDGRTREIRCPADGSLVGVVDEAGGKDTAEAIAAARRAFDEGPWPWLPAADRGDLLLRVADLLVRDRAKLARAESLDTGKRFVESEYDIDDIVNCFRYFGRLAAAESGRVIDTGSASTDSRVVYEPVGVCALITPWNYPLLQTAWKVAPALAAGNTFVLKPSELTPHTAIHLMRLLQEAELPPGVANLVLGAGPEAGAPLADHPDVDLVSFTGGLHTGRRLMAAAAGTVKKVALELGGKNPNIVFADADFDTAVDMALTAVFLHSGQVCSAGARLLVEDSLHDRFVDEVVRRAAEIRLGGPFDERAQTGALISAAHRAKVEAYVAKGLDEGAVLRCGGRRPEGLDEGFFYLPTVLDECTSGMSVIQDESFGPVLTVERFTGEAEAVRLANDTVYGLAGAVWTTDEAKAQRVVSRLRIGTVWINDYHPYVPQAEWGGYKQSGFGRELGPSGLAEYREAKHIWRNTDPSPQGWFA

SEQ ID NO: 53589 - protein, 599 aa, Arabidopsis thaliana
MEISVASVTVSVAVVVVSWWVWRTLQWVWFKPKMLESYLRRQGLAGTPYTPLVGDLKKNFSMLAEARSKPINLTDDITPRIVPYPLQMLKTHGRTFFTWFGPIPTITIMDPEQIKEVFNKVYDFQKAHTFPLGRLIATGLVSYDGDKWAKHRRIINPAFHIEKIKNMVPAFHQSCREVVGEWDQLVSDKGSSCEVDVWPGLVSMTADVISRTAFGSSYKEGQRIFELQAELAQLIIQAFRKAFIPGYSYLPTKSNRRMKAAAREIQVILRGIVNKRLRAREAGEAPSDDLLGILLESNLRQTEGNGMSTEDLMEECKLFYFAGQETTSVLLVWTMVLLSQHQDWQARAREEVKQVFGDKEPDAEGLNQLKVMTMILYEVLRLYPPIPQLSRAIHKEMELGDLTLPGGVLINLPILLVQRDTELWGNDAGEFNPDRFKDGLSKATKNQVSFFPFAWGPRICIGQNFALLEAKMAMALILQRFSFELSPSYVHAPYTQMKQFHISLPIMLVQRDTMMWEFKPERFKDGLSKATKSHVSFFPFAWGPKICIGQNFAMLEAKMAMALILQRFSFELSPSYVHAPQIVVTIHPQFGAHLILRKL

SEQ ID NO: 53590 - protein, 465 aa, Mesorhizobium loti MAFF303099
MGAKHGSGKNRPTWKEEREKEAAELGFKTQPYTLIIGGGQGGIALGARLRQLGVPTIIVEKNERAGDSWRKRYKSLCLHDPVWYDHLPYIDFPKNWPVFSPKDKIGDWLEMYTKVMELNYWSSTEAKSASYDDKTKEWTVVVRRDGKDITLKPKQLVLATGQSGKANLPKFKGMETFKGDQHHSSKHPGPDDYAGKRAVVIGSNNSAHDIAAALWEAGADVTMVQRSSTHISRSDTLMEIGLGSLYSEQALQNGITTAKADLIFASLPYKILHEFQIPAYAEMKKRDAAFYKGLEKAGFMLDWGDDESGLFMKYLRRGSGYYIDVGASQLIIDGSIKLKSGVDVEEIKQHSVLLSDGSELPADLIVYATGYGSMNGWAADLISRETADKVGKCWGLGSNTTKDPGPWEGELRNMWKPTQQEALWFHGGNLHQSRHYSQFLSLQLKARHAGLPTPVYGLQKVHHKG

SEQ ID NO: 53591 - protein, 384 aa, Streptomyces avermitilis MA-4680
MSPTYDVIVIGLGGMGSAAAHHLSARGARVLGLEKFGPVHNRGSSHGGSRITRQSYFEDPAYVPLLLRSYELYEEVERSTGREVATLSGGVMVGRPDSLTVAGSLRSATQWDLPHEMLDAKEIRRRFPTLNPSNDEVALYEKKAGLVRPENMVAAHLQLATRQGAELHFEEPMTRWEPYRDGVRVHTAENTYTAGQLVICPGAWAPQLLTDLGVPFTIERQVMYWFQPRHGVGPFRPENHPIYIWEDAEGVQVYGFPSIDGPDLGAKVAFFRKGVVCTPETIDRTVHDHEVQAMADHMSRCIPDLPGTFLKAATCMYSNTPDEHFVIARHPAHPDSVTVACGFSGHGFKFVPVVGEIVADLALTGTTAHPIGLFDPRRLAAAPA

SEQ ID NO: 53592 - protein, 437 aa, Oryza sativa (japonica cultivar-group)
MMARGAAGGEVGRSMPAVHDAHDDSENFLELLNSRTLAPELFAEPPACDYLKKMEYGGGGGGGGGGWPEHQFTAAAALEKHLSSAAAAGYGGALAHHHHAAGAPERLTANLSDLVSNWSIAPPNHGHHVGGAAACDNPAVAAAMAAAHGGGNVKQSGSSFLDSGGGGGGAMLQQESSSSTGTGGGGQDFLRPMGLAAGSSSYSSMLGLSSRMYGGGGTATMDVPWGSSNAGAARSLSDLISFGGGAMDKPPPPPPSSAPARTSSADYKKQQGQQEISSPVKTSSSGGGGKEGKKKRSEEAAGSEGSTKKSKHEATSPTSSLKSQVPKVKLGDKITALQQIVSPFGKTDTASVLYEAINYIKWLHEQVQLLSDPYMKSSSSKDYNAWGGLDRKEKADAEVDLRSRGLCLVPVSCTPQVYRDNNGPDYWTPPYRSCLYR

SEQ ID NO: 53593 - protein, 509 aa, Solanum tuberosum
MTLRISELFAAAIIYIIVHIIISKLIATVRERGRRLPPGPTGWPVIGALSLLGSMPHVALAKMAKNYGPIMYLKVGTCGMVVASTPNAAKAFLKTLDINFSNRPPNAGATHLAYNAQDMVFAPYGPRWKLLRKLSNLQMLGGKALENWANVRANELGHMIKSMFDASHVGECVVIADMLTFAMANMIGQVMLSKRVFVEKGAEVNEFKNMVVELMTVAGYFNIGDFIPKLAWMDLQGIEKGMKSLHKKFDDLLTKMFDEHEATTYERKENPDFLDVVMANKDNSEGERLSTTNIKALLLNLFTAGTDTSSSVIEWALAEMMKNPKIFKKAQEEMDQVIGKNRRLIESDIPNLPYLRAICKETFRKHPSTPLNLPRVSTEPCTVDGYYIPKNTRLSVNIWAIGRDPDVWENPLEFNPERFLSGKNAKIEPRGNDFELIPFGAGRRICAGTRMGIVMVEYILGTLVHSFDWKLPNDVIDINMEESFGLALQKAVPLEAMVTPRLSLDVYCC

SEQ ID NO: 53594 - protein, 608 aa, Brucella melitensis 16M
MELRNIAIIAHVDHGKTTLVDELLKQSGSFRENQRVAERMMDSNDIEKERGITILAKATSVVWKNTRINIVDTPGHADFGGEVERILSMVDGAIVLVDAAEGPMPQTKFVVGKALKVGLKPIVAINKIDRPDGRHEEVVNEVFDLFANLDATDEQLDFPILYGSGRNGWMALSPEGPKDQGLAPLFDLVLKHVPAPKVAEGPFRMIGTILEADPFLGRIITGRIHSGSIKPNQAVKVLGQDGSVLENGRISKILAFRGIERQAIDEAHAGDIVAIAGLSKGTVADTFCDPSVSEPLAAQPIDPPTVTMSFIVNDSPYAGTEGDKVTSRVIRDRLLKEAEGNVALKIEESTEKDSFFVSGRGELQLAVLIENMRREGFELGVSRPRVVMKDGENGEKLEPVEEVVIDVDEEYSGTVVQKMSERKAEMVELRPSGGNRVRLVFYAPTRGLIGYQSELLTDTRGTAIMNRLFHDYQPYKGEIAGRNNGVLISNDQGEAVAYALFNLEDRGPMIIEAGVKVYQGMLIGIHSRDNDLEVNVLKGKKLTNIRAAGKDEAVKLTPPIKMTLERALSWIQDDELVEVTPKSIRLRKLYLDPNERKRFEKSKSSSAA

SEQ ID NO: 53595 - protein, 487 aa, Nocardioides sp. JS614
MHVVVIGAGFGGLGMAHALRQAGVTDVTVLERADEIGGVWRDNTYPGAACDVPSPLYSWSWATNPEWGRRYSPQPEILDYIRRTAAADGLLELVRTGVEVSAVEYDDATSTWRVTTSTGTVTADLVVSAVGQLSNPVVPAIPGASTFAGPAFHSAHWRHDVDLTGKRVAVVGTGASAIQFVPGIVDRVGAITIFQRSAPYVVPKPDQAYRPRHHRLFRRWPGIPAAERRAVYWLTERLNGALAGESPISRPMIAALRAAWRLQLRRQVRDPELRHRLVPDYPIGCKRLLFSNDWYPALDRDHVEVVTDRITGIEPAGVRTADGALHEADVLIWGTGFAATEFLAGIDVRGAGGVSLKELWADGARAHLGLTVPGFPNLFCVYGPNTNLGGSSIIAMMEAQAGWIAQVARRIADGRAHRVAVRRDVWEVYDREMQGRLGESVWAGCDSWYVDGDRITTNWPGLVTEYKQRTATVDWSELQEVDLQRAK

SEQ ID NO: 53596 - protein, 363 aa, Streptomyces avermitilis MA-4680
MVVPHEVRAVVAVKKGAPVEVQTIVVPDPGPGEVLVAVQACGVCHTDLHYREGAITDDFPFLLGHEAAGTVEAVGAGVTDLAPGDYVVLAWRAPCGSCRSCRRGRPWYCFDSRNATQPMTLLDGTPLSNALGIGAFAEKTLVAAGQAVKIDPAARPEAAGLIGCGVMAGYGAAVNTGKVGRGDTVAVIGCGGVGNAAIAGACLNGAMKVIAVDIDDKKLDQAEKFGATHTVNSRGTDPVEAVRALTDGFGVDIAIDAVGRPETYKQAFYMRDHAGTLVQVGVPDPEMKIDLPLIDLFSRGGALKSSWYGDCLPSRDFPFLIDQYLYGLLDLNAFVSETISLEQVEEAFAKMHRGEVLRSVVVL

SEQ ID NO: 53597 - protein, 413 aa, Streptomyces avermitilis MA-4680
MRTVTVVGASLAGLYAARELRAQGFDGRLVIVGEEPHPPYDRPPLSKDFLTGRADQDRLALADAEETAELGAEWLLGVRARGLDPRGRTVLLDDGRTVSTDGVVIATGASARRLPGDDLSGVHTLRTLDDARALRDELSRGARRVVVIGGGFIGAETASSCAALGHDVTVVEAAPLPLVPQLGAEMAAVCAALHRRGGAGLVTGTGVAGLRGRAGAGAERSGHQGAGAAGPRRSVTAVELSDGRLLPADGVIVGIGATPNTGWLAGSTLALHDGVLCDDGCATALPQVVAVGDVARVGGTRAEHWTSATEQPRVAVRNLLAGRTTETVRSVPYFWSDQYGARIQFAGRRHDGDTVRITEGAIERGGPAEGGLLALYERDGRTTAVLSVDRPRPFMRARRELSRAADPVEPAAL

SEQ ID NO: 53598 - protein, 461 aa, Carboxydothermus hydrogenoformans Z-2901
MPDFLVIGGGIAGLAAAYELFREGQDFILIEENDYFGGKVKTIEREGFIIEGGPDCFLSEKPQVFQIARELKFEDKIIGTNDEFKGTYILSGGRLHELPEGLMMMVPTRIIPFALSPLISWPGKIRMGMDLFIPRKRDDEDESLYSFVTRRLGREALEKIAEPLIGGIHAGTPEEMSVKASFPRFVEMEKKYGSLIRGMLAAKKASSNRPKTKSNTTYFMSFQKGMGELAENIVKNLPDYKLFTGKKAVKVTYQKGKYRTYLTDGEIIESKHVILAVPAYNAAELLEEINKDLAELLAQTGFASSATITLAYRKEDWPFKVNTFGFVVPRIEKRHLMALTYSSVKWSYRVPDDSYLLVRGFLGGATNQNDVFLPEKEMVELVLAEIKDILGVTAKPLFYEIFRWPRGMAQYKVGHLERLAKIEELVFEMPGLALAGSSYRGIGVPDCIKSGREAVRNLLNK

SEQ ID NO: 53599 - protein, 340 aa, Brucella melitensis 16M
MTLVGNFSPLVLVGDSDRVEAETVGAYLDGWAGHDKVRLATANAIKAILSGAGRLVGRIARGYLPGDPGKLVGVNSDQDQQKSIDVGSHNLFVELLIAAGVASILSEEADLPVAGKADGLVAVAIDPLDGSGNVGLGAPLGTIFSIFPADVEEPFLQPGNRQIAAGYVSYGNSVDLGFSVGEGVIFATLDPVSGQFHITRRNVKLPERTSDLAFNASVQRHLSAGMQAYVNDAFLGKDGPRGRNFNMRWLGAAVGDMHRIMQRGGLFFYVNDSRPGYEKGRLRLVYEANPIAFLAREAGGKATDGSRPILDIVPQTYHERSALVFGVAEEVDILGEYFVK

SEQ ID NO: 53600 - protein, 328 aa, Escherichia coli K12
MSHVELQPGFDFQQAGKEVLAIERECLAELDQYINQNFTLACEKMFWCKGKVVVMGMGKSGHIGRKMAATFASTGTPSFFVHPGEAAHGDLGMVTPQDVVIAISNSGESSEITALIPVLKRLHVPLICITGRPESSMARAADVHLCVKVAKEACPLGLAPTSSTTATLVMGDALAVALLKARGFTAEDFALSHPGGALGRKLLLRVNDIMHTGDEIPHVKKTASLRDALLEVTRKNLGMTVICDDNMMIEGIFTDGDLRRVFDMGVDVRQLSIADVMTPGGIRVRPGILAVEALNLMQSRHITSVMVADGDHLLGVLHMHDLLRAGVV

SEQ ID NO: 53601 - protein, 209 aa, Sulfitobacter sp. EE-36
MTSPHGPLRIGIGGPVGAGKTTTTAALCRAMRDRWSIGVITNDIYTQEDAEALMRLQVLPQDRIIGVETGGCPHTAIREDASINLAAVARMRDRHPDLDCVLIESGGDNLSATFSPELADVTLYVIDVAAGEEIPRKGGPAITKSDILIINKTDLAPHVGASLEVMDRDAKRMRGDLPYLFAEMKHDKGVAELLDLIVKIGGLRPVPEN

SEQ ID NO: 53602 - protein, 609 aa, Wolbachia endosymbiont strain TRS of Brugia malayi
MNEFKSIRNIAIIAHVDHGKTTLLDNMLKQSGTFRENQEVQERVMDSGNQERERGITILAKCTSIMWGDEKINIIDTPGHADFGGEVERVLCMVDGVLLLVDAAEGPMPQTKFVLSKALKADLKSIVIINKVDRPDSRIDEVLNEIYELFFNLDATNEQLDFPVLYASGRNGWCIKELSDKRKDLSPLFSTVIDYIKPANYDRNAPFAMLVTLLESDKFLGRILTGKIYQGIAKVNSDLKVLDLDGKVIKRGRLTKLLSFSGLKRIPVEQAVAGDIIAIAGLEKASVSATIVAPEVTTAISSTPVDPPTMAITLSVNDSPFAGQEGTKLTSAIIKDRLYAEAEINVAITVTPTPNDEAFEVGGRGELQLGVLIENMRREGFELSVSRPRVLFKEEGGKKLEPIEEVVIDVDDEYSGIIMKKLSFRKGEVTDMRPSGSGRTRLIFLVPSRGLIGYQGEFLTDSRGTGIINRLFHSYAPYKGPISRRRNGVLISTDKGEAVAYAIFNLQDRGIMFIKPQDRVYCGMVVGQHSRDNDLEINVLKGKQLTNVRAAGSDEAIKLTPPKTMTLEDMIAYIDDDELVEVTPKSIRLRKKFLDPNERRRAEKAKNKE

SEQ ID NO: 53603 - protein, 435 aa, Chromobacterium violaceum ATCC 12472
MTGSIAVETNRKVTLSYNEGKETLDLPVLGGTLGPDVVDIRGFGKTGMFTFDPGFLATASCESKITFIDGDLGHLYYRGYPIEQLAEKSDYLEVCYLLLNGELPTAAQRKEFERGVMRHNMLHDQLMSLFKGFRRDAHPMAVMVGVVGALSAFYHDSLDISNPEHRRISAHRLIAKLPTIAAQAYRYNKGLPFSYPKNGLTYAENFLHMMFSTPCEEYKVNPVLARALDRIFTLHADHEQNASTSTVRLAGSSGANPFACIAACIACLWGPSHGGANEAVLKMLDEIGSVDNVADFMQGVKDKRYKLMGFGHRVYKNMDPRAAIMKQTCDEVLNELGLHNDPKFKLAMELEKIALSDPYFIERKLYPNVDFYSGIVLSAIGIPVSMFTPIFALARTVGWIAHWNEMIGDPGMKIGRPRQLYTGAARRDFVEVAKR

SEQ ID NO: 53604 - protein, 231 aa, Triticum aestivum
  misc_feature (223)..(223): Xaa can be any naturally occurring amino acid
  misc_feature (225)..(225): Xaa can be any naturally occurring amino acid
  misc_feature (227)..(227): Xaa can be any naturally occurring amino acid
  misc_feature (230)..(230): Xaa can be any naturally occurring amino acid
LGSKHHQSVEMASAGLLEAVAPKKKKSNIKYASTCAVVASMASIVLGYDTGVMSGASLYIQKDLEITDVQVEILMGILSIYSIIGTLAAGRTSDWIGRRFTAIFAAFFFFAGALLMGFASGYTMLMLGRFVAGIGVGYAIVIAPVYTAEIAPASARGFLVSFTEVFINIGILLGYISNYAFARLPLHLGWRFMLGIGAVPSVLLAVLVSGMPESPRWLVMKGXLXDXRVXL

SEQ ID NO: 53605 - protein, 409 aa, Chromobacterium violaceum ATCC 12472
MLIEVKVPQLPESVSEARLMSWHKKVGEFVKRDENLIDLETDKVVLELPAPQAGVVVEIIEQDGATVTSGQLIAKIDTAAKAGDAAPAAAAAAPVQAAPAAGAAAMPSAAKLAAETGVDLSKVAGSGRDGRVLKEDVQAAAKSAAPSQAGPVLAPASAGAALSATPAAVNVAGILSGRAEQRVPMSRLRQRVAERLVMSQQTNAILTTFNEVNMKPVMDLRAKYKDRFEKEHGIKLGFMGFFVKAVVAALKKYPIVNASVDGNDIVYHGYFDVGVAVGSPRGLVVPVIRNADQLSLAEIEKQIADFGKRAQEGKLTVEELTGGTYTISNGGTFGSMMSTPIINPPQSAILGMHATKERAVVENGQVVVRPMMYLAQSYDHRIIDGREAVLSLVAIKDAIEDPARLLLDL

SEQ ID NO: 53606 - protein, 227 aa, Glycine max
MAGAGGGYGDANQRIDYVFKVVLIGDSAVGKSQILARFARNEFSLDSKSTIGVEFQTRTLVIDHKTVKAQIWDTAGQERYRAVTSAYYRGAVGAMLVYDITKRQTFDHIPRWLEELRNHADKNIVIILIGNKCDLESQRDVPTEDAKEFAEKEGLFFLETSALEATNVETAFITVLTEIYNIVNKKNLTADENQGNGNSASLSGQKIIVPGPAQEIPAKRNMCCQSS

SEQ ID NO: 53607 - protein, 477 aa, Chromobacterium violaceum ATCC 12472
MSQQFDVVVIGGGPGGYVAAIRAAQLGFSAACVDAFKNPEGKPSLGGTCLNVGCIPSKALLQSSENFHAVQHDFAKHGISVSGAKMDVGQMLSRKTDIINKNAAGIGFLFKKNKVANIHGLAAFKGRQGEKWVIEVTDGGKVVDTLEAVHVIVATGSSPRALPGLATDNQLVLDNEGALALTAVPKRLGVIGAGVIGLEMGSVWKRLGAEVTILEAAPTFLAAADQQIAKEAFKTLTKDTGLDIKLGVKIGEVKAGKKSVSVSYELNGEAVKAEFDKLIVSIGRVPNTQGLGAETVGLALDERGFVAVDDHCHTNLPNVWAIGDVVRGPMLAHKASEEGVAVAERIAGQKPHVDFGVIPWVIYTSPEIAWVGKTEEQLKAEGVEYKKGTSGFGANGRALGLGQAQGTVKILADAKTDRILGLHMIGPMVSELVSEGVVSMEFKAASEDLARIVHAHPSLSEVIHEAALAADKRALHG

SEQ ID NO: 53608 - protein, 122 aa, Zea mays
  misc_feature (68)..(68): Xaa can be any naturally occurring amino acid
  misc_feature (86)..(86): Xaa can be any naturally occurring amino acid
  misc_feature (104)..(104): Xaa can be any naturally occurring amino acid
  misc_feature (114)..(114): Xaa can be any naturally occurring amino acid
MSQPSVILATASYDHTIRFWEAETGRCYRTIQYPDSHVNRLEITPDKHYLAAACNPHIRLFDVNSNSXPQPVMTYDSHTNNVMAVXFQCDAKWMYSGSEDGTVXIWDLKGSRVXQKEYESVA

SEQ ID NO: 53609 - protein, 585 aa, Rhodopirellula baltica SH 1
MPSQRSQWSDQPPSRNLMKLTSIPQLYRNLRRGREILRVLRRYGLADWISRTRRLPLQNWIKDRSGVPLTQYTRSQRIRMAITELGPTFIKVGQVLAARPDLVGNEIAEELKQLRNEVSPDSMEVVETTLAEELGPNFRKHFRHIEPMPLATASIGQVHRAELMDGQRVVLKVQRRGIEKMMREDLDVLEGLAQWADHVESLAIWGPSDMVRQLMPMILRELDFNRERSNLKQFAQILEADKAEIVIPSVFDQLCTRRVLVMEEMVGEPLAKVFERDVHSPSRETGEMTRADLPPELGRTLARTYLRMVFEDGFFHADPHPGNLFCLRDGRLAILDFGMTGRIDEAMRESIEEMLAAINAGDCRRLTRLIRRVGNPRVDLDQSALEIDVADFVDTYGRQTLDRFDLSGALNQLSEILHRHGIGLPNQSALLLKMLISLEGTLREIGVGFDSLDIVRSYLRRVMIRRLTPARRLRQARRIYLESEAFMENAPEQLLSLMNQARLGQLQVRLEPKRFAPVVNRLVVGLMTSAVFLGSALMLSYEVSPVLFPDQPMFGIQRVSILGLVGLIASFSVMVALCLAILRSE

SEQ ID NO: 53610 - protein, 390 aa, Helicobacter pylori 26695
MLYSSKIQSLSESATIAISTLAKELKSQGKDILSFSAGEPDFDTPQAIKDAAIKALNDGFTKYTPVAGIPELLKAIAFKLKKENNLDYEPNEILVSNGAKQSLFNAIQALIEEGDEVIIPVPFWVTYPELVKYSGGVSQFIQTDEKSHFKITPKQLKDALSPKTKMLILTTPSNPTGMLYSKAELEVLGEVLKDTKVWVLSDEIYEKLVYKGEFVSCAAVSEEMKKRTITISGLSKSVAMTGWRMGYAASKDKKLVKLMNNLQSQCTSNINSITQMASIVALEGLVDKEIETMRQAFERRCDLAHAKINAIGGLNALKPDGAFYLFIHIGSLCGGDSMRFCHELLEKEGVALVPGKAFGLEGYVRLSFACSEEQIEKGIERIARFVKSKG

SEQ ID NO: 53611 - protein, 424 aa, Bordetella pertussis Tohama I
MSNTTPAWMAQGYPHIWLPYAQMKTAAPPLPVVRSHGSLLELADGRTLIDGVAAWWTACHGYNHPHIAQAVREQLDRMPHVMFGGLAHEPALNLASRLSALLGPGLERVFYTDSGSVAVEVAMKMAVQFWLNQGERGRTRFVAFRGGYHGDTFGTMAVCDPDEGMHAMFRGLLPEHDVLALPRDEAALAALQAHLERHAGRIAGMLVEPLVQGAGGMLLHDPQVLARLRELADRYGILLIFDEIFTGFGRTGTMFAFEQAGVRPDIVTLSKALTGGTLPLAATVASARVFEGFWSDDPGHALMHGPTFMGCALACAAANASLDLFEREPRLRQVAALEQALRAGLEPCRDLPWVRDVRVLGAIGVIELDGIGARDDLRRRLVEAGVWVRPFGNIVYLTPAFTIAEDELQALLEAVRQVVAERRP

SEQ ID NO: 53612 - protein, 529 aa, Debaryomyces hansenii CBS767
LLPLVKINKLLSMFNNSTRQLFKQSSIRLQTINRHLSSSMAPLQAIRKYDYLVIGGGSGGVASARRAASYGAKVLLIELKFNKMGGTCVNVGCVPKKVMWYAGDLAEKRHHLKSYGLSTTDDKVKYGDFDWSTFKDKRDAYVKRLNGIYERNLKNEGVDYIYGFAHFANSNGDVEVTLTGDQELSFLEEGKEFKKDEKLVFAGSKTLIATGGYAINPPNVEGHELGTTSDGFFELQKQPKSVAVVGAGYIGVELSGIFKALGSETHLVIRGDTVLRSFDESIQNSITDYYTDKLGVNIIKQSGSVSKVEKIDGDRKKITLGNGQVLEVDELIWTMGRKSLINIGLDKVGVTLNDKQQVDVDQFQQTANPNIFSLGDVIGKVELTPVAIAAGRRLSNRLFSGDKAFENDHLDYSNVPSVIFSHPEAGSIGLSCKEAKEKYGEDQIKIYKSKFNAMYYAMMEDDSLKSPTSYKVVCAGEDEKVVGLHIVGDSSAEILQGFGVAIKMGATKKDFDSCVAIHPTSAEELVTMK

SEQ ID NO: 53613 - protein, 405 aa, Oryza sativa
MAFLGNGYCSSGSEGEDEDEGMEGYRKGGYHAARPGDRFAGGRFVAQRKLGWGNFSTVWLAYDTLLNRFVALKIQKSARDYAQAALHEIELLSAIAKGDPTNSKNVVQLLDHFKHAGPNGHHVCLVTEFLGDSLLRLIRYNRNKGIGLSGVKEICRSVLVGLDYLHRELGIIHTDLKPENVLLVSTINPSKDPVRSGFTPILERTVSNQYSGSVISFSEKMLKMRARRAVAKISLRRESLGGVAAEMEKERSLDGISLKCKIVDFGNACWGSQQLAGEIQTRQYRAPEVIIGAGYSYSADMWSFACMAFELATGEVLFAPKTCQGCSEDEIASSGTRSKDYFDRHGDLKRIRRLKFWPLERLLVQRYNFTEPDAQGLADFLRPILDFTPENRPTAAACLKNPWLN

SEQ ID NO: 53614 - protein, 228 aa, Francisella tularensis subsp. tularensis SCHU S4
MSDISELIKGNRAWAEEIKKTNPGFFETLSKGQSPEYLWIGCSDSRVPANQVCGLIPGEVFVHRNVANVVSLTDLNCLSVLQFAIEVLKIKKIIVCGHYACGGVETVVKDKSYGLIDNWLTSIHEVKEQNKQFIEESLSCYKDNQEEYMKKKVDMMCELNALHQALNLCKTTVVKNAWAKGLTFTIHAAIYGIGDGKLYEIGGGVGSRAEMDTTYAQAIKDIKSRYCR

SEQ ID NO: 53615 - protein, 318 aa, Pseudomonas putida KT2440
MSLNPDLAAYLQLVEAGRSAGKVLPMHALAADEARRQFEESSALIAGKADEPDCISDLSLTTRDGHTLPVRLYRPPQADPALAGAALLYLHGGGYVVGSLDSHDTLCWNLAQDAGVPVIAVGYRLAPQWRFPTASDDALDAWRWLVEQAEALGIDAQRLAVVGDSVGGSLATILANQLAAQRELPAPRLQVMIYPVTDASCRRPSVQRYGSGYLLEAQTLEWFYQQYATVPADRHDPRFSPLLGSVASNSAPALMLIAECDPLHDQGVAYARHLEQAGVAVQLAVIPGVTHDFMRMGSIIEEADEGLAMVVEALQQHL

SEQ ID NO: 53616 - protein, 143 aa, Arabidopsis thaliana
MSSRSPPFASLSVSASSVKKEVVSTEKAPAALGPYSQAIKANNLVFLSGVLGLIPETGKFVSESVEDQTEQVLKNMGEILKASGADYSSVVKTTIMLADLADFKTVNEIYAKYFPAPSPARSTYQVAALPLNAKIEIECIATL

SEQ ID NO: 53617 - protein, 452 aa, Pseudomonas putida KT2440
MPQPLYEFTDSPLLQRQQQQESNARSYPRRIPLALRRARGIHVEDVEGRQFIDCLAGAGTLALGHNHPVVVEAIQRVLADELPLHTLDLTTPVKDRFVQDLFGILPEALRREAKVQFCGPTGTDAVEAALKLVRTATGRSTVLAFQGAYHGMSQGALNLMGSHGPKQPLGALLGNGVQFMPYPYDYRCPFGLGGEAGVKANLHYLENLLLDPESGVPLPAAVILEVVQGEGGVVPADIEWLKGVRRITEQAGVALIVDEIQSGFARTGRMFAFEHAGIVPDVVTLSKAIGGSLPLAVVVYRDWLDTWKPGAHAGTFRGNQMAMAAGSAVINYLVEHRLAEHAEAMGQRLRGHLQRLQRDYPQLGDIRGRGLMLGVELVDPQGQPDALGHPPANRDLAPKVQRECLKRGLILELGGRHGAVVRFLPPLIISAEQIDEVAQRFSAAVAAAVGSV

SEQ ID NO: 53618 - protein, 510 aa, Phormidium laminosum
MTSTVPAETSLNKFEKLKSEKDGLAVKSELEDFARLGWEAMDETDRDHRLRWMGVFFRPVSQGKFMLRMRIPNGILTSGQIRVLAEVVERYGEDGNADITTRPNLQLRGIRLEDIPDIFRRFEQAGLTSIQSGMDNVRNITGSPVAGIDADELIDTRGLVRKVQDMITNNGEGNPSFSNLPRKFNIAIAGCRDNSVHAEINDIAFVPAYKDGKLGFNVLVGGFFSAKRCEAAVPLNAWVDPRDVVALCEAILIVYRITGCGANRQKSRLMWLIDEWGMDKFRAEVEQQLGHPLQTAAPKDEILWDKRDHIGIHAQKKPGLNYVGLLVPVGRLYAPMFDLARIAEVYGDGEMRLTVERKRDHSRTCPMSSVASLLKEPLLEKFSVSPGLLVRSLVSCTGAQFCNFALIETKNRAMALIRELESELELARPVRIHWTGCPNSCGQPQVADIGLMGTKVRKDGKATEGVDLYMGGKVGKHAELGTCVQKGIPCDDLKPILRNLLIEHFGARPK

SEQ ID NO: 53619 - protein, 378 aa, Solanum tuberosum subsp. andigena
MAIDCMITNAKSPMIDETKQFIFDASHMKRESNIPTQFIWPDHEKPCAVVQELHVPLIDLRGFLSGDSDAAQQASKLVGEACRSHGFFLVVNHGVDANLISNAHRYMDTFFDLPLLEKQKAQRKIGEHCGYASSFTGRFSSKLPWKETLSFRYSAEEESSHIVEDIFKGHWVKILTILGNVYQEYCNSKNTLSLGIMELLGMSLGVEKSHFKEFFEENDSIMRLNYYPPCQKPELTLGTGPHCDPTSLTILHQDCVGGLQVFVDDEWRSISPNFNAFVVNIGDTFMALSNGRYKSCLHRAVVNNKTPRKSLAFFLCPNKDKVVSPPNELVDSNNPRIYPDFTWPTLLEFTQKHYRADMNTLQTFSNWVHDQHNTKTQV

SEQ ID NO: 53620 - protein, 375 aa, Solanum tuberosum subsp. andigena
MAIDCMVMPMIQTSSDEKNPLIFDSSVLKHESNIPRQFIWPDHEKPSGGVPELDVPLIDLGAFLSGDPIAAKRESRLVDEACKNHGFFLVGNHGVDTNLISLAHRYMNMFFELPLSNKQMIQRKRGDHCGYASSFTERFSSKLPWKETLSFSYSALQGSSHMVDQYFLKTMGEDFSHIGKFYQEYCNAMSTLSSGIMELLGESLGVSKNHFKQFFEENESIMRLNYYPTCQKPDLALGTGPHCDPTSLTILHQDSVSGLQVFMDNQWRSISPNLSAFVVNIGDTFMALSNGRYKSCLHRAVVNNKTPRKSLAFFLCPKKDKVVRPPAELVDSNNPRIYPDFTWPTLLEFTQKHYRADTNTLQFFSNWLQQRTTEV

SEQ ID NO: 53621 - protein, 453 aa, Dechloromonas aromatica RCB
MNSKEDLARLQQELEAKGVKYCIGAYVDIHGVPKAKVVPIHHLLHMAKGSERYTGYALDGLGQAPNDDELTSIPDFSRLIQLPWEPKIAWIPSDNHFQGKPYPLNTRVALQNQLAEAAKLGFGMNLGIECEIFLLRQNADGSLSVPDPEDKLAKACYDVRGFTNNFSWLDKVATAINDLGWDLYSFDHEDANGQFEFDFQYADALTTCDRLTFFRYMAKHYAREEGLLATMMPKPFADKTGNGAHFNMSLYDLQDGRNLFACDPKDDPNGIGLTKLGYHFVAGILKHGRALCAVFAPTVNSYKRLVRRGAMNYFSWAPVFNSYGSNNRTNSVRIPSGGGRCESRNADGAVNPYLVATLVLAAGLEGIREGLDPGKPNEDNLYAISEAERHARGIEFLPQTLQEAVAAFAADPLVEQTLGKELRDEFIRYKSEEWEAYHLTVSQWEIDRYSYMF

SEQ ID NO: 53622 - protein, 224 aa, Glycine max
MVSFHKALAETPIAEVPSELEAPPRKRKWEDETLTEEFFKHDPTDEKRKSIFGIELHLETPLPSHKLQQYLTIQSGQIHLCNTGMTMMKTQDFERNSDPKVPSLGQMSLDLELSLKKKEDGYDTDEKKNHGSTGSAFGERDLMIESSNKCKKDDSCVLTRSPPWWLSSEGDDHKEMITTVCMRCHMLVMLCKSSPACPNCKFMHPPDQNPSKFLKRKKVQPLLC

SEQ ID NO: 53623 - protein, 182 aa, Acidovorax sp. JS42
MTCDIDAIVVMGVSGCGKSSVGEACAKALGWVLHEGDAHHAPESIAKMRAGVPLTDADRAGWLDRLAALLAAPAGTAGVVLTCSALRRKYRDRLRAGNPRVGFVFLALDYEQALQRVQTRAGHFFSPALVADQFATLESPEGEPRVLTLDATRPVDELAQSVVQWLRGNAAASLSSSSGDSA

SEQ ID NO: 53624 - protein, 445 aa, Zea mays
MRMGKYEMGRTLGEGHFGKVRLARHADTGRPFAIKILDRQRILAMKIHDQIKREIATLKLLKHPNVVRLYEVSASKTKIYMVLEYVNGGELFDKIALKGKLTEKEGRKLFQQLIDAVGYCHEKGVYHRDLKPENVLVDAKGNIKVSDFGLSALPQNQQKDGLLHTTCGSPNYIAPEVLLNKGYDGSISDVWSCGVILYVMLTGNLPFDDQNVVVLYQKILKGNAHIPKWLSQGAQDILRKILDPNPVTRIDVDGIRAHDWFKQGYAPAMPFSDDEEDISMDEDSLNITEHNDIQDKIAINQINAFQLIGMSSCLDLSGFFEKEDVSERKIRFASNYSPAYLFEKIESIVRKMGFQVHKSNGKLKVIQDCKGLANSRGQESLLISAEVFEINESLYVVELKKSSGDCSLYRKLCETLSEDLGTCKSQQFLKQDSIRQDIGRYNSSF

SEQ ID NO: 53625 - protein, 308 aa, Rhizobium leguminosarum bv. viciae 3841
MILCCGEALIDMLPRDTTLGEKGFAPYAGGAIFNTAIALGRLGIPTAFFTGIADDMMGEILLETLKASNVDYSPCAITPRPSTIAFVKLVNGQATYAFYDEGTAGRMITTADLPDLGDDCEALHFGAISLIPSPCGETYEALLDREAARRVISLDPNIRPGFIKDKPSHMARIKRMAAKADIVKFSDEDLEWFGLQGDHDALAAHWLNHGAKLVVITKGAEGASGYTKERKVTVPSERVTVVDTVGAGDTFDAGILASLKMDNLLTKAQVASLDEKALRNALTLGAKAAAVTVSRAGANPPWAREIGL

SEQ ID NO: 53626 - protein, 560 aa, Rhizobium leguminosarum bv. viciae 3841
MRVRKRIVSATFPPPKEPPMNAIVEQLKSTADATKATDIRAAFAADSQRFSRFSVSLDDLLMDFSKTAVNDDILKLLVKLAEEGGVEKKREEMFSGKAINFTEDRAVLHTALRNRSNAPVLVDGKDVMPDVNAVLAAMGKFADDVRSGTLKGATGKAITDVVNIGIGGSDLGPVMATLALAPFHDGPRAHFVSNIDGAHIADILKLVQPETTLFIVASKTFTTVETMTNAQTARNFIAKALGEAAVQHHFAAVSTALDKVAAFGIDSARVFGFWDWVGGRYSIWSAIGLPLMIAVGPENFGKFLDGAHAVDNHFRKAPITENLPILLGLIGFYHRNVLGYPTRAILPYDQRLSRFPAYLQQLDMESNGKGVTIDGTPVEGNSGPVVWGEPGTNGQHAFYQLIHQGTSIIPAEFMIAANAFEPELRHQHQLLISNVLAQSEALMKGRTFAEAKKQLTDKGMDDKKADFIAPHRVFTGNRPSITFVYDKLTPYALGRLIALYEHRVFVEGVLFRINSFDQWGVELGKELATGLLPVVEGKESAASHDSSTQGLVAALAKLAK

SEQ ID NO: 53627 - protein, 373 aa, Debaryomyces hansenii CBS767
MQIIFKDFKKQKIPIEVDLSDTVLATKEKLASEKDCEVSQLKFVYSGKVLQDEKTLESFKIKEGDSIIFMISKAKKASPAPGPAKAEEKTSTDASATTESTNASSTPAAASGASTNQQGSEPGSAFAQGDDREATIQNIMEMGYERPQIEEALRAAFNNPHRAVEYLLTGIPESLQRHADQSTSAPIGESTTNTTNDHEEEHEHDHEGEEGQGENLFEAAAAAAAQGEGGNTTSGAGGAEAGADDLGEDNQMRLLRTALQTNPELIQPLLEQLAASNPQVAALIQQDPEGFIRSFLGSGDDMGFDFEEGEGEGVEGAGQGNEPETVRIALTEQDESAINRLCELGFDRNLVIQVYMACDKNEEVAADILFRDM

SEQ ID NO: 53628 - protein, 566 aa, Rhizobium leguminosarum bv. viciae 3841
MNSISVHPNGAKPDKPWLAAYPDIVPAEIPPLEYASLAELLEKSCARYADRTAFSSMGKGMRYRELESQTRKLAAWLQSTGLQKGDRVAVMMPNVLQNPIATYAILRAGLVVVNVNPLYTPRELEHQLKDSGAKAIFVLENFARTVEQVLNKTDLRHVVVTSLGEMLGPKGLIVNFVVRKVKKLVPSWSIPQHKSFGQVLREGAGKELQPVTLTGGDIAFLQYTGGTTGVAKGAVLTHENLLANKLQLSLWLRSAFERKKEPEVLNFLCALPLYHIFALTVNSLMGMSHGAHNILIANPRDIPGLVKEFEKSKVHIFPGLNTLFNALMNNADFAKLDFSSLIMSLGGGMAVQRPVAERWLKMTGTAVTEGYGLSETSPVATANRFDSPEFTGTIGLPLPSTDLDIRDEEGNSLPSGQVGEICIRGPQVMAGYWQKPEETARVMTDDGYFRSGDMGFMDERGYTKIVDRKKDMILVSGFNVYPNEIEEVAAMHAGILEAAAIGVPDGHSGEAVKLFVVRKDPNLTEAEVKAHCIANLTNYKLPRFIEFRTELPKSPVGKILRKDLRG

SEQ ID NO: 53629 - protein, 281 aa, Brassica napus
MAVDAAYLMQFVDETSFYNRIVLSHLLPSTLWDPLPHFLQTWLRNYLAGTLLYFISGFLWCFYIYYLKLNVYLPKDAIPTRKAMLLQIYVAMKAMPWYTLLPTVSEYMIESGWTKCYSRVGEVSWILYFVSIATYLVLVEFGIYWMHRELHDIKPLYKYLHATHHIDNKQNTLSPFAGLAFHPLDGILQAVPHVVALFIVPIHFTTHLGLLFMEAIWTANIHDCIHGNIWPVMGAGYHTIHHTTYKHNYGHYTIWMDWMFGSLKDPLLEDVDNKDISKKAE

SEQ ID NO: 53630 - protein, 388 aa, Streptomyces coelicolor A3(2)
MSTKDFIEKDYYKVLGVPKDATEAEIKKAYRKLARENHPDANKGNVKAEERFKEISEANDILGDPKKRKEYDEARALFGNGGFRPGPGAGGGGTFNFDLGDLFGGGAQGGGGQGGAGGFGGGLGDVFGGLFNRTGGGPGTGTRTQPRRGQDIESEVTLSFTEAIEGATVPLRMSSQAPCKACSGTGDKNGTPRVCPTCVGTGQVARGSGGGFSLTDPCPDCKGRGLIAEDPCEVCKGSGRAKSSRTMQVRIPAGVSDGQRIRLRGKGTPGERGGPAGDLYVVVHVKEHPVFGRRGDNLTVTVPVTYAEAALGGEVRVPTLGGPSVTLKLPAGTPNGRTMRARGKGAVRKDGTRGDLLVTVEVSVPKDLTGKARDALQAYREATADEDP

SEQ ID NO: 53631 - protein, 122 aa, Oryza sativa (japonica cultivar-group)
MNSRSNYRSTRTSLFDGIEEGRIRATSYSSHEIDENENDQAIDGLQDRVSILKRLSGDIHEEVETHNRMLDRMGNDMDSSRGFLSGTVDKFKMVFETKSSRRMGTLVASFVALFLLVYYLTR

SEQ ID NO: 53632 - protein, 254 aa, Thermosynechococcus elongatus BP-1
MLRATTTNGPPVMSQSFADTAIDILIELAERGEIDPWDIQVVDVCDRCLAELARRGEPNLSESGQAFLYAAMLVLLKSDRLVAVTEPSPPAEGEEPPEIAENQSSGVLPPALEQHLHRRPVAPPQQWRRLTLEELIGHLKTMALQSDRTKVLRPHQPRQRPRPTTLKAITQLAHQENLTEMARDVESLLREMAPEGTWLDFQKLLQRKPDAVGVFWALLFLAAQSKVDLQQTDFYQPLQVRTCLPDAIPLEDLG

SEQ ID NO: 53633 - protein, 391 aa, Nocardioides sp. JS614
MSQDLYELLGVGRDADADAIKKAYRRLARQYHPDVNPDPEAQERFKEISLAYEVLSDPQKRAHYDRGGDPFGGGAGGFGQGAGFSFTDIMDAFFGGGGAAGAGRGPRPRERRGQDALIRLEVELAEAAFGVTREIKVDTAVRCSTCHGEGTAAGTHPIPCETCHGAGEVAHVQRSFLGEIRTLRPCPACRGFGTIIPEPCRECSGDGRVRSRRTLTVKIPAGVDNGTRVQLSGEGEVGPGGGPAGDLYVEIHTAPHETFTRHGNDLHCTVTLPMTAAALGTTLTLPTLEADVVTGDPDESEVETSFDLDVRPGTQSGTEQVLRGRGVPGLRGGRGDLVVTVVVETPTRLDPRQEELLIELAAIRGEEAPTGQVRPGAKSVFGRLRDAFNAH

SEQ ID NO: 53634 - protein, 309 aa, Glycine max
MAQQEVVEGFKFEQRHGKERVRVARVWKTRQGQHFVVEWRVGITLFSDCVNSYLRDDNSDIVATDTMKNTVYAKAKECSDILSAEDFAILLAKHFVSFYKKVTGAIVNIVEKPWERVIVDGQPHEHGFKLGSEKHTTEAIVQKSGSLQLTSGIEGLSVLKTTQSGFVNFIRDKYTALPDTRERILATEVTALWRYSYESQYSLPQKPLYFTEKYQEVKKVLADTFFGPPNGGVYSPSVQNTLYLMAKATLNRFPDIAYVSLKMPNLHFLPVNISNKDGPIVKFEDDVYLPTDEPHGSIQASLSRLWSKL

SEQ ID NO: 53635 - protein, 337 aa, Phaeosphaeria avenaria f. sp. triticae
MVVKVGINGFGRIGRIVFRNAIEHNDVEIVAVNDPFIEPHYAAYMLKYDSQHGQFKGDIKVDGNDLTINGKTIRFYTEKDPANIPWSETGAYYVVESTGVFTTTDKAKAHLKGGAKKVVISAPSADAPMFVMGVNNETYTKDIEVLSNASCTTNCLAPLAKVIHDKFTIIEGLMTTVHSYTATQKVVDGPSAKDWRGGRTAAQNIIPSSTGAAKAVGKVIPDLNGKLTGMSMRVPTSNVSVVDLTVRLEKGATYDEIKEAIKAAADGPLNGILGYTEDEIVSTDLNGDTRSSIFDAKAGISLNKNFVKLVSWYDNEWGYSRRVLDLLVYIAKVDGNA

SEQ ID NO: 53636 - protein, 652 aa, Phytophthora parasitica
MMLNSCIAKLIAQSETLSRLGDSTGWDAVTEPAKIVPMFGDEGRRASVLVTRERDRNGSGISYTSSECSNNHAEPDIPAEEIRAARQDLLIDDEEEAKPAVHDVQATARVTPVSVSEELLSPTVAGYCCSPEFPSNESSNSQELDTDNNATDEKESNNQEDNQGDDDSEEDSIAGDLATQSSVAPYKSAVLAGRGTSTYHSMGMEGGVSTYQRMGLEDEYTKASSRSAVAAVNGPRPLPRAAFGATSSSSGLFPMMRPQTHSFNANGQVFTLDTRYQLVKPIGNGAYGAVIAVKDVVNGGDNLAVKKITNIFEDLVDAKRILREVRLLGHFNHKNITRLHDLSPPPSRKQFDDMYIITELMETDLHQVIYSMQPMSDDHVKYFLYQMLCALHHIHSAGVLHRDMKPSNILLNANCDLKVCDFGLARGGVGSSSSLQQELPQLGELTEYVVTRWYRAPEIMLNCLHYTTAIDVWAVGCIFAEMLLREPLFPGNDYLHQLKLIIKFLGTPKQEDIGFVKNTKALRFLTKLAISKPKKWRDVFATSGAENVVSAEAIDLLSKMLLFNPDKRISVDAALRHPYLATFFDENDLILSKPFDFSFDLPDDQLSKDALINLLCEDIEHFHPPVPLSVTPMPLSTAASRFFRMGMTASAS

SEQ ID NO: 53637 - protein, 365 aa, Phytophthora parasitica
MGEEVEKHVLRKYELLQKLGKGAYGIVWKAIDKNNRQVVALKKCFDAFRNATDAQRTFREVMYLQELNGHSNIIRLLNVVKADNDRDIYLVFDFMETDLHAVIRANILEEIHKKYIIYQLLKSLKYMHTAELLHRDIKPSNLLLNSDCHTKLCDFGLCRSVAEISGPNPILTDYVATRWYRAPEILLGSTKYAKSVDMWAVGCIVAEMATGRPAFPGTSTMNQLERILDVTGPPSQEDIESIKSPFANTMLESLPAPKKKPLEELFPKASPEALDLIKQCFWFDPSKRISVIDALKHPYVAQFHNEKDEPSAPAPLQIVVNDNTKYSAADYRDRLYREIIKKKKEVRRKAGEQDGATAAAATTAQ

SEQ ID NO: 53638 - protein, 234 aa, Glycine max
MFTLNHSSDLYHVSPELSSSLDTSSPASEGSRGVAFSDEEVRLAVRHPKKRAGRKKFRETRHPVYRGVRRRNSDKWVCEVREPNKKTRIWLGTFPTPEMAARAHDVAAMALRGRYACLNFADSAWRLPVPATAEAKDIQKAAAEAAQAFRPDQTLKNANTRQECVEAVAVAVAETTTATAQGVFYMEEEEQVLDMPELLRNMVLMSPTHCLGYEYEDADLDAQDAEVSLWNFSI

SEQ ID NO: 53639 - protein, 214 aa, Brassica napus
MTGFSVSLIVSNFSNVASYLSPIFETIPSKVVPAQIEKVVSLVSRTGRDLQRYDNSGYRQVVGCVPYRYKTQQVNGTESKEIEVLLISAQKGKGMLFPKGGWEIDESMEEAALRETIEEAGVTGELEEKLGKWQYKSKRHNIIHHGYMFALLVDQEFERWPEAEMRQRKWVGLDEAGEVCQNWWMREALEAFVNVKCNTEEVEIEASNESGNDV

SEQ ID NO: 53640 - protein, 506 aa, Phytophthora parasitica
MGEDDDVNMSEEGERSGCSTPIQGGRTPRHRKSFDRLQELHKETGQNRRVSERYSLAASDVPGGFELVEADGVDQQDKTSASEEEEMYTFTVASTKFRVYRRYQLIRAIGHGAYGVVIAASDQVTGNSVAIKNIPRTFDDLVDAKRIVREIRLMRHLRHPHVVSVLDVMRPPLLATFEDTYIVTDLMETDLHRVINSPEPLSSDHIAFITYQLLCGLRYVHSAHIIHRDVKPSNVLINRDCLVKLCDFGLARGIDIRPVTPSSVDGNTTPSSQDGEPALDEALTEYVVTRWYRAPELLLASRYSTAIDLWAVGCILAEMFTRKALFPGHDHVHQLHLILQLVGSPPPDDMGFVTNMKAKRWMARQQQHEAKPLNSVCPNAPTEALDLMTKLLQFDPRKRISVDEAIAHPFLAPCRADGVEMDSERLADSAFDFSFERENKGNLDKNTLRRLIFEDVCHFHPEATAELEQFKQEQERLKRLEEEKWRKEEAQAKAKARTGKSWAVSV

SEQ ID NO: 53641 - protein, 203 aa, Zea mays
MFSLFYGLWKHVFSKAEFHVLILGVHKAGKTTLLEKLKSIYLKGEGLPHDRIVPTVGLNIGRIEDANVKLVFWDLGGQPGLRTIWEKYYEEAHAVIYVIDSASASSFEDAKSALEKVLRHEDLHGAPILIFANKQDSPAAVTEEELARHLHLKELDERPCMFQAGSAFNGTGIKHGVDWLVEEMERSKRTEALRARTEAAGKI

SEQ ID NO: 53642 - protein, 683 aa, Phytophthora parasitica
MPNLSRKFSFMTSVASSAASAASSAVGVGTSSNNSTPVVDPFSTGTPRNAGDESYLPTHPVWNRVLELPFSHVIGTCSLVVDVKDHSKNGVESQLGFATLNVAKYLMAADGTERTKKREEAAMAADSKWYSISNAKGEYCGKVQLGITCQRKKIMEEGDGVQPRLKKSQSVVIDRKNPPSSNMLQWDATPAHSQALLGAATPALKKGMTLDEFQMGGSEHARRHGWANVKLSPEDTARTQSAGAIVSSKEDDDESVHKRFPEGSAALPAATDAVICKENADMHTFMVCGAPFTIPRHYQLIKVCGRGAYGIVIAATNLRTGGNVAIKKVIDCIWHPHQLKQILRECRLIRHMAHENVLSLLDLIPPPSYTDFRDVYMTVDLMEMDLHRIIYSKEVLRDDHIRYFLYQMLSGLHHMHRAGVLHRDLKPSNLLINSDCQLKICDLGLARSKEADDVGMTEYVVTRWYRAPELLLGSAYGEGVDLWAAGCIFAEMLGRKPLFPGETYVHQLQLIMNVLGVPEEHSFKENPLANKLKGRQLLSRTQAVAGIDTSTMFPNANPEGLDLLWKMLVFDVEKRITVEEALRHPYLAMYYDEERENAPVEKFQSFDLDDLDETDLKELMFKEICHFHPEEMVKRAQQQKEHPEAVEKLPPGWVKRESRSVPGKFYYSNPKRGISTWIKEEMD

SEQ ID NO: 53643 - protein, 492 aa, Zea mays
MDLEDQEAQKPLLVTAPGRIGDGSHLAESDAASSSSSIAVVVASTAVAVAGSFEFGISVGYSSPSQSGIMRDLSLSLAEYSVFGSILTIGAMLGAVVSGTVADRVGRRSAMAISDLLCIFGYLLITFSQNFWWLDIGRFSIGCGIGLLSYVVPVYISEITPKNLRGGFATVNQFMICCGASLAYVLGTFITWRTLAIIDFDFPIVGVAPCLLQLVGLLVTPESPRWLARFGHPGAFEAALQKLRGKGTDISDEATGIKDFTEKLQQLPKSKMLDLFQKDYIRAVTVGVGLMVLQQFGGVNAICFYASEIFVSAGFSSGNTGMLAMVAVQIPMTGLGVILMDKAGRRPLLMVSAAGTCLGCLLVGLSFLAKEHHWGKDLNLVLALAGILIFGGSFSLGMGGIPWVIMSEIFPINMKGAAGSLVTLVSWLGSWIVSYAFNFLLVWNSYGTFFIFASICGLTVVFVEQLVPETKGRTLEEIQASMNSSLASPFDI

SEQ ID NO: 53644 - protein, 244 aa, Arabidopsis thaliana
MAGIDTQKQLLSLIRDFTSERSRGEQRVVGLKKRIEILQSEVEAANSEVEKAKRIKEVAEEELNGYEVELSLNDATIQSLEARISLLQDEVTTIGSEVDALKRSVYKPNGRTEQGDKVIFYSLRYHLVPGVTHLSCLVGNREFQKTVDSSLSSDDGIGITANVKASEDGSGADLEAIKGMLSEVNSQLAKEEEGYLAEQKIQEQLQKELDDYEKKMSLMEAITDKTNSVQVLTRYPLILLAGEA

SEQ ID NO: 53645 - protein, 1194 aa, Debaryomyces hansenii CBS767
IRYKFGASSVRARLQDFATIILCRDNATRGLDSATALEFIRALKTSATILDATPLIAIYQCSQDAYDLFDNVVVLYEGHQIFYGKANKAKEYFINMGWDCPKRQTTADFLTSLTNPAERVPRPGYEDKLPYTPVEFEEYWKKSPQYKKLIEDIEEYLKQKEGSDRDLYHQAHVARQSNHISQKSSFTVSFFMQTRYIMSRNILRTKGDPSIALQSIALQVVMGLIIGSTYYNLETTTGSLFYREAVLFFAILFNSFSSILEIMSLFEARPIVEKHKQYALYRPSADALAGIITELPTKFFMSMGFNFFVYFLSNMRRDAGRFFFYWLMNALCTLVMSHFFRSLGAVSTSFPGAMTPATVVLLAMVIFSGYCIPPPNMLGWSRWIGYINPVSYVFEALMINEFNDREFTCSAFVPAGPSYMDISSDQSICSVTGSRPGLSFVNGSDHIAVTYEYYNSHKWGCFGIIVGFIVFFLVLYVILSEFNKGSMQKGEVTLFLKSSLKEHKKQAAKGAATTKDIENSNISNEKISHKDQLDANKEENNNNNNALPSSKDIFHWRDLTYQVKIKSEDRVILNHVDGWVKPGQLTALMGSSGAGKTTLLNCLSERVTSGIISDGTRMINGQELGSSFQRSIGYVQQQDLHLPTSTVREALRFSAQLRQPNSVSIQEKNEYVEYIIHLLDMNLYADALVGVAGEGLNVEQRKRLTIGVELVAKPKLLIFLDEPTSGLDSQTAWSICKLMRKLADHGQAILCTIHQPSAILLQEFDRLLFLQKGGKTVYFGDLGENCHTLIDYFEKYGAHHCPEEANPSEWMLEVVGAAPGSHANQDYHEVWKNSAEYQMVKDHLTEMETELVKIPRDESQEAKRSFAAPIWKQYLIVTKRIFEQNWRSPSYIYSKLILVISSSLFNGFAFFKADRSLQGLQNQMISIIQFLVPFMTLVQQMMPYYIKQRDIYEVREAPSKTFSWFAFITAQITSEIPYQVVIGTLGFFCWYYPVGLYDNAVPTDSVDSRGVLMWLYITAFYVYTSTMGQLCISFIEVPENAANLAVNLFTVCLIFCGVLAPYDFLPGFWTFMYRCSPMTYFVQGMGSTGLSNVEAVCSESELLRFEPRSGQTCGSYMADYIKQTGGYLVDGNATSKCEYCTTKSTNDYLASVDSLFSERWRNWGIVICFIAFNIIFTVFFYWIARVPKSNRQKK

SEQ ID NO: 53646 - protein, 508 aa, Bifidobacterium longum NCC2705
MQLFRTKSVEQTIAETGEEGRKLKRNLTWWDLSIMGVAVAVGAGIFSVGAQAAAFHAGPAVIISFLIAGIVCGAAVMCYAEFASMIPVAGSAYTFTYTTVGEIMAWIIGWDLILEMLMAGSVISKYWGVYLNDFMRLMGWNANTNLTFGSFHIDIAPIIIVAFFTTLLVFGTKIGARVDGAMTVLKIAIVFFVVIVGFFYVKASNFTPFIPPSQPASTVEGSSAVTGVMTQPLWQFATGMTPSVYGVPGILSGAALVFFAFIGFDVVATASEETKNPHKNVPLGIGVGMLLIIVMYMLVAVVTTGMVSYADLAKQDSPSLATAFELVGADWAAKIISFGIVLGLATVVMVLLLGLTRIVFAMSRDGLLPRGLSKTGKHGTPAALQIVVGAVVALVAAFFDIGVLSDMVNIGTLSAFTLVAISIPIMRKKRPDLPRAFKMPGSPWIPILIAVANFWLMLNLSVLTWIRFVVWLVVGFAIYFGYGYWHARLGKGDLTETLSAETDKAVNG

SEQ ID NO: 53647 - protein, 112 aa, Nocardioides sp. JS614
MEDCLFCKIVAGDIPGEVVHTTERTVAFRDIDPKAPTHVLVVPRDHYTNAAELAAADPQATAELVTTAAAVAAAEGYADYRIVFNTGAEAGQSVFHTHLHLLAGRPLTWPPG

SEQ ID NO: 53648 - protein, 254 aa, Triticum aestivum
  misc_feature (208)..(208): Xaa can be any naturally occurring amino acid
HYRTSLYKKAGWYRSGIPGISSTHASDGGASGMLATCVIQPIDMIKVKIQLGEGSAAQVAKTMYANEGLGSFYKGLSAGLLRQATYTTARLGSFRVLTNKAIEANDGKPLPLVQKAFIGLTAGAIGACVGSPADLALIRMQADSTLPAAQRRHYKNAFHALYRITADEGVLALWKGAGPTVVRAMSLNMGMLASYDQSVELFKDKLGXAGRISELLFGASGHFLEFCAGCFESCPFDFVKTQIQKECTLMPLGK

SEQ ID NO: 53649 - protein, 308 aa, Erwinia carotovora subsp. atroseptica SCRI1043
MKTGKLVVLGSINADHILNLEQFPRPGETVIGEQYSVAFGGKGANQAVAAGRSGANIAFIACVGEDDIGSRICQQLSKDNIDVSAVEAISGETTGVALIFVNAEAENMIAINAGANAAVTPDYLHRHQQHIIDASALLMQLESPLETVIAAARLAHEHQTKVILNPAPARELPDELLSLVDMITPNETEAQLLTEITVETEEDAARAAQVLHDKGIETVLITLGSRGVWLSESGQGQRIPGYRVKAVDTIAAGDTFNGALVTALLENQPMSSAVKFAHAAAAISVTRRGAQPSVPWREEIDAFLQAQE

SEQ ID NO: 53650 - protein, 404 aa, Acidovorax sp. JS42
MNPLLSLLQPYPFERLRQLFAGVTPSAAHRAISLGIGEPRHATPPFIQEALAANLAGLASYPSTAGDPSLREACAGWMQRRYHIPVNPATQVLPVNGSREALFAFAQTVVDPTRAGATVVCPNPFYQIYEGATLLAGATPYYAPSDPARNFAVDWDSVPEEVWQRTQLLFVCSPGNPTGAVMPLPEWEKLFALSDRYGFVIASDECYSEIYFRDEPPLGGMEAAAKLGRSDYRNLIAFTSLSKRSNVPGLRSGFVAGDAALIKAFLLYRTYHGSAMGPAVQAASVAAWNDEVHVEENRALYRQKFAQVTPMLAEVMDVRLPDAGFYLWAKVPDALGMSDAEFAQALLAQYNVTVLPGSYLARDSGGANPGAQRLRMALVAETAECAEAASRIVQFIQSRTLFHP

SEQ ID NO: 53651 - protein, 221 aa, Larix griffithiana
KAAGARIIVTQAAYVDKLADLQSDDMIVIAIDGAPKEGCQHISILTEADETQCPSVEIHPDDVVALPYSSGTTGLPKGVMLTHKSLVSSVAQQVDGENPNLYFHSEDVILCVLPLFHIYSLNSVLLCALRAGAATLIMQKFNLTTLLELIQRYKVTVAPIVPPIVLEISKNPIVSRYDVSSVRIIMSGAAPLGKELEDALRERFPKAIFGQGYGMTEAGPV

SEQ ID NO: 53652 - protein, 221 aa, Larix griffithiana
KAAGARVIVTQAAYVEKLADLQSDDVIIITIDGAPKEGCQHISVLIEADETQCPSVEIHPDDVVALPYSSGTTGLPKGVMLTHKSQVSSVAQQVDGENPNLYFHSEDVILCVLPLFHIYSLNSILFCALRAGAAILIMQRFNLTTLLELIQRYKVTVAPFVPPIVLDITKNPIVSQYDVSSVRIIISGSAPLGKELEDALRERFPKAIFGQGYGMTEAGPV

SEQ ID NO: 53653 - protein, 221 aa, Larix himalaica
KAAGARIIVTQAAYVEKLADLQSDDVIIITIDGAPKEGCQHISVLIEADETQCPSVEIHPDDVVALPYSSGTTGLPKGVMLTHKSQVSSVAQQVDGENPNLYFHSEDVILCVLPLFHIYSLNSILFCALRAGAAILIMQRFNLTTLLELIQRYKVTVAPFVPPIVLDITKNPIVSQYDVSSVRIIISGSAPLGKELEDALRERFPKAIFGQGYGMTEAGPV

SEQ ID NO: 53654 - protein, 337 aa, Rhodococcus sp. RHA1
MTSVNRQVRLAKRPVGRPDDSTWEITSEPIPEPADGEFTVKVDYVSLDPAMRGWLDDVKSYVPPVAIGEVMRTHAVGRVVASKNAKFPEGQLVSGQFGVQEFALSDGRGALAVDESLAPAPTWLGALGFPGMTAYFGLTDVGKLEKGDTVLISGAAGAVGSIAGQIAKLKGATVIGIAGGPEKCAWLTEDLGFDAAIDYKSESVGKALRAAAPDGIDIYFDNVGGEILDAALARLRKNARVALCGAISGYNATDPQPGPSRYLSLLVNRASMTGFIVFDYLDRFPEGMEAMSEWIRAGEIVTREQVETGGVEAFGRTLNLLFDGANTGKLVLEIGDH

SEQ ID NO: 53655 - protein, 517 aa, Oryza sativa
MGNGGSTAHRPRVRVHRNSGGDDEAIDSWTLAPRHPTVPARCSYPYSTTALSGREARKRHAPRSRHLDFSGERRKNNTPPPLTYGDSDTMAMAAASASAMARRAASWPRLLLLSRAFAAAAAEPKRVLVPVADGTEPVEAAATADVLNRAGARVTVATADPAGDDRGLLVEAAFGVKLVADGRVADLEGEAFDLIALPGGMPGSANLRDCKVLEKMVKKQAEQGGLYAAICATPAVTLAHWGLLKGLKATCYPSFMEKFTAEIIPVNSRVVVDRNAVTSQGPATAIEYALALVEQLYGKEKSEEVAGPLYVRPQPGVDYVIDEFNSVEWKCSGTPQVLVPVANGSEEMEALNLIDILRRAGANVTVASVEDKLQVVTRRHKFNLIADIMVEEAAKREFDLIVMPGGLPGAQKLSSTKVLVDLLKKQAESNKPYGAICASPAYVLEPHGLLKGKKATSFPPMAHLLTDQSACDSRVVVDGNLITSKAPGSATEFALAIVEKLFGREKAVSIAKELIFM

SEQ ID NO: 53656 - protein, 203 aa, Isochrysis galbana
GEGTYGVVYKAQDTEDPQGATVALKKIWLDDRDEGVPVTTLREVALLRNLDHVNIVRMREFVTIPPRIYLVFEYLDHDLKACLDTKFRSGMPAPLVKSCALQILRGLAFCHSHRILHRDLKPQNVLIDNAGIVKLADFGLARASLLLNSQLYTNEVVTLWYRAPELLLGTQNYINSVDVWAAGCIFTELSCRMPLFPGDSEIE

SEQ ID NO: 53657 - protein, 211 aa, Neisseria gonorrhoeae FA 1090
MPMNLFQNAKFFTTVNHLKDLPDTPLEIAFVGRSNAGKSSAINTLTNHVRLAYVSKTPGRTQHINFFELQNGNFMVDLPGYGYAQVPEAVRAHWVNLLGDYLRHRKQLIGLVLIMDARHPLKELDIRMLDFFHTTGRPVHILLSKADKLSKNEQIKTLSQVKKLLKPYSDRQNISVQLFSSLKKQGIDEANRTVGSWFDAADAAASSPEEN

SEQ ID NO: 53658 - protein, 463 aa, Nostoc punctiforme PCC 73102
MADLTPNSSFSLTLRLQIPNRVGMLASVTQAIATTGGNLGQIDLIEQTRKESTRDITVDAASTEHAETIVQAVKALPDIKLLSVYDRTFNLHRGGKISITSRIPLKSVSDLAMAYTPGVGRICTAIAQDPEEVYKLTIKQNTVAIVTDGSAVLGLGNLGPAAALPVMEGKAMLFKEFAGLDAFPICLATQDTEEIIQTVKNIAPVFGGVNLEDIAAPRCFEIEKRLREELDIPVFHDDQHGTAIVTLAALFNSLKLVHKPMAEIRIVINGAGAAGVAIARLLRKAGAEKIWMCDSKGIISTSRADLTEEKLEFAVKAQGTLAGAMQGADVFIGVSAPGVLTPEMVHSMAKDPIVFAMANPIPEIQPELISKDVAVIATGRSDYPNQINNVLAFPGVFRGALDCRAKTITTTMYLEAANAIASLVKPSDLDREHIIPSVFDERVVNAVAAAVQQAARQEGIAQN

SEQ ID NO: 53659 - protein, 238 aa, Oryza sativa (japonica cultivar-group)
MSYFGNHAQNSHLVGAPIYIADASSPPEVEILQGNDDGNGNGNVRTEKRILWTEEEDIILMSAWIEHSTDSTCGADKGGGQYWGEVVESYNKTTPPLRKRNLKQCKDRWHKINRWTDLFECAYVKARRIFTSGYSNQMWIDAAHKFYVDDNKEAKLGPFVLMEVWKICREVSKWKTYNDNLRNARKRKSFHLEGDSEEADDTFDEMPKRPMGQKAAKKAALDAKIKSNGLGSSDDDRK

SEQ ID NO: 53660 - protein, 429 aa, Bacillus thuringiensis serovar konkukian str. 97-27
MRKFDKSIAAFEEAQDLMPGGVNSPVRAFKSVGMNPLFMERGKGSKVYDIDGNEYIDYVLSWGPLIHGHANDRVVEALKAVAERGTSFGAPTEIENKLAKLVIERVPSIEIVRMVNSGTEATMSALRLARGYTGRNKILKFIGCYHGHGDSLLIKAGSGVATLGLPDSPGVPEGVAKNTITVAYNDLESVKYAFEQFGDDIACVIVEPVAGNMGVVPPQPGFLEGLREVTEQNGALLIFDEVMTGFRVAYNCGQGYYGVTPDLTCLGKVIGGGLPVGAYGGKAEIMRQVAPSGPIYQAGTLSGNPLAMAAGYETLVQLTPESYVEFERKAEMLEAGLRKAAEKHGIPHHINRAGSMIGIFFTDEPVINYDAAKSSNLQFFAAYYREMVEQGVFLPPSQFEGLFLSTAHSDADIEATIAAAEIAMSKLKA

SEQ ID NO: 53661 - protein, 846 aa, Bifidobacterium longum NCC2705
MKNPPLHRYATRPGLYFTDDGGADVVVRSETADQVWLCVLEPIDEPSAFFQDAIRLFEDPNISFIQQIHEFPVCTRIIEHLYLRETLFRMTGPNYGLWYVHLPKAWDGMRYGYRVDGAWDPKHGVRFNPYKFLLDPYGKGIDGSMELTPAAFSYECDVVDHKVTGSAYGAMSTVDSLGHVPVSVAIDDRDIHKHEGDPQHPHVPWRKTVIYEMHVKGFTANAPWLPESLRGTYAGLAHPTTLAYLQGLGITSIELLPIMAKQDELFLQEHGRKNYWGYSTLSYFAPEPSYATKAAQEKGAAAVRQEVIDMVRALHEAGFEVIMDVVYNHTCEGGVEGPTVCWRGLDDLAYYRHQKSNTGRLEDTTGCGNTLDFTNTHVVTFAIDSLRYWAKRIGIDGFRFDLGVTLARLEGEFTHHHPFLYALRSDLLLGNLKLIMEPWDLGNLGWRTGQFSVPFAEWNDRFRDTARTFWLEDVDGGSDFGRISLQEMSTRLCGSADLFATEPGRGAPASINFVSCHDGFTLTDLTRYRSKHNEANGENNNDGSSVNHSANFGVEGVTDDPDVIAAREQAAMNMIGMLLLSLGTPMMLAGDEFRNTQDGNNNAYCQDNDITWLKWDWMYSTNKTREMRRLETVSRLVALRKSLDLYHHEDFFTRLTQLGLLKPSSRVQWFLPDGTTPMERDWFDLGVRSFTMRLLSNSEVDVCIVVNGTADDRTFRLPPDTHWTPKWCSAEINGRRAGHGTQVEECDLNGDTTVWTQHVPDASETVLKMVKEVAMQRTESSTENEADTIKFAMPVTDHAANGTSSAPRDEVSADMPDAPVDDTPDTPVDDNVWTMPALSITLMKQV

SEQ ID NO: 53662 - protein, 408 aa, Debaryomyces hansenii CBS767
VIGEVLLEQAYGGMRGIKGLVWEGSVLDPIEGIRFRGRTIPDIQEQLPKAPGGSEPLPEALFWLLLTGEVPSVAQTKAFSQELAARSALPKHVEELIDRSPSHLHPMAQFSIAVTALESESQFAKAYAKGVNKSEYWDYTYEDSIDLLAKLPNIAARIYRNVFHDGRLGAIDSSLDYSANLANLLGFGENKEFLELMRLYLTIHSDHEGGNVSAHTTHLVGSALSSPFLSLAAGLNGLAGPLHGRANQEVLEWLFKMRGELNGDYSKENIEKYLWETLNAGRVVPGYGHAVLRKTDPRYTAQREFALKHMPDYELFQLVSNVYEVAPGVLTKHGKTKNPWPNVDSHSGVLLQYYGLTEESFYTVLFGVSRAFGVLPQLILDRGLGLPIERPKSFSTEKYMELVKNIKA

SEQ ID NO: 53663 - protein, 211 aa, Erwinia carotovora subsp. atroseptica SCRI1043
MTQQYNYHMTRFIISAPDIRHLETDNGIEVAFAGRSNAGKSSALNTLTNQKSLARTSKTPGRTQLINLFQVAEGVRLVDLPGYGYAEVPEQMKIKWQRALGEYLQKRNSLKGLVVLMDIRHPLKDLDQQMILWAVDVKLPVLVLLTKADKLASGARKAQLNMVREAVLPFMGDIQVEAFSSLKKIGVDKLQQKLDNWFSTLQHIEEEQDAE

SEQ ID NO: 53664 - protein, 387 aa, Dechloromonas aromatica RCB
MELNSMTVTLRTLTANDSEALEQVRQYFRNYAAWLGVDLSYQNFDQEMASLPGTYVAPQGRLFFAEVDGRPAGCVGVRPLPDSDGVCEMKRLYVDPAERGHGIGAALALAAIKAAKEIGFRKLMIDTLPNMRMAVKLYRELGFTEAPNYYQTPVEGTMFLALDLENWSEEEIRSENLSHLFDFNRAWARQMQEVDPTYFDRLSHLQTPEFLWIGCSDSRVPANQIVGLLPGEVFVHRNVANVVVHTDLNCLSVIQYAVDVLKVKHIMVVGHYGCGGVGAALQRDRVGIVDLWLRHVHDVHNKHLANVNSLPEAQRHDRLCELNVLEQVVNVCHNPVVQDAWSRGQQLTVHGWVYGLKDGLIHDLGITIDCPQDLPSRYDAALKALDA

SEQ ID NO: 53665 - protein, 286 aa, Kineococcus radiotolerans SRS30216
MCHIVPSGRVPTPSPARQELTVDVTGSTALITGASGGIGAGIARALAARGADLVLVARSADKLEALAADLRARHGRDVLVVPLDLSTPGAGARVQEALSGRTVDVLVNNAGFGVTGRLAETEDPDRLSAMITLNCTTLTDLTARFLPAMVQRRRGAVVNIASMAAYLPAPGFAAYAATKAFVLSLSQALWAETRGTGVRVAALSPTVTDTGFFDVAGENASGGMRRRSVDQVVATFLDTLDGDRPVVVDGRRNEVLAAAAHLVPRGPLLRLVGPRFADRVATAPAG

SEQ ID NO: 53666 - protein, 393 aa, Nocardioides sp. JS614
MKAVTWQGRKDIRVEEVPDPRIEEPTDAIIRVTTTGLCGSDLHLYDPLTPFMTPGDIVGHEPMGVVEAVGSEVTELAVGDRVVVPFNISCGSCWMCERGLHSQCETTQNRDTGTGASLFGYSSLYGAVPGGQAELLRVPFADFLPVQVPHGPPDDRFIYLSDVLPTAWQGIAYAGVPEGGTLLVLGAGPIGDMATRIALHRGIRVIVVDRVPERLARVSARGAEILDLGEIDDVAEQVRGLTGGRGADSVLEAVGMEAHGSPVAEAVQKSLRLLPKKLQQLMMTNLSVERLAALYLAFEAVRRGGTVSISGVYGGTSDPMPMMQLFDKQLQLRMGQANVRAWTDELRTLLEQDEDHLDVEGFATHHLPLDAAPQAYASFQAKDDGMVKVLFRP

SEQ ID NO: 53667 - protein, 454 aa, Haemophilus influenzae R2846
MTMITPVQAILASNQHFLDRQDVMESNVRSYPRKLPFAYAKAQGCWVTDVEGNEYLDFLAGAGTLALGHNHPILMQAIKDVLDSGLPLHTLDLTTPLKDAFSEELLSFFPKDKYILQFTGPSGADANEAAIKLAKTYTGRGNIIAFSGGFHGMTQGALALTGNLGAKNAVENLMPGVQFMPYPHEYRCPFGIGGEAGAKAVEQYFENFIEDVESGVVKPAAVILEAIQGEGGVVSAPISFLQKVREVTQKHGILMIVDEVQAGFCRSGKMFAFEHAGIEPDIIVMSKAVGGSLPLAVLAIRKEFDAWQPAGHTGTFRGNQLAMATGYASLKIMRDENLAQNAQERGEYLTNALRELSKEYPCIGNVRGRGLMMGIDIVDERQSKDATGAYPRDCELAAAIQKACFKNKLLLERGGRGGNVVRVLCAVNINQNECEEFIKRFKQSVVDALKVVRS

SEQ ID NO: 53668 - protein, 221 aa, Larix himalaica
KAAGARIIVTQAAYVEKLADLQSDDVIIITIDGAPKEGCQHISVLIEADETQCPSVEIHPDDVVALPYSSGTTGLPKGVMLTHKSQVSSVAQQADGENPNLYFHSEDVILCVLPLFHIYSLNSILFRALRAGAAILIMQRFNLTTLLELIQRYKVTVAPFVPPIVLDITKNPIVSQYDVSSVRIIISGSAPLGKELEDALRERFPKAIFGQGYGMTEAGPV

SEQ ID NO: 53669 - protein, 221 aa, Larix himalaica
KAAGARIIVTQAAYVDKLADLQSDDMIVIAIDGAPKEGCQHISILTEADETQCPSVEIHPEDVVALPYSSGTTGLPKGVMLTHKSLVSSVAQQVDGENPNLYFHSEDVILCVLPLFHIYSLNSVLLCALRAGAATLIMQKFNLTTLLELIQRYKVTVAPIVPPIVLEISKNPIVSQYDVSSVRIIMSGAAPLGKELEDALRERFPKAIFGQGYGMTEAGPV

SEQ ID NO: 53670 - protein, 336 aa, Zea mays
  misc_feature (277)..(277): Xaa can be any naturally occurring amino acid
MAPLGDGGAAAAAASNNLVVSFGEMLIDFVPDVAGLSLAESGGFVKAPGGAPANVACAIAKLGGSSAFVGKFGDDEFGHMLVNILKQNNVNSEGCLFDKHARTALAFVTLKHDGEREFMFYRNPSADMLLTEAELDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVSGFKVDTVDTTGAGDAFXVGSLLVNVAKDDSIFHNEEKLREALKFSNACGAICTTKKGAIPALPTVATAQDLIAKAN

SEQ ID NO: 53671 - protein, 221 aa, Larix mastersiana
KAAGARIIVTQAAYVDKLADLQSDDMIVIAIDGAPKEGCQHISILTEADETQCPSVEIHPDDVVALPYSSGTTGLPKGVMLTHKSLVSSVAQQVDGENPNLYFHSEDVILCVLPPFHIYSLNSVLLCALRAGAATLIMQKFNLTTLLELIQRYKVTVAPIVPPIVLEISKNPIVSQYDVSSVRIIMSGAAPLGKELGDALRERFPKAIFGQGYGMTEAGPV

SEQ ID NO: 53672 - protein, 422 aa, Clostridium tetani E88
MNNLEIFKESEKYMPGGVNSPVRAFSNASINPPIIKKGLGSRIVDEEGKEYIDFVASWGPMILGHNDPEVVEAIQNTVEDAISFGAPTELELKLAKHMVETLDNIDMVRMVNSGTEATMSAIKLARGYTRRDRIIKFAGCYHGHFDGFLVEAGSGVLTERIPGSPGVPKGSIENTLIAEYNHIDTVEALFEKYPEEIAAIIIEPIAGNMGTIPAKTEFLQRLREICTKYGALLIFDEVMTGFRVAYKGAQSRYGVKPDLTTYAKIMGGGLPSGAYGGRRDIMEKLSPIGPVYQAGTMSGNPVVMAAGYTTLRKLYNNPSYYEHMEKIGAELQKGIEIVAKEKGLPVVVNRCGAMLTPFFSKRDKVADYEDAKSSDTELYGRFFEHMIKSGIYIAPSQFEAMFIGVKHDIYEVERFLEAMRKF

SEQ ID NO: 53673 - protein, 552 aa, Nostoc punctiforme PCC 73102
MAKPIEFNLFAPYNKGAALIGSFSDWQEIPMEKGNDGYFRTSVELKDGVYKYKFRVQSNSWFFEPEQWVDVTDPYATDIDELSGKDDSVIHVKDCERITDTYVWQNDDKPLPADHELVIYELHVGDFSGGEDDPYARGKYKHVIEKLDYLSELGINAIELMPLKEYPGDYSWGYNPRHFFATESSYGSTAELKKLIDECHGRGIRVIIDGIYNHSEASAPLTQIDHDYWYHHEPRDPDNNWGPEFNYEHYDEKLEIHPARKFIGETIRFWIQEYHLDGIRYDAARQIANYDFMHWIVQEAKNTAGAKPFYNVAEHIPETTSITNVDGPMDGCWHDSFYHCILEHICGDTFDLERLKDVIDCKRQGFLGATNVVNYLTNHDHNHIMVELGNREIFDEEAFRRAKLGVAILMTAVGVPLIWMGEEFGEYKPKQPESSKIDWTLLGNDLNRSLFESYKGLTNLRKSNHALYTENIDFIHENPEAKVLAYTRWNDEGSRVVVIANFSENFLAGYHVPNFPSAGTWHEWTGNYDVESGDDGIITDLGPYEAKVFVWQ

SEQ ID NO: 53674 - protein, 737 aa, Arabidopsis thaliana
MNAKDVISRLPDEVLGRILSLISTKEAVSTSVLSKRWKNMFVLVSNLDIDDRQSVPKTKQNRIEIHRNYMAFVDKLLDTQRGSSIKKLTLKSHVGVRGGTDSSRIQSWICNVLDHGVMDLDVFITLKGKSPPVPAMIFKSKTLVKLRVGRGFTIKLSQDVSLPLLRTLCLDSVNFVGGHNVVGTLISRCPVLEELVVEERRCVDWTCSVSSPSLKRLHIRFDRKFTSISLDAPNLIYYKHSGYVLGKYPNVKLDSLIEARLNLRMDETRMVGVRNGSLGSIPADMRNLINGIRNVRILHLSSHTLELLYFSCKEMPLFDSLVSLSIGNDKARGWQMLPLLIKNSPNLETLIFMGLDHYITNRCGDVCVCYDTDESITSCLSSSQVKVLEILSYQGTTRELNQMKHFLEKLPCLELVKICVVNNSNNLQTTMEMRNLMMLPRASSKYRERERPFQQLPNYLLLRCFETLVTSRERESKQTHTKDRSELRTTMQKQEFLELYEAALRAAKSVKGVKNSSKVSRFVDARNRLKDAPTSLACEVVSKTSMGKGLSFLNDHKNPHIRSEGRLLRDLWMKILYASGREKSHDRETQVKIPTHSTMKKTGDSKRDKVREILQTSLVKVASEIVDTEMKTRVTACDPSVVAVSVESAMFEKLGCFMGPHKAKYRSILFNMGDSNNPDLRRKVLIGEINGERLVTMERQEMGSEKIQKEVQRIKENARFKEESRMKILQSASMIMT

SEQ ID NO: 53675 - protein, 221 aa, Larix mastersiana
KAAGARIIVTQAAYVDKLADLQSDDMIVIAIDGAPKEGCQHISILTEADETPCPSVEIHPDDVVALPYSSGTTGLPKGVMLTHKSLVSSVAQQVDGENPNLYFHSEDVILCVLPLFHIYSLNSVLLCALRAGAATLIMQKFNLTTLLELIQRYKVTVAPIVPPIVLEISKNPIVSQYDVSSVRIIMSGAAPLGKELEDALRERFPKAIFGQGYGMTEAGPV

SEQ ID NO: 53676 - protein, 716 aa, Erwinia carotovora subsp. atroseptica SCRI1043
MKKITSVCPYCGAGCKLKLVVEDNKIIRAEAADGVTNQNELCLKGYYGWDFLNDTQLLTPRLTQPMIRYEKGGRLTPVSWDEAIRYTAQRFSEIKAKYGPRSIMTTGSSRGTGNETNYVMQKFARAVLNTNNVDCCARVCHGPSVAGLQEVLGNGAMSNSISDIENSKCLLIFGYNSADSHPIVARRVVKAHQNGAKIIVCDPRRIEAARIADQHLQLNNGSNMALVNAFGYVLLEEKLYNQHYVDRFTEGLDTYREIVKDYAPEAVEHLTGVPAADVRQAMRTFAAAPSATIMWGMGVTQFGQAVDVVRGLAGLALLTGNLGRENVGVGPIRGQNNVQGACDMGVLPNMFPGYQSVTDPDVRAKFADAWGISPAVMDENIGTRITEVPHMALEGKIKAYYIMGEDPLQTEADLSLVRRGVEALDFLVVQDIFMTKTAEVADVLLPATSWGEHGGVFTCADRGFQRFEKAIEPKGNVKRDWEIISLIASEMGYPMHYADNQQIWDEMRSLCSLFYGVTYEKMGDMGHIQWPCPTLDHPGTPYLYQDSHFDTPTGKGKLFATQWRAPAEVPDEAYPLVLCTVREVGHYSCRSMTGNCAALQALADEPGRVQMHPQDANRLGIKDRSLVWVSSRRGKVISRADISERINKGTIYMTYQWWIGACNELTQDNLDPISKTPETKYCAAKVDVIEDQRWAEDFASTSYNDMKARLRAAVAH

SEQ ID NO: 53677 - protein, 227 aa, Arabidopsis thaliana
ILVDWLVEVSEEYTLASDTLYLTVYLIDWFLHGNYVQRQQLQLLGITCMLIASKYEEISAPRIEEFCFITDNTYTEDQVLEMENQVLKHFSFQIYTPTPKTSLRRFLRAAQASRLSPSLGVEFLASYLTELALIDCHFLKFLPSVVAASAVFLAKWTMDQSTHPWNPTLDHYTTYKPSDLKASVHALQDLQLNTKGCPLSAIRMKYRQEKYKSVAVLTSPKLLDTLF

SEQ ID NO: 53678 - protein, 110 aa, Glycine max
MGMIVDFENDQNDAVLVPPPNFAMVEDCVFRSSFPTPSNFPFLQTLNLRSIIYLCPEPYPEENLEFLRSQNIRLFQFGIEGKTDVSMPVLKDSIMDALQVFNILRVCVCV

SEQ ID NO: 53679 - protein, 142 aa, Aquifex aeolicus VF5
MAVERTLIIVKPDAMEKGALGKILDRFIQEGFQIKALKMFRFTPEKAGEFYYVHRERPFFQELVEFMSSGPVVAAVLEGEDAIKRVREIIGPTDSEEARKVAPNSIRAQFGTDKGKNAIHASDSPESAQYEICFIFSGLEIV

SEQ ID NO: 53680 - protein, 469 aa, Erwinia carotovora subsp. atroseptica SCRI1043
MSAEHVLTMLNEHEVKFVDLRFTDTKGKEQHVTIPAHQVNADFFEEGKMFDGSSIGGWKGINESDMVLMPDASTAMIDPFFEDTTLIIRCDILEPGTMQGYDRDPRSIAKRAEDFLRSSGIADTVLFGPEPEFFLFDDIRFGSSTSGSHVAIDDVEAYWNSGKAYEGGNKGHRPGLKGGYFPVPPVDSSQDIRSAMCLTMEQMGLVVEAHHHEVATAGQNEVATRFNTMTKKADEIQIYKYVVHNVAHAYGKTATFMPKPMFGDNGSGMHCHMSLSKDGTNLFAGDKYGGLSEMALFYIGGVIKHAKAINALANPTTNSYKRLVPGYEAPVMLAYSARNRSASIRIPVVASPKARRIEARFPDPAANPYLCFAALLMAGLDGIINKIHPGDAMDKNLYDLPPEEEAEIPKVAGSLDEALAALNEDREFLTRGGVFTDDAIEAYIELRKPEIDRVRMTPHPVEFELYYSV

SEQ ID NO: 53681 - protein, 793 aa, Clostridium perfringens str. 13
MKVPFNWLKDYVDIDMTAEELGDALTLSGSKVEEVVTAGAEIENIVTCQIDKIEQHPDAEKLKICQVNIGSEMIQIVTAADNMKEHDKVPVALHGAILADGSKIKKGKLRGEVSNGMFCSEEELGIADGKEVIGLMILPEDAPIGVCIKEYLGLNKQVLDFEITSNRPDCLSVLGMARETAATTRKTYRMPNTKFEVKCDKNINDEIKVTVNDKLCNRYMARGVKNVKVAPSPTWMQERLLDAGVRPINNIVDITNFVMLELGQPMHAFDRRELKSSNIVVERAKDGDKFVTLDEIERELNSDVLCIKDGEEIVALAGIMGGLNSGVKDDTTEIVFESANFDGTNIRVNSKNLGLRTESSSRFEKDIDPNLAALALDRACALVEELGCGEIMEGTIDVYNNVKEEKTLEVSVSWINKFLGTSLEAEEMKKCLDSLDLKTTINGDTLEILVPTFRIDVDIREDVAEEVARIYGYNNIPATLISTSTEKEAKDKKQLLDEKVIDTMLASGLNQSISYSFVSPKVFDKICVPEDSSLRNVVKIKNPLGEDYSVMRTSTLPSMMESLARNYSRSNEIVRLFEIGKTYIPNSDENELPTERNILTIGIYGQCDYFDLKGIVENLLDSLGLKSASFKRMSENPSYHPGKTAELILGRTSLGVLGEIHPDVNENYGVDVPCYVAELDLDAMYNFSKTEKYYKPLPKYPAITRDIALLVDDAVLVQEIEDAIRKAGGQVVEKVELFDVYKGAQIPEGKKSIAYAIAYRDPSKTLKDKDINKVHDKILRALEYKLGAQLREQ

SEQ ID NO: 53682 - protein, 270 aa, Arabidopsis thaliana
MTSLKAVRCQTVRIQPRNSFHRLDRYALGYDKNRNHKILRFVDDHLAVGEHVFGYEIYDFSSSSWRVLDVTPDWDIQFYQRGVSLNGNTYFFAQEKITEDGEYEEFEDFLLYFDFSTERFEPRLPLPFHFYVLETVSLSSVRDEQLAVLYQRLDSYEILDIWLTTKIEPSAVSWSMFLKLDMRPLTGFQFMVDGGSFFIDEEKKVAVVFDLTKHKQTVTRRYQTAYIIGQDGYFKPVSLGEAPYLGDPHELYCLPLVCPSYAPSLVQLYN

SEQ ID NO: 53683 - protein, 621 aa, Listeria monocytogenes EGD-e
MCGFVGCVHDRITEITGADKETFRQMNSMITHRGPDDEGYFTDDHVQFGFRRLSIIDVENGHQPLTYENERYWIIFNGEVYNYVELREQLVAEGMTFETESDTEVIIATYAKYKEKTAERLRGMFGFVIWDKQEELVYGARDPFGIKPFFYAEEDDKLFMGSEKKSILHALKEKELDEVSLQNYMTYQFVPEPDSLTKNVKRLEPGHQFTKKIGQPMEITTYWKASFAPVTKSEDAWIKEVRDVMYDSVKMHMRSDVPVGSFLSGGIDSSIIAAIAKEYHPAIKTFSVGFERDGFSEIDVAKETADKLGVENISYVISPEEYMKELPKIVWHMDDPLADPAAIPLYFLSREARKQVTVALSGEGADELFGGYNIYNEPNSLAMFNKMPGVFKSMLNNLARIMPEGMRGKSFLERGTTPMEERYIGNAKMFTEKEKQILLPKYQAGHDYTNITDPFYAETTNYHPVERMQYIDIHTWLRGDILLKADRMTMANSLEVRVPFLDKEVYNVARNIPDTMKTTNGTTKYILRKAAATFVPEHVLNRRKLGFPVPIRHWLKDEMNAWVKNIIKESPTDHLINKQYVLDLLDDHCAGKFDYSRKIWTVVIFMIWYDVYVADKYDFGK

SEQ ID NO: 53684 - protein, 182 aa, Pseudomonas putida KT2440
MHSDAFDLKALIRPVVDFPKPGVIFRDITPLFQSPRGLRYVADQFIERYVEAEFSHIGAMDARGFLIGSIIAHQLNKPLILFRKQGKLPADVLSEGYQTEYGEAFLEVHADSLCEGDSVLIFDDLIATGGTLLAAANLVRRTGAQVFEAAAIIDLPELDGSRRLQAAGVPTFCLTEFSLSEY

SEQ ID NO: 53685 - protein, 79 aa, Brassica napus
  misc_feature (10)..(12): Xaa can be any naturally occurring amino acid
  misc_feature (16)..(16): Xaa can be any naturally occurring amino acid
  misc_feature (18)..(18): Xaa can be any naturally occurring amino acid
  misc_feature (27)..(27): Xaa can be any naturally occurring amino acid
  misc_feature (48)..(48): Xaa can be any naturally occurring amino acid
  misc_feature (50)..(51): Xaa can be any naturally occurring amino acid
  misc_feature (58)..(58): Xaa can be any naturally occurring amino acid
  misc_feature (60)..(60): Xaa can be any naturally occurring amino acid
  misc_feature (63)..(63): Xaa can be any naturally occurring amino acid
MAYSMLSSAXXXTSPXQXTMDAPFTGXLKPSSAFPVTRKVNNDITSIXSXXGRVSCMXVXPPXGKNKFETLSYLPDLTE

SEQ ID NO: 53686 - protein, 648 aa, Oryza sativa (indica cultivar-group)
MGRHGGVPVEAGGVEAKLLGRWLAATSLDNIGELWNVDLEAQEQQGVAVSNQGCVGVFGSFCSLRKASSIVKHVAATGCLPEYSSEAPARYFSSESSLQVDSTEENGFKGHGMLAPFTAGWQSTDLHPLVIDRSEGSYVYDINGKKYIDALAGLWSTALGGNEPRLIKAATDQLNKLPFYHSFWNRTTKPSLDLANEILSMFTAREMGKIFFTNSGSEANDSQVKLVWYYNNALGRPNKKKFIARSKSYHGSTLVSASLSGLPALHQKFDLPAPFVLHTDCPHYWRFHLPDETEEEFATRLATNLENLILKEGPETIAAFIAEPVMGAGGVIPPPKTYFEKIQAVLKKYDILLIADEVITAFGRLGTMFGCDMYDIKPDLVSIAKALSSAYMPIGAILVSPEITDVIYSQSNKLGSFAHGFTYSGHPVSCAVAIEALKIYKERNIIEHVQKIAPRFQEGIKAFSGSPIVGEIRGLGLILGTEFVDNKSPNDPFPAEWGVGSLFGAECEKRGMLIRVAGDNIMLSPPLIMTPDEVEEIISKYGDALKATEERIAELKAKRVIDDGDDKLTMFNVYRVVSSVDANNEVLFELADFESFAGGVRWLSSSSIGGHLKHMSRRQQQQSAAQLKQHNTGEQRMHASSAGDHTVN

SEQ ID NO: 53687 - protein, 260 aa, Thermosynechococcus elongatus BP-1
MAPTLPSLLALDFDGVLCNGLREYFQTSWRVYQQVWPEPLLGISLEQLEREFGQLRPVITVGWEMPLLLRAIVAGTPAQQILQDWPKVRDRLLATYHLTAADLGARVDGLRDRWIETDWQSWLALHDFYDGVIAALQHWQAQGQALAIVTTKEQRFVTYLLEQAGLSFPSEAIYGKEQQQPKPVILQALQSTYGAPLWFVEDRLGALLQVAVTPELGQTELFLAAWGYTTAGDRAQAEAHPRIHLLSLEQFCQFPHWLPP

SEQ ID NO: 53688 - protein, 272 aa, Salmonella enterica subsp. enterica serovar Paratyphi A str.
MEIYAVFGNPIAHSKSPFIHQQFAQQLDIVHPYGRVLAPINNFINTLDAFFAAGGKGANITVPFKEEAFARSDELTERASLAGAVNTLKRLEDGRLLGDNTDGIGLLSDLERLNFIRPGLRILLIGAGGASRGVLLPLLSLDCAVTITNRTASRAEALAKIFAHTGSVHATDMDKLDGCEFDLIINATSSGIRGEIPAIPASLIHPSLCCYDMFYQKGNTPFLSWCVQQGAKRYADGLGMLVGQAAHAVLLWHGVLPQVEPVIELLQQELLA

SEQ ID NO: 53689 - protein, 429 aa, Erwinia carotovora subsp. atroseptica SCRI1043
MTRRAIGVSERPPLLQTIPLSFQHLFAMFGATVLVPILFKINPATVLLFNGVGTLLYLFICKGKIPAYLGSSFAFISPVLLLLPLGYEVALGGFIMCGVLFCLVALIVQKAGTGWLNVLFPPAAMGAIVAVIGLELAGVAAGMAGLLPADGASVDSTAVTISLATLAITILGSVLFRGFLAIIPILIGVLAGYVLSFALGVVDLTPIREAHWFAMPTFYTPRFEWFAILAILPAALVVIAEHVGHLVVTANIVKKDLMRDPGLHRSLFANGISTVLSGFFGSTPNTTYGENIGVLAITKVYSTWVIGGAAILAILLSCVGKLAAAIQAVPVPVMGGVSLLLYGVIGASGIRVLIESKVDYNKAQNLILTSVILIIGVSGAKVHLGSTELKGMALATVVGIGMSLVFKVISLFRKEEEILDAPEENDARS

SEQ ID NO: 53690 - protein, 294 aa, Rhodopseudomonas palustris CGA009
MDPTTMPAPAPINYSQTWTFFEGEWHDGNVPIMGPRTHAAWLGSMVFDGARAFEGVTPDLDQHLARINWSATNFKLNALVDKATWLGLVQDGLKRFAGNAELYIRPMYWAQNGVGGGVLFDPDTTNWCLCIYEAPMPKPTGLSITLSPFRRPTAECAPVEAKAGCLYPNNSRAMMEAKSRGFDNCLLRDMLGHIAELGNSNIFMAKDGVVYTPAANGTFLSGITRQRVIELLRGDGITVLETSLSYRDFETADEIFASGNFAKVQPIIRIDDRSLQPGPFYAKARKLYWEFAHG

SEQ ID NO: 53691 - protein, 425 aa, Wolbachia endosymbiont strain TRS of Brugia malayi
MTKRIINNVFAREILDSRGYPTVEVEIELCDGATGRASVPSGASTGKLEALELRDQDEKRYCGKGVLKAVKAVNGVIANAIIGMDAADQSTIDKALIELDGTRNKSKLGANATLGVSLASAKAAANSFKMPLYRYLGGEQANVMPFPLINIINGGVHADNKLDFQEFMILPIGAEAFSEAIRMSAEVFHNLRSILRKRGYSTNVGDEGGFAPNIESTEEALDLIVHAIESASYSTQNHFALGLDVASSTFYKNKIYKFANKELTSEELVEYYYNLVEKYPITSMEDAMSEDDYEGWKLLTAKLGSKVQLVGDDLFVTNCELIRKGIEEKMANAVLIKPNQIGTLTETFTAIGMTKSGGYKAVISHRSGETEDTTISHIAIASNCGQIKTGSLSRSDRLAKYNELIRIEGTLERNAKYYYGLAWTS

SEQ ID NO: 53692 - protein, 449 aa, Pseudomonas syringae pv. tomato str. DC3000
MFGFFRPARHQAPLPEEKVDSTYRRLRWQIFAGIFIGYAGYYLLRKNFSLAMPYLIDEGYTRGQLGVAMSAIAIAYGLSKFLMGIISDRSNPRYFLPFGLLVSAGIMFIFGFAPWATSSVTIMFVLLFINGWAQGMGWPPSGRTMVHWWSQKERGGVVSVWNVAHNVGGGLIGPLFLLGMGWTNDWHAAFYVPAAVALLVAVFAFATMRDTPQSVGLPPIEHYKNDYPEGYDESHEEEFSAREIFVKYVLRNKFLWYIAMANVFVYLLRYGVLDWAPTYLKEAKHFTVDKTSWAYFLYEWAGIPGTLLCGWMSDKIFKGNRGLTGMVFMFLVTIATLVYWLNPEGNPTVDMIALVSIGFLIYGPVMLIGLQALELAPKKAAGTAAGFTGLFGYLGGSVAASAAMGYTVDHFGWDGGFVLLIGACILAMVFLAPTLRHKQVASTSRDIKR

SEQ ID NO: 53693 - protein, 429 aa, Salmonella enterica subsp. enterica serovar Paratyphi A str.
MKKQNNLRSLAAQAVEQVVEQGQSLSNVLPPLQQKVADKDKALLQELCFGVLRTLSQLEWLINKLMSRPMTGKQRTVHYLIMVGFYQLLYTRVPPHAALAETVEGAVSIKRPQLKGLINGVLRQFQRQQETLLNEFATSDARFLHPGWLVKRLQNAYPTQWQRIIEANNQRPPMWLRVNRTHHTRDGWLGLLEDAGMKGYPHPDYPDAVRLETPAPVHALPGFAEGWVTVQDASAQGCAVFLAPQNGEHILDLCAAPGGKTTHILEVAPEADVLAVDIDEQRLSRVYDNLKRLGMKATVKQGDGRYPAQWCGEQQFDRILLDAPCSATGVIRRHPDIKWLRRDRDIAELAQLQAEILDTVWPRLKPGGTLVYATCSVLPEENRDQIKTFLQRTPDAALSETGTPDQPGQQNLPGGEEGDGFFYAKLIKK

SEQ ID NO: 53694 - protein, 197 aa, Francisella tularensis subsp. tularensis SCHU S4
MNYSKAKYIMGAAKVSQLPEDTGVEVAFAGRSNAGKSSALNTLTDQKGLARVSKTPGRTQLINLFDLGNNNRLVDLPGYGYAKVSESIKRQWQSEMENYLTSRKCLNGIVLLVDLRHELKEFDSLMIEMAISFDLNLHILLTKADKLNNKERAQANRMIESFLKTFVSTDKISYQLFSSLTKMGLDKFKEKLDTWYQ

SEQ ID NO: 53695 - protein, 253 aa, Triticum aestivum
MASLSSMQMVHTSQIGVKSQLVSSANRTSPSVSSGSALSSRLHYAASFPLKKQFSGAYATIKNQRTACVKSMAAEEEEVIEPQAKVTNKVYFDVEIGGEVAGRIVMGLFGDVVPKTVENFRVLCTGEKKYGYKGSSFHRIIKDFMIQGGDFTEGNGTGGISIYGAKFEDENFTLKHTGPGILSMANAGPNTNGSQFFICTVKTPWLDNKHVVFGQVIEGMKLVRTLESQETRAFDVPKKGCRIYACGELPLDA

SEQ ID NO: 53696 - protein, 399 aa, Pyrococcus abyssi GE5
MNIMSGDEVQFHENYDDYITYLKRRIRQLELQVRMLEADKERLERELSRLRSEMSRLRQPPAFAGTVIEVLDDDRAIVQNYNGPRFVVRIAPWIERDKLRPGARVALDQRTMAIIELLPSSKDPTVLGFEVIERPNVTYNDIGGLKKQLQELREAIELPLKHPELFEEVGIDPPKGVLLYGPPGCGKTLMAKALAHEVNATFIRVVGSELVRKYIGEGARLVHELFELAKEKAPTIIFIDEIDAIGAKRMDETTGGEREVNRTLMQLLAEMDGFDPRGNVKVIAATNRPDILDPALLRPGRFDRLIEVPLPDFEGRLEILKVHTRRMKLKNVDLRVIAEITEGASGADLKAIATEAGMFAIRERRTYVTQEDFLKAVDKVLGNERKLLQQITSHEIIYG

SEQ ID NO: 53697 - protein, 201 aa, Sinorhizobium meliloti
MSEALNELASYLREGRGALIADAEVKYGELTVTAKAENLIALLTFLRDDVQCGFVSFIDVCGVDYPQRPDRFDVVYHLLSPRQNQRVRVKVATRENDPVPSATSVFPGADWFEREAYDMYGILFTGHPDLRRILTDYGFEGYPLRKDFPLTGFVEVRYDNEAKRVVYEPVELKQEFRNFDFLSPWEGTEYVLPGDEKARPR

SEQ ID NO: 53698 - protein, 116 aa, Yersinia pestis CO92
MTTIDKIQRQITENPILLYMKGSPKLPNCGFSAQAVQALSACGERFAYVDILQNPDIRAELPKYANWPTFPQLWVDGELVGGCDILMEMYQRGELQTLLKETADKYRSQEDQPAAE
